US007553954B2

(12) United States Patent
Andersen et al.

(10) Patent No.: US 7,553,954 B2
(45) Date of Patent: Jun. 30, 2009

(54) NUCLEIC ACID MOLECULES AND OTHER MOLECULES ASSOCIATED WITH PLANTS

(75) Inventors: Scott E. Andersen, St. Louis, MO (US); James D. Masucci, Ballwin, MO (US)

(73) Assignee: Monsanto Technology LLC, St. Louis, MO (US)

( * ) Notice: Subject to any disclaimer, the term of this patent is extended or adjusted under 35 U.S.C. 154(b) by 347 days.

(21) Appl. No.: 11/352,295

(22) Filed: Feb. 13, 2006

(65) Prior Publication Data

US 2008/0120751 A1 May 22, 2008

Related U.S. Application Data

(63) Continuation of application No. 09/667,188, filed on Sep. 21, 2000.

(60) Provisional application No. 60/155,006, filed on Sep. 22, 1999.

(51) Int. Cl.
C07H 21/04 (2006.01)
C12N 15/05 (2006.01)
C12N 15/82 (2006.01)
A01H 5/00 (2006.01)

(52) U.S. Cl. .................. 536/23.6; 800/278; 800/295; 800/298; 800/314

(58) Field of Classification Search .................. None
See application file for complete search history.

(56) References Cited

U.S. PATENT DOCUMENTS

| 4,784,949 A | 11/1988 | Gelfand et al. |
| 4,956,282 A | 9/1990 | Goodman et al. |
| 5,011,912 A | 4/1991 | Hopp et al. |
| 6,093,545 A | 7/2000 | Goodearl et al. |

FOREIGN PATENT DOCUMENTS

WO WO 00/18922 4/2000

OTHER PUBLICATIONS

Result 5 Genembl—Adachi et al. Collection, mapping and annotation of over 28,000 cDNA clones form japonica rice. Science 301 (5631) 376-379 (Jun. 2003).*
U.S. Appl. No. 09/815,254, filed Mar. 23, 2001, Boukharov et al.
U.S. Appl. No. 10/425,114, filed Mar. 28, 2003, Liu et al.
U.S. Appl. No. 11/329,175, filed Jan. 11, 2006, CaJacob et al.
U.S. Appl. No. 11/329,160, filed Jan. 11, 2006, Bhat et al.
U.S. Appl. No. 11/329,388, filed Jan. 11, 2006, Andersen et al.
U.S. Appl. No. 11/330,082, filed Jan. 12, 2006, Buehler et al.
U.S. Appl. No. 11/330,083, filed Jan. 12, 2006, Byrum et al.
U.S. Appl. No. 11/330,364, filed Jan. 12, 2006, Abad et al.
U.S. Appl. No. 11/331,019, filed Jan. 13, 2006, Fincher et al.
U.S. Appl. No. 11/331,032, filed Jan. 13, 2006, Fincher et al.
U.S. Appl. No. 11/353,150, filed Feb. 14, 2006, Andersen et al.
U.S. Appl. No. 11/486,299, filed Jul. 14, 2006, Byrum.
U.S. Appl. No. 11/490,207, filed Jul. 21, 2006, Brown et al.
U.S. Appl. No. 11/491,125, filed Jul. 24, 2006, Boukharov et al.
U.S. Appl. No. 11/491,178, filed Jul. 24, 2006, Hinkle et al.
U.S. Appl. No. 11/491,371, filed Jul. 24, 2006, Byrum.
U.S. Appl. No. 11/497,489, filed Aug. 2, 2006, Byrum et al.
U.S. Appl. No. 11/503,243, filed Aug. 14, 2006, Kovalic et al.
U.S. Appl. No. 11/520,715, filed Sep. 14, 2006, Liu et al.
U.S. Appl. No. 11/521,349, filed Sep. 15, 2006, Byrum et al.
U.S. Appl. No. 11/595,983, filed Nov. 13, 2006, Boukharov et al.
AA501409, EST Database (Aug. 19, 1997).
Aach et al., "*ent*-Kaurene Biosynthesis in a Cell-Free System From Wheat (*Triticum aestivum* L.) Seedlings and the Localisation of *ent*-Kaurene Synthetase in Plastids of Three Species", *Planta* 197(2), 333-342 (1995).
Adams et al., "Complementary DNA Sequencing: Expressed Sequence Tags and Human Genome Project", *Science* 252(5013), 1651-1656 (1991).
Ait-Ali et al., "The *LS* Locus of Pea Encodes the Gibberellin Biosynthesis Enzyme *ent*-Kaurene Synthase A", *Plant J.* 11(3), 443-454 (1997).
Anaviev et al., "Oat-Maize Chromosome Addition Lines: A New System for Mapping the Maize Genome", *Proc. Natl. Acad. Sci. USA* 94, 3524-3529 (1997).
Anton et al., "Sequencing and Overexpression of the *Escherichia coli aroE* Gene Encoding Shikimate Dehydrogenase", *Biochem. J.* 249, 319-326 (1988).
Attwood, "The Babel of Bioinoformatics", *Science* 290(5491), 471-473 (2000).
Bensen et al., "Cloning and Characterization of the Maize An1 Gene", *Plant Cell* 7, 75-84.
Bentley, "The Shikimate Pathway—A Metabolic Tree with Many Branches," *Critical Rev. Biochem. Mol. Biol.* 25(5), 307-384 (1990).
Birkenbihl et al., "Cosmid-Derived Map of *E.coli* Strain BHE2600 in Comparison to the Map of Strain W3110", *Nucleic Acids Res.* 17(13), 5057-5069 (1989).
Bishop et al., "The Tomato *Dwarf* Gene Isolated by Heterologous Transposon Tagging Encodes the First Member of a New Cytochrome P450 Family", *Plant Cell* 8, 959-969 (1996).
Bonner et al., "Cloning of cDNA Encoding the Bifunctional Dehydroquinase-Shikimate Dehydrogenase of Aromatic-Amino-Acid Biosynthesis in *Nicotiana tabacum*", *Biochem J.* 362, 11-14 (1994).

(Continued)

*Primary Examiner*—Wendy C. Haas
(74) *Attorney, Agent, or Firm*—Lawrence M. Lavin, Jr.; Matthew L. Madsen; Arnold & Porter LLP

(57) ABSTRACT

Expressed Sequence Tags (ESTs) isolated from wheat are disclosed. The ESTs provide a unique molecular tool for the targeting and isolation of novel genes for plant protection and improvement. The disclosed ESTs have utility in the development of new strategies for understanding critical plant developmental and metabolic pathways. The disclosed ESTs have particular utility in isolating genes and promoters, identifying and mapping the genes involved in developmental and metabolic pathways, and determining gene function. Sequence homology analyses using the ESTs provided in the present invention, will result in more efficient gene screening for desirable agronomic traits. An expanding database of these select pieces of the plant genomics puzzle will quickly expand the knowledge necessary for subsequent functional validation, a key limitation in current plant biotechnology efforts.

20 Claims, No Drawings

OTHER PUBLICATIONS

Bork, "Powers and Pitfalls in Sequence Analysis: The 70% Hurdle", *Genome Res.*, 10, 398-400 (2000).
Bougri et al., "Members of a Low-Copy Number Gene Family Encoding Glutamyl-tRNA Reductase are Differentially Expressed in Barley," *Plant J.* 9(6), 867-878 (1996).
Broun et al., "Catalytic Plasticity of Fatty Acid Modification Enzymes Underlying Chemical Diversity of Plant Lipids", *Science* 282, 1315-1317 (1998).
Bukanov et al., "Ordered Cosmid Library and High-Resolution Physical-Genetic Aap of *Helicobacter pylori* Strain NCTC11638", *Mol. Microbiol.* 11(3), 509-523 (1994).
Charles et al., "Isolation, Characterization and Nucleotide Sequences of the *aroC* Genes encoding Chorismate Synthase from *Salmonella typhi* and *Escherichia coli*", *J. Gen. Microbiol.* 136, 353-358 (1990).
Chen et al., "Microcolinearity in *sh2*-Homologous Regions of the Maize, Rice, and Sorghum Genomes", *Proc. Natl. Acad. Sci. USA* 94, 3431-3435 (1997).
Coulson et al., "Toward a Physical Map of the Genome of the Nematode *Caenorhabditis elegans*", *Proc. Natl. Acad. Sci. USA* 83, 7821-7825 (1986).
Day et al., "Cloning of the cDNA for Glutamyl-tRNA Synthetase from *Arabidopsis thaliana*", *Biochim. Biophys. Acta* 1399(2-3):219-224 (1998).
Duncan et al., "The Overexpression and Complete Amino Acid Sequence of *Escherichia coli* 3-Dehydroquinase", *Biochem. J.* 238, 475-483 (1986).
Eberhard et al., "Cloning and Expression in Yeast of a Higher Plant Chorismate Mutase", *FEBS Lett.* 334(2), 233-236 (1993).
Ebert et al., "Identification of an Essential Upstream Element in the Nopaline Synthase Promoter by Stable and Transient Assays", *Proc. Natl. Acad. Sci. USA* 84(16), 5745-5749 (1987).
Efstratiadis et al., "Enzymatic in Vitro Synthesis of Globin Genes", *Cell* 7, 279-288 (1976).
Eiglmeier et al., "Use of an Ordered Cosmid Library to Deduce the Genomic Organization of *Mycobacterium leprae*", *Mol. Microbiol.* 7(2), 197-206 (1993).
Evans et al., "Immunodetection of Recombinant Proteins Based on Antibodies Directed Against a Metal Binding Peptide Engineered for Purification by Immobilized Metal Affinity Chromatography," *J. Immunol. Meth.* 156(2), 231-238 (1992) (Abstract Only).
Entrez Accession No. M21071 J03227 (Sep. 15, 1989).
Entrez Accession No. 170374 (Sep. 15, 1989).
Entrez Accession No. M27715 (Jun. 15, 1990).
Entrez Accession No. 153878 (Jun. 15, 1990).
Entrez Accession No. X59509 S55160 (Jun. 30, 1993).
Entrez Accession No. 48906 (Jun. 30, 1993).
Entrez Accession No. Y00710 (Sep. 12. 1993).
Entrez Accession No. 40978 (Sep. 12, 1993).
Entrez Accession No. Z26519 (Dec. 2, 1993).
Entrez Accession No. 429153 (Dec. 2, 1993).
Entrez Accession No. 551666 (Jan. 25, 1995).
Entrez Accession No. X81413 (Jan. 25, 1995).
Entrez Accession No. M87280 M99707 (Apr. 12, 1995).
Entrez Accession No. 551855 (Apr. 12, 1995).
Entrez Accession No. 313150 (Jun. 13, 1995).
Entrez Accession No. X73535 (Jun. 13, 1995).
Entrez Accession No. X04306 (Jul. 12, 1995).
Entrez Accession No. 40973 (Jul. 12, 1995).
Entrez Accession No. D63474 D16312 (Jul. 27, 1995).
Entrez Accession No. 474964 (Jul. 27, 1995).
Entrez Accession No. 987267 (Jul. 31, 1995).
Entrez Accession No. U32579 (Sep. 16, 1995).
Entrez Accession No. X82831 (Mar. 1, 1996).
Entrez Accession No. 1213067 (Mar. 1, 1996).
Entrez Accession No. 1220402 (Mar. 5, 1996).
Entrez Accession No. M63245 (Mar. 11, 1996).
Entrez Accession No. W49458 (May 28, 1996).
Entrez Accession No. 1421741 (Oct. 17, 1996).
Entrez Accession No. U54770 (Oct. 18, 1996).
Entrez Accession No. X86101 (Nov. 8, 1996).
Entrez Accession No. 520943 (Feb. 26, 1997).
Entrez Accession No. 2160544 (Jun. 5, 1997).
Entrez Accession No. U63652 (Jun. 6, 1997).
Entrez Accession No. 2257714 (Jul. 15, 1997).
Entrez Accession No. U93215 (Jul. 15, 1997).
Entrez Accession No. 2224890 (Jul. 31, 1997).
Entrez Accession No. 2224892 (Jul. 31, 1997).
Entrez Accession No. U61385 (Aug. 1, 1997).
Entrez Accession No. U61386 (Aug. 1, 1997).
Entrez Accession No. 2316104 (Aug. 8, 1997).
Entrez Accession No. AF010169 (Aug. 9, 1997).
Entrez Accession No. 1524045 (Aug. 20, 1997).
Entrez Accession No. X96943 (Aug. 20, 1997).
Entrez Accession No. Y12809 (Dec. 2, 1997).
Entrez Accession No. D88382 (Mar. 17, 1998).
Entrez Accession No. 3068709 (Apr. 2, 1998).
Entrez Accession No. AF058763 (Aug. 16, 1998).
Entrez Accession No. 3420233 (Apr. 20, 1998).
Entrez Accession No. AF049236 (Apr. 22, 1998).
Entrez Accession No. AF038152 (May 7, 1998).
Entrez Accession No. 2708690 (May 7, 1998).
Entrez Accession No. AC003058 (May 16, 1998).
Entrez Accession No. 3135277 (May 16, 1998).
Entrez Accession No. 3288821 (Jul. 20, 1998).
Entrez Accession No. AF063901 (Jul. 21, 1998).
Entrez Accession No. 3435196 (Sep. 21, 1998).
Entrez Accession No. AF067773 (Sep. 22, 1998).
Entrez Accession No. 3694811 (Sep. 24, 1998).
Entrez Accession No. AJ225107 (Oct. 1, 1998).
Entrez Accession No. 3093410 (Oct. 1, 1998).
Entrez Accession No. AF060481 (Oct. 4, 1998).
Entrez Accession No. 3925407 (Nov. 24, 1998).
Entrez Accession No. AF083948 (Nov. 25, 1998).
Entrez Accession No. AB015492 (Dec. 11, 1998).
Entrez Accession No. 4001680 (Dec. 11, 1998).
Entrez Accession No. AF017431 (Jan. 2, 1999).
Entrez Accession No. 3080490 (Jan. 12, 1999).
Entrez Accession No. AL022602 (Jan. 12, 1999).
Entrez Accession No. AB011416 (Feb. 5, 1999).
Entrez Accession No. AAC17095 GI:315616 (Apr. 5, 1999).
Entrez Accession No. AP000836; GI:6539551 (Aug. 12, 2000).
Entrez Accession No. AY013245 (May 7, 2002).
Fiedler et al., "The Formation of Homogentisate in the Biosynthesis of Tocopherol and Plastoquinone in Spinach Chloroplasts", *Planta* 155, 511-515 (1982).
Garbe et al., "The *Mycobacterium tuberculosis* Shikimate Pathway Genes: Evolutionary Relationship Between Biosynthetic and Catabolic 3-Dehydroquinases", *Mol. Gen. Genet.* 228, 385-392 (1991).
Gasser et al., "Structure, Expression, and Evolution of the 5-Enolpyruvylshikimate-3-Phosphate Synthase Genes of Petunia and Tomato", *J. Biol. Chem.* 263, 4280-4289 (1988).
Gaubier et al., "A Chlorophyll Synthetase Gene from *Arabidopsis thaliana*", *Mol. Gen. Genet.* 249, 58-64 (1995).
GenBank Accession No. U03774 (Jun. 22, 1994).
GenBank Accession No. L37750 (Aug. 3, 1995).
GenBank Accession No. H30177 (Aug. 16, 1995).
GenBank Accession No. W21756 (May 6, 1996).
GenBank Accession No. X80265 (Feb. 26, 1997).
GenBank Accession No. E03435 (Sep. 29, 1997).
GenBank Accession No. AF015462 (Jul. 16, 1998).
Genbank Accession No. AC005922 (Nov. 14, 1998).
GenBank Accession No. X74737 (Jan. 21, 1999).
GenBank Accession No. AU033328 (Apr. 28, 1999).
GenBank Accession No. AQ402486 (Mar. 13, 1999).
GenBank Accession No. AI861202 (Jul. 19, 1999).
GenBank Accession No. AC018632 (Dec. 15, 1999).
GenBank Accession No. AI834598 (Feb. 2, 2000).
GenBank Accession No. AZ134591 (Jun. 2, 2000).
GenBank Accession No. BE428765 (Jul. 26, 2000).
GenBank Accession No. BF542512 (Dec. 11, 2000).
GenBank Accession No. AW871780 (Dec. 11, 2001).
GenBank Accession No. BQ603510 (Jun. 24, 2002).
GenBank Accession No. DR37H4T (Nov. 22, 2002).
GenBank Accession No. BX513761 (May 27, 2003).

GenEMBL Accession No. AF096555 (Jul. 22, 1999).
GenEMBL Accession No. AL096768 (Dec. 12, 1999).
GenSeq Accession No. AAZ35275 (Mar. 27, 2000).
Gerhold et al., "It's the genes! EST access to human genome content", *BioEssays* 18(2), 973-981 (1996).
Gibson et al., "The Bacteriochlorophyll Biosynthesis Gene, bchM, of *Rhodobacter sphaeroides* Encodes S-Adenosyl-1-Methionine: Mg Protoporphyrin IX Methyltransferase", *FEBS Lett.* 352, 127-130 (1994).
Goers et al., "The Differential Allosteric Regulation of Two Chorismate-Mutase Isoenzymes of *Nicotiana silvestris*", *Planta* 162, 117-124 (1984).
Goff, "Rice as a Model for Cereal Genomics", *Curr. Opin. Plant Biol.* 2, 86-89 (1999).
Hedden et al., "Gibberellin Biosynthesis: Enzymes, Genes and Their Regulation", *Annu. Rev. Plant Physiol. Plant Mol. Biol.* 48, 431-460 (1997).
Herrmann, "The Shikimate Pathway as an Entry to Aromatic Secondary Metabolism," *Plant Physiol.* 107, 7-12 (1995).
Hong, "A Rapid and Accurate Strategy for Rice Contig Map Construction by Combination of Fingerprinting and Hybridization", *Plant Mol. Biol.* 35,129-133 (1997).
Hundle et al., "Functional Assignment of *Erwinia herbicola* Eho10 Carotenoid Genes Expressed in *Escherichia coli*", *Mol. Gen. Genet.* 245, 406-416 (1994).
Ibba, "Biochemistry and Bioinformatics: When Worlds Collide," *Trends in Biochem. Sci.* 27(2), 64 (2000).
Iyer et al., "*Quod erat demonstrandum*? The Mystery of Experimental Validation of Apparently Erroneous Computational Analysis of Protein Aequences", *Genome Biol.* 2(12), 1-11 (2001).
Johnston et al., "Cloning and Characterization of Potato cDNAs Involved in Tetrapyrrole Biosynthesis: Ferrochelatase (Accession No. AJ005802), Chloroplatic Protoporphyrinogen IX Oxidase (Accession No. AJ225107), and Mitochondrial Protoporphyrinogen IX Oxidase (Accession No. AJ225108)", *Plant Physiol.* 118, 329-331 (1998).
Keon et al., "Isolation and Heterologous Expression of a Gene Encoding 4-Hydroxyphenylpyruvate Dioxygenase from the Wheat Leaf-Spot Pathogen, *Mycosphaerella graminicola*", *FEMS Microbiol. Lett.* 161, 337-343 (1998).
Kidwell et al., "Transposable Elements as Sources of Variation in Animals and Plants", *Proc. Natl. Acad. Sci. USA* 94, 7704-7711 (1997).
Kim et al., "Construction and Characterization of a Human Bacterial Artificial Chromosome Library", *Genomics* 34, 213-218 (1996).
Knott et al., "Randomly Picked Cosmid Clones Overlap the *pyr*B and *ori*C gap in the Physical Map of the *E.coli* Chromosome", *Nucleic Acids Res.* 16, 2601-2612 (1988).
Ko et al, "An 'Equalized cDNA' Library by the Reassociation of Short Double-Stranded cDNAs", *Nucleic Acids Res.* 18(19), 5705-5711 (1990).
Kyrpides et al., "Whole-Genome Sequence Annotation: 'Going Wrong With Confidence'", *Mol. Microbiol.* 32, 886-887 (1999).
Kurata et al., "A 300 Kilobase Interval Genetic Map of Rice Including 883 Expressed Sequences," *Nature Gen.* 8(4), 362-372 (1994).
Lange et al., "Cloning and Expression of a Gibberellin 2β,3β-Hydroxylase cDNA from Pumpkin Endosperm," *Plant Cell* 9(8), 1459-1467 (1997).
Lange "Cloning Gibberellin Dioxygenase Genes from Pumpkin Endosperm by Heterologous Expression of Enzyme Activities in *Escherichia coli*", *Proc. Natl. Acad. Sci. USA* 94(12), 6553-6558 (1997).
Lange et al., "Expression Cloning of a Gibberellin 20-Oxidase, a Multifunctional Enzyme Involved in Gibberellin Biosynthesis", *Proc. Natl. Acad. Sci. USA* 91(18), 8552-8556 (1994).
Liepman et al., "Sequence Analysis of a cDNA Encoding Alanine:Glyoxylate Amino Transferase from *Arabidopsis* (Accession No. AF063901)", *Plant Physiol.* 117, 1125-1127 (1998).
Lim et al., "Porphobilinogen Deaminase is Encoded by a Single Gene in *Arabidopsis thaliana* and Is Targeted to the Chloroplasts," *Plant Mol. Biol.* 26, 863-872 (1994).

Mahairas et al., "Sequence-Tagged Connectors: A Sequence Approach to Mapping and Scanning the Human Genome", *Proc. Natl. Acad. Sci. USA* 96, 9739-9744 (1999).
Martin et al., "MYB Transcription Factors in Plants", *Trends Genet.* 13(2), 67-73 (1997).
Martin et al., "Mendel's Dwarfing Gene: cDNAs from the *Le* Alleles and Function of the Expressed Proteins", *Proc. Natl. Acad. Sci. USA*, 94(16):8907-8911 (1997).
McCombie et al., "*Caenorhabditis elegans* Expressed Sequence Tags Identify Gene Families and Disease Gene Homologues," *Nature Gen.* 1, 124-131 (1992).
Meinkoth et al., "Hybridization of Nucleic Acids Immobilized on Solid Supports", *Anal. Biochem.* 138, 267-284 (1984).
Mende et al., "The Geranylgeranyl Diphosphate Synthase Gene of *Gibberella fujikuroi*: Isolation and Expression", *Mol. Gen. Genet.* 255(1), 96-105 (1997).
Mohan et al., "Genome Mapping, Molecular Markers and Marker-Assisted Selection Crop Plants", *Mol. Breed.* 3, 87-103 (1997).
Nakane et al., "Nucleotide Sequence of the Shikimate Kinase Gene (*aroL*) of *Bacillus subtilis*", *J. Ferment. Bioeng.* 77, 312-314 (1994).
Nakayashiki et al., "Nucleotide Sequence of a cDNA Clone Encoding Glutamyl-tRNA Reductase from Rice (Accession No. AB011416)", *Plant Physiol.* 117, 332 (1998).
NCBI Accession No. S42508 (May 8, 1993).
NCBI Accession No. D23883 (Nov. 29, 1993).
NCBI Accession No. AAA34069, corresponding to gi:535771 (Sep. 11, 1994).
Norris et al., "Complementation of the Arabidopsis *pds I* Mutation with the Gene Encoding *p*-Hydroxyphenylpuruvate Dioxygenase", *Plant Physiol.* 117, 1317-1323 (1998).
Oka et al., "Replication Origin of the *Escherichia coli* K-12 Chromosome: The Size and Structure of the Minimum DNA Segment Carrying the Information for Autonomous Replication", *Mol. Gen. Genet.* 178(1), 9-20 (1980).
Okubo et al., "Large Scale cDNA Sequencing for Analysis of Quantitative and Qualitative Aspects of Gene Expression", *Nature Gen.* 2, 173-179 (1992).
Phillips et al., "Isolation and Expression of Three Gibberellin 20-Oxidase cDNA Clones from *Arabidopsis*", *Plant Physiol.* 108(3), 1049-1057 (1995).
Porra, "Recent Progress in Porphyrin and Chlorophyll Biosynthesis", *Photochem. Photobiol.* 65(3), 492-516 (1997).
Russell et al., "Structural Features can be Unconserved in Protiens with Similar Folds. An Analysis of Side-Chain to Side-Chain Contacts Secondary Structure and Accessibility", *J. Mol. Biol.* 244, 332-350 (1994).
Sakamoto et al., "An Overview of Gibberellin Metabolism Enzyme Genes and Their Related Mutants in Rice", *Plant Physiol.* 134, 1642-1653 (2004).
Schmitz et al., "The Tomato *Blind* Gene Encodes a MYB Transcription Factor that Controls the Formation of Lateral Meristems", *Proc. Nat. Acad. Sci.* 99(2), 1064-1069 (2002).
Schünmann et al., "Identification of Three cDNA Clones Expressed in the Leaf Extension Zone and with Altered Patterns of Expression in the *Slender* Mutant of Barley: A Tonoplast Intrinsic Protein, a Putative Structural Protein and Protochlorophylide Oxidoreductase," *Plant Mol. Biol.* 31, 529-537 (1996).
Seffernick et al., "Melamine Deaminase and Atrazine Chlorohydrolase: 98 Percent Identical but Functionally Different", *J. Bacteriol.* 183(8), 2405-2410 (2001).
SIGMA Chemical Catalogue (Sigma Chemical Co.; P.O. Box 14508, St. Louis MO 63178) 1993, product Nos. 01256, 03628, 04375, pp. 736-737.
Smith et al., "Partial Purification and Characterization of the Gibberellin $A_{20}$ 3β-Hydroxylase from Seeds of *Phaseolus vulgaris*", *Plant Physiol.* 94:1390-1401 (1990).
Smith et al., "The First Step of Gibberellin Biosynthesis in Pumpkin is Catalyzed by at Least Two Copalyl Diphosphate Synthases Encoded by Differentially Regulated Genes", *Plant Physiol.* 118, 1411-1419 (1998).

Stammers et al., "Rapid Purification and Characterization of HIV-1 Reverse Transcriptase and RNaseH Engineered to Incorporate a C-terminal Tripeptide α-Tubulin Epitope", *FEBS Lett.* 283(2), 298-302 (1991).

Tanaka et al., "The Third Member of the *hemA* gene Family Encoding Glutamyl-tRNA Reductase is Primarily Expressed in Roots in *Hordeum vulgare*", *Photosynthesis Res.* 53, 161-171 (1997).

Tanksley et al., "Chromosome landing: a paradigm for map-based gene cloning in plants with large genomes", *Trends in Genet.* 11(2), 63-68 (1995).

Tikhonov et al., "Colinearity and its Exceptions in Orthologous *adh* Regions of Maize and Sorghum", *Proc. Natl. Acad. Sci. USA* 96, 7409-7414 (1999).

van de Loo et al., "An Oleate 12-Hydroxylase from *Ricirus communis L.* is a Fatty Acyl Desaturase Homolog", *Proc. Nat. Acad. Sci.* 92, 6743-6747 (1995).

Venter et al., "A New Strategy for Genome Sequencing", *Nature* 381, 364-366 (1996).

Venter et al., "The Sequence of the Human Genome" *Science* 291, 1304-1351 (2001).

Wang et al., "Construction of a Rice Bacterial Artificial Chromosome Library and Identification of Clones Linked to the Xa-21 Disease Resistance Locus", *Plant J.* 7(3), 525-533 (1995).

Wells et al., "The Chemokine Information Source: Identification and Characterization of Novel Chemokines Using the WorldWideWeb and Expressed Sequence Tag Databases", *J. Leukocyte Biol.* 61(5), 545-550 (1997).

Wendel et al., "New Isozyme Systems for Maize (*Zea mays* L.): Aconitate Hydratase, Adenylate Kinase, NADH Dehydrogenase, and Shikimate Dehydrogenase", *Biochem. Genet.* 26(5-6), 421-446 (1988) (Abstract Only).

Wenzel et al., "Physical mapping of the *Mycoplasma pneumoniae* genome", *Nucleic Acids Res.* 16(17), 8323-8336 (1988).

Winkler et al., "The Maize *Dwarf3* Gene Encodes a Cytochrome P450-Mediated Early Step in Gibberellin Biosynthesis", *Plant Cell* 7(8), 1307-1317 (1995).

Woese et al., "Conservation of Primary Structure in 16S Ribosomal RNA", *Nature* 254, 83-85 (1975).

Written Discription Training Material, Example 7, pp. 30-32.

Yomo et al., "Histochemical Studies on Protease Formation in the Cotyledons of Germinating Bean Seeds," *Planta* 112(1), 35-43 (1973).

Zhang et al., "Physical Mapping of the Rice Genome with BACs", *Plant Mol. Biol.* 35, 115-127 (1997).

Zhang et al., "Construction and Characterization of Two Rice Bacterial Artificial Chromosome Libraries from the Parents of a Permanent Recombinant Inbred Mapping Population", *Mol. Breeding* 2, 11-24 (1996).

Zwick et al., "Physical Mapping of the *liguleless* Linkage Group in *Sorghum bicolor* Using Rice RFLP-Selected Sorghum BACs", *Genetics* 248, 1983-1992 (1998).

BLASTN Search of GenBank Non-human, non-mouse EST entries database performed Nov. 18, 2008, showing 50 hits (34 pages).

BLASTX Search of Non-redundant SwissProt sequences database performed Nov. 7, 2008, showing 50 hits (15 pages).

Conserved Domain Search conducted Nov. 18, 2008 (2 pages).

NCBI Record BE515536 (gi:9739559) obtained Nov. 18, 2008 (2 pages).

NCBI Record Q07764 (gi:57012754) obtained Nov. 18, 2008 (2 pages).

Shen et al., "Hormone Response Complex in a Novel Abscisic Acid and Cyclohexamide-inducible Barley Gene," *Journal of Biological Chemistry* 268(31):23652-23660 (1993).

* cited by examiner

US 7,553,954 B2

NUCLEIC ACID MOLECULES AND OTHER MOLECULES ASSOCIATED WITH PLANTS

CROSS-REFERENCE TO RELATED APPLICATION

This application is a continuation of U.S. application Ser. No. 09/667,188 filed Sep. 21, 2000, which claims the benefit of U.S. Provisional Application Ser. No. 60/155,006 filed Sep. 22, 1999, the entireties of which are herein incorporated by reference.

INCORPORATION OF SEQUENCE LISTING

This application contains a sequence listing, which is contained on three identical CD-ROMs: two copies of a sequence listing (Copy 1 and Copy 2) and a sequence listing Computer Readable Form (CRF), all of which are herein incorporated by reference. All three CD-ROMs each contain one file called "51464C seq list.txt" which is 5,099,520 bytes in size (measured in Windows XP) and which was created on Feb. 13, 2006.

FIELD OF THE INVENTION

The present invention is in the field of plant biochemistry. More specifically the invention relates to nucleic acid molecules that encode proteins and fragments of proteins produced in plant cells, in particular, wheat plants. The invention also relates to proteins and fragments of proteins so encoded and antibodies capable of binding the proteins. The invention also relates to methods of using the nucleic acid molecules, proteins and fragments of proteins.

BACKGROUND OF THE INVENTION

I. Expressed Sequence Tag Nucleic Acid Molecules

Expressed sequence tags, or ESTs, are short sequences of randomly selected clones from a cDNA (or complementary DNA) library which are representative of the cDNA inserts of these randomly selected clones. McCombie, et al., *Nature Genetics*, 1:124-130 (1992); Kurata, et al., *Nature Genetics*, 8: 365-372 (1994); Okubo, et al., *Nature Genetics*, 2: 173-179 (1992), all of which references are incorporated herein in their entirety.

Using conventional methodologies, cDNA libraries can be constructed from the mRNA (messenger RNA) of a given tissue or organism using poly dT primers and reverse transcriptase (Efstratiadis, et al., *Cell* 7:279-288 (1976), the entirety of which is herein incorporated by reference; Higuchi, et al., *Proc. Natl. Acad. Sci.* (U.S.A.) 73:3146-3150 (1976), the entirety of which is herein incorporated by reference; Maniatis, et al., *Cell* 8:163 (1976) the entirety of which is herein incorporated by reference; Land, et al., *Nucleic Acids Res.* 9:2251-2266 (1981), the entirety of which is herein incorporated by reference; Okayama, et al., *Mol. Cell. Biol.* 2:161-170 (1982), the entirety of which is herein incorporated by reference; Gubler, et al., *Gene* 25:263 (1983), the entirety of which is herein incorporated by reference).

Several methods may be employed to obtain full-length cDNA constructs. For example, terminal transferase can be used to add homopolymeric tails of dC residues to the free 3′ hydroxyl groups (Land, et al., *Nucleic Acids Res.* 9:2251-2266 (1981), the entirety of which is herein incorporated by reference). This tail can then be hybridized by a poly dG oligo which can act as a primer for the synthesis of full length second strand cDNA. Okayama and Berg, report a method for obtaining full length cDNA constructs. This method has been simplified by using synthetic primer-adapters that have both homopolymeric tails for priming the synthesis of the first and second strands and restriction sites for cloning into plasmids (Coleclough, et al., *Gene* 34:305-314 (1985), the entirety of which is herein incorporated by reference) and bacteriophage vectors (Krawinkel, et al., *Nucleic Acids Res.* 14:1913 (1986), the entirety of which is herein incorporated by reference; and Han, et al., *Nucleic Acids Res.* 15:6304 (1987), the entirety of which is herein incorporated by reference).

These strategies have been coupled with additional strategies for isolating rare mRNA populations. For example, a typical mammalian cell contains between 10,000 and 30,000 different mRNA sequences. Davidson, *Gene Activity in Early Development*, 2nd ed., Academic Press, New York (1976). The number of clones required to achieve a given probability that a low-abundance mRNA will be present in a cDNA library is $N=(\ln(1-P))/(\ln(1-1/n))$ where N is the number of clones required, P is the probability desired, and $1/n$ is the fractional proportion of the total mRNA that is represented by a single rare mRNA. (Sambrook, et al., *Molecular Cloning: A Laboratory Manual*, 2nd ed., Cold Spring Harbor Laboratory Press (1989), the entirety of which is herein incorporated by reference.).

A method to enrich preparations of mRNA for sequences of interest is to fractionate by size. One such method is to fractionate by electrophoresis through an agarose gel (Pennica, et al., *Nature* 301:214-221 (1983), the entirety of which is herein incorporated by reference). Another such method employs sucrose gradient centrifugation in the presence of an agent, such as methylmercuric hydroxide, that denatures secondary structure in RNA (Schweinfest, et al., *Proc. Natl. Acad. Sci.* (U.S.A.) 79:4997-5000 (1982), the entirety of which is herein incorporated by reference).

A frequently adopted method is to construct equalized or normalized cDNA libraries (Ko, *Nucleic Acids Res.* 18:5705-5711 (1990), the entirety of which is herein incorporated by reference; Patanjali, S. R. et al., *Proc. Natl. Acad. Sci.* (U.S.A.) 88:1943-1947 (1991), the entirety of which is herein incorporated by reference). Typically, the cDNA population is normalized by subtractive hybridization. Schmid, et al., *J. Neurochem.* 48:307-312 (1987) the entirety of which is herein incorporated by reference; Fargnoli, et al., *Anal. Biochem.* 187:364-373 (1990) the entirety of which is herein incorporated by reference; Travis, et al., *Proc. Natl. Acad. Sci* (U.S.A.) 85:1696-1700 (1988) the entirety of which is herein incorporated by reference; Kato, *Eur. J. Neurosci.* 2:704 (1990); and Schweinfest, et al., *Genet. Anal. Tech. Appl.* 7:64 (1990), the entirety of which is herein incorporated by reference). Subtraction represents another method for reducing the population of certain sequences in the cDNA library. Swaroop, et al., *Nucleic Acids Res.* 19:1954 (1991), the entirety of which is herein incorporated by reference).

ESTs can be sequenced by a number of methods. Two basic methods may be used for DNA sequencing, the chain termination method of Sanger et al., *Proc. Natl. Acad. Sci.* (U.S.A.) 74: 5463-5467 (1977), the entirety of which is herein incorporated by reference and the chemical degradation method of Maxam and Gilbert, *Proc. Nat. Acad. Sci.* (U.S.A.) 74: 560-564 (1977), the entirety of which is herein incorporated by reference. Automation and advances in technology such as the replacement of radioisotopes with fluorescence-based sequencing have reduced the effort required to sequence DNA (Craxton, *Methods*, 2: 20-26 (1991), the entirety of which is herein incorporated by reference; Ju et al., *Proc. Natl. Acad. Sci.* (U.S.A.) 92: 4347-4351 (1995), the entirety of which is herein incorporated by reference; Tabor and Richardson, *Proc. Natl. Acad. Sci.* (U.S.A.) 92: 6339-6343 (1995), the entirety of which is herein incorporated by reference). Automated sequencers are available from, for example, Pharmacia Biotech, Inc., Piscataway, N.J. (Pharmacia ALF), LI-COR, Inc., Lincoln, Nebr. (LI-COR 4,000) and Millipore, Bedford, Mass. (Millipore BaseStation).

In addition, advances in capillary gel electrophoresis have also reduced the effort required to sequence DNA and such advances provide a rapid high resolution approach for sequencing DNA samples (Swerdlow and Gesteland, *Nucleic Acids Res.* 18:1415-1419 (1990); Smith, *Nature* 349:812-813 (1991); Luckey et al., *Methods Enzymol.* 218:154-172 (1993); Lu et al., *J. Chromatog. A.* 680:497-501 (1994); Carson et al., *Anal. Chem.* 65:3219-3226 (1993); Huang et al., *Anal. Chem.* 64:2149-2154 (1992); Kheterpal et al., *Electrophoresis* 17:1852-1859 (1996); Quesada and Zhang, *Electrophoresis* 17:1841-1851 (1996); Baba, *Yakugaku Zasshi* 117: 265-281 (1997), all of which are herein incorporated by reference in their entirety).

ESTs longer than 150 bases have been found to be useful for similarity searches and mapping. (Adams, et al., *Science* 252:1651-1656 (1991), herein incorporated by reference.) EST sequences normally range from 150-450 bases. This is the length of sequence information that is routinely and reliably generated using single run sequence data. Typically, only single run sequence data is obtained from the cDNA library, Adams, et al., *Science* 252:1651-1656 (1991). Automated single run sequencing typically results in an approximately 2-3% error or base ambiguity rate. (Boguski, et al., *Nature Genetics*, 4:332-333 (1993), the entirety of which is herein incorporated by reference).

EST databases have been constructed or partially constructed from, for example, *C. elegans* (McCombrie, et al., *Nature Genetics* 1:124-131 (1992), human liver cell line HepG2 (Okubo, et al., *Nature Genetics* 2:173-179 (1992)), human brain RNA (Adams, et al., *Science* 252:1651-1656 (1991); Adams, et al., *Nature* 355:632-635 (1992)), *Arabidopsis*, (Newman, et al., *Plant Physiol.* 106:1241-1255 (1994)); and rice (Kurata, et al., *Nature Genetics* 8:365-372 (1994).

II. Sequence Comparisons

A characteristic feature of a protein or DNA sequence is that it can be compared with other known protein or DNA sequences. Sequence comparisons can be undertaken by determining the similarity of the test or query sequence with sequences in publicly available or propriety databases ("similarity analysis") or by searching for certain motifs ("intrinsic sequence analysis")(e.g. cis elements)(Coulson, *Trends in Biotechnology*, 12: 76-80 (1994), the entirety of which is herein incorporated by reference; Birren, et al., *Genome Analysis*, 1: 543-559 (1997), the entirety of which is herein incorporated by reference).

Similarity analysis includes database search and alignment. Examples of public databases include the DNA Database of Japan (DDBJ)(available on the world wide web at ddbj.nig.ac.jp/); Genebank (available on the world wide web at ncbi.nlm.nih.gov/web/Genbank/Index.htlm); and the European Molecular Biology Laboratory Nucleic Acid Sequence Database (EMBL) (available on the world wide web at ebi.ac.uk/ebi_docs/embl_db.html). A number of different search algorithms have been developed, one example of which are the suite of programs referred to as BLAST programs. There are five implementations of BLAST, three designed for nucleotide sequences queries (BLASTN, BLASTX, and TBLASTX) and two designed for protein sequence queries (BLASTP and TBLASTN) (Coulson, *Trends in Biotechnology*, 12: 76-80 (1994); Birren, et al., *Genome Analysis*, 1: 543-559 (1997)).

BLASTN takes a nucleotide sequence (the query sequence) and its reverse complement and searches them against a nucleotide sequence database. BLASTN was designed for speed, not maximum sensitivity, and may not find distantly related coding sequences. BLASTX takes a nucleotide sequence, translates it in three forward reading frames and three reverse complement reading frames, and then compares the six translations against a protein sequence database. BLASTX is useful for sensitive analysis of preliminary (single-pass) sequence data and is tolerant of sequencing errors (Gish and States, *Nature Genetics*, 3: 266-272 (1993), the entirety of which is herein incorporated by reference). BLASTN and BLASTX may be used in concert for analyzing EST data (Coulson, *Trends in Biotechnology*, 12: 76-80 (1994); Birren, et al., *Genome Analysis*, 1: 543-559 (1997).

Given a coding nucleotide sequence and the protein it encodes, it is often preferable to use the protein as the query sequence to search a database because of the greatly increased sensitivity to detect more subtle relationships. This is due to the larger alphabet of proteins (20 amino acids) compared with the alphabet of nucleic acid sequences (4 bases), where it is far easier to obtain a match by chance. In addition, with nucleotide alignments, only a match (positive score) or a mismatch (negative score) is obtained, but with proteins, the presence of conservative amino acid substitutions can be taken into account. Here, a mismatch may yield a positive score if the non-identical residue has physical/chemical properties similar to the one it replaced. Various scoring matrices are used to supply the substitution scores of all possible amino acid pairs. A general purpose scoring system is the BLOSUM62 matrix (Henikoff and Henikoff, *Proteins*, 17: 49-61 (1993), the entirety of which is herein incorporated by reference), which is currently the default choice for BLAST programs. BLOSUM62 is tailored for alignments of moderately diverged sequences and thus may not yield the best results under all conditions. Altschul, *J. Mol. Biol.* 36: 290-300 (1993), the entirety of which is herein incorporated by reference, uses a combination of three matrices to cover all contingencies. This may improve sensitivity, but at the expense of slower searches. In practice, a single BLOSUM62 matrix is often used but others (PAM40 and PAM250) may be attempted when additional analysis is necessary. Low PAM matrices are directed at detecting very strong but localized sequence similarities, whereas high PAM matrices are directed at detecting long but weak alignments between very distantly related sequences.

Homologues in other organisms are available that can be used for comparative sequence analysis. Multiple alignments are performed to study similarities and differences in a group of related sequences. CLUSTAL W is a multiple sequence alignment package available that performs progressive multiple sequence alignments based on the method of Feng and Doolittle, *J. Mol. Evol.* 25: 351-360 (1987), the entirety of which is herein incorporated by reference. Each pair of sequences is aligned and the distance between each pair is calculated; from this distance matrix, a guide tree is calculated, and all of the sequences are progressively aligned based on this tree. A feature of the program is its sensitivity to the effect of gaps on the alignment; gap penalties are varied to encourage the insertion of gaps in probable loop regions instead of in the middle of structured regions. Users can specify gap penalties, choose between a number of scoring matrices, or supply their own scoring matrix for both the pairwise alignments and the multiple alignments. CLUSTAL W for UNIX and VMS systems is available by ftp at: ebi. ac.uk. Another program is MACAW (Schuler et al., *Proteins, Struct. Func. Genet*, 9:180-190 (1991), the entirety of which is herein incorporated by reference, for which both Macintosh and Microsoft Windows versions are available. MACAW uses a graphical interface, provides a choice of several alignment algorithms, and is available by anonymous ftp at: ncbi.nlm.nih.gov (directory/pub/macaw).

Sequence motifs are derived from multiple alignments and can be used to examine individual sequences or an entire database for subtle patterns. With motifs, it is sometimes possible to detect distant relationships that may not be demonstrable based on comparisons of primary sequences alone. Currently, the largest collection of sequence motifs in the world is PROSITE (Bairoch and Bucher, *Nucleic Acid Research*, 22: 3583-3589 (1994), the entirety of which is herein incorporated by reference.) PROSITE may be accessed via either the ExPASy server on the World Wide Web or anonymous ftp site. Many commercial sequence analysis packages also provide search programs that use PROSITE data.

A resource for searching protein motifs is the BLOCKS E-mail server developed by S. Henikoff, *Trends Biochem Sci.*, 18:267-268 (1993), the entirety of which is herein incorporated by reference; Henikoff and Henikoff, *Nucleic Acid Research*, 19:6565-6572 (1991), the entirety of which is herein incorporated by reference; Henikoff and Henikoff, *Proteins*, 17: 49-61 (1993). BLOCKS searches a protein or nucleotide sequence against a database of protein motifs or "blocks." Blocks are defined as short, ungapped multiple alignments that represent highly conserved protein patterns. The blocks themselves are derived from entries in PROSITE as well as other sources. Either a protein or nucleotide query can be submitted to the BLOCKS server; if a nucleotide sequence is submitted, the sequence is translated in all six reading frames and motifs are sought in these conceptual translations. Once the search is completed, the server will return a ranked list of significant matches, along with an alignment of the query sequence to the matched BLOCKS entries.

Conserved protein domains can be represented by two-dimensional matrices, which measure either the frequency or probability of the occurrences of each amino acid residue and deletions or insertions in each position of the domain. This type of model, when used to search against protein databases, is sensitive and usually yields more accurate results than simple motif searches. Two popular implementations of this approach are profile searches (such as GCG program ProfileSearch) and Hidden Markov Models (HMMs)(Krough et al., *J. Mol. Biol.* 235:1501-1531 (1994); Eddy, *Current Opinion in Structural Biology* 6:361-365 (1996), both of which are herein incorporated by reference in their entirety). In both cases, a large number of common protein domains have been converted into profiles, as present in the PROSITE library, or HHM models, as in the Pfam protein domain library (Sonnhammer et al., *Proteins* 28:405-420 (1997), the entirety of which is herein incorporated by reference). Pfam contains more than 500 HMM models for enzymes, transcription factors, signal transduction molecules, and structural proteins. Protein databases can be queried with these profiles or HMM models, which will identify proteins containing the domain of interest. For example, HMMSW or HMMFS, two programs in a public domain package called HMMER (Sonnhammer et al., *Proteins* 28:405-420 (1997)) can be used.

PROSITE and BLOCKS represent collected families of protein motifs. Thus, searching these databases entails submitting a single sequence to determine whether or not that sequence is similar to the members of an established family. Programs working in the opposite direction compare a collection of sequences with individual entries in the protein databases. An example of such a program is the Motif Search Tool, or MoST (Tatusov et al. *Proc. Natl. Acad. Sci.* 91: 12091-12095 (1994), the entirety of which is herein incorporated by reference.) On the basis of an aligned set of input sequences, a weight matrix is calculated by using one of four methods (selected by the user); a weight matrix is simply a representation, position by position in an alignment, of how likely a particular amino acid will appear. The calculated weight matrix is then used to search the databases. To increase sensitivity, newly found sequences are added to the original data set, the weight matrix is recalculated, and the search is performed again. This procedure continues until no new sequences are found.

SUMMARY OF THE INVENTION

The present invention provides a substantially purified nucleic acid molecule that encodes a wheat protein or fragment thereof comprising a nucleic acid sequence selected from the group consisting of SEQ ID NO: 1 through SEQ ID NO: 8135.

The present invention also provides one or more substantially purified nucleic acid molecules comprising a nucleic acid sequence selected from the group consisting of SEQ ID NO: 1 through SEQ ID NO:8135 or complements thereof.

The present invention also provides a substantially purified wheat protein or fragment thereof, wherein said wheat protein is encoded by a nucleic acid molecule that comprises a nucleic acid sequence selected from the group consisting of SEQ ID NO: 1 through SEQ ID NO: 8135.

The present invention further provides a substantially purified protein, peptide, or fragment thereof encoded by a nucleic acid sequence which specifically hybridizes to a nucleic acid molecule comprising a nucleic acid sequence selected from the group consisting of a complement of SEQ ID NO: 1 through SEQ ID NO:8135.

The present invention further provides a substantially purified antibody capable of specifically binding to a protein or fragment thereof encoded by a nucleic acid sequence which specifically hybridizes to a nucleic acid molecule having a nucleic acid sequence selected from the group consisting of a complement of SEQ ID NO: 1 through SEQ ID NO:8135.

The present invention also provides a transformed plant transformed to contain a nucleic acid molecule which comprises: (A) an exogenous promoter region which functions in plant cells to cause the production of an mRNA molecule; which is linked to (B) a structural nucleic acid molecule, wherein said structural nucleic acid molecule comprises a nucleic acid molecule that encodes a protein, peptide, or fragment thereof which hybridizes to a nucleic acid sequence selected from the group consisting of a complement of SEQ ID NO: 1 through SEQ ID NO:8135 expressed in an effective amount to produce a desirable agronomic effect; which is linked to (C) a 3' non-translated sequence that functions in plant cells to cause the termination of transcription and the addition of polyadenylated ribonucleotides to the 3' end of the mRNA sequence.

The present invention also provides a transformed plant cell containing a nucleic acid molecule whose non-transcribed strand encodes a protein or fragment thereof, wherein the transcribed strand of said nucleic acid is complementary to a nucleic acid molecule that encodes a protein or fragment thereof. The present invention also provides bacterial, viral, microbial, and plant cells comprising a nucleic acid molecule of the present invention The present invention also provides a method of producing a plant containing one or more proteins encoded by sequences comprising SEQ ID NO: 1 or complement thereof through SEQ ID NO:8135 or complements thereof, expressed in a sufficient amount and/or fashion to produce a desirable agronomic effect.

In accomplishing the foregoing, there is provided, in accordance with one aspect of the present invention, methods of producing genetically transformed plants, comprising the steps of:
(a) inserting into the genome of a plant cell a recombinant, double-stranded DNA molecule comprising
  (i) a promoter which functions in plant cells to cause the production of an RNA sequence,
  (ii) a structural DNA sequence that causes the production of an RNA sequence which encodes a desired protein.
  (iii) a 3' non-translated DNA sequence which functions in plant cells to cause the addition of polyadenylated nucleotides to the 3' end of RNA sequence; where the promoter is homologous or heterologous with respect to the coding sequence and adapted to cause sufficient expression of a protein in desired plant tissues to enhance the agronomic utility of a plant transformed with said gene.
(b) obtaining a transformed plant cell with said nucleic acid molecule that encodes one or more proteins, wherein said nucleic acid molecule is transcribed and results in expression of said protein(s); and
(c) regenerating from the transformed plant cell a genetically transformed plant The present invention also encompasses differentiated plants, seeds, and progeny comprising said transformed plant cells and which exhibit novel properties of agronomic significance.

The present invention also provides a method of producing a plant containing reduced levels of a protein comprising: (A) transforming a plant cell with a nucleic acid molecule that encodes a protein, wherein said nucleic acid molecule is transcribed and results in co-suppression of endogenous protein synthesis activity, and (B) regenerating plants and producing subsequent progeny from the transformed plant.

The present invention also provides a method of determining an association between a polymorphism and a plant trait comprising: (A) hybridizing a nucleic acid molecule specific for a polymorphism to genetic material of a plant, wherein said nucleic acid molecule comprising a nucleic acid sequence selected from the group consisting of SEQ ID NO: 1 through SEQ ID NO:8135 or complements thereof; and (B) calculating the degree of association between the polymorphism and the plant trait.

The present invention also provides a method of isolating a genetic region, or nucleic acid that encodes a protein or fragment thereof comprising: (A) incubating under conditions permitting nucleic acid hybridization: a marker nucleic acid molecule, preferably an EST, with a complementary nucleic acid molecule obtained from a plant cell or plant tissue; (B) permitting hybridization between said marker nucleic acid molecule, preferably an EST, and said complementary nucleic acid molecule obtained from said plant cell or plant tissue; and (C) isolating said complementary nucleic acid molecule.

The present invention also provides a method for determining a level or pattern in a plant cell of a protein in a plant comprising: (A) incubating, under conditions permitting nucleic acid hybridization, a marker nucleic acid molecule, the marker nucleic acid molecule selected from the group of marker nucleic acid molecules which specifically hybridize to a nucleic acid molecule having the nucleic acid sequence selected from the group consisting of SEQ ID NO: 1 through SEQ ID NO: 8135 or complements thereof or fragments of either, with a complementary nucleic acid molecule obtained from the plant cell or plant tissue, wherein nucleic acid hybridization between the marker nucleic acid molecule and the complementary nucleic acid molecule obtained from the plant cell or plant tissue permits the detection of an mRNA for the enzyme; (B) permitting hybridization between the marker nucleic acid molecule and the complementary nucleic acid molecule obtained from the plant cell or plant tissue; and (C) detecting the level or pattern of the complementary nucleic acid, wherein the detection of the complementary nucleic acid is predictive of the level or pattern of the protein.

The present invention also provides a method for determining the level or pattern of a protein in a plant cell or plant tissue comprising: (A) incubating under conditions permitting nucleic acid hybridization: a marker nucleic acid molecule, the marker nucleic acid molecule comprising a nucleotide sequence selected from the group consisting of SEQ ID NO: 1 through SEQ ID NO:8135 or complements thereof, with a complementary nucleic acid molecule obtained from a plant cell or plant tissue, wherein nucleic acid hybridization between the marker nucleic acid molecule, and the complementary nucleic acid molecule obtained from the plant cell or plant tissue permits the detection of said protein; (B) permitting hybridization between the marker nucleic acid molecule and the complementary nucleic acid molecule obtained from the plant cell or plant tissue; and (C) detecting the level or pattern of the complementary nucleic acid, wherein the detection of said complementary nucleic acid is predictive of the level or pattern of the protein synthesis.

The present invention also provides a method for determining a level or pattern of a protein in a plant cell or plant tissue which comprises assaying the concentration of a molecule, whose concentration is dependent upon the expression of a gene, the gene having a nucleic acid sequence which specifically hybridizes to a protein marker nucleic acid molecule, the molecule being present in a plant cell or plant tissue, in comparison to the concentration of that molecule present in a plant cell or plant tissue with a known level or pattern of said protein, wherein an assayed concentration of the molecule is compared to the assayed concentration of the molecule in a plant cell or plant tissue with a known level or pattern of said protein.

The present invention also provides a method of determining a mutation in a plant whose presence is predictive of a mutation affecting a level or pattern of a protein comprising the steps: (A) incubating, under conditions permitting nucleic acid hybridization, a marker nucleic acid, the marker nucleic acid selected from the group of marker nucleic acid molecules which specifically hybridize to a nucleic acid molecule consisting of the nucleic acid sequence selected from the group consisting of SEQ ID NO: 1 through SEQ ID NO: 8135 or complements thereof or fragments of either and a complementary nucleic acid molecule obtained from the plant, wherein nucleic acid hybridization between the marker nucleic acid molecule and the complementary nucleic acid molecule obtained from the plant permits the detection of a polymorphism whose presence is predictive of a mutation affecting the level or pattern of the protein in the plant; (B) permitting hybridization between the marker nucleic acid molecule and the complementary nucleic acid molecule obtained from the plant; and (C) detecting the presence of the polymorphism, wherein the detection of the polymorphism is predictive of the mutation.

The present invention also provides a method for determining a mutation in a plant whose presence is predictive of a mutation affecting the level or pattern of protein synthesis comprising the steps: (A) incubating under conditions permitting nucleic acid hybridization: a marker nucleic acid molecule, the marker nucleic acid molecule comprising a nucleic acid molecule that is linked to gene, the gene having a nucleic acid sequence which specifically hybridizes to a sequence selected from the group consisting of SEQ ID NO: 1 through SEQ ID NO:8135 and complements thereof, and a complementary nucleic acid molecule obtained from a plant tissue or plant cell of the plant, wherein nucleic acid hybridization between the marker nucleic acid molecule and the complementary nucleic acid molecule obtained from the plant permits the detection of a polymorphism whose presence is predictive of a mutation affecting said level or pattern of a protein synthesis in the plant; (B) permitting hybridization between said marker nucleic acid molecule and said complementary nucleic acid molecule obtained from said plant; and; (C) detecting the presence of the polymorphism, wherein the detection of the polymorphism is predictive of the mutation.

The present invention also provides a method for reducing expression of a protein in a plant cell, the method comprising: growing a transformed plant cell containing a nucleic acid molecule whose non-transcribed strand encodes a protein or fragment thereof, wherein the transcribed strand of said nucleic acid is complementary to a nucleic acid molecule that encodes the protein in said plant cell, and whereby the strand that is complementary to the nucleic acid molecule that encodes the protein reduces or depresses expression of the protein.

The present invention provides wheat nucleic acid molecules for use as molecular tags to isolate genetic regions (i.e. promoters and flanking sequences), isolate genes, map genes, and determine gene function. The present invention further provides wheat nucleic acid molecules for use in determining if genes are members of a particular gene family.

The present invention also provides a method of obtaining full length genes using wheat ESTs or complements thereof or fragments of either.

The present invention also provides a method of isolating promoters and flanking sequences using wheat ESTs or complements thereof or fragments of either.

The present invention also provides wheat ESTs or complements thereof or fragments of either for use in marker-assisted breeding programs.

The present invention also provides a method of identifying tissues comprising hybridizing nucleic acids from the tissue with wheat ESTs or complements thereof or fragments of either.

The present invention also provides a method for production of antibodies targeted against the proteins, peptides, or fragments produced by the disclosed or complements thereof or fragments of either.

The present invention also provides a method for the transformation and regeneration of plants comprising sequences hybridizable to the disclosed ESTs or complements thereof or fragments of either.

The present invention also provides a method of modifying plant protein expression by inserting in a chimeric gene sense or antisense constructs of the wheat ESTs.

DETAILED DESCRIPTION OF THE INVENTION

Agents (a) Nucleic Acid Molecules

Agents of the present invention include nucleic acid molecules and more specifically EST nucleic acid molecules or nucleic acid fragment molecules thereof. Fragment EST nucleic acid molecules may encode significant portion(s) of, or indeed most of, the EST nucleic acid molecule. Alternatively, the fragments may comprise smaller oligonucleotides (having from about 15 to about 250 nucleotide residues, and more preferably, about 15 to about 30 nucleotide residues).

A subset of the nucleic acid molecules of the present invention includes nucleic acid molecules that are marker molecules. Another subset of the nucleic acid molecules of the present invention include nucleic acid molecules that encode a protein or fragment thereof. Another subset of the nucleic acid molecules of the present invention are EST molecules.

The term "substantially purified", as used herein, refers to a molecule separated from substantially all other molecules normally associated with it in its native state. More preferably a substantially purified molecule is the predominant species present in a preparation. A substantially purified molecule may be greater than 60% free, preferably 75% free, more preferably 90% free, and most preferably 95% free from the other molecules (exclusive of solvent) present in the natural mixture. The term "substantially purified" is not intended to encompass molecules present in their native state.

The agents of the present invention will preferably be "biologically active" with respect to either a structural attribute, such as the capacity of a nucleic acid to hybridize to another nucleic acid molecule, or the ability of a protein to be bound by antibody (or to compete with another molecule for such binding). Alternatively, such an attribute may be catalytic, and thus involve the capacity of the agent to mediate a chemical reaction or response.

The agents of the present invention may also be recombinant. As used herein, the term recombinant means any agent (e.g. DNA, peptide etc.), that is, or results, however indirect, from human manipulation of a nucleic acid molecule.

It is understood that the agents of the present invention may be labeled with reagents that facilitate detection of the agent (e.g. fluorescent labels (Prober, et al., *Science* 238:336-340 (1987); Albarella et al., EP 144914, chemical labels (Sheldon et al., U.S. Pat. No. 4,582,789; Albarella et al., U.S. Pat. No. 4,563,417, modified bases (Miyoshi et al., EP 119448, all of which are hereby incorporated by reference in their entirety).

It is further understood, that the present invention provides bacterial, viral, microbial, and plant cells comprising the agents of the present invention.

Nucleic acid molecules or fragment thereof of the present invention are capable of specifically hybridizing to other nucleic acid molecules under certain circumstances. As used herein, two nucleic acid molecules are said to be capable of specifically hybridizing to one another if the two molecules are capable of forming an anti-parallel, double-stranded nucleic acid structure. A nucleic acid molecule is said to be the "complement" of another nucleic acid molecule if they exhibit complete complementarity. As used herein, molecules are said to exhibit "complete complementarity" when every nucleotide of one of the molecules is complementary to a nucleotide of the other. Two molecules are said to be "minimally complementary" if they can hybridize to one another with sufficient stability to permit them to remain annealed to one another under at least conventional "low-stringency" conditions. Similarly, the molecules are said to be "complementary" if they can hybridize to one another with sufficient stability to permit them to remain annealed to one another under conventional "high-stringency" conditions. Conventional stringency conditions are described by Sambrook, et al., In: *Molecular Cloning, A Laboratory Manual, 2nd Edition*, Cold Spring Harbor Press, Cold Spring Harbor, N.Y. (1989), and by Haymes, et al. In: *Nucleic Acid Hybridization, A Practical Approach*, IRL Press, Washington, D.C. (1985), the entirety of which is herein incorporated by reference. Departures from complete complementarity are therefore permissible, as long as such departures do not completely preclude the capacity of the molecules to form a double-stranded structure. Thus, in order for an nucleic acid molecule or fragment of the present invention to serve as a primer or probe it need only be sufficiently complementary in sequence to be able to form a stable double-stranded structure under the particular solvent and salt concentrations employed.

Appropriate stringency conditions which promote DNA hybridization are, for example, 6.0× sodium chloride/sodium citrate (SSC) at about 45° C., followed by a wash of 2.0×SSC at 50° C., are known to those skilled in the art or can be found in *Current Protocols in Molecular Biology*, John Wiley & Sons, N.Y. (1989), 6.3.1-6.3.6. For example, the salt concentration in the wash step can be selected from a low stringency of about 2.0×SSC at 50° C. to a high stringency of about 0.2×SSC at 50° C. In addition, the temperature in the wash step can be increased from low stringency conditions at room temperature, about 22° C., to high stringency conditions at about 65° C. Both temperature and salt may be varied, or either the temperature or the salt concentration may be held constant while the other variable is changed.

In a preferred embodiment, a nucleic acid of the present invention will specifically hybridize to one or more of the nucleic acid molecules set forth in SEQ ID NO: 1 through SEQ ID NO: 8135 or complements thereof under moderately stringent conditions, for example, at about 2.0×SSC and about 65° C.

In a particularly preferred embodiment, a nucleic acid of the present invention will include those nucleic acid molecules that specifically hybridize to one or more of the nucleic acid molecules set forth in SEQ ID NO:1 through SEQ ID NO: 8135 or complements thereof under high stringency conditions.

In one aspect of the present invention, the nucleic acid molecules of the present invention have one or more of the nucleic acid sequences set forth in SEQ ID NO: 1 through SEQ ID NO:8135 or complements thereof. In another aspect of the present invention, one or more of the nucleic acid molecules of the present invention share between 100% and 90% sequence identity with one or more of the nucleic acid sequences set forth in SEQ ID NO: 1 through SEQ ID NO:8135 or complements thereof. In a further aspect of the present invention, one or more of the nucleic acid molecules of the present invention share between 100% and 95% sequence identity with one or more of the nucleic acid sequences set forth in SEQ ID NO: 1 through SEQ ID NO:8135 or complements thereof. In a more preferred aspect of the present invention, one or more of the nucleic acid molecules of the present invention share between 100% and 98% sequence identity with one or more of the nucleic acid sequences set forth in SEQ ID NO: 1 through SEQ ID NO:8135 or complements thereof. In an even more preferred aspect of the present invention, one or more of the nucleic acid molecules of the present invention share between 100% and 99% sequence identity with one or more of the sequences set forth in SEQ ID NO: 1 through SEQ ID NO:8135 or complements thereof. In a further, even more preferred aspect of the present invention, one or more of the nucleic acid molecules of the present invention exhibit 100% sequence identity with one or more nucleic acid molecules present within the cDNA libraries designated LIB3280 and LIB3281 (Monsanto Company, St. Louis, Mo., United States of America).

In a preferred embodiment of the present invention, a wheat protein or fragment thereof of the present invention is a homologue of another plant protein. In another preferred embodiment of the present invention, a wheat protein or fragment thereof of the present invention is a homologue of a fungal protein. In another preferred embodiment of the present invention, a wheat protein or fragment thereof of the present invention is a homologue of mammalian protein. In another preferred embodiment of the present invention, a wheat protein or fragment thereof of the present invention is a homologue of a bacterial protein. In another preferred embodiment of the present invention, a wheat protein or fragment thereof of the present invention is a homologue of an algal protein. In another preferred embodiment of the present invention, a wheat protein or fragment thereof of the present invention is a homologue of a soybean protein. In another preferred embodiment of the present invention, a wheat protein or fragment thereof of the present invention is a homologue of a maize protein. In another preferred embodiment of the present invention, a wheat protein or fragment thereof of the present invention is a homologue of a cotton protein.

In a preferred embodiment of the present invention, the nucleic molecule of the present invention encodes a wheat protein or fragment thereof where a wheat protein or fragment thereof exhibits a BLAST probability score of greater than 1E-12, preferably a BLAST probability score of between about 1E-30 and about 1E-12, even more preferably a BLAST probability score of greater than 1E-30 with its homologue.

In another preferred embodiment of the present invention, the nucleic acid molecule encoding a wheat protein or fragment thereof exhibits a % identity with its homologue of between about 25% and about 40%, more preferably of between about 40 and about 70%, even more preferably of between about 70% and about 90% and even more preferably between about 90% and 99%. In another preferred embodiment, of the present invention, a wheat protein or fragment thereof exhibits a % identity with its homologue of 100%.

In a preferred embodiment of the present invention, the nucleic molecule of the present invention encodes a wheat protein or fragment thereof where the wheat protein exhibits a BLAST score of greater than 120, preferably a BLAST score of between about 1450 and about 120, even more preferably a BLAST score of greater than 1450 with its homologue.

Nucleic acid molecules of the present invention also include non-wheat homologues. Preferred non-wheat homologues are selected from the group consisting of alfalfa, *Arabidopsis*, barley, *Brassica*, broccoli, cabbage, citrus, cotton, garlic, oat, oilseed rape, onion, canola, flax, an ornamental plant, maize, pea, peanut, pepper, potato, rice, rye, sorghum, soybean, strawberry, sugarcane, sugarbeet, tomato, poplar, pine, fir, eucalyptus, apple, lettuce, lentils, grape, banana, tea, turf grasses, sunflower, oil palm and Phaseolus.

The degeneracy of the genetic code, which allows different nucleic acid sequences to code for the same protein or peptide, is known in the literature. (U.S. Pat. No. 4,757,006, the entirety of which is herein incorporated by reference).

In an aspect of the present invention, one or more of the nucleic acid molecules of the present invention differ in nucleic acid sequence from those encoding a wheat protein or fragment thereof in SEQ ID NO: 1 through SEQ ID NO: 8135 due to the degeneracy in the genetic code in that they encode the same protein but differ in nucleic acid sequence.

In another further aspect of the present invention, nucleic acid molecules of the present invention can comprise sequences, which differ from those encoding a protein or fragment thereof in SEQ ID NO: 1 through SEQ ID NO: 8135 due to fact that the different nucleic acid sequence encodes a protein having one or more conservative amino acid changes. It is understood that codons capable of coding for such conservative amino acid substitutions are known in the art.

It is well known in the art that one or more amino acids in a native sequence can be substituted with another amino acid(s), the charge and polarity of which are similar to that of the native amino acid, i.e., a conservative amino acid substitution, resulting in a silent change. Conserved substitutes for an amino acid within the native polypeptide sequence can be selected from other members of the class to which the naturally occurring amino acid belongs. Amino acids can be divided into the following four groups: (1) acidic amino acids, (2) basic amino acids, (3) neutral polar amino acids, and (4) neutral nonpolar amino acids. Representative amino acids within these various groups include, but are not limited to, (1) acidic (negatively charged) amino acids such as aspartic acid and glutamic acid; (2) basic (positively charged) amino acids such as arginine, histidine, and lysine; (3) neutral polar amino acids such as glycine, serine, threonine, cysteine, cystine, tyrosine, asparagine, and glutamine; and (4) neutral nonpolar (hydrophobic) amino acids such as alanine, leucine, isoleucine, valine, proline, phenylalanine, tryptophan, and methionine.

Conservative amino acid changes within the native polypeptides sequence can be made by substituting one amino acid within one of these groups with another amino acid within the same group. Biologically functional equivalents of the proteins or fragments thereof of the present invention can have 10 or fewer conservative amino acid changes, more preferably seven or fewer conservative amino acid changes, and most preferably five or fewer conservative amino acid changes. The encoding nucleotide sequence will thus have corresponding base substitutions, permitting it to encode biologically functional equivalent forms of the proteins or fragments of the present invention.

It is understood that certain amino acids may be substituted for other amino acids in a protein structure without appreciable loss of interactive binding capacity with structures such as, for example, antigent-binding regions of antibodies or binding sites on substrate molecules. Because it is the interactive capacity and nature of a protein that defines that protein's biological functional activity, certain amino acid sequence substitutions can be made in a protein sequence and, of course, its underlying DNA coding sequence and, nevertheless, obtain a protein with like properties. It is thus contemplated by the inventors that various changes may be made in the peptide sequences of the proteins or fragments of the present invention, or corresponding DNA sequences that encode said peptides, without appreciable loss of their biological utility or activity. It is understood that codons capable of coding for such amino acid changes are known in the art.

In making such changes, the hydropathic index of amino acids may be considered. The importance of the hydropathic amino acid index in conferring interactive biological function on a protein is generally understood in the art (Kyte and Doolittle, *J. Mol. Biol.* 157, 105-132 (1982), herein incorporated by reference in its entirety). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like.

Each amino acid has been assigned a hydropathic index on the basis of its hydrophobicity and charge characteristics (Kyte and Doolittle, 1982); these are isoleucine (+4.5), valine (+4.2), leucine (+3.8), phenylalanine (+2.8), cysteine/cystine (+2.5), methionine (+1.9), alanine (+1.8), glycine (−0.4), threonine (−0.7), serine (−0.8), tryptophan (−0.9), tyrosine (−1.3), proline (−1.6), histidine (−3.2), glutamate (−3.5), glutamine (−3.5), aspartate (−3.5), asparagine (−3.5), lysine (−3.9), and arginine (−4.5).

In making such changes, the substitution of amino acids whose hydropathic indices are within ±2 is preferred, those which are within ±1 are particularly preferred, and those within ±0.5 are even more particularly preferred.

It is also understood in the art that the substitution of like amino acids can be made effectively on the basis of hydrophilicity. U.S. Pat. No. 4,554,101, incorporated herein by reference in its entirety, states that the greatest local average hydrophilicity of a protein, as govern by the hydrophilicity of its adjacent amino acids, correlates with a biological property of the protein.

As detailed in U.S. Pat. No. 4,554,101, the following hydrophilicity values have been assigned to amino acid residues: arginine (+3.0), lysine (+3.0), aspartate (+3.0±1), glutamate (+3.0±1), serine (+0.3), asparagine (+0.2), glutamine (+0.2), glycine (0), threonine (−0.4), proline (−0.5±1), alanine (−0.5), histidine (−0.5), cysteine (−1.0), methionine (−1.3), valine (−1.5), leucine (−1.8), isoleucine (−1.8), tyrosine (−2.3), phenylalanine (−2.5), and tryptophan (−3.4).

In making such changes, the substitution of amino acids whose hydrophilicity values are within ±2 is preferred, those which are within ±1 are particularly preferred, and those within ±0.5 are even more particularly preferred.

In a further aspect of the present invention, one or more of the nucleic acid molecules of the present invention differ in nucleic acid sequence from those encoding a wheat protein or fragment thereof set forth in SEQ ID NO: 1 through SEQ ID NO: 8135 or fragment thereof due to the fact that one or more codons encoding an amino acid has been substituted for a codon that encodes a nonessential substitution of the amino acid originally encoded.

One aspect of the present invention concerns markers that include nucleic acid molecules SEQ ID NO: 1 through SEQ ID NO: 8135 or complements thereof or fragments of either that can act as markers or other nucleic acid molecules of the present invention that can act as markers. Genetic markers of the present invention include "dominant" or "codominant" markers "Codominant markers" reveal the presence of two or more alleles (two per diploid individual) at a locus. "Dominant markers" reveal the presence of only a single allele per locus. The presence of the dominant marker phenotype (e.g., a band of DNA) is an indication that one allele is present in either the homozygous or heterozygous condition. The absence of the dominant marker phenotype (e.g. absence of a DNA band) is merely evidence that "some other" undefined allele is present. In the case of populations where individuals are predominantly homozygous and loci are predominately dimorphic, dominant and codominant markers can be equally valuable. As populations become more heterozygous and multi-allelic, codominant markers often become more informative of the genotype than dominant markers. Marker molecules can be, for example, capable of detecting polymorphisms such as single nucleotide polymorphisms (SNPs).

SNPs are single base changes in genomic DNA sequence. They occur at greater frequency and are spaced with a greater uniformity throughout a genome than other reported forms of polymorphism. The greater frequency and uniformity of SNPs means that there is greater probability that such a polymorphism will be found near or in a genetic locus of interest than would be the case for other polymorphisms. SNPs are located in protein-coding regions and noncoding regions of a genome. Some of these SNPs may result in defective or variant protein expression (e.g., as a results of mutations or defective splicing). Analysis (genotyping) of characterized SNPs can require only a plus/minus assay rather than a lengthy measurement, permitting easier automation.

SNPs can be characterized using any of a variety of methods. Such methods include the direct or indirect sequencing of the site, the use of restriction enzymes (Botstein et al., *Am. J Hum. Genet.* 32:314-331 (1980), the entirety of which is herein incorporated reference; Konieczny and Ausubel, *Plant J.* 4:403-410 (1993), the entirety of which is herein incorporated by reference), enzymatic and chemical mismatch assays (Myers et al., *Nature* 313:495-498 (1985), the entirety of which is herein incorporated by reference), allele-specific PCR (Newton et al., *Nucl. Acids Res.* 17:2503-2516 (1989), the entirety of which is herein incorporated by reference; Wu et al., *Proc. Natl. Acad. Sci.* (U.S.A.) 86:2757-2760 (1989), the entirety of which is herein incorporated by reference), ligase chain reaction (Barany, *Proc. Natl. Acad. Sci.* (U.S.A.) 88:189-193 (1991), the entirety of which is herein incorporated by reference), single-strand conformation polymorphism analysis (Labrune et al., *Am. J. Hum. Genet.* 48: 1115-1120 (1991), the entirety of which is herein incorporated by reference), primer-directed nucleotide incorporation assays (Kuppuswami et al., *Proc. Natl. Acad. Sci. USA* 88:1143-1147 (1991), the entirety of which is herein incorporated by reference), dideoxy fingerprinting (Sarkar et al., *Genomics* 13:441-443 (1992), the entirety of which is herein incorporated by reference), solid-phase ELISA-based oligonucleotide ligation assays (Nikiforov et al., *Nucl. Acids Res.* 22:4167-4175 (1994), the entirety of which is herein incorporated by reference), oligonucleotide fluorescence-quenching assays (Livak et al., *PCR Methods Appl.* 4:357-362 (1995), the entirety of which is herein incorporated by reference), 5'-nuclease allele-specific hybridization TaqMan assay (Livak et al., *Nature Genet.* 9:341-342 (1995), the entirety of which is herein incorporated by reference), template-directed dye-terminator incorporation (TDI) assay (Chen and Kwok, *Nucl. Acids Res.* 25:347-353 (1997), the entirety of which is herein incorporated by reference), allele-specific molecular beacon assay (Tyagi et al., *Nature Biotech.* 16: 49-53 (1998), the entirety of which is herein incorporated by reference), PinPoint assay (Haff and Smirnov, *Genome Res.* 7: 378-388 (1997), the entirety of which is herein incorporated by reference) and dCAPS analysis (Neff et al., *Plant J.* 14:387-392 (1998), the entirety of which is herein incorporated by reference).

Additional markers, such as AFLP markers, RFLP markers and RAPD markers, can be utilized (Walton, *Seed World* 22-29 (July, 1993), the entirety of which is herein incorporated by reference; Burow and Blake, *Molecular Dissection of Complex Traits,* 13-29, Paterson (ed.), CRC Press, New York (1988), the entirety of which is herein incorporated by reference). DNA markers can be developed from nucleic acid molecules using restriction endonucleases, the PCR and/or DNA sequence information. RFLP markers result from single base changes or insertions/deletions. These codominant markers are highly abundant in plant genomes, have a medium level of polymorphism and are developed by a combination of restriction endonuclease digestion and Southern blotting hybridization. CAPS are similarly developed from restriction nuclease digestion but only of specific PCR products. These markers are also codominant, have a medium level of polymorphism and are highly abundant in the genome. The CAPS result from single base changes and insertions/deletions.

Another marker type, RAPDs, are developed from DNA amplification with random primers and result from single base changes and insertions/deletions in plant genomes. They are dominant markers with a medium level of polymorphisms and are highly abundant. AFLP markers require using the PCR on a subset of restriction fragments from extended adapter primers. These markers are both dominant and codominant are highly abundant in genomes and exhibit a medium level of polymorphism.

SSRs require DNA sequence information. These codominant markers result from repeat length changes, are highly polymorphic and do not exhibit as high a degree of abundance in the genome as CAPS, AFLPs and RAPDs, SNPs also require DNA sequence information. These codominant markers result from single base substitutions. They are highly abundant and exhibit a medium of polymorphism (Rafalski et al., In: *Nonmammalian Genomic Analysis*, Birren and Lai (ed.), Academic Press, San Diego, Calif., pp. 75-134 (1996), the entirety of which is herein incorporated by reference). It is understood that a nucleic acid molecule of the present invention may be used as a marker.

A PCR probe is a nucleic acid molecule capable of initiating a polymerase activity while in a double-stranded structure with another nucleic acid. Various methods for determining the structure of PCR probes and PCR techniques exist in the art. Computer generated searches using programs such as Primer3 (available on the world wide web at genome.wi.mit.edu/cgi-bin/primer/primer3.cgi), STSPipeline (available on the world wide web at genome.wi.mit.edu/cgi-bin/www-STS_Pipeline), or GeneUp (Pesole et al., *BioTechniques* 25:112-123 (1998) the entirety of which is herein incorporated by reference), for example, can be used to identify potential PCR primers.

It is understood that a fragment of one or more of the nucleic acid molecules of the present invention may be a probe and specifically a PCR probe.

(b) Protein and Peptide Molecules

A class of agents comprises one or more of the protein or peptide molecules encoded by SEQ ID NO: 1 through SEQ ID NO:8135 or one or more of the protein or fragment thereof or peptide molecules encoded by other nucleic acid agents of the present invention. As used herein, the term "protein molecule" or "peptide molecule" includes any molecule that comprises five or more amino acids. It is well know in the art that proteins may undergo modification, including post-translational modifications, such as, but not limited to, disulfide bond formation, glycosylation, phosphorylation, or oligomerization. Thus, as used herein, the term "protein molecule" or "peptide molecule" includes any protein molecule that is modified by any biological or non-biological process. The terms "amino acid" and "amino acids" refer to all naturally occurring L-amino acids. This definition is meant to include norleucine, ornithine, homocysteine, and homoserine.

One or more of the protein or fragment of peptide molecules may be produced via chemical synthesis, or more preferably, by expression in a suitable bacterial or eukaryotic host. Suitable methods for expression are described by Sambrook, et al., (In: *Molecular Cloning, A Laboratory Manual, 2nd Edition*, Cold Spring Harbor Press, Cold Spring Harbor, N.Y. (1989)), or similar texts.

A "protein fragment" is a peptide or polypeptide molecule whose amino acid sequence comprises a subset of the amino acid sequence of that protein. A protein or fragment thereof that comprises one or more additional peptide regions not derived from that protein is a "fusion" protein. Such molecules may be derivatized to contain carbohydrate or other moieties (such as keyhole limpet hemocyanin, etc.). Fusion protein or peptide molecule of the present invention are preferably produced via recombinant means.

Another class of agents comprise protein or peptide molecules encoded by SEQ ID NO: 1 through SEQ ID NO:8135 or complements thereof or, fragments or fusions thereof in which non-essential, or not relevant, amino acid residues have been added, replaced, or deleted. An example of such a homologue is the homologue protein of all non- wheat plant species, including but not limited to alfalfa, *Arabidopsis*, barley, *Brassica*, broccoli, cabbage, citrus, cotton, garlic, oat, oilseed rape, onion, canola, flax, maize, an ornamental plant, pea, peanut, pepper, potato, rice, rye, sorghum, soybean, strawberry, sugarcane, sugarbeet, tomato, poplar, pine, fir, eucalyptus, apple, lettuce, peas, lentils, grape, banana, tea, turf grasses, etc. Particularly preferred non-wheat plants to utilize for the isolation of homologues would include alfalfa, *Arabidopsis*, barley, cotton, corn, oat, oilseed rape, rice, canola, ornamentals, soybean, sugarcane, sugarbeet, tomato, potato, and turf grasses. Such a homologue can be obtained by any of a variety of methods. Most preferably, as indicated above, one or more of the disclosed sequences (SEQ ID NO: 1 through SEQ ID NO:8135 or complements thereof) will be used to define a pair of primers that may be used to isolate the homologue-encoding nucleic acid molecules from any desired species. Such molecules can be expressed to yield homologues by recombinant means.

(c) Antibodies

One aspect of the present invention concerns antibodies, single-chain antigen binding molecules, or other proteins that specifically bind to one or more of the protein or peptide molecules of the present invention and their homologues, fusions or fragments. Such antibodies may be used to quantitatively or qualitatively detect the protein or peptide molecules of the present invention. As used herein, an antibody or peptide is said to "specifically bind" to a protein or peptide molecule of the present invention if such binding is not competitively inhibited by the presence of non-related molecules.

Nucleic acid molecules that encode all or part of the protein of the present invention can be expressed, via recombinant means, to yield protein or peptides that can in turn be used to elicit antibodies that are capable of binding the expressed protein or peptide. Such antibodies may be used in immunoassays for that protein. Such protein-encoding molecules, or their fragments may be a "fusion" molecule (i.e., a part of a larger nucleic acid molecule) such that, upon expression, a fusion protein is produced. It is understood that any of the nucleic acid molecules of the present invention may be expressed, via recombinant means, to yield proteins or peptides encoded by these nucleic acid molecules.

The antibodies that specifically bind proteins and protein fragments of the present invention may be polyclonal or monoclonal, and may comprise intact immunoglobulins, or antigen binding portions of immunoglobulins (such as (F(ab'), F(ab')$_2$ fragments, or single-chain immunoglobulins producible, for example, via recombinant means). It is understood that practitioners are familiar with the standard resource materials which describe specific conditions and procedures for the construction, manipulation and isolation of antibodies (see, for example, Harlow and Lane, In Antibodies: *A Laboratory Manual*, Cold Spring Harbor Press, Cold Spring Harbor, N.Y. (1988), the entirety of which is herein incorporated by reference).

Murine monoclonal antibodies are particularly preferred. BALB/c mice are preferred for this purpose, however, equivalent strains may also be used. The animals are preferably immunized with approximately 25 µg of purified protein (or fragment thereof) that has been emulsified a suitable adjuvant (such as TiterMax adjuvant (Vaxcel, Norcross, Ga.)). Immunization is preferably conducted at two intramuscular sites, one intraperitoneal site, and one subcutaneous site at the base of the tail. An additional i.v. injection of approximately 25 µg of antigen is preferably given in normal saline three weeks later. After approximately 11 days following the second injection, the mice may be bled and the blood screened for the presence of anti-protein or peptide antibodies. Preferably, a direct binding Enzyme-Linked Immunoassay (ELISA) is employed for this purpose.

More preferably, the mouse having the highest antibody titer is given a third i.v. injection of approximately 25 µg of the same protein or fragment. The splenic leukocytes from this animal may be recovered 3 days later, and are then permitted to fuse, most preferably, using polyethylene glycol, with cells of a suitable myeloma cell line (such as, for example, the P3X63Ag8.653 myeloma cell line). Hybridoma cells are selected by culturing the cells under "HAT" (hypoxanthine-aminopterin-thymine) selection for about one week. The resulting clones may then be screened for their capacity to produce monoclonal antibodies ("mAbs), preferably by direct ELISA.

In one embodiment, anti-protein or peptide monoclonal antibodies are isolated using a fusion of a protein, protein fragment, or peptide of the present invention, or conjugate of a protein, protein fragment, or peptide of the present invention, as immunogens. Thus, for example, a group of mice can be immunized using a fusion protein emulsified in Freund's complete adjuvant (e.g. approximately 50 µg of antigen per immunization). At three week intervals, an identical amount of antigen is emulsified in Freund's incomplete adjuvant and used to immunize the animals. Ten days following the third immunization, serum samples are taken and evaluated for the presence of antibody. If antibody titers are too low, a fourth booster can be employed. Polysera capable of binding the protein or peptide can also be obtained using this method.

In a preferred procedure for obtaining monoclonal antibodies, the spleens of the above-described immunized mice are removed, disrupted, and immune splenocytes are isolated over a ficoll gradient. The isolated splenocytes are fused, using polyethylene glycol with BALB/c-derived HGPRT (hypoxanthine guanine phosphoribosyl transferase) deficient P3x63xAg8.653 plasmacytoma cells. The fused cells are plated into 96-well microtiter plates and screened for hybridoma fusion cells by their capacity to grow in culture medium supplemented with hypothanthine, aminopterin and thymidine for approximately 2-3 weeks.

Hybridoma cells that arise from such incubation are preferably screened for their capacity to produce an immunoglobulin that binds to a protein of interest. An indirect ELISA may be used for this purpose. In brief, the supernatants of hybridomas are incubated in microtiter wells that contain immobilized protein. After washing, the titer of bound immunoglobulin can be determined using, for example, a goat anti-mouse antibody conjugated to horseradish peroxidase. After additional washing, the amount of immobilized enzyme is determined (for example through the use of a chromogenic substrate). Such screening is performed as quickly as possible after the identification of the hybridoma in order to ensure that a desired clone is not overgrown by non-secreting neighbors. Desirably, the fusion plates are screened several times since the rates of hybridoma growth vary. In a preferred sub-embodiment, a different antigenic form of immunogen may be used to screen the hybridoma. Thus, for example, the splenocytes may be immunized with one immunogen, but the resulting hybridomas can be screened using a different immunogen. It is understood that any of the protein or peptide molecules of the present invention may be used to raise antibodies.

As discussed below, such antibody molecules or their fragments may be used for diagnostic purposes. Where the antibodies are intended for diagnostic purposes, it may be desirable to derivatize them, for example with a ligand group (such as biotin) or a detectable marker group (such as a fluorescent group, a radioisotope or an enzyme).

The ability to produce antibodies that bind the protein or peptide molecules of the present invention permits the identification of mimetic compounds of those molecules. A "mimetic compound" is a compound that is not that compound, or a fragment of that compound, but which nonetheless exhibits an ability to specifically bind to antibodies directed against that compound.

It is understood that any of the agents of the present invention can be substantially purified and/or be biologically active and/or recombinant.

Uses of the Agents of the Invention

The nucleic acid molecules and fragments thereof of the present invention from the cDNA library LIB3280 are prepared from *Triticum aestivum* anthers harvested from plants which reaches anthesis at the split boot stage. Libraries from this tissue can enable the acquisition of, including but not limited to genes involved in reproduction, pollen production and development, and pathogen resistance or susceptibility, therefore, the ESTs of the present invention will find great use in the isolation of a variety of agronomically significant genes, including but not limited to, non-regulatory genes and genes that regulate microsporogenesis, meiosis, cell cycle, signal transduction, cell-cell communication, carotenoids, floral biogenesis, embryogenesis, protein, amino acids, sterols, oils, minerals, isoflavones, saponins, vitamins, tocopherols, antinutrient components, carbohydrates, starch metabolism and seed composition and function. Such genes are associated with plant growth, quality and yield, and could also serve as links in important developmental, metabolic, and catabolic pathways. Libraries from this tissue can enable the acquisition of a variety of agronomically significant genes involved in the synthesis and catabolism of commercially important traits. The ESTs of the present invention also can enable the acquisition of promoters and cis-regulatory elements which will be useful to express agronomically significant genes in these tissues and/or other tissues. The ESTs of the present invention also can enable the acquisition of molecular markers, which can be used in, including but not limited to, breeding schemes, genetic and molecular mapping, and cloning of agronomically significant genes.

The nucleic acid molecules and fragments of the present invention from the cDNA library LIB3281 are isolated from *Triticum aestivum* floral reproductive tissue (gynoecium) harvested from plants which reaches anthesis at the split boot stage. Libraries from this tissue can enable acquisition of, including but not limited to, genes that are involved in reproduction, female production and development (ovary/ovule development), and pathogen resistance or susceptibility; therefore, the ESTs of the present invention will find great use in the isolation of a variety of agronomically significant genes and genes that regulate megasporogenesis, meiosis, cell cycle, signal transduction, cell-cell communication, carotenoids, floral biogenesis, embryogenesis, protein, amino acids, sterols, oils, minerals, isoflavones, saponins, vitamins, tocopherols, antinutrient components, carbohydrates, starch metabolism and seed composition and function. Such genes are associated with plant growth, quality, yield, and could also serve as links in important developmental, metabolic, and catabolic pathways. Libraries from this tissue can enable the acquisition of a variety of agronomically significant genes involved in the synthesis and catabolism of commercially important traits. The ESTs of the present invention also can enable the acquisition of promoters and cis-regulatory elements which will be useful to express agronomically significant genes in these tissues and/or other tissues. The ESTs of the present invention also can enable the acquisition of molecular markers, which can be used in, including but not limited to, breeding schemes, genetic and molecular mapping, and cloning of agronomically significant genes.

Nucleic acid molecules and fragments thereof of the present invention may be employed to obtain other nucleic acid molecules. Such molecules include the nucleic acid molecules of other plants or other organisms (e.g., alfalfa, rice, potato, cotton, oat, rye, barley, maize, soybean, *Arabidopsis, Brassica*, etc.) including the nucleic acid molecules that encode, in whole or in part, protein homologues of other plant species or other organisms, and sequences of genetic elements such as promoters and transcriptional regulatory elements. Such molecules can be readily obtained by using the above-described nucleic acid molecules or fragments thereof to screen cDNA or genomic libraries obtained from such plant species. Methods for forming such libraries are well known in the art. Such homologue molecules may differ in their nucleotide sequences from those found in one or more of SEQ ID NO:1 through SEQ ID NO:8135 or complements thereof because complete complementarity is not needed for stable hybridization. The nucleic acid molecules of the present invention therefore also include molecules that, although capable of specifically hybridizing with the nucleic acid molecules may lack "complete complementarity."

Any of a variety of methods may be used to obtain one or more of the above-described nucleic acid molecules (Zamechik et al., *Proc. Natl. Acad. Sci.* (U.S.A.) 83:4143-4146 (1986), the entirety of which is herein incorporated by reference; Goodchild et al., *Proc. Natl. Acad Sci.* (U.S.A.) 85:5507-5511 (1988), the entirety of which is herein incorporated by reference; Wickstrom et al., *Proc. Natl. Acad. Sci. (U.S.A.)* 85:1028-1032 (1988), the entirety of which is herein incorporated by reference; Holt, et al., *Molec. Cell. Biol.* 8:963-973 (1988), the entirety of which is herein incorporated by reference; Gerwirtz, et al., *Science* 242:1303-1306 (1988), the entirety of which is herein incorporated by reference; Anfossi, et al., *Proc. Natl. Acad. Sci.* (U.S.A.) 86:337-3383 (1989), the entirety of which is herein incorporated by reference; Becker, et al., *EMBO J.* 8:3685-3691 (1989); the entirety of which is herein incorporated by reference). Automated nucleic acid synthesizers may be employed for this purpose. In lieu of such synthesis, the disclosed nucleic acid molecules may be used to define a pair of primers that can be used with the polymerase chain reaction (Mullis, et al., *Cold Spring Harbor Symp. Quant. Biol.* 51:263-273 (1986); Erlich et al., EP 50,424; EP 84,796, EP 258,017, EP 237,362; Mullis, EP 201,184; Mullis et al., U.S. Pat. No. 4,683,202; Erlich, U.S. Pat. No. 4,582,788; and Saiki, R. et al., U.S. Pat. No. 4,683,194, all of which are hereby incorporated by reference in their entirety) to amplify and obtain any desired nucleic acid molecule or fragment.

Promoter sequence(s) and other genetic elements including but not limited to transcriptional regulatory elements associated with one or more of the disclosed nucleic acid sequences can also be obtained using the disclosed nucleic acid sequences provided herein.

In one embodiment, such sequences are obtained by incubating EST nucleic acid molecules or preferably fragments thereof with members of genomic libraries (e.g. maize, cotton, soybean and wheat) and recovering clones that hybridize to the EST nucleic acid molecule or fragment thereof. In a second embodiment, methods of "chromosome walking," or inverse PCR may be used to obtain such sequences (Frohman, et al., *Proc. Natl. Acad. Sci.* (U.S.A.) 85:8998-9002 (1988); Ohara, et al., *Proc. Natl. Acad. Sci.* (U.S.A.) 86: 5673-5677 (1989); Pang et al., *Biotechniques,* 22(6); 1046-1048 (1977); Huang et al., *Methods Mol. Biol.* 69: 89-96 (1977); Hartl et al., *Methods Mol. Biol.* 58: 293-301 (1996), all of which are hereby incorporated by reference in their entirety). In one embodiment, the disclosed nucleic acid molecules are used to identify cDNAs whose analogous genes contain promoters with desirable expression patterns. The nucleic acid molecules isolated from the library of the present invention are used to isolate promoters of tissue-enhanced, tissue-specific, developmentally- or environmentally-regulated expression profiles. Isolation and functional analysis of the 5' flanking promoter sequences of these genes from genomic libraries, for example, using genomic screening methods and PCR techniques would result in the isolation of useful promoters and transcriptional regulatory elements. These methods are known to those of skill in the art and have been described (See for example Birren et al., *Genome Analysis:Analyzing DNA,* 1, (1997), Cold Spring Harbor Laboratory Press, Cold Spring Harbor, N.Y., the entirety of which is herein incorporated by reference).

Promoters obtained utilizing the nucleic acid molecules of the present invention could also be modified to affect their control characteristics. Examples of such modifications would include but are not limited to enhancer sequences as reported by Kay et al., *Science* 236:1299 (1987), herein incorporated by reference in its entirety. Such genetic elements could be used to enhance gene expression of new and existing traits for crop improvements.

The nucleic acid molecules of the present invention may be used to isolate promoters of tissue enhanced. tissue specific, cell-specific, cell-type, developmentally or environmentally regulated expression profiles. Isolation and functional analysis of the 5' flanking promoter sequences of these genes from genomic libraries, for example, using genomic screening methods and PCR techniques would result in the isolation of useful promoters and transcriptional regulatory elements. These methods are known to those of skill in the art and have been described (See, for example, Birren et. al., *Genome Analysis: Analyzing DNA,* 1, Cold Spring Harbor Laboratory Press, Cold Spring Harbor, N.Y. (1997), the entirety of which is herein incorporated by reference). Promoters obtained utilizing the nucleic acid molecules of the present invention could also be modified to affect their control characteristics. Examples of such modifications would include but are not limited to enhancer sequences as reported by Kay, et al *Science* 236:1299 (1987), herein incorporated reference in its entirety. Such genetic elements could be used to enhance gene expression of new and existing traits for crop improvements.

In an aspect of the present invention, one or more of the nucleic molecules of the present invention are used to determine whether a plant (preferably wheat) has a mutation affecting the level (i.e., the concentration of mRNA in a sample, etc.) or pattern (i.e., the kinetics of expression, rate of decomposition, stability profile, etc.) of the expression encoded in part or whole by one or more of the nucleic acid molecules of the present invention (collectively, the "Expression Response" of a cell or tissue). As used herein, the Expression Response manifested by a cell or tissue is said to be "altered" if it differs from the Expression Response of cells or tissues of plants not exhibiting the phenotype. To determine whether a Expression Response is altered, the Expression Response manifested by the cell or tissue of the plant exhibiting the phenotype is compared with that of a similar cell or tissue sample of a plant not exhibiting the phenotype. As will be appreciated, it is not necessary to re-determine the Expression Response of the cell or tissue sample of plants not exhibiting the phenotype each time such a comparison is made; rather, the Expression Response of a particular plant may be compared with previously obtained values of normal plants. As used herein, the phenotype of the organism is any of one or more characteristics of an organism (e.g. disease resistance, pest tolerance, environmental tolerance, male sterility, yield, quality improvements, etc.). A change in genotype or phenotype may be transient or permanent. Also as used herein, a tissue sample is any sample that comprises more than one cell. In a preferred aspect, a tissue sample comprises cells that share a common characteristic (e.g. derived from leaf, root, or pollen etc).

In one sub-aspect, such an analysis is conducted by determining the presence and/or identity of polymorphism(s) by one or more of the nucleic acid molecules of the present invention and more specifically, one or more of the EST nucleic acid molecules or fragments thereof which are associated with phenotype, or a predisposition to phenotype.

Any of a variety of molecules can be used to identify such polymorphism(s). In one embodiment, one or more of the EST nucleic acid molecules (or a sub-fragment thereof) may be employed as a marker nucleic acid molecule to identify such polymorphism(s). Alternatively, such polymorphisms can be detected through the use of a marker nucleic acid molecule or a marker protein that is genetically linked to (i.e., a polynucleotide that co-segregates with) such polymorphism(s).

In an alternative embodiment, such polymorphisms can be detected through the use of a marker nucleic acid molecule that is physically linked to such polymorphism(s). For this purpose, marker nucleic acid molecules comprising a nucleotide sequence of a polynucleotide located within 1 mb of the polymorphism(s), and more preferably within 100 kb of the polymorphism(s), and most preferably within 10 kb of the polymorphism(s) can be employed.

The genomes of animals and plants naturally undergo spontaneous mutation in the course of their continuing evolution (Gusella, *Ann. Rev. Biochem.* 55:831-854 (1986)). A "polymorphism" is a variation or difference in the sequence of the gene or its flanking regions that arises in some of the members of a species. The variant sequence and the "original" sequence co-exist in the species' population. In some instances, such co-existence is in stable or quasi-stable equilibrium.

A polymorphism is thus said to be "allelic," in that, due to the existence of the polymorphism, some members of a species may have the original sequence (i.e., the original "allele") whereas other members may have the variant sequence (i.e., the variant "allele"). In the simplest case, only one variant sequence may exist, and the polymorphism is thus said to be di-allelic. In other cases, the species' population may contain multiple alleles, and the polymorphism is termed tri-allelic, etc. A single gene may have multiple different unrelated polymorphisms. For example, it may have a di-allelic polymorphism at one site, and a multi-allelic polymorphism at another site.

The variation that defines the polymorphism may range from a single nucleotide variation to the insertion or deletion of extended regions within a gene. In some cases, the DNA sequence variations are in regions of the genome that are characterized by short tandem repeats (STRs) that include tandem di- or tri-nucleotide repeated motifs of nucleotides. Polymorphisms characterized by such tandem repeats are referred to as "variable number tandem repeat" ("NTR") polymorphisms. VNTRs have been used in identity analysis (Weber, U.S. Pat. No. 5,075,217; Armour, et al., *FEBS Lett.* 307:113-115 (1992); Jones, et al., *Eur. J. Haematol.* 39:144-147 (1987); Horn, et al., PCT Application WO91/14003; Jeffreys, European Patent Application 370,719; Jeffreys, U.S. Pat. No. 5,699,082; Jeffreys. et al., Amer. *J. Hum. Genet.* 39:11-24 (1986); Jeffreys. et al., *Nature* 316:76-79 (1985); Gray, et al., *Proc. R. Acad Soc. Lond.* 243:241-253 (1991); Moore, et al., *Genomics* 10:654-660 (1991); Jeffreys, et al., *Anim. Genet.* 18:1-15 (1987); Hillel, et al., *Anim. Genet.* 20:145-155 (1989); Hillel, et al., *Genet.* 124:783-789 (1990), all of which are herein incorporated by reference in their entirety).

The detection of polymorphic sites in a sample of DNA may be facilitated through the use of nucleic acid amplification methods. Such methods specifically increase the concentration of polynucleotides that span the polymorphic site, or include that site and sequences located either distal or proximal to it. Such amplified molecules can be readily detected by gel electrophoresis or other means.

The most preferred method of achieving such amplification employs the polymerase chain reaction ("PCR") (Mullis, et al., *Cold Spring Harbor Symp. Quant. Biol.* 51:263-273 (1986); Erlich, et al., European Patent Appln. 50,424; European Patent Appln. 84,796, European Patent Application 258, 017, European Patent Appln. 237,362; Mullis, European Patent Appln. 201,184; Mullis, et al., U.S. Pat. No. 4,683,202; Erlich., U.S. Pat. No. 4,582,788; and Saiki, et al., U.S. Pat. No. 4,683,194, all of which are herein incorporated by reference), using primer pairs that are capable of hybridizing to the proximal sequences that define a polymorphism in its double-stranded form.

In lieu of PCR, alternative methods, such as the "Ligase Chain Reaction" ("LCR") may be used (Barany, *Proc. Natl. Acad. Sci.* (U.S.A.) 88:189-193 (1991), the entirety of which is herein incorporated by reference). LCR uses two pairs of oligonucleotide probes to exponentially amplify a specific target. The sequences of each pair of oligonucleotides is selected to permit the pair to hybridize to abutting sequences of the same strand of the target. Such hybridization forms a substrate for a template-dependent ligase. As with PCR, the resulting products thus serve as a template in subsequent cycles and an exponential amplification of the desired sequence is obtained.

LCR can be performed with oligonucleotides having the proximal and distal sequences of the same strand of a polymorphic site. In one embodiment, either oligonucleotide will be designed to include the actual polymorphic site of the polymorphism. In such an embodiment, the reaction conditions are selected such that the oligonucleotides can be ligated together only if the target molecule either contains or lacks the specific nucleotide that is complementary to the polymorphic site present on the oligonucleotide. Alternatively, the oligonucleotides may be selected such that they do not include the polymorphic site (see, Segev, PCT Application WO 90/01069, the entirety of which is herein incorporated by reference).

The "Oligonucleotide Ligation Assay" ("OLA") may alternatively be employed (Landegren, et al., *Science* 241:1077-1080 (1988), the entirety of which is herein incorporated by reference). The OLA protocol uses two oligonucleotides which are designed to be capable of hybridizing to abutting sequences of a single strand of a target. OLA, like LCR, is particularly suited for the detection of point mutations. Unlike LCR, however, OLA results in "linear" rather than exponential amplification of the target sequence.

Nickerson, et al. have described a nucleic acid detection assay that combines attributes of PCR and OLA (Nickerson, et al., *Proc. Natl. Acad. Sci.* (U.S.A.) 87:8923-8927 (1990), the entirety of which is herein incorporated by reference). In this method, PCR is used to achieve the exponential amplification of target DNA, which is then detected using OLA. In addition to requiring multiple, and separate, processing steps, one problem associated with such combinations is that they inherit all of the problems associated with PCR and OLA.

Schemes based on ligation of two (or more) oligonucleotides in the presence of nucleic acid having the sequence of the resulting "di-oligonucleotide", thereby amplifying the di-oligonucleotide, are also known (Wu, et al., *Genomics* 4:560 (1989), the entirety of which is herein incorporated by reference), and may be readily adapted to the purposes of the present invention.

Other known nucleic acid amplification procedures, such as allele-specific oligomers, branched DNA technology, transcription-based amplification systems, or isothermal amplification methods may also be used to amplify and analyze such polymorphisms (Malek, et al., U.S. Pat. No. 5,130,238; Davey, et al., European Patent Application 329,822; Schuster et al., U.S. Pat. No. 5,169,766; Miller, et al., PCT Application WO 89/06700; Kwoh, et al., *Proc. Natl. Acad. Sci.* (U.S.A.) 86:1173-1177 (1989); Gingeras, et al., PCT Application WO 88/10315; Walker, et al., *Proc. Natl. Acad. Sci.* (U.S.A.) 89:392-396 (1992), all of which are herein incorporated by reference in their entirety).

The identification of a polymorphism can be determined in a variety of ways. By correlating the presence or absence of it in a plant with the presence or absence of a phenotype, it is possible to predict the phenotype of that plant. If a polymorphism creates or destroys a restriction endonuclease cleavage site, or if it results in the loss or insertion of DNA (e.g., a VNTR polymorphism), it will alter the size or profile of the DNA fragments that are generated by digestion with that restriction endonuclease. As such, individuals that possess a variant sequence can be distinguished from those having the original sequence by restriction fragment analysis. Polymorphisms that can be identified in this manner are termed "restriction fragment length polymorphisms" ("RFLPs"). RFLPs have been widely used in human and plant genetic analyses (Glassberg, UK Patent Application 2135774; Skolnick, et al., Cytogen. *Cell Genet.* 32:58-67 (1982); Botstein, et al., *Ann. J Hum. Genet.* 32:314-331 (1980); Fischer, et al. (PCT Application WO90/13668); Uhlen, PCT Application WO90/11369).

Polymorphisms can also be identified by Single Strand Conformation Polymorphism (SSCP) analysis. The SSCP technique is a method capable of identifying most sequence variations in a single strand of DNA, typically between 150 and 250 nucleotides in length (Elles, *Methods in Molecular Medicine: Molecular Diagnosis of Genetic Diseases*, Humana Press (1996), the entirety of which is herein incorporated by reference); Orita et al., *Genomics* 5: 874-879 (1989), the entirety of which is herein incorporated by reference). Under denaturing conditions a single strand of DNA will adopt a conformation that is uniquely dependent on its sequence conformation. This conformation usually will be different, even if only a single base is changed. Most conformations have been reported to alter the physical configuration or size sufficiently to be detectable by electrophoresis. A number of protocols have been described for SSCP including, but not limited to Lee et al., *Anal. Biochem.* 205: 289-293 (1992), the entirety of which is herein incorporated by reference; Suzuki et al., *Anal. Biochem.* 192: 82-84 (1991), the entirety of which is herein incorporated by reference; Lo et al., *Nucleic Acids Research* 20: 1005-1009 (1992), the entirety of which is herein incorporated by reference; Sarkar et al., *Genomics* 13: 441-443 (1992), the entirety of which is herein incorporated by reference). It is understood that one or more of the nucleic acids of the present invention, may be utilized as markers or probes to detect polymorphisms by SSCP analysis.

Polymorphisms may also be found using a DNA fingerprinting technique called amplified fragment length polymorphism (AFLP), which is based on the selective PCR amplification of restriction fragments from a total digest of genomic DNA to profile that DNA. Vos, et al., *Nucleic Acids Res.* 23:4407-4414 (1995), the entirety of which is herein incorporated by reference. This method allows for the specific co-amplification of high numbers of restriction fragments, which can be visualized by PCR without knowledge of the nucleic acid sequence.

AFLP employs basically three steps. Initially, a sample of genomic DNA is cut with restriction enzymes and oligonucleotide adapters are ligated to the restriction fragments of the DNA. The restriction fragments are then amplified using PCR by using the adapter and restriction sequence as target sites for primer annealing. The selective amplification is achieved by the use of primers that extend into the restriction fragments, amplifying only those fragments in which the primer extensions match the nucleotide flanking the restriction sites. These amplified fragments are then visualized on a denaturing polyacrylamide gel.

AFLP analysis has been performed on Salix (Beismann, et al., *Mol. Ecol.* 6:989-993 (1997), the entirety of which is herein incorporated by reference); *Acinetobacter* (Janssen, et al., *Int. J. Syst. Bacteriol* 47:1179-1187 (1997), the entirety of which is herein incorporated by reference), *Aeromonas popoffi* (Huys, et al., *Int. J. Syst. Bacteriol.* 47:1165-1171 (1997), the entirety of which is herein incorporated by reference), rice (McCouch, et al., *Plant Mol. Biol.* 35:89-99 (1997), the entirety of which is herein incorporated by reference); Nandi, et al., *Mol. Gen. Genet.* 255:1-8 (1997); Cho, et al., *Genome* 39:373-378 (1996), herein incorporated by reference), barley (*Hordeum vulgare*)(Simons, et al., *Genomics* 44:61-70 (1997), the entirety of which is herein incorporated by reference; Waugh, et al., *Mol. Gen. Genet.* 255:311-321 (1997), the entirety of which is herein incorporated by reference; Qi, et al., *Mol. Gen Genet.* 254:330-336 (1997), the entirety of which is herein incorporated by reference; Becker, et al., *Mol. Gen. Genet.* 249:65-73 (1995), the entirety of which is herein incorporated by reference), potato (Van der Voort, et al., *Mol. Gen. Genet.* 255:438-447 (1997), the entirety of which is herein incorporated by reference; Meksem, et al., *Mol. Gen. Genet.* 249:74-81 (1995), the entirety of which is herein incorporated by reference), *Phytophthora infestans* (Van der Lee, et al., *Fungal Genet. Biol.* 21:278-291 (1997), the entirety of which is herein incorporated by reference), *Bacillus anthracis* (Keim, et al., *J. Bacteriol.* 179:818-824 (1997)), *Astragalus cremnophylax* (Travis, et al., *Mol. Ecol.* 5:735-745 (1996), the entirety of which is herein incorporated by reference), *Arabidopsis* (Cnops, et al., *Mol. Gen. Genet.* 253:32-41 (1996), the entirety of which is herein incorporated by reference), *Escherichia coli* (Lin, et al., *Nucleic Acids Res.* 24:3649-3650 (1996), the entirety of which is herein incorporated by reference), *Aeromonas* (Huys, et al., *Int. J. Syst. Bacteriol.* 46:572-580 (1996), the entirety of which is herein incorporated by reference), nematode (Folkertsma, et al., *Mol. Plant Microbe Interact.* 9:47-54 (1996), the entirety of which is herein incorporated by reference), tomato (Thomas, et al., *Plant J.* 8:785-794 (1995), the entirety of which is herein incorporated by reference), and human (Latorra, et al., *PCR Methods Appl.* 3:351-358 (1994)). AFLP analysis has also been used for fingerprinting mRNA (Money, et al., *Nucleic Acids Res.* 24:2616-2617 (1996), the entirety of which is herein incorporated by reference; Bachem, et al., *Plant J.* 9:745-753 (1996), the entirety of which is herein incorporated by reference). It is understood that one or more of the nucleic acids of the present invention, may be utilized as markers or probes to detect polymorphisms by AFLP analysis for fingerprinting mRNA.

Polymorphisms may also be found using random amplified polymorphic DNA (RAPD) (Williams et al., *Nucl. Acids Res.* 18: 6531-6535 (1990), the entirety of which is herein incorporated by reference) and cleavable amplified polymorphic sequences (CAPS) (Lyamichev et al., *Science* 260: 778-783 (1993), the entirety of which is herein incorporated by reference). It is understood that one or more of the nucleic acids of the present invention, may be utilized as markers or probes to detect polymorphisms by RAPD or CAPS analysis.

Polymorphisms are useful, through linkage analysis, to define the genetic distances or physical distances between polymorphic traits. A physical map or ordered array of genomic DNA fragments in the desired region containing the gene may be used to characterize and isolate genes corresponding to desirable traits. For this purpose, yeast artificial chromosomes (YACs), bacterial artificial chromosomes (BACs), and cosmids are appropriate vectors for cloning large segments of DNA molecules. Although fewer clones are needed to make a contig for a specific genomic region by using YACs (Agyare et al., *Genome Res.* 7: 1-9 (1997), the entirety of which is herein incorporated by reference; James et al., *Genomics* 32: 425-430 (1996), the entirety of which is herein incorporated by reference), chimerism in the inserted DNA fragment can arise. Cosmids are convenient for handling smaller-size DNA molecules and may be used for transformation in developing transgenic plants. BACs also carry DNA fragments and are less prone to chimerism.

Through genetic mapping, a fine scale linkage map can be developed using DNA markers and, then, a genomic DNA library of large-sized fragments can be screened with molecular markers linked to the desired trait. Molecular markers are advantageous for agronomic traits that are otherwise difficult to tag, such as resistance to pathogens, insects and nematodes, tolerance to abiotic stress, quality parameters and quantitative traits such as high yield potential.

The essential requirements for marker-assisted selection in a plant breeding program are: (1) the marker(s) should co-segregate or be closely linked with the desired trait; (2) an efficient means of screening large populations for the molecular marker(s) should be available; and (3) the screening technique should have high reproducibility across laboratories and preferably be economical to use and be user-friendly.

The genetic linkage of marker molecules can be established by a gene mapping model such as, without limitation, the flanking marker model reported by Lander and Botstein, *Genetics* 121:185-199 (1989) and the interval mapping, based on maximum likelihood methods described by Lander and Botstein, *Genetics* 121:185-199 (1989) and implemented in the software package MAPMAKER/QTL (Lincoln and Lander, *Mapping Genes Controlling Quantitative Traits Using MAPMAKER/QTL*, Whitehead Institute for Biomedical Research, Mass., (1990). Additional software includes Qgene, Version 2.23 (1996), Department of Plant Breeding and Biometry, 266 Emerson Hall, Cornell University, Ithaca, N.Y., the manual of which is herein incorporated by reference in its entirety). Use of Qgene software is a particularly preferred approach.

A maximum likelihood estimate (MLE) for the presence of a marker is calculated, together with an MLE assuming no QTL effect, to avoid false positives. A $\log_{10}$ of an odds ratio (LOD) is then calculated as: LOD=$\log_{10}$ (MLE for the presence of a QTL/MLE given no linked QTL).

The LOD score essentially indicates how much more likely the data are to have arisen assuming the presence of a QTL than in its absence. The LOD threshold value for avoiding a false positive with a given confidence, say 95%, depends on the number of markers and the length of the genome. Graphs indicating LOD thresholds are set forth in Lander and Botstein, *Genetics* 121:185-199 (1989) the entirety of which is herein incorporated by reference and further described by Arús and Moreno-González, *Plant Breeding*, Hayward et al., (eds.) Chapman & Hall, London, pp. 314-331 (1993), the entirety of which is herein incorporated by reference.

Additional models can be used. Many modifications and alternative approaches to interval mapping have been reported, including the use of non-parametric methods (Kruglyak and Lander, *Genetics* 139:1421-1428 (1995), the entirety of which is herein incorporated by reference). Multiple regression methods or models can be also be used, in which the trait is regressed on a large number of markers (Jansen, *Biometrics in Plant Breeding*, van Oijen and Jansen (eds.), Proceedings of the Ninth Meeting of the Eucarpia Section Biometrics in Plant Breeding, The Netherlands, pp. 116-124 (1994); Weber and Wricke, *Advances in Plant Breeding*, Blackwell, Berlin, 16 (1994), both of which is herein incorporated by reference in their entirety). Procedures combining interval mapping with regression analysis, whereby the phenotype is regressed onto a single putative QTL at a given marker interval and at the same time onto a number of markers that serve as 'cofactors,' have been reported by Jansen and Stam, *Genetics* 136:1447-1455 (1994), the entirety of which is herein incorporated by reference and Zeng, *Genetics* 136:1457-1468 (1994) the entirety of which is herein incorporated by reference. Generally, the use of cofactors reduces the bias and sampling error of the estimated QTL positions (Utz and Melchinger, *Biometrics in Plant Breeding*, van Oijen and Jansen (eds.) Proceedings of the Ninth Meeting of the Eucarpia Section Biometrics in Plant Breeding, The Netherlands, pp.195-204 (1994), the entirety of which is herein incorporated by reference, thereby improving the precision and efficiency of QTL mapping (Zeng, *Genetics* 136:1457-1468 (1994)). These models can be extended to multi-environment experiments to analyze genotype-environment interactions (Jansen et al., *Theo. Appl. Genet.* 91:33-37 (1995), the entirety of which is herein incorporated by reference).

Selection of an appropriate mapping population is important to map construction. The choice of an appropriate mapping population depends on the type of marker systems employed (Tanksley et al., *Molecular mapping plant chromosomes. Chromosome structure and function: Impact of new concepts*, Gustafson and Appels (eds.), Plenum Press, New York, pp 157-173 (1988), the entirety of which is herein incorporated by reference). Consideration must be given to the source of parents (adapted vs. exotic) used in the mapping population. Chromosome pairing and recombination rates can be severely disturbed (suppressed) in wide crosses (adapted x exotic) and generally yield greatly reduced linkage distances. Wide crosses will usually provide segregating populations with a relatively large array of polymorphisms when compared to progeny in a narrow cross (adapted x adapted).

An $F_2$ population is the first generation of selfing after the hybrid seed is produced. Usually a single $F_1$ plant is selfed to generate a population segregating for all the genes in Mendelian (1:2:1) fashion. Maximum genetic information is obtained from a completely classified $F_2$ population using a codominant marker system (Mather, *Measurement of Linkage in Heredity*, Methuen and Co., (1938), the entirety of which is herein incorporated by reference). In the case of dominant markers, progeny tests (e.g. $F_3$, $BCF_2$) are required to identify the heterozygotes, thus making it equivalent to a completely classified $F_2$ population. However, this procedure is often prohibitive because of the cost and time involved in progeny testing. Progeny testing of $F_2$ individuals is often used in map construction where phenotypes do not consistently reflect genotype (e.g. disease resistance) or where trait expression is controlled by a QTL. Segregation data from progeny test populations (e.g. $F_3$ or $BCF_2$) can be used in map construction. Marker-assisted selection can then be applied to cross progeny based on marker-trait map associations ($F_2$, $F_3$), where linkage groups have not been completely disassociated by recombination events (i.e., maximum disequilibrium).

Recombinant inbred lines (RIL) (genetically related lines; usually >$F_5$, developed from continuously selfing $F_2$ lines towards homozygosity) can be used as a mapping population. Information obtained from dominant markers can be maximized by using RIL because all loci are homozygous or nearly so. Under conditions of tight linkage (i.e., about <10% recombination), dominant and co-dominant markers evaluated in RIL populations provide more information per individual than either marker type in backcross populations (Reiter et al., *Proc. Natl. Acad. Sci.* (U.S.A.) 89:1477-1481 (1992), the entirety of which is herein incorporated by reference). However, as the distance between markers becomes larger (i.e., loci become more independent), the information in RIL populations decreases dramatically when compared to codominant markers.

Backcross populations (e.g., generated from a cross between a successful variety (recurrent parent) and another variety (donor parent) carrying a trait not present in the former) can be utilized as a mapping population. A series of backcrosses to the recurrent parent can be made to recover most of its desirable traits. Thus a population is created consisting of individuals nearly like the recurrent parent but each individual carries varying amounts or mosaic of genomic regions from the donor parent. Backcross populations can be useful for mapping dominant markers if all loci in the recurrent parent are homozygous and the donor and recurrent parent have contrasting polymorphic marker alleles (Reiter et al., *Proc. Natl. Acad. Sci.* (U.S.A.) 89:1477-1481 (1992)). Information obtained from backcross populations using either codominant or dominant markers is less than that obtained from $F_2$ populations because one, rather than two, recombinant gametes are sampled per plant. Backcross populations, however, are more informative (at low marker saturation) when compared to RILs as the distance between linked loci increases in RIL populations (i.e. about 15% recombination). Increased recombination can be beneficial for resolution of tight linkages, but may be undesirable in the construction of maps with low marker saturation.

Near-isogenic lines (NIL) created by many backcrosses to produce an array of individuals that are nearly identical in genetic composition except for the trait or genomic region under interrogation can be used as a mapping population. In mapping with NILs, only a portion of the polymorphic loci are expected to map to a selected region.

Bulk segregant analysis (BSA) is a method developed for the rapid identification of linkage between markers and traits of interest (Michelmore et al., *Proc. Natl. Acad. Sci.* (U.S.A.) 88:9828-9832 (1991), the entirety of which is herein incorporated by reference). In BSA, two bulked DNA samples are drawn from a segregating population originating from a single cross. These bulks contain individuals that are identical for a particular trait (resistant or susceptible to particular disease) or genomic region but arbitrary at unlinked regions (i.e. heterozygous). Regions unlinked to the target region will not differ between the bulked samples of many individuals in BSA.

It is understood that one or more of the nucleic acid molecules of the present invention may be used as molecular markers. It is also understood that one or more of the protein molecules of the present invention may be used as molecular markers.

In accordance with this aspect of the present invention, a sample nucleic acid is obtained from plants cells or tissues. Any source of nucleic acid may be used. Preferably, the nucleic acid is genomic DNA. The nucleic acid is subjected to restriction endonuclease digestion. For example, one or more EST nucleic acid molecule or fragment thereof can be used as a probe in accordance with the above-described polymorphic methods. The polymorphism obtained in this approach can then be cloned to identify the mutation at the coding region which alters the protein's structure or regulatory region of the gene which affects its expression level.

In one aspect of the present invention, an evaluation can be conducted to determine whether a particular mRNA molecule is present. One or more of the nucleic acid molecules of the present invention, preferably one or more of the EST nucleic acid molecules of the present invention are utilized to detect the presence or quantity of the mRNA species. Such molecules are then incubated with cell or tissue extracts of a plant under conditions sufficient to permit nucleic acid hybridization. The detection of double-stranded probe-mRNA hybrid molecules is indicative of the presence of the mRNA; the amount of such hybrid formed is proportional to the amount of mRNA. Thus, such probes may be used to ascertain the level and extent of the mRNA production in a plant's cells or tissues. Such nucleic acid hybridization may be conducted under quantitative conditions (thereby providing a numerical value of the amount of the mRNA present). Alternatively, the assay may be conducted as a qualitative assay that indicates either that the mRNA is present, or that its level exceeds a user set, predefined value.

A principle of in situ hybridization is that a labeled, single-stranded nucleic acid probe will hybridize to a complementary strand of cellular DNA or RNA and, under the appropriate conditions, these molecules will form a stable hybrid. When nucleic acid hybridization is combined with histological techniques, specific DNA or RNA sequences can be identified within a single cell. An advantage of in situ hybridization over more conventional techniques for the detection of nucleic acids is that it allows an investigator to determine the precise spatial population (Angerer et al., *Dev. Biol.* 101: 477-484 (1984), the entirety of which is herein incorporated by reference; Angerer et al., *Dev. Biol.* 112: 157-166 (1985), the entirety of which is herein incorporated by reference; Dixon et al., *EMBO J.* 10: 1317-1324 (1991), the entirety of which is herein incorporated by reference). In situ hybridization may be used to measure the steady-state level of RNA accumulation. It is a sensitive technique and RNA sequences present in as few as 5-10 copies per cell can be detected (Hardin et al., *J. Mol. Biol.* 202: 417-431.(1989), the entirety of which is herein incorporated by reference). A number of protocols have been devised for in situ hybridization, each with tissue preparation, hybridization, and washing conditions (Meyerowitz, *Plant. Mol Biol. Rep.* 5: 242-250 (1987), the entirety of which is herein incorporated by reference; Cox and Goldberg, In: *Plant Molecular Biology: A Practical Approach* (ed. C. H. Shaw), pp. 1-35. IRL Press, Oxford (1988), the entirety of which is herein incorporated by reference; Raikhel et al., *In situ RNA hybridization in plant tissues*. In *Plant Molecular Biology Manual*, vol. B9: 1-32. Kluwer Academic Publisher, Dordrecht, Belgium (1989), the entirety of which is herein incorporated by reference).

In situ hybridization also allows for the localization of proteins within a tissue or cell (Wilkinson, *In Situ Hybridization*, Oxford University Press, Oxford (1992), the entirety of which is herein incorporated by reference; Langdale, *In Situ Hybridization* 165-179 In: *The Maize Handbook*, eds. Freeling and Walbot, Springer-Verlag, New York (1994), the entirety of which is herein incorporated by reference). It is understood that one or more of the molecules of the present invention, preferably one or more of the EST nucleic acid molecules of the present invention or one or more of the antibodies of the present invention may be utilized to detect the level or pattern of a protein or fragment thereof by in situ hybridization.

Fluorescent in situ hybridization also enables the localization of a particular DNA sequence along a chromosome which is useful, among other uses, for gene mapping, following chromosomes in hybrid lines or detecting chromosomes with translocations, transversions or deletions. In situ hybridization has been used to identify chromosomes in several plant species (Griffor et al., *Plant. Mol Biol.* 17: 101-109 (1991), the entirety of which is herein incorporated by reference; Gustafson et al., *Proc. Nat'l. Acad. Sci.* (U.S.A.). 87: 1899-1902 (1990), herein incorporated by reference; Mukai and Gill, *Genome* 34: 448-452. (1991); Schwarzacher and Heslop-Harrison, *Genome* 34: 317-323 (1991); Wang et al., *Jpn. J. Genet.* 66: 313-316 (1991), the entirety of which is herein incorporated by reference; Parra and Windle, *Nature Genetics,* 5: 17-21 (1993), the entirety of which is herein incorporated by reference). It is understood that the nucleic acid molecules of the present invention may be used as probes or markers to localize sequences along a chromosome.

It is also understood that one or more of the molecules of the present invention, preferably one or more of the EST nucleic acid molecules of the present invention or one or more of the antibodies of the present invention may be utilized to detect the expression level or pattern of a protein or mRNA thereof by in situ hybridization.

Another method to localize the expression of a molecule is tissue printing. Tissue printing provides a way to screen, at the same time on the same membrane many tissue sections from different plants or different developmental stages. Tissue-printing procedures utilize films designed to immobilize proteins and nucleic acids. In essence, a freshly cut section of an organ is pressed gently onto nitrocellulose paper, nylon membrane or polyvinylidene difluoride membrane. Such membranes are commercially available (e.g. Millipore, Bedford, Mass.). The contents of the cut cell transfer onto the membrane, and the molecules are immobilized to the membrane. The immobilized molecules form a latent print that can be visualized with appropriate probes. When a plant tissue print is made on nitrocellulose paper, the cell walls leave a physical print that makes the anatomy visible without further treatment (Varner and Taylor, *Plant Physiol.* 91: 31-33 (1989), the entirety of which is herein incorporated by reference).

Tissue printing on substrate films is described by Daoust, *Exp. Cell Res.* 12: 203-211 (1957), the entirety of which is herein incorporated by reference, who detected amylase, protease, ribonuclease, and deoxyribonuclease in animal tissues using starch, gelatin, and agar films. These techniques can be applied to plant tissues (Yomo and Taylor, *Planta* 112:35-43 (1973); Harris and Chrispeels, *Plant Physiol.* 56: 292-299 (1975). Advances in membrane technology have increased the range of applications of Daoust's tissue-printing techniques allowing (Cassab and Varner, *J. Cell. Biol.* 105: 2581-2588 (1987), the entirety of which is herein incorporated by reference; the histochemical localization of various plant enzymes and deoxyribonuclease on nitrocellulose paper and nylon (Spruce et al., *Phytochemistry*, 26: 2901-2903 (1987), the entirety of which is herein incorporated by reference; Barres et al. *Neuron* 5: 527-544 (1990), the entirety of which is herein incorporated by reference; the entirety of which is herein incorporated by reference; Reid and Pont-Lezica, *Tissue Printing: Tools for the Study of Anatomy, Histochemistry, and Gene Expression*, Academic Press, New York, N.Y. (1992), the entirety of which is herein incorporated by reference; Reid et al. *Plant Physiol.* 93: 160-165 (1990), herein incorporate by reference; Ye et al. *Plant J.* 1: 175-183 (1991), the entirety of which is herein incorporated by reference).

It is understood that one or more of the molecules of the present invention, preferably one or more of the EST nucleic acid molecules of the present invention or one or more of the antibodies of the present invention may be utilized to detect the presence or quantity of a protein by tissue printing.

Further, it is also understood that any of the nucleic acid molecules of the present invention may be used as marker nucleic acids and or probes in connection with methods that require probes or marker nucleic acids. As used herein, a probe is an agent that is utilized to determine an attribute or feature (e.g. presence or absence, location, correlation, etc.) or a molecule, cell, tissue or plant. As used herein, a marker nucleic acid is a nucleic acid molecule that is utilized to determine an attribute or feature (e.g., presence or absence, location, correlation, etc.) or a molecule, cell, tissue or plant.

A microarray-based method for high-throughput monitoring of plant gene expression may be utilized to measure gene-specific hybridization targets. This 'chip'-based approach involves using microarrays of nucleic acid molecules as gene-specific hybridization targets to quantitatively measure expression of the corresponding plant genes (Schena et al., *Science* 270: 467-470 (1995), the entirety of which is herein incorporated by reference; Shalon, Ph.D. Thesis. Stanford University (1996), the entirety of which is herein incorporated by reference). Every nucleotide in a large sequence can be queried at the same time. Hybridization can be used to efficiently analyze large amounts of nucleotide sequence.

Several microarray methods have been described. One method compares the sequences to be analyzed by hybridization to a set of oligonucleotides representing all possible subsequences (Bains and Smith, *J. Theor. Biol.* 135: 303 (1989), the entirety of which is herein incorporated by reference). A second method hybridizes the sample to an array of oligonucleotide probes. An array consisting of oligonucleotides complementary to subsequences of a target sequence can be used to determine the identity of a target sequence, measure its amount, and detect differences between the target and a reference sequence. Nucleic acid molecules microarrays may also be screened with protein molecules or fragments thereof to determine nucleic acid molecules that specifically bind protein molecules or fragments thereof.

The microarray approach may be used with polypeptide targets (U.S. Pat. No. 5,445,934; U.S. Pat. No: 5,143,854; U.S. Pat. No. 5,079,600; U.S. Pat. No. 4,923,901, all of which are herein incorporated by reference in their entirety). Essentially, polypeptides are synthesized on a substrate (microarray) and these polypeptides can be screened with either protein molecules or fragments thereof or nucleic acid molecules in order to screen for either protein molecules or fragments thereof or nucleic acid molecules that specifically bind the target polypeptides. Implementation of these techniques rely on recently developed combinatorial technologies to generate any ordered array of a large number of oligonucleotide probes (Fodor et al., *Science* 251:767-773 (1991), the entirety of which is herein incorporated by reference).

It is understood that one or more of the molecules of the present invention, preferably one or more of the nucleic acid molecules or protein molecules or fragments thereof of the present invention may be utilized in a microarray based method.

In a preferred embodiment of the present invention microarrays may be prepared that comprise nucleic acid molecules where preferably at least 10%, preferably at least 25%, more preferably at least 50% and even more preferably at least 75%, 80%, 85%, 90% or 95% of the nucleic acid molecules located on that array are selected from the group of nucleic acid molecules that specifically hybridize to one or more nucleic acid molecule having a nucleic acid sequence selected from the group of SEQ ID NO: 1 through SEQ ID NO: 8135 or complement thereof or fragments of either.

A particular preferred microarray embodiment of the present invention is a microarray comprising nucleic acid molecules encoding genes or fragments thereof that are homologues of known genes or nucleic acid molecules that comprise genes or fragment thereof that elicit only limited or no matches to known genes. A further preferred microarray embodiment of the present invention is a microarray comprising nucleic acid molecules having genes or fragments thereof that are homologues of known genes and nucleic acid molecules that comprise genes or fragment thereof that elicit only limited or no matches to known genes. Site-directed mutagenesis may be utilized to modify nucleic acid sequences, particularly as it is a technique that allows one or more of the amino acids encoded by a nucleic acid molecule to be altered (e.g. a threonine to be replaced by a methionine). Three basic methods for site-directed mutagenesis are often employed. These are cassette mutagenesis (Wells et al., *Gene* 34:315-23 (1985), the entirety of which is herein incorporated by reference), primer extension (Gilliam et al., *Gene* 12:129-137 (1980), the entirety of which is herein incorporated by reference); Zoller and Smith, *Methods Enzymol.* 100:468-500 (1983), the entirety of which is herein incorporated by reference; and Dalbadie-McFarland et al., *Proc. Natl. Acad. Sci.* (U.S.A.) 79:6409-6413 (1982), the entirety of which is herein incorporated by reference) and methods based upon PCR (Scharf et al., *Science* 233:1076-1078 (1986), the entirety of which is herein incorporated by reference; Higuchi et al., *Nucleic Acids Res.* 16:7351-7367 (1988), the entirety of which is herein incorporated by reference). Site-directed mutagenesis approaches are also described in European Patent 0 385 962, the entirety of which is herein incorporated by reference, European Patent 0 359 472, the entirety of which is herein incorporated by reference, and PCT Patent Application WO 93/07278, the entirety of which is herein incorporated by reference.

Site-directed mutagenesis strategies have been applied to plants for both in vitro as well as in vivo site-directed mutagenesis (Lanz et al., *J. Biol. Chem.* 266:9971-6 (1991), the entirety of which is herein incorporated by reference; Kovgan and Zhdanov, *Biotekhnologiya* 5:148-154; No. 207160n, *Chemical Abstracts* 110:225 (1989), the entirety of which is herein incorporated by reference; Ge et al., *Proc. Natl. Acad. Sci.* (U.S.A.) 86:4037-4041 (1989), the entirety of which is herein incorporated by reference, Zhu et al., *J. Biol. Chem.* 271:18494-18498 (1996), Chu et al., *Biochemistry* 33:6150-6157 (1994), the entirety of which is herein incorporated by reference, Small et al., *EMBO J.* 11:1291-1296 (1992), the entirety of which is herein incorporated by reference, Cho et al., *Mol. Biotechnol.* 8:13-16 (1997), Kita et al., *J. Biol. Chem.* 271:26529-26535 (1996), the entirety of which is herein incorporated by reference, Jin et al., *Mol. Microbiol.* 7:555-562 (1993), the entirety of which is herein incorporated by reference, Hatfield and Vierstra, *J. Biol. Chem.* 267:14799-14803 (1992), the entirety of which is herein incorporated by reference, Zhao et al., *Biochemistry* 31:5093-5099 (1992), the entirety of which is herein incorporated by reference).

Any of the nucleic acid molecules of the present invention may either be modified by site-directed mutagenesis or used as, for example, nucleic acid molecules that are used to target other nucleic acid molecules for modification. It is understood that mutants with more than one altered nucleotide can be constructed using techniques that practitioners skilled in the art are familiar with such as isolating restriction fragments and ligating such fragments into an expression vector (see, for example, Sambrook et al., *Molecular Cloning: A Laboratory Manual*, Cold Spring Harbor Press (1989)).

Sequence-specific DNA-binding proteins play a role in the regulation of transcription. The isolation of recombinant cDNAs encoding these proteins facilitates the biochemical analysis of their structural and functional properties. Genes encoding such DNA-binding proteins have been isolated using classical genetics (Vollbrecht et al., *Nature* 350: 241-243 (1991), the entirety of which is herein incorporated by reference) and molecular biochemical approaches, including the screening of recombinant cDNA libraries with antibodies (Landschulz et al., *Genes Dev.* 2: 786-800 (1988), the entirety of which is herein incorporated by reference) or DNA probes (Bodner et al., *Cell* 55: 505-518 (1988), the entirety of which is herein incorporated by reference). In addition, an in situ screening procedure has been used and has facilitated the isolation of sequence-specific DNA-binding proteins from various plant species (Gilmartin et al., *Plant Cell* 4: 839-849 (1992), the entirety of which is herein incorporated by reference; Schindler et al., *EMBO J.* 11: 1261-1273 (1992) the entirety of which is herein incorporated by reference). An in situ screening protocol does not require the purification of the protein of interest (Vinson et al., *Genes Dev.* 2: 801-806 (1988), the entirety of which is herein incorporated by reference; Singh et al., *Cell* 52: 415-423 (1988), the entirety of which is herein incorporated by reference).

Steps may be employed to characterize DNA-protein interactions. The first is to identify promoter fragments that interact with DNA-binding proteins, to titrate binding activity, to determine the specificity of binding, and to determine whether a given DNA-binding activity can interact with related DNA sequences (Sambrook et al., *Molecular Cloning: A Laboratory Manual*, 2$^{nd}$ edition. Cold Spring Harbor Laboratory Press, Cold Spring Harbor, N.Y. (1989). Electrophoretic mobility-shift assay is a widely used assay. The assay provides a simple, rapid, and sensitive method for detecting DNA-binding proteins based on the observation that the mobility of a DNA fragment through a nondenaturing, low-ionic strength polyacrylamide gel is retarded upon association with a DNA-binding protein (Fried and Crother, *Nucleic Acids Res.* 9: 6505-6525 (1981), the entirety of which is herein incorporated by reference). When one or more specific binding activities have been identified, the exact sequence of the DNA bound by the protein may be determined. Several procedures for characterizing protein/DNA-binding sites are used, including methylation and ethylation interference assays ( Maxam and Gilbert, *Methods Enzymol.* 65: 499-560 (1980), the entirety of which is herein incorporated by reference; Wissman and Hillen, *Methods Enzymol.* 208: 365-379 (1991), the entirety of which is herein incorporated by reference) and footprinting techniques employing DNase I (Galas and Schmitz, *Nucleic Acids Res.* 5: 3157-3170 (1978), the entirety of which is herein incorporated by reference), 1,10-phenanthroline-copper ion methods (Sigman et al., *Methods Enzymol.* 208: 365-379 (1991), the entirety of which is herein incorporated by reference) or hydroxyl radical methods (Dixon et al., *Methods Enzymol.* 208: 380-413 (1991), the entirety of which is herein incorporated by reference). It is understood that one or more of the nucleic acid molecules of the present invention, preferably one or more of the EST nucleic acid molecules of the present invention may be utilized to identify a protein or fragment thereof that specifically binds to a nucleic acid molecule of the present invention. It is also understood that one or more of the protein molecules or fragments thereof of the present invention may be utilized to identify a nucleic acid molecule that specifically binds to it.

The two-hybrid system is based on the fact that many cellular functions are carried out by proteins that interact (physically) with one another. Two-hybrid systems have been used to probe the function of new proteins (Chien et al., *Proc. Natl. Acad. Sci.* (U.S.A.) 88: 9578-9582 (1991) the entirety of which is herein incorporated by reference; Durfee et al., *Genes Dev.* 7: 555-569 (1993) the entirety of which is herein incorporated by reference; Choi et al., *Cell* 78: 499-512 (1994), the entirety of which is herein incorporated by reference; Kranz et al., *Genes Dev.* 8: 313-327 (1994), the entirety of which is herein incorporated by reference).

Interaction mating techniques have facilitated a number of two-hybrid studies of protein-protein interaction. Interaction mating has been used to examine interactions between small sets of tens of proteins (Finley and Brent, *Proc. Natl. Acad. Sci.* (U.S.A.) 91: 12098-12984 (1994), the entirety of which is herein incorporated by reference), larger sets of hundreds of proteins, (Bendixen et al., *Nucl. Acids Res.* 22: 1778-1779 (1994), the entirety of which is herein incorporated by reference) and to comprehensively map proteins encoded by a small genome (Bartel et al., *Nature Genetics* 12: 72-77 (1996), the entirety of which is herein incorporated by reference). This technique utilizes proteins fused to the DNA-binding domain and proteins fused to the activation domain. They are expressed in two different haploid yeast strains of opposite mating type, and the strains are mated to determine if the two proteins interact. Mating occurs when haploid yeast strains come into contact and result in the fusion of the two haploids into a diploid yeast strain. An interaction can be determined by the activation of a two-hybrid reporter gene in the diploid strain. The primary advantage of this technique is that it reduces the number of yeast transformations needed to test individual interactions. It is understood that the protein-protein interactions of protein or fragments thereof of the present invention may be investigated using the two-hybrid system and that any of the nucleic acid molecules of the present invention that encode such proteins or fragments thereof may be used to transform yeast in the two-hybrid system.

Synechocystis 6803 is a photosynthetic Cyanobacterium capable of oxygenic photosynthesis as well as heterotrophic growth in the absence of light. The entire genome has been sequenced, and it is reported to have a circular genome size of 3.57 Mbp containing 3168 potential open reading frames. Open reading frames (ORFs) were identified based upon their homology to other reported ORFs and by using ORF identification computer programs. Sixteen hundred potential ORFs were assigned based on their homology to previously identified ORFs. Of these 1600 ORFs, 145 were identical to reported ORFs (Kaneko et al., *DNA Research* 3:109-36 (1996), herein incorporated by reference in its entirety).

Several prokaryote promoters have been used in Synechocystis to express heterologous genes including the tac, lac, and lambda phage promoters (Bryant (ed.), *The Molecular Biology of Cyanobacteria*, Kluwer Academic Publishers, (1994); Ferino and Chauvat, *Gene* 84:257-266 (1989), both of which are herein incorporated by reference in their entirety). Several bacterial origins of replication such as RSF 1010 and ACYC are reported to replicate in Synechocystis (Mermet-Bouvier and Chauvat, *Current Microbiology* 28:145-148 (1994); Kuhlemeier et al., *Mol. Gen. Genet.* 184:249-254 (1981), both of which are herein incorporated by reference in their entirety).

Synechocystis has been used to study gene regulation by gene replacement through homologous recombination or by gene disruption using antibiotic resistance markers (Pakrasi et al., *EMBO* 7:325-332 (1988), herein incorporated by reference in its entirety). In such gene regulation studies, double reciprocal homologous regions of the host genome flanking the gene of interest recombine to stably integrate the gene of interest into the genome. The gene of interest can be expressed once that gene has been stably integrated into the genome. Biochemical analysis can be performed to study the effect of the replaced or deleted gene.

It is understood that the agents of the present invention may be employed in a Synechocystis system.

Exogenous genetic material may be transferred into a plant cell and the plant cell regenerated into a whole, fertile or sterile plant. Exogenous genetic material is any genetic material, whether naturally occurring or otherwise, from any source that is capable of being inserted into any organism. Such genetic material may be transferred into either monocotyledons and dicotyledons including but not limited to the crops, maize and soybean (See specifically, Chistou, *Particle Bombardment for Genetic Engineering of Plants*, pp 63-69 (maize), pp50-60 (soybean), Biotechnology Intelligence Unit. Academic Press, San Diego, Calif. (1996), the entirety of which is herein incorporated by reference and generally Chistou, *Particle Bombardment for Genetic Engineering of Plants*, Biotechnology Intelligence Unit. Academic Press, San Diego, Calif. (1996), the entirety of which is herein incorporated by reference).

Transfer of a nucleic acid that encodes for a protein can result in overexpression of that protein in a transformed cell or transgenic plant. One or more of the proteins or fragments thereof encoded by nucleic acid molecules of the present invention may be overexpressed in a transformed cell or transformed plant. Such overexpression may be the result of transient or stable transfer of the exogenous material.

Exogenous genetic material may be transferred into a plant cell by the use of a DNA vector or construct designed for such a purpose. Design of such a vector is generally within the skill of the art (See, Plant Molecular Biology: A Laboratory Manual eds. Clark, Springer, N.Y. (1997), the entirety of which is herein incorporated by reference).

A construct or vector may include a plant promoter to express the protein or protein fragment of choice. A number of promoters which are active in plant cells have been described in the literature. These include the nopaline synthase (NOS) promoter (Ebert et al., *Proc. Natl. Acad Sci.* (U.S.A.) 84:5745-5749 (1987), the entirety of which is herein incorporated by reference), the octopine synthase (OCS) promoter (which are carried on tumor-inducing plasmids of *Agrobacterium tumefaciens*), the caulimovirus promoters such as the cauliflower mosaic virus (CaMV) 19S promoter (Lawton et al., *Plant. Mol Biol.* 9:315-324 (1987), the entirety of which is herein incorporated by reference) and the CAMV 35S promoter (Odell et al., *Nature* 313:810-812 (1985), the entirety of which is herein incorporated by reference), the figwort mosaic virus 35S-promoter, the light-inducible promoter from the small subunit of ribulose-1,5-bis-phosphate carboxylase (ssRUBISCO), the Adh promoter (Walker et al., *Proc. Natl. Acad. Sci.* (U.S.A.) 84:6624-6628 (1987), the entirety of which is herein incorporated by reference), the sucrose synthase promoter (Yang et al., *Proc. Natl. Acad. Sci.* (U.S.A.) 87:4144-4148 (1990), the entirety of which is herein incorporated by reference), the R gene complex promoter (Chandler et al., *The Plant Cell* 1:1175-1183 (1989), the entirety of which is herein incorporated by reference), and the chlorophyll a/b binding protein gene promoter, etc. These promoters have been used to create DNA constructs which have been expressed in plants; see, e.g., PCT publication WO 84/02913, herein incorporated by reference in its entirety.

Promoters which are known or are found to cause transcription of DNA in plant cells can be used in the present invention. Such promoters may be obtained from a variety of sources such as plants and plant viruses. It is preferred that the particular promoter selected should be capable of causing sufficient expression to result in the production of an effective amount of a protein to cause the desired phenotype. In addition to promoters which are known to cause transcription of DNA in plant cells, other promoters may be identified for use in the current invention by screening a plant cDNA library for genes which are selectively or preferably expressed in the target tissues or cells.

For the purpose of expression in source tissues of the plant, such as the leaf, seed, root or stem, it is preferred that the promoters utilized in the present invention have relatively high expression in these specific tissues. For this purpose, one may choose from a number of promoters for genes with tissue- or cell-specific or -enhanced expression. Examples of such promoters reported in the literature include the chloroplast glutamine synthetase GS2 promoter from pea (Edwards et al., *Proc. Natl. Acad Sci.* (U.S.A.) 87:3459-3463 (1990), herein incorporated by reference in its entirety), the chloroplast fructose-1,6-biphosphatase (FBPase) promoter from wheat (Lloyd et al., *Mol. Gen. Genet.* 225:209-216 (1991), herein incorporated by reference in its entirety), the nuclear photosynthetic ST-LS1 promoter from potato (Stockhaus et al., *EMBO J.* 8:2445-2451 (1989), herein incorporated by reference in its entirety), the phenylalanine ammonia-lyase (PAL) promoter and the chalcone synthase (CHS) promoter from *Arabidopsis thaliana*. Also reported to be active in photosynthetically active tissues are the ribulose-1,5-bisphosphate carboxylase (RbcS) promoter from eastern larch (*Larix laricina*), the promoter for the cab gene, cab6, from pine (Yamamoto et al., *Plant Cell Physiol.* 35:773-778 (1994), herein incorporated by reference in its entirety), the promoter for the Cab-1 gene from wheat (Fejes et al., *Plant. Mol Biol.* 15:921-932 (1990), herein incorporated by reference in its entirety), the promoter for the CAB-1 gene from spinach (Lubberstedt et al., *Plant Physiol.* 104:997-1006 (1994), herein incorporated by reference in its entirety), the promoter for the cabIR gene from rice (Luan et al., *Plant Cell.* 4:971-981 (1992), the entirety of which is herein incorporated by reference), the pyruvate, orthophosphate dikinase (PPDK) promoter from maize (Matsuoka et al., *Proc. Natl. Acad. Sci.* (U.S.A.) 90: 9586-9590 (1993), herein incorporated by reference in its entirety), the promoter for the tobacco Lhcb1*2 gene (Cerdan et al., *Plant. Mol Biol.* 33: 245-255. (1997), herein incorporated by reference in its entirety), the *Arabidopsis thaliana* SUC2 sucrose-H+ symporter promoter (Truernit et al., *Planta.* 196: 564-570 (1995), herein incorporated by reference in its entirety), and the promoter for the thylacoid membrane proteins from spinach (psaD, psaF, psae, PC, FNR, atpC, atpD, cab, rbcS). Other promoters for the chlorophyl a/b-binding proteins may also be utilized in the present invention, such as the promoters for LhcB gene and PsbP gene from white mustard (*Sinapis alba*; Kretsch et al., *Plant. Mol Biol.* 28: 219-229 (1995), the entirety of which is herein incorporated by reference).

For the purpose of expression in sink tissues of the plant, such as the tuber of the potato plant, the fruit of tomato, or the seed of maize, wheat, rice, and barley, it is preferred that the promoters utilized in the present invention have relatively high expression in these specific tissues. A number of promoters for genes with tuber-specific or -enhanced expression are known, including the class I patatin promoter (Bevan et al., *EMBO J.* 8: 1899-1906 (1986); Jefferson et al., *Plant Mol. Biol.* 14: 995-1006 (1990), both of which are herein incorporated by reference in its entirety), the promoter for the potato tuber ADPGPP genes, both the large and small subunits, the sucrose synthase promoter (Salanoubat and Belliard, *Gene.* 60: 47-56 (1987), Salanoubat and Belliard, *Gene.* 84: 181-185 (1989), both of which are incorporated by reference in their entirety), the promoter for the major tuber proteins including the 22 kd protein complexes and proteinase inhibitors (Hannapel, *Plant Physiol.* 101: 703-704 (1993), herein incorporated by reference in its entirety), the promoter for the granule bound starch synthase gene (GBSS) (Visser et al., *Plant. Mol Biol.* 17: 691-699 (1991), herein incorporated by reference in its entirety), and other class I and II patatins promoters (Koster-Topfer et al., *Mol Gen Genet.* 219: 390-396 (1989); Mignery et al., *Gene.* 62: 27-44 (1988), both of which are herein incorporated by reference in their entirety).

Other promoters can also be used to express a fructose 1,6 bisphosphate aldolase gene in specific tissues, such as seeds or fruits. The promoter for β-conglycinin (Chen et al., *Dev. Genet.* 10: 112-122 (1989), herein incorporated by reference in its entirety) or other seed-specific promoters such as the napin and phaseolin promoters, can be used. The zeins are a group of storage proteins found in maize endosperm. Genomic clones for zein genes have been isolated (Pedersen et al., *Cell* 29: 1015-1026 (1982), herein incorporated by reference in its entirety), and the promoters from these clones, including the 15 kD, 16 kD, 19 kD, 22 kD, 27 kD, and gamma genes, could also be used. Other promoters known to function, for example, in maize, include the promoters for the following genes: waxy, Brittle, Shrunken 2, Branching enzymes I and II, starch synthases, debranching enzymes, oleosins, glutelins, and sucrose synthases. A particularly preferred promoter for maize endosperm expression is the promoter for the glutelin gene from rice, more particularly the Osgt-1 promoter (Zheng et al., *Mol. Cell Biol.* 13: 5829-5842 (1993), herein incorporated by reference in its entirety). Examples of promoters suitable for expression in wheat include those promoters for the ADPglucose pyrophosphorylase (ADPGPP) subunits, the granule bound and other starch synthases, the branching and debranching enzymes, the embryogenesis-abundant proteins, the gliadins, and the glutenins. Examples of such promoters in rice include those promoters for the ADPGPP subunits, the granule bound and other starch synthases, the branching enzymes, the debranching enzymes, sucrose synthases, and the glutelins. A particularly preferred promoter is the promoter for rice glutelin, Osgt-1. Examples of such promoters for barley include those for the ADPGPP subunits, the granule bound and other starch synthases, the branching enzymes, the debranching enzymes, sucrose synthases, the hordeins, the embryo globulins, and the aleurone specific proteins.

Root specific promoters may also be used. An example of such a promoter is the promoter for the acid chitinase gene (Samac et al., *Plant. Mol Biol.* 25: 587-596 (1994), the entirety of which is herein incorporated by reference). Expression in root tissue could also be accomplished by utilizing the root specific subdomains of the CaMV35S promoter that have been identified (Lam et al., *Proc. Natl. Acad. Sci.* (U.S.A.) 86:7890-7894 (1989), herein incorporated by reference in its entirety). Other root cell specific promoters include those reported by Conkling et al. (Conkling et al., *Plant Physiol.* 93:1203-1211 (1990), the entirety of which is herein incorporated by reference).

Additional promoters that may be utilized are described, for example, in U.S. Pat. Nos. 5,378,619, 5,391,725, 5,428, 147, 5,447,858, 5,608,144, 5,608,144, 5,614,399, 5,633,441, 5,633,435, and 4,633,436, all of which are herein incorporated in their entirety. In addition, a tissue specific enhancer may be used (Fromm et al., *The Plant Cell* 1:977-984 (1989), the entirety of which is herein incorporated by reference).

Constructs or vectors may also include, with the coding region of interest, a nucleic acid sequence that acts, in whole or in part, to terminate transcription of that region. For example, such sequences have been isolated including the Tr7 3' sequence and the nos 3' sequence (Ingelbrecht et al., *The Plant Cell* 1:671-680 (1989), the entirety of which is herein incorporated by reference; Bevan et al., *Nucleic Acids Res.* 11:369-385 (1983), the entirety of which is herein incorporated by reference), or the like.

A vector or construct may also include regulatory elements. Examples of such include the Adh intron 1 (Callis et al., *Genes and Develop.* 1:1183-1200 (1987), the entirety of which is herein incorporated by reference), the sucrose synthase intron (Vasil et al., *Plant Physiol.* 91:1575-1579 (1989), the entirety of which is herein incorporated by reference) and the TMV omega element (Gallie et al., *The Plant Cell* 1:301-311 (1989), the entirety of which is herein incorporated by reference). These and other regulatory elements may be included when appropriate.

A vector or construct may also include a selectable marker. Selectable markers may also be used to select for plants or plant cells that contain the exogenous genetic material. Examples of such include, but are not limited to, a neo gene (Potrykus et al., *Mol. Gen. Genet.* 199:183-188 (1985), the entirety of which is herein incorporated by reference) which codes for kanamycin resistance and can be selected for using kanamycin, G418, etc.; a bar gene which codes for bialaphos resistance; a mutant EPSP synthase gene (Hinchee et al., *Bio/Technology* 6:915-922 (1988), the entirety of which is herein incorporated by reference) which encodes glyphosate resistance; a nitrilase gene which confers resistance to bromoxynil (Stalker et al., *J. Biol. Chem.* 263:6310-6314 (1988), the entirety of which is herein incorporated by reference); a mutant acetolactate synthase gene (ALS) which confers imidazolinone or sulphonylurea resistance (European Patent Application 154,204 (Sep. 11, 1985), the entirety of which is herein incorporated by reference); and a methotrexate resistant DHFR gene (Thillet et al., *J. Biol. Chem.* 263:12500-12508 (1988), the entirety of which is herein incorporated by reference).

A vector or construct may also include a transit peptide. Incorporation of a suitable chloroplast transit peptide may also be employed (European Patent Application Publication Number 0218571, the entirety of which is herein incorporated by reference). Translational enhancers may also be incorporated as part of the vector DNA. DNA constructs could contain one or more 5' non-translated leader sequences which may serve to enhance expression of the gene products from the resulting mRNA transcripts. Such sequences may be derived from the promoter selected to express the gene or can be specifically modified to increase translation of the mRNA. Such regions may also be obtained from viral RNAs, from suitable eukaryotic genes, or from a synthetic gene sequence. For a review of optimizing expression of transgenes, see Koziel et al., *Plant Mol. Biol.* 32:393-405 (1996), the entirety of which is herein incorporated by reference.

A vector or construct may also include a screenable marker. Screenable markers may be used to monitor expression. Exemplary screenable markers include a β-glucuronidase or uidA gene (GUS) which encodes an enzyme for which various chromogenic substrates are known (Jefferson, *Plant. Mol Biol, Rep.* 5: 387-405 (1987), the entirety of which is herein incorporated by reference; Jefferson et al., *EMBO J.* 6: 3901-3907 (1987), the entirety of which is herein incorporated by reference); an R-locus gene, which encodes a product that regulates the production of anthocyanin pigments (red color) in plant tissues ((Dellaporta et al., *Stadler Symposium* 11:263-282 (1988), the entirety of which is herein incorporated by reference); a β-lactamase gene (Sutcliffe et al., *Proc. Natl. Acad. Sci.* (U.S.A.) 75: 3737-3741 (1978), the entirety of which is herein incorporated by reference), a gene which encodes an enzyme for which various chromogenic substrates are known (e.g., PADAC, a chromogenic cephalosporin); a luciferase gene (Ow et al., *Science* 234: 856-859 (1986), the entirety of which is herein incorporated by reference) a xyle gene (Zukowsky et al., *Proc. Natl. Acad. Sci.* (U.S.A.) 80:1101-1105 (1983), the entirety of which is herein incorporated by reference) which encodes a catechol dioxygenase that can convert chromogenic catechols; an α-amylase gene (Ikatu et al., *BiolTechnol.* 8:241-242 (1990), the entirety of which is herein incorporated by reference); a tyrosinase gene (Katz et al., *J. Gen. Microbiol.* 129:2703-2714 (1983), the entirety of which is herein incorporated by reference) which encodes an enzyme capable of oxidizing tyrosine to DOPA and dopaquinone which in turn condenses to melanin; an α-galactosidase, which will turn a chromogenic α-galactose substrate.

Included within the terms "selectable or screenable marker genes" are also genes which encode a scriptable marker whose secretion can be detected as a means of identifying or selecting for transformed cells. Examples include markers which encode a secretable antigen that can be identified by antibody interaction, or even secretable enzymes which can be detected catalytically. Secretable proteins fall into a number of classes, including small, diffusible proteins detectable, e.g., by ELISA, small active enzymes detectable in extracellular solution (e.g., α-amylase, β-lactamase, phosphinothricin transferase), or proteins which are inserted or trapped in the cell wall (such as proteins which include a leader sequence such as that found in the expression unit of extension or tobacco PR-S). Other possible selectable and/or screenable marker genes will be apparent to those of skill in the art.

Methods and compositions for transforming a bacteria and other microorganisms are known in the art (see for example Sambrook et al., *Molecular Cloning: A Laboratory Manual*, Second Edition, Cold Spring Harbor Laboratory Press, Cold Spring Harbor, N.Y., (1989), the entirety of which is herein incorporated by reference).

There are many methods for introducing transforming nucleic acid molecules into plant cells. Suitable methods are believed to include virtually any method by which nucleic acid molecules may be introduced into a cell, such as by *Agrobacterium* infection or direct delivery of nucleic acid molecules such as, for example, by PEG-mediated transformation, by electroporation or by acceleration of DNA coated particles, etc. (Pottykus, *Ann. Rev. Plant Physiol. Plant. Mol Biol.* 42:205-225 (1991), the entirety of which is herein incorporated by reference; Vasil, *Plant. Mol Biol.* 25: 925-937 (1994), the entirety of which is herein incorporated by reference. For example, electroporation has been used to transform maize protoplasts (Fromm et al., *Nature* 312:791-793 (1986), the entirety of which is herein incorporated by reference).

Other vector systems suitable for introducing transforming DNA into a host plant cell includes but is not limited to binary artificial chromosome (BIBAC) vectors (Hamilton et al., *Gene* 200:107-116, (1997), the entirety of which is herein incorporated by reference, and transfection with RNA viral vectors (Della-Cioppa et al., *Ann. N.Y. Acad. Sci.* (1996), 792 (Engineering Plants for Commercial Products and Applications), 57-61, the entirety of which is herein incorporated by reference.

Technology for introduction of DNA into cells is well known to those of skill in the art. Four general methods for delivering a gene into cells have been described: (1) chemical methods (Graham and van der Eb, *Virology*, 54:536-539 (1973), the entirety of which is herein incorporated by reference); (2) physical methods such as microinjection (Capecchi, *Cell* 22:479-488 (1980), electroporation (Wong and Neumann, *Biochem. Biophys. Res. Commun.*, 107:584-587 (1982); Fromm et al., *Proc. Natl. Acad. Sci. USA*, 82:5824-5828 (1985); U.S. Pat. No. 5,384,253; and the gene gun (Johnston and Tang, *Methods Cell Biol.* 43:353-365 (1994), all of which the entirety is herein incorporated by reference; (3) viral vectors (Clapp, *Clin. Perinatol.*, 20:155-168 (1993); Lu et al., *J. Exp. Med.*, 178:2089-2096 (1993); Eglitis and Anderson, *Biotechniques*, 6:608-614 (1988), all of which the entirety is herein incorporated by reference); and (4) receptor-mediated mechanisms (Curiel et al., *Hum. Gen. Ther.*, 3:147-154 (1992); Wagner et al., *Proc. Natl. Acad. Sci. USA*, 89:6099-6103 (1992), all of which the entirety is herein incorporated by reference).

Acceleration methods that may be used include, for example, microprojectile bombardment and the like. One example of a method for delivering transforming nucleic acid molecules to plant cells is microprojectile bombardment. This method has been reviewed by Yang and Christou, eds., *Particle Bombardment Technology for Gene Transfer*, Oxford Press, Oxford, England (1994), the entirety of which is herein incorporated by reference). Non-biological particles (microprojectiles) that may be coated with nucleic acids and delivered into cells by a propelling force. Exemplary particles include those comprised of tungsten, gold, platinum, and the like.

A particular advantage of microprojectile bombardment, in addition to it being an effective means of reproducibly, and stably transforming monocotyledons, is that neither the isolation of protoplasts (Cristou et al., *Plant Physiol.* 87:671-674 (1988), the entirety of which is herein incorporated by reference) nor the susceptibility of *Agrobacterium* infection is required. An illustrative embodiment of a method for delivering DNA into maize cells by acceleration is a biolistics g-particle delivery system, which can be used to propel particles coated with DNA through a screen, such as a stainless steel or Nytex screen, onto a filter surface covered with corn cells cultured in suspension. Gordon-Kamm et al., describes the basic procedure for coating tungsten particles with DNA (Gordon-Kamm et al., *Plant Cell* 2: 603-618 (1990), the entirety of which is herein incorporated by reference). The screen disperses the tungsten nucleic acid particles so that they are not delivered to the recipient cells in large aggregates. A particle delivery system suitable for use with the present invention is the helium acceleration PDS-1000/He gun which is available from Bio-Rad Laboratories (Bio-Rad, Hercules, Calif.)(Sanford et al., *Technique* 3:3-16 (1991), the entirety of which is herein incorporated by reference).

For the bombardment, cells in suspension may be concentrated on filters. Filters containing the cells to be bombarded are positioned at an appropriate distance below the microprojectile stopping plate. If desired, one or more screens are also positioned between the gun and the cells to be bombarded.

Alternatively, immature embryos or other target cells may be arranged on solid culture medium. The cells to be bombarded are positioned at an appropriate distance below the macroprojectile stopping plate. If desired, one or more screens are also positioned between the acceleration device and the cells to be bombarded. Through the use of techniques set forth herein one may obtain up to 1000 or more foci of cells transiently expressing a marker gene. The number of cells in a focus which express the exogenous gene product 48 hours post-bombardment often range from one to ten and average one to three.

In bombardment transformation, one may optimize the prebombardment culturing conditions and the bombardment parameters to yield the maximum numbers of stable transformants. Both the physical and biological parameters for bombardment are important in this technology. Physical factors are those that involve manipulating the DNA/microprojectile precipitate or those that affect the flight and velocity of either the macro- or microprojectiles. Biological factors include all steps involved in manipulation of cells before and immediately after bombardment, the osmotic adjustment of target cells to help alleviate the trauma associated with bombardment, and also the nature of the transforming DNA, such as linearized DNA or intact supercoiled plasmids. It is believed that pre-bombardment manipulations are especially important for successful transformation of immature embryos. In another alternative embodiment, plastids can be stably transformed. Methods disclosed for plastid transformation in higher plants include the particle gun delivery of DNA containing a selectable marker and targeting of the DNA to the plastid genome through homologous recombination (Svab et al., *Proc. Natl. Acad. Sci.* (U.S.A.) 87:8526-8530 (1990); Svab and Maliga, *Proc. Natl. Acad. Sci.* (U.S.A.) 90:913-917 (1993); Staub and Maliga, *EMBO J.* 12:601-606 (1993); U.S. Pat. Nos. 5,451,513 and 5,545,818, all of which are herein incorporated by reference in their entirety).

Accordingly, it is contemplated that one may wish to adjust various aspects of the bombardment parameters in small scale studies to fully optimize the conditions. One may particularly wish to adjust physical parameters such as gap distance, flight distance, tissue distance, and helium pressure. One may also minimize the trauma reduction factors by modifying conditions which influence the physiological state of the recipient cells and which may therefore influence transformation and integration efficiencies. For example, the osmotic state, tissue hydration and the subculture stage or cell cycle of the recipient cells may be adjusted for optimum transformation. The execution of other routine adjustments will be known to those of skill in the art in light of the present disclosure.

*Agrobacterium*-mediated transfer is a widely applicable system for introducing genes into plant cells because the DNA can be introduced into whole plant tissues, thereby bypassing the need for regeneration of an intact plant from a protoplast. The use of *Agrobacterium*-mediated plant integrating vectors to introduce DNA into plant cells is well known in the art. See, for example the methods described (Fraley et al., *Biotechnology* 3:629-635 (1985); Rogers et al., *Meth. In Enzymol,* 153:253-277 (1987), both of which are herein incorporated by reference in their entirety. Further, the integration of the Ti-DNA is a relatively precise process resulting in few rearrangements. The region of DNA to be transferred is defined by the border sequences, and intervening DNA is usually inserted into the plant genome as described (Spielmann et al., *Mol. Gen. Genet.*, 205:34 (1986), the entirety of which is herein incorporated by reference).

Modern *Agrobacterium* transformation vectors are capable of replication in *E. coli* as well as *Agrobacterium*, allowing for convenient manipulations as described (Klee et al., *In: Plant DNA Infectious Agents*, T. Hohn and J. Schell, eds., Springer-Verlag, New York, pp. 179-203 (1985), the entirety of which is herein incorporated by reference. Moreover, recent technological advances in vectors for *Agrobacterium*-mediated gene transfer have improved the arrangement of genes and restriction sites in the vectors to facilitate construction of vectors capable of expressing various polypeptide coding genes. The vectors described have convenient multi-linker regions flanked by a promoter and a polyadenylation site for direct expression of inserted polypeptide coding genes and are suitable for present purposes (Rogers et al., *Meth. In Enzymol.,* 153:253-277 (1987), the entirety of which is herein incorporated by reference). In addition, *Agrobacterium* containing both armed and disarmed Ti genes can be used for the transformations. In those plant strains where *Agrobacterium*-mediated transformation is efficient, it is the method of choice because of the facile and defined nature of the gene transfer.

A transgenic plant formed using *Agrobacterium* transformation methods typically contains a single gene on one chromosome. Such transgenic plants can be referred to as being heterozygous for the added gene. More preferred is a transgenic plant that is homozygous for the added structural gene; i.e., a transgenic plant that contains two added genes, one gene at the same locus on each chromosome of a chromosome pair. A homozygous transgenic plant can be obtained by sexually mating (selfing) an independent segregant transgenic plant that contains a single added gene, germinating some of the seed produced and analyzing the resulting plants produced for the gene of interest.

It is also to be understood that two different transgenic plants can also be mated to produce offspring that contain two independently segregating added, exogenous genes. Selfing of appropriate progeny can produce plants that are homozygous for both added, exogenous genes that encode a polypeptide of interest. Back-crossing to a parental plant and out-crossing with a non-transgenic plant are also contemplated, as is vegetative propagation.

Transformation of plant protoplasts can be achieved using methods based on calcium phosphate precipitation, polyethylene glycol treatment, electroporation, and combinations of these treatments. See for example (Potrykus et al., *Mol. Gen. Genet.,* 205:193-200 (1986); Lorz et al., *Mol. Gen. Genet.,* 199:178, (1985); Fromm et al., *Nature,* 319:791,(1986); Uchimiya et al., *Mol. Gen. Genet.:*204:204, (1986); Callis et al., *Genes and Development*, 1183,(1987); Marcotte et al., *Nature*, 335:454, (1988), all of which the entirety is herein incorporated by reference).

Application of these systems to different plant strains depends upon the ability to regenerate that particular plant strain from protoplasts. Illustrative methods for the regeneration of cereals from protoplasts are described (Fujimura et al., *Plant Tissue Culture Letters*, 2:74,(1985); Toriyama et al., *Theor Appl. Genet.* 205:34. (1986); Yamada et al., *Plant Cell Rep.*, 4:85, (1986); Abdullah et al., *Biotechnology*, 4:1087, (1986), all of which the entirety is herein incorporated by reference).

To transform plant strains that cannot be successfully regenerated from protoplasts, other ways to introduce DNA into intact cells or tissues can be utilized. For example, regeneration of cereals from immature embryos or explants can be effected as described (Vasil, *Biotechnology*, 6:397,(1988), the entirety of which is herein incorporated by reference). In addition, "particle gun" or high-velocity microprojectile technology can be utilized (Vasil et al., *Bio/Technology* 10:667, (1992), the entirety of which is herein incorporated by reference).

Using the latter technology, DNA is carried through the cell wall and into the cytoplasm on the surface of small metal particles as described (Klein et al., *Nature*, 328:70, (1987); Klein et al., *Proc. Natl. Acad. Sci. USA*, 85:8502-8505, (1988); McCabe et al., *Biotechnology*, 6:923, (1988), all of which the entirety is herein incorporated by reference). The metal particles penetrate through several layers of cells and thus allow the transformation of cells within tissue explants.

Other methods of cell transformation can also be used and include but are not limited to introduction of DNA into plants by direct DNA transfer into pollen (Hess et al., *Intern Rev. Cytol.*, 107:367, (1987); Luo et al., *Plant Mol Biol. Reporter*, 6:165, (1988), all of which the entirety is herein incorporated by reference), by direct injection of DNA into reproductive organs of a plant (Pena et al., *Nature*, 325:274, (1987), the entirety of which is herein incorporated by reference), or by direct injection of DNA into the cells of immature embryos followed by the rehydration of desiccated embryos (Neuhaus et al., *Theor. Appl. Genet.*, 75:30, (1987), the entirety of which is herein incorporated by reference).

The regeneration, development, and cultivation of plants from single plant protoplast transformants or from various transformed explants is well known in the art (Weissbach and Weissbach, *In: Methods for Plant Molecular Biology*, (Eds.), Academic Press, Inc. San Diego, Calif., (1988), the entirety of which is herein incorporated by reference). This regeneration and growth process typically includes the steps of selection of transformed cells, culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil.

The development or regeneration of plants containing the foreign, exogenous gene that encodes a protein of interest is well known in the art. Preferably, the regenerated plants are self-pollinated to provide homozygous transgenic plants, as discussed before. Otherwise, pollen obtained from the regenerated plants is crossed to seed-grown plants of agronomically important lines. Conversely, pollen from plants of these important lines is used to pollinate regenerated plants. A transgenic plant of the present invention containing a desired polypeptide is cultivated using methods well known to one skilled in the art.

There are a variety of methods for the regeneration of plants from plant tissue. The particular method of regeneration will depend on the starting plant tissue and the particular plant species to be regenerated.

Methods for transforming dicots, primarily by use of *Agrobacterium tumefaciens*, and obtaining transgenic plants have been published for cotton (U.S. Pat. No. 5,004,863, U.S. Pat. No. 5,159,135, U.S. Pat. No. 5,518,908, all of which the entirety is herein incorporated by reference); soybean (U.S. Pat. No. 5,569,834, U.S. Pat. No. 5,416,011, McCabe et al., *Biotechnology* 6:923, (1988), Christou et al., *Plant Physiol.*, 87:671-674 (1988), all of which the entirety is herein incorporated by reference); *Brassica* (U.S. Pat. No. 5,463,174, the entirety of which is herein incorporated by reference); peanut (Cheng et al., *Plant Cell Rep.* 15: 653-657 (1996), McKently et al., *Plant Cell Rep.* 14:699-703 (1995), all of which the entirety is herein incorporated by reference); papaya (Yang et al., (1996), the entirety of which is herein incorporated by reference); pea (Grant et al., *Plant Cell Rep.* 15:254-258, (1995), the entirety of which is herein incorporated by reference).

Transformation of monocotyledons using electroporation, particle bombardment, and *Agrobacterium* have also been reported. Transformation and plant regeneration have been achieved in asparagus (Bytebier et al., *Proc. Natl. Acad. Sci. USA* 84:5345, (1987), the entirety of which is herein incorporated by reference); barley (Wan and Lemaux, *Plant Physiol* 104:37, (1994), the entirety of which is herein incorporated by reference); maize (Rhodes et al., *Science* 240: 204, (1988), Gordon-Kamm et al., *Plant Cell*, 2:603, (1990), Fromm et al., *Bio/Technology* 8:833, (1990), Koziel et al., *Bio/Technology* 11:194, (1993), Armstrong et al., *Crop Science* 35:550-557, (1995), all of which the entirety is herein incorporated by reference); oat (Somers et al., *Bio/Technology*, 10:1589, (1992), the entirety of which is herein incorporated by reference); orchardgrass (Horn et al., *Plant Cell Rep.* 7:469, (1988), the entirety of which is herein incorporated by reference); rice (Toriyama et al., *TheorAppl. Genet.* 205:34, (1986); Park et al., *Plant Mol. Biol.*, 32: 1135-1148, (1996); Abediniaetal., *Aust. J. Plant Physiol.* 24:133-141, (1997); Zhang and Wu, *Theor. Appl. Genet.* 76:835, (1988); Zhang et al. *Plant Cell Rep.* 7:379, (1988); Battraw and Hall, *Plant Sci.* 86:191-202, (1992); Christou et al., *Bio/Technology* 9:957, (1991), all of which the entirety is herein incorporated by reference); sugarcane (Bower and Birch, *Plant J.* 2:409, (1992), the entirety of which is herein incorporated by reference); tall fescue (Wang et al., *Bio/Technology* 10:691, (1992), the entirety of which is herein incorporated by reference), and wheat (Vasil et al., *Bio/Technology* 10:667, (1992), the entirety of which is herein incorporated by reference; U.S. Pat. No. 5,631,152, the entirety of which is herein incorporated by reference.

Assays for gene expression based on the transient expression of cloned nucleic acid constructs have been developed by introducing the nucleic acid molecules into plant cells by polyethylene glycol treatment, electroporation, or particle bombardment (Marcotte, et al., *Nature*, 335: 454-457 (1988), the entirety of which is herein incorporated by reference; Marcotte, et al., *Plant Cell*, 1: 523-532 (1989), the entirety of which is herein incorporated by reference; McCarty, et al., *Cell* 66: 895-905 (1991), the entirety of which is herein incorporated by reference; Hattori, et al., *Genes Dev.* 6: 609-618 (1992), the entirety of which is herein incorporated by reference; Goff, et al., *EMBO J.* 9: 2517-2522 (1990), the entirety of which is herein incorporated by reference). Transient expression systems may be used to functionally dissect gene constructs (See generally, Mailga et al., *Methods in Plant Molecular Biology*, Cold Spring Harbor Press (1995)).

Any of the nucleic acid molecules of the present invention may be introduced into a plant cell in a permanent or transient manner in combination with other genetic elements such as vectors, promoters enhancers etc. Further any of the nucleic acid molecules of the present invention may be introduced into a plant cell in a manner that allows for over expression of the protein or fragment thereof encoded by the nucleic acid molecule.

Cosuppression is the reduction in expression levels, usually at the level of RNA, of a particular endogenous gene or gene family by the expression of a homologous sense construct that is capable of transcribing mRNA of the same strandedness as the transcript of the endogenous gene (Napoli et al., *Plant Cell* 2: 279-289 (1990), the entirety of which is herein incorporated by reference; van der Krol et al., *Plant Cell* 2: 291-299 (1990), the entirety of which is herein incorporated by reference). Cosuppression may result from stable transformation with a single copy nucleic acid molecule that is homologous to a nucleic acid sequence found with the cell (Prolls and Meyer, *Plant J.* 2:465-475 (1992), the entirety of which is herein incorporated by reference) or with multiple copies of a nucleic acid molecule that is homologous to a nucleic acid sequence found with the cell (Mittlesten et al., *Mol. Gen. Genet.* 244: 325-330 (1994), the entirety of which is herein incorporated by reference). Genes, even though different, linked to homologous promoters may result in the cosuppression of the linked genes (Vaucheret, *C. R. Acad. Sci. III* 316: 1471-1483 (1993), the entirety of which is herein incorporated by reference).

This technique has, for example been applied to generate white flowers from red petunia and tomatoes that do not ripen on the vine. Up to 50% of petunia transformants that contained a sense copy of the chalcone synthase (CHS) gene produced white flowers or floral sectors; this was as a result of the post-transcriptional loss of mRNA encoding CHS (Flavell, *Proc. Natl. Acad. Sci.* (U.S.A.) 91:3490-3496 (1994)), the entirety of which is herein incorporated by reference). Cosuppression may require the coordinate transcription of the transgene and the endogenous gene, and can be reset by a developmental control mechanism (Jorgensen, *Trends Biotechnol*, 8:340344 (1990), the entirety of which is herein incorporated by reference; Meins and Kunz, In: *Gene Inactivation and Homologous Recombination in Plants* (Paszkowski, J., ed.), pp. 335-348. Kluwer Academic, Netherlands (1994), the entirety of which is herein incorporated by reference).

It is understood that one or more of the nucleic acids of the present invention including those comprising SEQ ID NO:1 through SEQ ID NO:8135 or complement thereof or fragments of either or other nucleic acid molecules of the present invention may be introduced into a plant cell and transcribed using an appropriate promoter with such transcription resulting in the co-suppression of an endogenous protein.

Antisense approaches are a way of preventing or reducing gene function by targeting the genetic material (Mol et al., *FEBS Lett.* 268: 427-430 (1990), the entirety of which is herein incorporated by reference). The objective of the antisense approach is to use a sequence complementary to the target gene to block its expression and create a mutant cell line or organism in which the level of a single chosen protein is selectively reduced or abolished. Antisense techniques have several advantages over other 'reverse genetic' approaches. The site of inactivation and its developmental effect can be manipulated by the choice of promoter for antisense genes or by the timing of external application or microinjection. Antisense can manipulate its specificity by selecting either unique regions of the target gene or regions where it shares homology to other related genes (Hiatt et al., *In Genetic Engineering*, Setlow (ed.), Vol. 11, New York: Plenum 49-63 (1989), the entirety of which is herein incorporated by reference).

The principle of regulation by antisense RNA is that RNA that is complementary to the target mRNA is introduced into cells, resulting in specific RNA:RNA duplexes being formed by base pairing between the antisense substrate and the target mRNA (Green et al., *Annu. Rev. Biochem.* 55: 569-597 (1986), the entirety of which is herein incorporated by reference). Under one embodiment, the process involves the introduction and expression of an antisense gene sequence. Such a sequence is one in which part or all of the normal gene sequences are placed under a promoter in inverted orientation so that the 'wrong' or complementary strand is transcribed into a noncoding antisense RNA that hybridizes with the target mRNA and interferes with its expression (Takayama and Inouye, *Crit. Rev. Biochem. Mol. Biol.* 25: 155-184 (1990), the entirety of which is herein incorporated by reference). An antisense vector is constructed by standard procedures and introduced into cells by transformation, transfection, electroporation, microinjection, or by infection, etc. The type of transformation and choice of vector will determine whether expression is transient or stable. The promoter used for the antisense gene may influence the level, timing, tissue, specificity, or inducibility of the antisense inhibition.

It is understood that protein synthesis activity in a plant cell may be reduced or depressed by growing a transformed plant cell containing a nucleic acid molecule whose non-transcribed strand encodes a protein or fragment thereof.

Antibodies have been expressed in plants (Hiatt et al., *Nature* 342:76-78 (1989), the entirety of which is herein incorporated by reference; Conrad and Fielder, *Plant. Mol Biol.* 26: 1023-1030 (1994), the entirety of which is herein incorporated by reference). Cytoplasmic expression of a scFv (single-chain Fv antibodies) has been reported to delay infection by artichoke mottled crinkle virus. Transgenic plants that express antibodies directed against endogenous proteins may exhibit a physiological effect (Philips et al., *EMBO J.* 16: 4489-4496 (1997), the entirety of which is herein incorporated by reference; Marion-Poll, *Trends in Plant Science* 2: 447-448 (1997), the entirety of which is herein incorporated by reference). For example, expressed anti-abscisic antibodies reportedly result in a general perturbation of seed development (Philips et al., *EMBO J.* 16: 4489-4496 (1997)).

Antibodies that are catalytic may also be expressed in plants (abzymes). The principle behind abzymes is that since antibodies may be raised against many molecules, this recognition ability can be directed toward generating antibodies that bind transition states to force a chemical reaction forward (Persidas, *Nature Biotechnology* 15:1313-1315 (1997), the entirety of which is herein incorporated by reference; Baca et al., *Ann. Rev. Biophys. Biomol. Struct.* 26:461-493 (1997), the entirety of which is herein incorporated by reference). The catalytic abilities of abzymes may be enhanced by site directed mutagenesis. Examples of abzymes are, for example, set forth in U.S. Pat. No. 5,658,753; U.S. Pat. No. 5,632,990; U.S. Pat. No. 5,631,137; U.S. Pat. No. 5,602,015; U.S. Pat. No. 5,559,538; U.S. Pat. No. 5,576,174; U.S. Pat. No. 5,500,358; U.S. Pat. 5,318,897; U.S. Pat. No. 5,298,409; U.S. Pat. No. 5,258,289 and U.S. Pat. No. 5,194,585, all of which are herein incorporated in their entirety.

It is understood that any of the antibodies of the present invention may be expressed in plants and that such expression can result in a physiological effect. It is also understood that any of the expressed antibodies may be catalytic.

In addition to the above discussed procedures, practitioners are familiar with the standard resource materials which describe specific conditions and procedures for the construction, manipulation and isolation of macromolecules (e.g., DNA molecules, plasmids, etc.), generation of recombinant organisms and the screening and isolating of clones, (see for example, Sambrook et al., *Molecular Cloning: A Laboratory Manual*, Cold Spring Harbor Press (1989); Mailga et al., *Methods in Plant Molecular Biology*, Cold Spring Harbor Press (1995), the entirety of which is herein incorporated by reference; Birren et al., *Genome Analysis: Analyzing DNA*, 1, Cold Spring Harbor, N.Y., the entirety of which is herein incorporated by reference).

The nucleotide sequence provided in SEQ ID NO: 1, through SEQ ID NO:8135 or fragment thereof, or complement thereof, or a nucleotide sequence at least 90% identical, preferably 95%, identical even more preferably 99% or 100% identical to the sequence provided in SEQ ID NO: 1 through SEQ ID NO:8135 or fragment thereof, or complement thereof, can be "provided" in a variety of mediums to facilitate use fragment thereof. Such a medium can also provide a subset thereof in a form that allows a skilled artisan to examine the sequences.

In one application of this embodiment, a nucleotide sequence of the present invention can be recorded on computer readable media. As used herein, "computer readable media" refers to any medium that can be read and accessed directly by a computer. Such media include, but are not limited to: magnetic storage media, such as floppy discs, hard disc, storage medium, and magnetic tape: optical storage media such as CD-ROM; electrical storage media such as RAM and ROM; and hybrids of these categories such as magnetic/optical storage media. A skilled artisan can readily appreciate how any of the presently known computer readable mediums can be used to create a manufacture comprising computer readable medium having recorded thereon a nucleotide sequence of the present invention.

As used herein, "recorded" refers to a process for storing information on computer readable medium. A skilled artisan can readily adopt any of the presently known methods for recording information on computer readable medium to generate media comprising the nucleotide sequence information of the present invention. A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII file, stored in a database application, such as DB2, Sybase, Oracle, or the like. A skilled artisan can readily adapt any number of data processor structuring formats (e.g. text file or database) in order to obtain computer readable medium having recorded thereon the nucleotide sequence information of the present invention.

By providing one or more of nucleotide sequences of the present invention, a skilled artisan can routinely access the sequence information for a variety of purposes. Computer software is publicly available which allows a skilled artisan to access sequence information provided in a computer readable medium. The examples which follow demonstrate how software which implements the BLAST (Altschul et al., *J. Mol. Biol.* 215:403-410 (1990)) and BLAZE (Brutlag et al., *Comp. Chem.* 17:203-207 (1993), the entirety of which is herein incorporated by reference) search algorithms on a Sybase system can be used to identify open reading frames (ORFs) within the genome that contain homology to ORFs or proteins from other organisms. Such ORFs are protein-encoding fragments within the sequences of the present invention and are useful in producing commercially important proteins such as enzymes used in amino acid biosynthesis, metabolism, transcription, translation, RNA processing, nucleic acid and a protein degradation, protein modification, and DNA replication, restriction, modification, recombination, and repair.

The present invention further provides systems, particularly computer-based systems, which contain the sequence information described herein. Such systems are designed to identify commercially important fragments of the nucleic acid molecule of the present invention. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A skilled artisan can readily appreciate that any one of the currently available computer-based system are suitable for use in the present invention.

As indicated above, the computer-based systems of the present invention comprise a data storage means having stored therein a nucleotide sequence of the present invention and the necessary hardware means and software means for supporting and implementing a search means. As used herein, "data storage means" refers to memory that can store nucleotide sequence information of the present invention, or a memory access means which can access manufactures having recorded thereon the nucleotide sequence information of the present invention. As used herein, "search means" refers to one or more programs which are implemented on the computer-based system to compare a target sequence or target structural motif with the sequence information stored within the data storage means. Search means are used to identify fragments or regions of the sequence of the present invention that match a particular target sequence or target motif. A variety of known algorithms are disclosed publicly and a variety of commercially available software for conducting search means are available and can be used in the computer-based systems of the present invention. Examples of such software include, but are not limited to, MacPattern (EMBL), BLASTIN and BLASTIX (NCBIA). One of the available algorithms or implementing software packages for conducting homology searches can be adapted for use in the present computer-based systems.

The most preferred sequence length of a target sequence is from about 10 to 100 amino acids or from about 30 to 300 nucleotide residues. However, it is well recognized that during searches for commercially important fragments of the nucleic acid molecules of the present invention, such as sequence fragments involved in gene expression and protein processing, may be of shorter length.

As used herein, "a target structural motif," or "target motif," refers to any rationally selected sequence or combination of sequences in which the sequences or sequence(s) are chosen based on a three-dimensional configuration which is formed upon the folding of the target motif. There are a variety of target motifs known in the art. Protein target motifs include, but are not limited to, enzymatic active sites and signal sequences. Nucleic acid target motifs include, but are not limited to, promoter sequences, cis elements, hairpin structures and inducible expression elements (protein binding sequences).

Thus, the present invention further provides an input means for receiving a target sequence, a data storage means for storing the target sequences of the present invention sequence identified using a search means as described above, and an output means for outputting the identified homologous sequences. A variety of structural formats for the input and output means can be used to input and output information in the computer-based systems of the present invention. A preferred format for an output means ranks fragments of the sequence of the present invention by varying degrees of homology to the target sequence or target motif. Such presentation provides a skilled artisan with a ranking of sequences which contain various amounts of the target sequence or target motif and identifies the degree of homology contained in the identified fragment.

A variety of comparing means can be used to compare a target sequence or target motif with the data storage means to identify sequence fragments sequence of the present invention. For example, implementing software which implement the BLAST and BLAZE algorithms (Altschul et al., *J. Mol. Biol.* 215:403-410 (1990)) can be used to identify open frames within the nucleic acid molecules of the present invention. A skilled artisan can readily recognize that any one of the publicly available homology search programs can be used as the search means for the computer-based systems of the present invention. Having now generally described the invention, the same will be more readily understood through reference to the following examples which are provided by way of illustration, and are not intended to be limiting of the present invention, unless specified.

EXAMPLE 1

The cDNA library of the present invention designated LIB3280, is prepared from *Triticum aestivum* anthers harvested from plants which reaches anthesis at the split boot stage. At this stage, the anthers should contain microspores with 2 nuclei which will further divide into 1 nuclei sperm. The wheat variety Piko, which is used as the primary male donor in Europe, is used for the collection. Seeds are harvested on June 98' and stored in a warehouse from June - September. In late September, the seeds are planted in 3 foot rows in a field at Monsanto's Indiana research facility. In February, plants are removed and sent to Chesterfield, Mo. The plants are potted and grown in a greenhouse till May when the plants reached anthesis at the split boot stage. Tillers are removed and dissected to separate anthers from other tissues. The harvested anther tissue is ground with a mortar and pestle in liquid nitrogen. Poly A+ RNA is isolated using Oligo dT DYNABEADS® from Dynal (Prod # 610.05) according to the direct isolation method described in Dynal's literature.

Construction of plant cDNA libraries is well-known in the art and a number of cloning strategies exist. A number of cDNA library construction kits are commercially available. The SUPERSCRIPT ™ Plasmid System for cDNA synthesis and Plasmid Cloning (Gibco BRL, Life Technologies, Gaithersburg, Md. U.S.A.) is used, following the conditions suggested by the manufacturer.

The cDNA library of the present invention designated LIB3281, is prepared from *Triticum aestivum* gynoecium tissue. The wheat variety Piko, which is used as the primary male donor in Europe, is used for the collection. Seeds are harvested on June 98' and stored in a warehouse from June-September. In late September, the seeds are planted in 3 foot rows in a field at Monsanto's Indiana research facility. In February, plants are removed and sent to Chesterfield, Mo. The plants are potted and grown in a greenhouse till May when the plants reach anthesis at the split boot stage. Tillers are removed from plants and dissected to separate the gynoecium from other tissues. The harvested gynoecium tissue is ground with a mortar and pestle in liquid nitrogen. Poly A+ RNA is isolated using Oligo dT Dynabeads from Dynal according to the direct isolation method described in Dynal's literature.

Construction of plant cDNA libraries is well-known in the art and a number of cloning strategies exist. A number of cDNA library construction kits are commercially available. The SUPERSCRIPT™ Plasmid System for cDNA synthesis and Plasmid Cloning (Gibco BRL, Life Technologies, Gaithersburg, Md. U.S.A.) is used, following the conditions suggested by the manufacturer.

EXAMPLE 2

The cDNA libraries are plated on LB agar containing the appropriate antibiotics for selection and incubated at 37° for a sufficient time to allow the growth of individual colonies. Single selective media colonies are individually placed in each well of a 96-well microtiter plates containing LB liquid including the selective antibiotics. The plates are incubated overnight at approximately 37° C. with gentle shaking to promote growth of the cultures. The plasmid DNA is isolated from each clone using Qiaprep plasmid isolation kits, using the conditions recommended by the manufacturer (Qiagen Inc., Santa Clara, Calif. U.S.A.).

Template plasmid DNA clones are used for subsequent sequencing. For sequencing, the cDNA libraries LOB 3280 and LIB 3281, a commercially available sequencing kit, such as the ABI PRISM® dRhodamine Terminator Cycle Sequencing Ready Reaction Kit with AMPLITAQ® DNA Polymerase, FS, is used under the conditions recommended by the manufacturer (PE Applied Biosystems, Foster City, Calif. U.S.A.). The ESTs of the present invention are generated by sequencing initiated from the 5' end of each cDNA clone.

A number of sequencing techniques are known in the art, including fluorescence-based sequencing methodologies. These methods have the detection, automation and instrumentation capability necessary for the analysis of large volumes of sequence data. Currently, the 377 DNA Sequencer (Perkin-Elmer Corp., Applied Biosystems Div., Foster City, Calif.) allows the most rapid electrophoresis and data collection. With these types of automated systems, fluorescent dye-labeled sequence reaction products are detected and data entered directly into the computer, producing a chromatogram that is subsequently viewed, stored, and analyzed using the corresponding software programs. These methods are known to those of skill in the art and have been described and reviewed (Birren et al., *Genome Analysis: Analyzing DNA*, 1, Cold Spring Harbor, N.Y., the entirety of which is herein incorporated by reference).

SEQUENCE LISTING (8135 sequences)

SEQ ID NO: 1 - DNA, 332 bp, Triticum aestivum
  Clone ID: LIB3280-001-P1-K1-A1
agggactttttttttgcctcaaagtaatatattgatgtaaattggggttgtttcaaaatgtacaagggatatcacttaacgatgatatagctatttactcccaaatcccatatatcaaatcgcagcaggataaagacaagacaaacattgtcttaatttagagctattcacatatagttcactcaagtaaaaacccaagttatcctctgtcatagctctggctatatcagaagaatgtcttatgcaaaggtttgtacatcacggcaaccaagaaccgttggttgtcatcttttcttggtaaccaccgagatctggtcagtttctgaccatgg

SEQ ID NO: 2 - DNA, 319 bp, Triticum aestivum
  Clone ID: LIB3280-001-P1-K1-A10
cccagagaaacgcccctcctcaccttgaacgtccaaggaagcagcacacaagtccggccagccaagatgtcgtggcagacttacgtcgacgagcacctgatgtgcgacatcgagggccaccacctcgcctccgcggccatcctcggccacgacggcaccgtctgggcccagagcgccgacttcccccagttcgcgcccgccgagatcactgccatcatgaaggacttcgacgagccggggcacctcgcccccaccggcatgttcgttgcaggtgccaagtacatggttatccaaggtgaacctggggccgtcatccgtg

SEQ ID NO: 3 - DNA, 357 bp, Triticum aestivum
  Clone ID: LIB3280-001-P1-K1-A11
caaacaacttcgaaaagctttcttcccgagactccactaaaaaggcgccacttctacggcaatatcctaacagaccaaagctaaaaccgaaagcttagtagagcagtggtaatccctacacctaacacgacctaatagactcctactaaaactactttctaacaagttctttctagtagtagggcaacaactaaatagaggacgccaagaaaaatccacgagtgcgttacaacagactaatcaacggcacggccgaaaaagatgtacactacccgccgcggggaggggcggctagaacgaggccacggccggcgcggtggcggcctctatgacgacggggacggggttctttttggg

SEQ ID NO: 4 - DNA, 401 bp, Triticum aestivum
  Clone ID: LIB3280-001-P1-K1-A12
caggatttgtttgctgagctacgaccaaacatgaccagatattcatcaatagatgaacttaactctgcattagctgaactcgaagaacacgagcgtgcggcctcagtagagaaacctgagagtgaaaggcactcggacaatgaatctcagaaaaggcagccacatgatgatggcaggggttcagcgaatggagctgagggaaatggtaaggatcatggagaaggcgcagatagtgagagctattcagatagtggcagcattggtggtcatgaagatgaagaagatcttctgtctgaggagaaatcaaatgatgcatcggagaacgaaggtgatgatgaggatgatgggatgcctgttggttctgatgaagatgagggtgttgaggttaggcaaaaggtcgt

SEQ ID NO: 5 - DNA, 274 bp, Triticum aestivum
  Clone ID: LIB3280-001-P1-K1-A2
gcgttctttcttagtaccgaggccaccaccatttttttttgtcttgcgactgacctacgcgcttccagaacccaatccctagccaacccaacgcttgatcctagttccccagcctactcacgggacatgggcgtggataatccgccgccgattaccgaattccagccgcgacgacagcgcgttcgtcttgatctcccagggctggcgcgaggtgcgggactcggcgaccgcgcgcctgcagatgatgctcactacggaccgattgggaactggt

SEQ ID NO: 6 - DNA, 398 bp, Triticum aestivum
  Clone ID: LIB3280-001-P1-K1-A3
gctaatatccatccttgcagctaaccgatcagatcatggccatggggactaggcgcgccgctctctgctttcttctgctagtcgccgtcttcttacaaggcaaccctacattggtttcagcggacgaggagtgcaagtacaggattccgtacgtacccttctgcaaggggtggagctgcaaggtggagtgctggctggaggccaagctcttccgcgcccgtctacaggagcacaagtgcatcaggggcggcatcaagggcgcctgctactgcctcttctgcgggaagcacctccaatgaaatacatacatcatccatccatcatttgctcgctcgctcgtccagtaggcattaccactagttatttatctcaaacgttcctcatccacgttcgcttat

SEQ ID NO: 7 - DNA, 218 bp, Triticum aestivum
  Clone ID: LIB3280-001-P1-K1-A4
gttgtactccatatgagcaatcgttcattatgtattgaactactcattactcagagaacggaggtgggcttcccttcctctgtgcctagaccatacatccaaccttcttatttttcacttaatccaggcgaagtaccacctccgtgagcttgttgaatggaggccgcggtagtccagacatcggtacctgtctgaaagtacatcccgacccgcttgac

SEQ ID NO: 8 - DNA, 246 bp, Triticum aestivum
  Clone ID: LIB3280-001-P1-K1-A6
aaagaaaagaaaaagcaagcccaccccgtgaaccctacatcctgcaaaccatgccgaccttgcatccctcccgcgcgccgccgcaccgtcctcgcttaccagcgcgcctcctgccggccttcttccagcgtgcctgcggtcggcctgtccttgagcgcgccgccgtccggccttctcctcgagcgcaccgctgccgggcctgcttctcagctcaccgacggccggcttgctcccaacagccatatt

SEQ ID NO: 9 - DNA, 232 bp, Triticum aestivum
  Clone ID: LIB3280-001-P1-K1-A7
gtctaactttagagccacctccctttttattatcgttattttcccaggaaggctttccttaaaaactgaatcagattgatcccagtatttcagcgtcattatgcctctctttttcttcaacatacagcgtaagaggcatcctaatgttccatccccaacagtggcacagctctgcatatccttcatcccccatgactggctccaggtgcagattctcggcaaccgccttctc

SEQ ID NO: 10 - DNA, 253 bp, Triticum aestivum
  Clone ID: LIB3280-001-P1-K1-A8
taaccgatcagatcatggccatggggactaaggcgcgccgctctcagctttcttctgctagtcgccgtcttcttacaaggcaaccctacattggtttcagcggacgaggagtgcaagtacaggattccgtacgtacccttctgcaaggggtggagctgcaaggtggagtgctggctggaggccaagcttttccgcgcccgtctacaggagcacaagtgcattaggggcggcatcaagggcgcctgctactgcc

SEQ ID NO: 11 - DNA, 394 bp, Triticum aestivum
  Clone ID: LIB3280-001-P1-K1-A9
gtttctgaatctgcccaatttggtgtcgatcgggcgcatggcgtcggggccgctcattggatggatgattatgaatgaatggtatcttcctgcttttggcacattagctttgtctggtgcaagtgattggttggatggttttttagcaagaaagatgggcatcaattctgtcattggttcatatctggacccattggctgacaaggtgttgatttgctgtgttgctgtagcaatggttgagaaggagctcttacatcctggccttgttggcctggtggttgcaagagactttctcctggtgggtggggctttctacaaacgagcatccagcctgggatggaagtggaacagttggtcaaacttttgtaacttagatgcaattcagcgtgagaag

SEQ ID NO: 12 - DNA, 187 bp, Triticum aestivum
  Clone ID: LIB3280-001-P1-K1-B1
gttcaacttctgtatcatgtcacagatggctggagcatctctctggagtctcttcgggcgagcagcggcttgtagcaggcagtgggagcttctctgccagccagtaggctcgcaggcatctcgagcatagagtcgtagagctgtcaaatctgaagtcagtctcagcttcgcggtagtttcctctaga

SEQ ID NO: 13 - DNA, 399 bp, Triticum aestivum
  Clone ID: LIB3280-001-P1-K1-B10
cccacgcgtccggacaatatctctgtcaccaagggggttgtttctagagtggaaccaacacagtatgcccatggtgcgactcagctcatggctatacaaatagatgcagctattaatccaggcaatagtggagggcctgcaatcatgggtgataaagtggctggagttgctttccaaaatctgtcaggagcagaaaacattgggtatattatacctgtgcctgtaattaagcgttttatttctggtgtggaagagagtggcaaatattctgggttttgttctcttgggatatcttgccaggccactgagaacatccaaataagagagtgctttggtatgcggcctgaaatgactggagtgttagtcagtagaataaatcctctgtctggtgcttacgaa

SEQ ID NO: 14 - DNA, 400 bp, Triticum aestivum
  Clone ID: LIB3280-001-P1-K1-B11
gctagctccgccctcctcctcctcgccctcgtggccctggcgggcctcgtcgatctgcaggcctccgcggccgccccgacgcccgctcacgccgcggaggtctccttggcggcggcggcggcgacgatgggcatggcggatcaggagctggacgggacggtgcagtgcctgatcgggtgcttgacgactgttctgggctgcgccttcaagtgcctgcgcgtgcgcaagggcattgacctgccgctctgcgtcatcggctgcaacgataggggcatcgtctgcatgttcagctgcggcaagccaccttccccgccgggtcccaagccgccagtgccaccttatcccacaccgacgccgtctgctcccacaccgacgccgtcagagccgtctgctcccacac

SEQ ID NO: 15 - DNA, 402 bp, Triticum aestivum
  Clone ID: LIB3280-001-P1-K1-B12
ccgaggacaggccccccttcgactaccgtgattacagccgctcgccgcccgatgatgaaccgagcaagagcaccggcgccgcctccggggcgcgggacttcgactacgacgactacagcgggggcgacaagctccgtggcgccgcctccggggcgcgggacttcgactacgacgactacagcggggccgacaagctccgtggcgccaccgatgaatacaaggcgccgagcagcagcctcgctggaaacggggcgtccatggctaggggcggcaaggcggagacgacgacggtgttctttcacgaggaggcggtgcgcgtcggcaagaggctcccattccgcttcccgccggcgactcccgccgcgctcggtttcctgccgcgccaggtcgccgactccgtcc

SEQ ID NO: 16 - DNA, 360 bp, Triticum aestivum
  Clone ID: LIB3280-001-P1-K1-B2
acctcacaaacatttttcatagttgattgcggttttcaacattagatatgtgacattccatctagtgcatatatccaaactcaagaatacagccttgcaccttttctaaatcagcaagttctttaaattttgtaattctagatggcccactgaatgagaccagatttaatctcggttagctgagtttagcaaacccgtacactatattgatacggagaacttcccgttacaagtagcctaagacacttcattcagcagtgttataaataatacagtacgtgtacacccattagcacgcggctttttggtcgatgcgctaatccctccgcacctggtgatcgcgcttacatatcgattggg

SEQ ID NO: 17 - DNA, 363 bp, Triticum aestivum
  Clone ID: LIB3280-001-P1-K1-B3
acaatacggcaacgaataacaaagttctggctccatacgatagtcagcattgtatttatttcgacaaagagaaaaaaacaaagcacttcttacctaagcttgcagtagttctagttctcaaaacaccattatggatagagaatatatgcataaaagtccacgagaacaacatagggcgactcgagcatagctcgtactaacttcctaaacggcgctcttctaccagtgttctctactggtagttcctccctggcccgtccctgccctcgtagggaggaggggcggcgttgttgtagttaccgccaccttggtagcctgggttaccacctggttggccctggtagtctggtgcaccaccaccat

SEQ ID NO: 18 - DNA, 355 bp, Triticum aestivum
  Clone ID: LIB3280-001-P1-K1-B4
agtcccatcaaacttgattgactgataaatgatgtacacaagaccaaatcaagtccagcaagaaaatggcatcagacgagacactgaaaatggcatgcacaggtttactggccagctggtgttgcgttgatgatgtcggaatcgccagggtcgatgatactcaggcagcagactcggaagtatttaccacacgcagttcccaaatcaacattgtttccatggtagtggtggacagtgatcttcgccaacatagcatagtactcaatctcagacttgcggagtggagggcagttgttagcaaggatcacaagctttgccttggagttcctgagggtcctgaggacggtcttgtagc

SEQ ID NO: 19 - DNA, 342 bp, Triticum aestivum
  Clone ID: LIB3280-001-P1-K1-B5
agtcccaagagaacgtttttgactgataaatgatgttcccactaccaatttaagtccagaaagaaaattgtctcagactacacacattaaatggcttgcacaggtttactgtccaactggagttgcatttatgatctccaaattgtcaggtgcaataatcctcaggcatcatactctgaagtttttaccacacgcagatcccaaattaacattgttttcatgatattattggacaatgatttttaccaacatatcataatactcaattttagacttgcggagaagaagcaattgttatccaaggatcacaaagttttgcctttgagttctcaaaaattcctt

SEQ ID NO: 20 - DNA, 406 bp, Triticum aestivum
  Clone ID: LIB3280-001-P1-K1-B6
gacgaaccggagaggaacatcaggttttagcatcgcgattttcccagaagcgtttcgcggagaaatttcgtcagattgttccccggattccagcgcaaagatgccgcgcattcccatgatcagattccccaagaggcatctcaaagtcccatccccagcagcggcgcagcctgcagatcagcacgcgaccctcatgtcccgattgggagctaaagtagaggcaccatcttctggagagaaaaagaattaccgctttagatcagatgtgccttccgcaccttctcataatgctgttggagggccagcttcacagcttcccaagcgcaaaccactatctgaggaagagattgaagctatcatgcaaggcggtgtcttctgatattgcttccagccagtggcacctttt

SEQ ID NO: 21 - DNA, 271 bp, Triticum aestivum
  Clone ID: LIB3280-001-P1-K1-B7
gacgaaccggagaggaacatcaggttttagcatcgtgattttcccaggagcgttttgcgtagaaatttcgtcagattgttccccggattccagcgcaaagatgccgcgcattcccatgatcagattccccaagaggcatctcaaagtcccatccccagcagcggcgcagcctgcagatcagcacgcgacccttatgtcccgattgggagctaaagcagttagctgattttagcaaacccatacactatattgattcggagaactttccgtt

SEQ ID NO: 22 - DNA, 383 bp, Triticum aestivum
  Clone ID: LIB3280-001-P1-K1-B8
cccacgcgtccgcccagtttcgcgcacggagctggccatcgagatcgatcaagccggagggaacccaagacgcgcacggcgttgttgtcgtccggctagccgggccatggcgagcagcctcctccccgtcgtggcgctcctcgcgctgctcttcggcgcgtcgcgcgccaccgacttcgaggtcggcggcgacgccgggtgggtcgtgccggcggccggcgactccggcacctacaacgactgggcgtccaagaaccgcttcctcgtcggcgacagcgttcatttcaagtacaaggcggactcggtgatggaggtgacgcaggaggagtacgacaagtgcgggtcgacgcacctcatcttcttctccaacaacggtgacaccg

SEQ ID NO: 23 - DNA, 363 bp, Triticum aestivum
  Clone ID: LIB3280-001-P1-K1-B9
gcaagaagctcactcagctacccccagtcccgatcacaggtagctagccactcgacgcaatcggcatggccagcaagtcggtgtccctgctggtcctcgcggcgctggtggccgcggcgtgcctcgccgggctgggctcggcggcgcgcgacatgccggcggagaagcccgcggaggacgcggtgaagcggccggagacgttccaggaggggacggtgctgatcccggggatcgggcggtacgagctgggcacccactacatcccggacatcggcgggctggaccacagcatcccggccgccgccagcgggcagttcatccccggcgccgacgacacctgggtgcccaaccccggctttgaga

SEQ ID NO: 24 - DNA, 220 bp, Triticum aestivum
  Clone ID: LIB3280-001-P1-K1-C1
cggacgcgtgggggaagccagcattttattacagtggcagccacacatccgcataggaccatcagataagggaagggtagagcagcccgcgtcaagttcataggccacggatttacatccttcttgcttctaaaaccctggtgttccccaacttcctctccttgctggactttgccgttctcgacattcctgtagtaaagcccagggaggacccggtgat

SEQ ID NO: 25 - DNA, 113 bp, Triticum aestivum
  unsure (1)...(113): unsure at all n locations
  Clone ID: LIB3280-001-P1-K1-C10
cctacacatcctcccacgcctccgttatatgataggttaatcacacaagaagagctntttcattggcaaatatttctattattaccttttatctccttagaagtatctcttct

SEQ ID NO: 26 - DNA, 307 bp, Triticum aestivum
  Clone ID: LIB3280-001-P1-K1-C11
gctagctacgccctcctcctcctcttccttgtggccctggcgatccggggagatctgcaagcctccgaagtcgcccctactcccgtttacgccgcggaggtcttcttggcggcggcggcggcgacgataggcatggcggatcaggagctggacagaacggtgcattgcctgatcgggtgctcgacgactgttctgggctgtgccttcaactgcctgtgcgtgcgcaagggcattgacctgccgatctgcgttatctgctgcaacgataggcgcatcgtctgcatgttcagttgttgcaagccacctt

SEQ ID NO: 27 - DNA, 403 bp, Triticum aestivum
  Clone ID: LIB3280-001-P1-K1-C12
gttgcggggtctgatgcatcagtgaacgtggctcctcagcaactgcttggacaaggtgctacacaggagggcagctcaaatgtgctttcggttggtctgccgtctgttgtggttcatcaacaggatgaacatcagcctgcgagtggtgtatcaaaggttgatagttcagtacagggacccccacctcaggttggccaggtgaccggtgccaagaagcgcaagcttgggtctgtcaggaggttcaagcaggatgaggcgcagcaggagcaagggcaagttgtcaatggcacaagtgagaagcctggcaatgagaaaactgattccgcacaaggagaaacgggtgataggaccaagggggagggcggtgctaaccgttgcatcactaagatcatcaagccagtgt

SEQ ID NO: 28 - DNA, 98 bp, Triticum aestivum
  Clone ID: LIB3280-001-P1-K1-C2
actatttaagtttctctaccccagagggccatctcataagagaaggatatttccacctccatttaatccactgtccgtcatttttacaaccttcattc

SEQ ID NO: 29 - DNA, 404 bp, Triticum aestivum
  Clone ID: LIB3280-001-P1-K1-C4
cggacgcgtgggcgcggacaagaacctggtcgccctctacgccggagggtaccaccctctccctccgcatactaccgccgccgaattccgccccgctcctaggcctgcgctcgggccacatctccagcgcggacaagaacctggtcgccctctacgccggagggtaccaccctggcgccgatacgattgcggagatgggagcctatctcatctacgacgccagggatggctccctctccgtcatcccccctatcccctccgacgacgagtatctggccatggggcaccagtcggccgtcgtcatgtgcgacgccaccgggaccgggggtggctaccttcttgccgagctcgtctgggtcatgccagggttctcccgagccgccgtctggctgtgggagtcgtct

SEQ ID NO: 30 - DNA, 361 bp, Triticum aestivum
  Clone ID: LIB3280-001-P1-K1-C5
gattttaaggcaattctttacaactgaataataaaccaggattcagatgaagtgttgcaaaagagcttctgttgcgaagagctcgaacccaaaacttagcattttctaatctacaaaatcgagcttctaccaccaaagattgccatcgtggaacccttattatatagttatacagtaattctccggagaagtctctactacaaggcaagctaaaaactcacaagagaaggttaaaaaagaatagctataattacacatgctcaatatatccatcccaacagctttgtgcctctcactcggctccagctgacccgttacagttgggtgagcacttcgccggtgagccatcgaggagctgcgt

SEQ ID NO: 31 - DNA, 401 bp, Triticum aestivum
  Clone ID: LIB3280-001-P1-K1-C7
ggctgttgatcagttaactgtttatttgagagatgacaatgctattgagttgccctacagtgttgagaatcgtgaaaaggcccctgttgagaaagacagcgatggcgaggattcagtcactcctgccatgacaaaacttacctcagaagaatctcagcactcaatgtctctcaagcccgaggaagcctgtggggttctgtatgttgaccttggcatgactgctgcagtgcagggagagcttgagcaggccaattacctggtgagccgtggttttgcaatgttgcccaacagccctagggcactgctagcatccatctatgtggatcttctgcaagggaaggtgcaagaagctatcggcaagttgagaaggtgcagaaacgtgagattaagaccagtagtgt

SEQ ID NO: 32 - DNA, 221 bp, Triticum aestivum
  Clone ID: LIB3280-001-P1-K1-C8
tttttgttttttttttttttttttttttttttttttttttttttgaaaaacgaagggaacgaaaaaaaaaaacattacaccacgtattttatgtatgtatcggggggagccaaaaaaatattttaatttgttttccggccgaaaactactggccgtgggcaacggcccccggttaaactgatcggggggggaaccaataccactggccccctaatgtcccg

SEQ ID NO: 33 - DNA, 375 bp, Triticum aestivum
  Clone ID: LIB3280-001-P1-K1-C9
cccacgcgtccgcccacgcgtccgaaagaggagaggtaaatcacacagagaaccatcagcaatggcgaagatttctagtagcaccgttgttctcctggtgtttctcgtctcgtcgaggggggcattgccggtgctgtcccgtggaggcctggaggatggaggaggcgggccaaacggtggtatcggtgctaatgttgggcttcaaaagtctgtcggtgctaatattggtgttggtgcgaatggaggcgctggtgctggtgctggtgctggcattggagcaaatgtaggtgttggagcaaatgtatgtgccaatgctggtcttggtgccgctgcaaatggaaatggtggtgctcgttttgttgttcgtgcacataa

SEQ ID NO: 34 - DNA, 228 bp, Triticum aestivum
  Clone ID: LIB3280-001-P1-K1-D1
cccacgcgtccgcccacgcgtgcgcttttcccttccctgtcgcggaggaagagaggaccgtccgaatcgagcccattcgagctcgattttagccgtcaaaaagtttagcgtgctccatacaggggcttgccgtacgggcaaagctttgagcggtagatcgctcgcggtgggcggcgagatctgtgacccaaaccctaagttgcggcagctccgtcgtgggggtgaaat

SEQ ID NO: 35 - DNA, 162 bp, Triticum aestivum
  Clone ID: LIB3280-001-P1-K1-D10
ctcagagaggcttttccaaaaaggattctttcttttttcactttaaataaatcaaaccttccgcccttttataatatcacgtcccccaagaagcaccccacaaccccataaaaaataatttccttcccactaatcatacctccacatttatgttcccaaaaa

SEQ ID NO: 36 - DNA, 403 bp, Triticum aestivum
  Clone ID: LIB3280-001-P1-K1-D12
cgccgtcactctgctcagctccagctccccaatcaagcgaggcaaaagccctagcccgcgagctccggcggccgccactccctccctcccctcccacgcacgagcggcgcggcctccgtccgccccctcaatcggggtccagcaatgccccggcggcggccgagggccggggagaagcggatggacgccgcgatcgaccacttcgccgagatgggataccgcaaagccgacgtccgccgcgtcgtcaacaagctcctcaaggatgtgtatgggaaggatgggtggccgttgctggagggcagttgttactccgtagtgcaagaagcgctctttgagatggaggagcaggagaagttgcagcagcagcagcagcagcagcagaatgaggatgatgatggtgatg

SEQ ID NO: 37 - DNA, 348 bp, Triticum aestivum
  Clone ID: LIB3280-001-P1-K1-D3
aaaaatgaagggagagtgaataatgattggcagcaatcatcatatatatacaggaggaaattgatcgtgatcatcaacaggcccgtgtgccaacccagggcagcttcacggggccgatgggccaggcggcgccgcgcactgaatgccacgcggggccaccggcgacggggccctccacggcccacgccatgcagcatcattacaccggcgacgcggagggcccggcgccgctgatcgccgaccgccaaacagggtcgacctcgcctttggcggcggcggcgagccaagcgtctactttttttaaaagcacccatcttttatttaacatcaaaggttattcttatctta

SEQ ID NO: 38 - DNA, 268 bp, Triticum aestivum
  Clone ID: LIB3280-001-P1-K1-D5
ccgcccaggagctgtcggaggagaaggcgctggcctactcatgcctcgcgtggatccacattcgaagggcagctgctcctctgatgttttgaataaatgaaaccttccgctccttagaaactctcgtctccacccagaacagccgcacatcgcgatgcatgctccttttcgctggttttcccagtgtgtatgaatgaggcttgtagctccccttttgcctgatgatttacaggacagtacatttgctggaaggatgaaacaatttgac

SEQ ID NO: 39 - DNA, 279 bp, Triticum aestivum
  Clone ID: LIB3280-001-P1-K1-D6
acgttctagatctttaaatcgtacgtacgcatgcattctacatgaaaagtttcttctatgattacctaaattcaaataaccgagcggtgcgtcctacgtccgccccctcaatcggagtccagcaatgccccggcggcggccgagggccggagagaagcggatggacgccgcgatcgaccactttgccgagatgggataccgcaaagccgacgtcgtccatcttgttataaaacttctcaaggatgtgtatttgaaagataagtgctcgttggtcaaagg

SEQ ID NO: 40 - DNA, 343 bp, Triticum aestivum
  Clone ID: LIB3280-001-P1-K1-D7
gaccgaaaccctcgcgtcctcctccgcgccgccgcctatctcctccgcccctccaccgccgccccgcaacccctaacgaacgccagacctcccctgccactttctccgcggggcctcatcctccctgcacaacgccgcgccttctcgacggactacggcaaggacgtcgacgaggtgaaccgcaagttcgccgaagcgcgggaggagatcgaggctgccatggacagcaaggagacggtgtacttcaacgaggaggccgcctgcgcgcgcgacgcggccggcgaggccctcggcgccttcgacgcgctgcttgcgcgggtcccgcccgcagacgccgacgcgc

SEQ ID NO: 41 - DNA, 400 bp, Triticum aestivum
  Clone ID: LIB3280-001-P1-K1-D8
gcaaagctttgccaagaggactactaccagaggaggagacaaggaatccggggggctcgcttccccttcagcccaaccccaaccccaaccaggccccgcggcgaccacaagctccttcgctccccgcaacctcgtctcgccacgctcaggtcggtcaggctgttgagtggccagaaatcttgatatggatgtgcctgctgctccagccatggcatttaaagcctacaagttcaaagaggtttttgtcagggactacttgctcgcagactcttatgctccatacactgctgtgcttggggggatcctgatgtgcaaattggcctatgatttcacgcgcattattaggttatttaactacaaaggatatgcttttttttacaattttcatttcatttgattg

SEQ ID NO: 42 - DNA, 241 bp, Triticum aestivum
  Clone ID: LIB3280-001-P1-K1-D9
tttttgtttttttttttttttttttttttttttttttttgaggcttcaccccatcctcggcggttttattattattgcactcattttacgaaccccaccccaccataaaaaaaattactctgccactatggggacgggacaatcctatgggccaaaaaatgatcaccctagaggtccaaaattgtaagaaggagaaaacagccattgcagaggcctttctatgccttttgcttggactttt

SEQ ID NO: 43 - DNA, 197 bp, Triticum aestivum
  Clone ID: LIB3280-001-P1-K1-E1
cgcacacgagggcagctttctgccatactctgccacacatttttatgctttcagagagatttctgtagcgaggcatgttacgttcttacatgaagcaaagacttcttttgcacaccatggagtgaaaatctctaatctggaaggggatctcccagccatgatggcgcagaaagacaaggccgtggtccggttaacaa

SEQ ID NO: 44 - DNA, 402 bp, Triticum aestivum
  Clone ID: LIB3280-001-P1-K1-E10
gttcatcttgggcgtcgttctccttgccggagagcgtgccggcggtggcggagttcgctggcggctgcgcgatgctccgggccgtgtgtcggtctatggaggtgcgcggtgcggcgaggaggtcgcggtggctgcggcggcacggtgaggaggccgcggaggacctgcgtggtggcagcttcaacgacacacagcggcatggcggcatggaggtgctgcgctgcggttgaggccgcagcggtgcagggcaataagccgtggcggcgagccgggcgcaaccggtgcgtgttatgggtgcacactgaacgcgtcgggcgcgtcgggaccgcgggcgcgcgtacgagcgtgcggttgacgttgggaggaggcgtatgtcgccgttgtgctcgagtcaatgctcga

SEQ ID NO: 45 - DNA, 395 bp, Triticum aestivum
  Clone ID: LIB3280-001-P1-K1-E11
gatttgcctgctcatgaacatgccgcttaccagggacacgctcctctattcgaatgtcaagatggattagtttgtgctacatatgaattttcgcacgatgtcattgaagttgtcaacagtcatgcgtgtttttattctttggaccttgggtttacaatagggacgctgagtgtgggcttgctgctcacccagtgcagcataaaaatactctgttgctatgtggacccttcatttagaattgtactgccactgcctgcatgggcttctctcgtttccccgtaaataaataaaaaacaatcgagaggagtgtattttgttaatatcagcgaagattgtactatattgttgtaaaaacccagtatctgaataaattcgccacttggatattcattggg

SEQ ID NO: 46 - DNA, 172 bp, Triticum aestivum
  Clone ID: LIB3280-001-P1-K1-E12
gatttgcctgctcatgaacatgcttcttaccagggacacgctccttgaggggaatgtcaagatggatgaggttgtgctacatatgaattttctcacgatgtcattgaagttgtctaacagttatgcgtgtttttattctttgtaccttaggtgtacaatagggacgctgagt

SEQ ID NO: 47 - DNA, 88 bp, Triticum aestivum
  Clone ID: LIB3280-001-P1-K1-E2
gcgagtggcgccgcctggagcgcgtgcgcgccccgccgtctgcggctcacgtggaggtgcgcggccgcgtgtggtgcatctagggcac

SEQ ID NO: 48 - DNA, 402 bp, Triticum aestivum
  Clone ID: LIB3280-001-P1-K1-E3
cggacgcgtgggtttcaaattagtgattgcaaagccttattgaattgccgcttttgaatggcagggactggtgaagcacaaagagtgacacatggaaatggcgtgcaacctacttacacatagaatatttcaagagattgttccttcaaatgctggaaatgttcttggtactgaagataacgttctgacaaagaagcgggtatcacttattgatcaccaggtgatgaatatattggtggggatgcaagaaatgtaccatatttttcaccattcccatatggctatcgtacttcaacacctatggaagaagatgatgagcagccaaatacttctagttcctattgtaaataaagcaaaagaagttttgtggcaaagatgcagaccgcaagaccaaactaagcc

SEQ ID NO: 49 - DNA, 361 bp, Triticum aestivum
  Clone ID: LIB3280-001-P1-K1-E5
acgttctttggtgcaatccaaaggttagttcatgtctcatggcgtcggctgtttgcgggtgttctcatatacatgcatatacatatgcatcttgtcatcgtcgtgtatatttgtatttctcgaagaaggaaaattggcatacacacgtgccttgagctcgcactcggacatagccgccgatcgagcaggaaaagtaaatggaagtaaccgccggccagccgttctatactttgggggcggatggagtgggcgtggttggaggtttcaggtcttcgtacctcgcgtatggtgaaagtgggcgccctggatcagcagtgggggcggcggtggcgggagcgccgttggcgttggaatccaacag

SEQ ID NO: 50 - DNA, 213 bp, Triticum aestivum
  Clone ID: LIB3280-001-P1-K1-E6
tcatcaagaaacctggagaggatcatggccggcgtgaacaccagtgtggtcggactcaagcccgccgcggcggtgccgcagtccgtctcgccggcgacggaaaagcgcgttcaggtcgcccctcccaaggaccggcgggcggcgcttctcggtctggcggacggtttcaccgtgaccgtcatacgcttggggtgatggaagcctagctcattt

SEQ ID NO: 51 - DNA, 388 bp, Triticum aestivum
  Clone ID: LIB3280-001-P1-K1-E7
gaagaggggcaccctcggcggcacctgcctcaacgtcggatgcatcccctccaaggctctgttgcactcttctcatatgtaccatgaagcaaagacttcttttgcacaccatggagtgaaaatctctaatctggaagtggatctcccagccatgatggcgcagaaagacaaggccgtggccgggttaacaaaaggaatcgaaggcctctttaagaagaacaaagtgacatatgtcaaaggctttgggaaacttacttccccttcagaagtttcggttgatttggtcgatggtggtaacactgttgtcaaaggaaaaaacataatcattgccactggatctgatgtaaaatcacttcctgggattacaattgacgagaagaagattgtc

SEQ ID NO: 52 - DNA, 398 bp, Triticum aestivum
  Clone ID: LIB3280-001-P1-K1-E8
catcgcgccggactggcgggggtatggcctctccgaccagccaccggagccggaggcggcggcctacagcgacctgacagaggatctcctcgccgtcctggatgcgctctccgtccccaaggcttaccttgtggcaaaggatttcggagccatgctagcttatgattttgctcttcgtcaccccagccgcacatgcggcgttatgtgtttgggcatcccatttcttcacggtggctcctccttcactgccatgcccgaaggcttctatatactgcgttggcgggaaccaggaagagcagaggcagactttggcaggtatgacgtcaagcgagtcgtgcgcaccatctacattctcttctctagaagcgaaatcccgatagcgaaggaagatcaagaaa

SEQ ID NO: 53 - DNA, 393 bp, Triticum aestivum
  Clone ID: LIB3280-001-P1-K1-E9
gccacttcgacccctacggcccgatctacaacgaccgggagcgtgctcagattttcatctcggatgtcggcgtgctggccgtgtccctcgccttgttgaagctcgtgtcgtcgttcgggttctggtgggtggtgcgggtctacggcgtgccgctgctgatcgtgaacgcgtggctggtcctgatcacctacctgcagcacacccacccggcgctgccgcactacgactcgacggagtgggactggctgcgcggggcgctcgccaccatggaccgcgactacggcatcctcaaccgcgtgttccacaacatcacagacacgcacgtggcgcaccacctcttctccaccatgccgtactaccacgccatggaggccaccaaggcgatcaagccca

SEQ ID NO: 54 - DNA, 406 bp, Triticum aestivum
  Clone ID: LIB3280-001-P1-K1-F1
caatttcctccgcgaactcatcgcatcctgagcgagcaaccccccacaccctcccccccgggaccacgtgacggagaagttgaggataatgacgtcgtcgtcggcggcgaggaaccagcacctggatgagctccgcgctctcatggcgtcgcactcgccgccgatccacgcgctcctcatcccctccgaggatgctcaccagagcgagtacgtgtcggagcgggacaagcggcggcaattcatctccgggttcactgggagcgctgggttggcccttatcactacaaaggaggcgttattatggacggatggacgatacttcttgcaggccacaaatcaacttagcgatcggtggagactcatgcgcatgggagaagacccaccagtcgaagtctggatagctgat

SEQ ID NO: 55 - DNA, 366 bp, Triticum aestivum
  Clone ID: LIB3280-001-P1-K1-F10
aaaccaactaatgggattccattttatttccaacatttaacgactacagtcaaaatgaagaggatccgtaccaaaagaaggaaacaaaacatgaaactaataaactatgaaaaactaaacaaaacacgaaagaaactatgaaaaactaaactgaggatcaacaggaatcccacgttattgagcctttatccattgttactgagccgaattgctcgtggcatgcgggcgatctaggggcggcgcaacgggggagcgaggggagggagagggccgggcggagtcttggccgcgatcttggtgaggaagttgacggcgatcctgatcatcttctggaactccacgaggctggcctcgaggatgagcctg

SEQ ID NO: 56 - DNA, 315 bp, Triticum aestivum
  Clone ID: LIB3280-001-P1-K1-F11
aaaccaacggaggggatttcattttattggcaacatttaacgactacagtcaaaatgaagaggatccgcaccaaaagaaggaaacaaaacatgaaactaataaactatgaaaaactaaaccaaacacgaaagaaactatgaaaaactaaactgaggatcaacaggaatcccacgttattgaggctttatccattgttactgatccgaattgttcgtggtatgcgggctatttaagagcagggtcatctagtggagcaattttgagggagagggccgttcagaattttgtctcatcatcttagtgaggaatttaac

SEQ ID NO: 57 - DNA, 402 bp, Triticum aestivum
  Clone ID: LIB3280-001-P1-K1-F12
cccacgcgtccgggtgcaggtacttcaccaaggacttcaagggctccgtgcccggctactctgtcaacaccgtcgacaccaccggcgccggcgacgccttcgtcggctccctcctcgtcagcgtctccaaggacgactccatcttctacaatgaggcgaagctgagggaggtgctgcagttctcgaacgcttgcggcgccatctgcaccaccaagaagggagccatcccggcgctgcccaccaccgccaccgccctggagctcatcagcaagggcagcaactagagacgccttgtgtcgcgccgtcgggtctgaatcttaggggagtttagctgcacttttattattagggatgaattgagtttagttcgtgtgtgtcagtgtgtgacctcgtgggcgctta

SEQ ID NO: 58 - DNA, 405 bp, Triticum aestivum
  Clone ID: LIB3280-001-P1-K1-F2
ggaagtgtagttcacatccccctttaacccttttaacacctaccaaaaatggcgtcatcacacaagttcttcccggccgtcctcctcctcctgctgctggttgtcgccatggaggtggcgccggcgcaggcggaggagccgagggtgtgcgagacggatagcactcggttcaaggggatatgcatggttggcacaaactgcgccaacatttgcctcaccgagggcttcaccagcggcaagtgctctggcttgaagaggaagtgcatttgcaccaaaccatgctagctagactgataaaacgtggtaatgaccgtaaatacctatagatctgttctcaagatggtctgagtcacatcgatctgccgtgcatgcctctgcatacttcaggttcacggcatcgcgatg

SEQ ID NO: 59 - DNA, 402 bp, Triticum aestivum
  Clone ID: LIB3280-001-P1-K1-F3
cggacgcgtgggtagttccagcgacggcggcggccgtggaggagagaggtggtggaggtgtgcgacgatacggcggagtgcgggtacctgtgttggctggaggaggagaagtcgtcgggtggcgtgtcggcgggcgaggacgacggcgccgaggctagtccggcggtgaacgagatcgacaagctggcggagaagttcatcgcgaggttccacgcaaagttcttgctggagaagcaggagtcgtaccggaggtaccaggagatgatcgccaggagcatatgaaccacgagatccatggcgatccatcgagggttcatccattgcgccgggcggcttggtgttcggactttgagaattcgtagtactacgtgagttcgaattcgatgttgaacagtgagttat

SEQ ID NO: 60 - DNA, 400 bp, Triticum aestivum
  Clone ID: LIB3280-001-P1-K1-F4
cgagcactcgcagccctacttcaagcctccccacctggacaaccccatttccactctcctgctgtctgaaacctcgatggcatttggaaggtcacttgtcactgacagcaacggcaactacaagggaccgctcacactctcactgaagcaagggtcacttctggtgatgcgcgggaacagcgcggacatggcgcgccatgtcgtgtgcccgtcgtccaaccgccgcgtgagcatcacgttcgtgagggtgaggccatcgactccggtggacctcagcccgctcccgtcgcccaccaaggccatgacgctctggcagcctcccccgactgcggcaacggccggcatgcagaaaccaccccatggcagcaacggcgcaatcattggctactgccccgcgccg

SEQ ID NO: 61 - DNA, 406 bp, Triticum aestivum
  Clone ID: LIB3280-001-P1-K1-F5
gtcaggagggaatgccaagaccgccggcgcggccaagaacattgaggtggaggtcgacaagccgctcggcctcacccttggccagaagtccggcggcggcgtcgtcatcaccggtgtggagtcaggagggaatgcagcaagagcagggctcaagtcgggtgaccaagtgctctatacaagcagcttcttcggtgatgaattgtggccggcagacaagctgggattcaccaagacagccatccaagcaaagccagactctgtatactttgtggtaagcaggggtggtggtgatattgatgtgaagcgcctgcccaagaggccggcgccccctcggtttggccggaagttatctgattcacagaaggctagagcaacacacatctgccttgattgtggatacatatac

SEQ ID NO: 62 - DNA, 403 bp, Triticum aestivum
  Clone ID: LIB3280-001-P1-K1-F6
gagcattttatagagattatccgattttaagtattttatttaatgtgtctatctccggttgtgatcctagaaggcagtaaatgtgcacttgtgttttgctaatgcaacagagtatctatgagattagtaattctctgtataacatggaaattcttcacaactgtaattttgaatgaagctattttctgatatttggatcttgccaaaaatgaacatgagtgatataacccatataacaaaacagatgagagttctctttgcaagttgcactgcaaagattgctttttagtgaagttatccttggcggtgtacaacttagaacttgattgatacttttcattttacattgatgtgctctccagtgagaacatttttttgactgaacgtgtttcattagatatgc

SEQ ID NO: 63 - DNA, 394 bp, Triticum aestivum
  Clone ID: LIB3280-001-P1-K1-F7
ggtgttgatgaccaccaccctcagcagagggattggctccaatgtccacatcaactgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaagaagaatgttgagtccgccacaaagtatcttcttagcaagctcaaggaccttcagttctttgttggcgagagcatgcatgatgatggcggcgtggtgttcgcctactacaaggagggagctgctgatccaactttcctgtactttgcacatgggct

SEQ ID NO: 64 - DNA, 161 bp, Triticum aestivum
  Clone ID: LIB3280-001-P1-K1-F8
cgacgatcaacttcgtggaactgggactgagctatcctctctgacggagaaatgctgctagtagcttaattattatttctcgtcgggcattatcgcctcctttgtttgatccatgtttatgaacctctctgcattgcaactattcgcttggttgtcgactg

SEQ ID NO: 65 - DNA, 268 bp, Triticum aestivum
  Clone ID: LIB3280-001-P1-K1-F9
actgagctatcctctctgacggagaggtgctgttagtagcttaattattatttctcgtcgggcattatcgccttctttgcttgatccatgtttattaacctctctgcattgcaactattcgcttggttgtcgactgattaaaaaaaatataatcattgcgtttttttatttaatttttttaaaaaccttaaatttggctcccctttttatttttttttattttgtataatttataagaaggggccgcccttctttatgggttccaggt

SEQ ID NO: 66 - DNA, 404 bp, Triticum aestivum
  Clone ID: LIB3280-001-P1-K1-G1
cggacgcgtgggggaagccaggatttcggacagtggcagccacacaggcgcatagcagcagcagagaagggaagggaagagcagagcgcgccatgtccctggtcgccggagtgcgcgcctccctgctttgctcccccggatcgtcctagtccagtccatgccaggccctcgcccaccaagtccgtgcgtatcggttccttatctcgccggcggcgagcaggggaggccgccgcagtacgcgtcttcgggtgcgcgcagccaggctggagtccaccggcgtcttcgagggcttgcgtgcaccccaatttgagctcccggagcccctgacagggaaaatctggacactggatgacttcgagggtagccctgctgtgctggttatgttcatatgcaatcactgtcca

SEQ ID NO: 67 - DNA, 403 bp, Triticum aestivum
  Clone ID: LIB3280-001-P1-K1-G10
ctcctacagcccccgctgcttcctcctcgcatccgcggtgctccacccgccgcgaaccctcgtcgccgaccgtgggcatccgtcggcggtgaactaccctatctcctcccctcgagtcgtcacagatctgggacaccaccgcccgcgccgtcctcgagagggcctcacggatcccgccttgaaccaccatcaacacgcaccgaccgcgccgtccttgacaactgcgacgccgcgcccaggtctcgaccggaaccctagtcttcaccgcgcgcaaccagcaagctctaatgtcaagtgacagcgaaccaagtggctcccaatcaagtgacaccaaatcaagtgatgcgggaccaaaagatacttccattccctttaatctgcatagaggtagtgtaaatccagt

SEQ ID NO: 68 - DNA, 400 bp, Triticum aestivum
  Clone ID: LIB3280-001-P1-K1-G11
gacccctctccgccgtacacgcccactctccacctaagcgcgccagggaattctctcgcccgctcgccccttcgtccccgccgccgccgtcgccgtcgccctcctccgcgcggaggggatccgcccgggcccgaactcgacccctcccgctggacagccgttgcagtttggtctcggagaagatatcggtgtgcttatctactgcggcatggaatgaaggtcttgagtgccgtgtctttttgccgagcttgacactagttgcgcttcgcctcggaaagtaacaaaccatgacttctgtcgccgacggtgtttcaggtgatcatagagctgatgagcagcagaagcaagctgccgctcaagggaaccaggaagaggccccagctactagtataggtagtca

SEQ ID NO: 69 - DNA, 347 bp, Triticum aestivum
  Clone ID: LIB3280-001-P1-K1-G12
gacccatatccgccgtacacgcccactctccacctaagcgcgccagggaaggctctcgcccgctcgccccttcgtccccagccgacgccgtcgccgtctccctcctccgcgcgggaggggatccgcccgggcccgaactcgacccctcccgctggacagccattgcagaggggtctcgcagaagatctcggtgtacttatctactgcggcatgaaatgaaagtcttgagtgccgtgtctttttgccgagcatgacactagtagcgcttcgcctcgaaaagtaacataccatgacttctgtcgtcgacggagattcacgcgatcatagagctgatgagcagcaaaagc

SEQ ID NO: 70 - DNA, 400 bp, Triticum aestivum
  Clone ID: LIB3280-001-P1-K1-G2
cggacgcgtgggggaagccaggatttcggacagtggcagccacacaggcgcatagcagcagcagagaagggaagggaagagcagagcgcgccatgtccctggtcgccggagtgcgcgcctccctgctttcctcccccgcatcgtcctcgtcccgcccatgccaggccctcgcccaccaggtccgtgcgtatcggtcccttatctcgccggcggcgagcaggggaggccgccgcagtacgcgtctccgggtgcgcgcagccaggctggagtccaccggcgtctccgtgggcttccgtgcaccccaatttgagctcccggagcccctgacagggaaaatctggacactggatgacttcgagggtagccctgctttgctggttatgttcatatgcaatcactg

SEQ ID NO: 71 - DNA, 364 bp, Triticum aestivum
  Clone ID: LIB3280-001-P1-K1-G3
actgcgtgtaggagtacatcgagaagcacagtgactgggtcgctcactggagcgagagctttatactagctggtacactaggtgtggtagtccacgtggtatgtgacacaacatacgagtccatcaacacatttaacaacacagggctctacaaccggcttggcatcttgcatgccatgcatcttggcatggatgtgcgtatgcacgcagctacaactgcaattactggttgcattcatggcgtccttgatgaggtcctagatgagttcatagaggcaacaagcgagcctacatggcgtgcttgctagcataggatgcctcatatgcttggagctaagccgggagacataccgttgtatattca

SEQ ID NO: 72 - DNA, 370 bp, Triticum aestivum
  Clone ID: LIB3280-001-P1-K1-G5
ggaggacaatgtatttaaggaaaattgcccggtaacgattcagggcacatactcgaactcaaactcaaccctatgatagtaaatgttttgagaacgctgccgccaacctacgacaacctctggagttcgatgcctccaccaaaaacgaatgttgggaaaatccaccctctacaataattattgccttccaacgttaaaaagataaaagttcaccagatcctcgaagggtaggactgggaacaaacttctcttgttcgtcatcatttcgtcccctctaggcaccgcctgagccgtacttcttgccgaagaagaggatctggagctgatcatagccggagagcacaccagcaccagcaatggcacggaggat

SEQ ID NO: 73 - DNA, 407 bp, Triticum aestivum
  Clone ID: LIB3280-001-P1-K1-G6
aatccccccggaccagcagcgcctcatctttgccggcaagcagctcgaggatggccgcaccctggctgactacaacatccagaaggagtccaccctccacctggtgctccgcctccgtggaggcatgcagatctttgtcaagaccctcactggcaagaccatcacgctggaggtggagtcctcggacaccatcgacaatgtgaaggccaagatccaggacaaggagggcatccccccggaccagcagcgcctcatctttgccggcaagcagctggaggatggccgcaccctggctgactataacatccagaaagagtctaccctccacctggtgctcaggctccgtggaggcatgcagattttcgtcaagaccctcaccggcaagaccatcaccttggaggtggagt

SEQ ID NO: 74 - DNA, 397 bp, Triticum aestivum
  Clone ID: LIB3280-001-P1-K1-G7
ggaatgatgctggtgtacttatacgaactgagagactaagaactaaagatatcacacaaaaagtgaaagcaaagagctactggcagggtggtgtctgcttggcctttgctgacgaggttttatgctggctgtatggcactgtcaaagaaaatgaagactacgttctgcaatttgcacacccgttccatctattggaactattaaaagcccaatctccgtgccccgatgcaataactctgcatgtggaacagctcaccggtgcaacaaactaatctgttcccaagcaaagcttcggcgctgatgtttcgctaaacggacagttttgacggaccttacgtagaagcgtcgcgtcttagaatggctagagctatagttcgaggggctgatgcggatgcat

SEQ ID NO: 75 - DNA, 402 bp, Triticum aestivum
  Clone ID: LIB3280-001-P1-K1-G8
ggggatcggcgagcactttgagggcgtgaagcagcactgggcgcgcaacttcgccttcctcgactacttcaagaaggtctacggccgcgaccagcccctccccaagtggtccgacgccgacgtcgaagagttcatcgcctccgaccccgtctacggcccgcagctcaaggccctgagggagtccaggaagttcgcgctcggcggggccctggccggcgccgcgcacctcggcggcgttgccttcaagtactccaagagcccgcacggtgtcgtgctggcgaccgggttcggagcgctcactggcgccgtgctcgggtcggaggtggccgagcactggtacgagctctacaagatggacaagcagggggccaacctcaggttcatctactggtgggaggacaa

SEQ ID NO: 76 - DNA, 316 bp, Triticum aestivum
  Clone ID: LIB3280-001-P1-K1-G9
cggtgccaaggccacataaaacatttcaattggatgtactgctacactcgttgttaatttgtttcgcgtatttattcaacaaatccggccagaataaaagcaaagaagatgctggctagtcagcaccagcgtgtacaacaatctctcaggaggtgcccatcgttttcgttttctctagtagtcgtcgtcgtcgtagccgccgccggccaggtagacctccaccttctccgccacgtcgacctcgatcttgtccttcaggtagctcgcccctttcgtcagcgccagcccgcccagtacccccgtcgtcgagcccacc

SEQ ID NO: 77 - DNA, 400 bp, Triticum aestivum
  Clone ID: LIB3280-001-P1-K1-H1
cgccttccagttcgagttccaccgcccgcagcaaccaaagccaagtttcgaagccgccgccgccgaggagcaggagaaggcgagaagccatggcccgtaccaagcagaccgcccgcaagtccaccggcggcaaggcgccccgcaagcagctcgccaccaaggcggcgaggaagtcggcgccgaccaccggcggcgtgaagaagccccaccgctacaggccatgtaccgtggcgctccgtgagatccgcaagtaccagaagtccacggagctgctgatccgcaagctgccgttccagcgcctggtccgcgagatcgcgcaagacttcaagacggacctccgctttcagtcccacgccgtgctggccctccaggaggccgccgaggcgtacctggtggggct

SEQ ID NO: 78 - DNA, 328 bp, Triticum aestivum
  Clone ID: LIB3280-001-P1-K1-H10
agagcatgtacattttagaagaacttgtgctcgcatatgcaagttccaggtaaaatcccctttcccccgatcctctctcagttttcacatttcattaccttgttagctcctttgttgtactcccaacagctactcgaaatctataacatgacagaaaattgtcaagaagaagaaaaacctagacgctctagagcagcagttaacaagctcattctctccaccctagctagtagctacaccctgcaagcttcgtcctgcaccttggcgccgtcgagcgtggcgctctcctcggcgttatagctcgcgtgcacgctgtagagcacgtaga

SEQ ID NO: 79 - DNA, 382 bp, Triticum aestivum
  Clone ID: LIB3280-001-P1-K1-H11
aaacaggctttgacatatctgtggcaagtgagataatggctgtattagctcttacaacttcccttgctgacatgagggaaagacttggaagaatggtgataggcaacagcaaggcgggtgagccggttacagctgatgatcttggtcttggaggtgccttgactgtcctaatgaaagatgctattcatcccaccctcatgcaaactcttgaaggcactcctgttttagtgcatgctggaccttttgctaacattgcacatgggaactcttccatagttgctgataagattgctttgaagttggttgggaagggtggctttgttgttacagaagctggttttggcgctgatattgggactgagaaattcatggacataaagtg

SEQ ID NO: 80 - DNA, 227 bp, Triticum aestivum
  Clone ID: LIB3280-001-P1-K1-H12
gacgggcctaataaaatattctatttattttaccctcaccaaactcttaaaagcactccttttttaaacttgcttgaccttttgctaacattattacataagatcttttttaaaaatactgatgagaatacttcgaagttggttgaaaataaaaacccccttaatacatattttttttttgtttttaaaaataagctcttatttttttaaaaacattaaatttttgt

SEQ ID NO: 81 - DNA, 303 bp, Triticum aestivum
  Clone ID: LIB3280-001-P1-K1-H2
taagtggttttttttttgtgttttgtgagagcaagaacaaaatcagggttgatcaggtttaacggatataattgaaccacacggtggtatagtgccactagtaaataaggctgaaacagtgtcaacttacagcttatagatgcaaattcaaatgggtggcaagcaccataaaatcccgtcgctctgcgagatctatttttctttgttttcccaacaattacttttcctgcgattgcaagttaaagtctcgtaacccattatagattgcaaagcggaaatttcattacagttaccataaccttt

SEQ ID NO: 82 - DNA, 227 bp, Triticum aestivum
  Clone ID: LIB3280-001-P1-K1-H3
tcgctgcacttcgatgaggagaaagccagccatttccttacaagtggcaagccacacatagctcatagggagcagcactacaaggggaagggtaagagcagtaacgccgccatagttcctggatgcgccggagtagcgcagcctctccttgctttcgctccgcccgctattgatgctccgtcccagcccatagccagagccctcagcccaccagagtccgttgcgta

SEQ ID NO: 83 - DNA, 406 bp, Triticum aestivum
  Clone ID: LIB3280-001-P1-K1-H4
gaagaggggcaccctcggcggcacctgcctcaacgtcggatgcatcccctccaaggctctgttgcactcttctcatatgtaccatgaagcaaagacttcttttgcacaccatggagtgaaaatctctaatctggaagtggatctcccagccatgatggcgcagaaagacaaggccgtggccgggttaacaaaaggaatcgaaggcctctttaagaagaacaaagtgacatatgtcaaaggctttgggaaacttacttccccttcagaagtttcggttgatttggtcgatggtggtaacactgttgtcaaaggaaaaaacataatcattgccactggatctgatgtaaaatcacttcctgggattacaattgacgagaagaagattgtctcatccactggcgccctg

SEQ ID NO: 84 - DNA, 392 bp, Triticum aestivum
  unsure (1)...(392): unsure at all n locations
  Clone ID: LIB3280-001-P1-K1-H5
gaagaggggcactctcgccagcacctgcctcaacgtctgatgcattcggagagaggttctactgcccttggggcctttangcaaagacttgtaagattgttgatcggcaacagcaaggcggatgagccaattacagctgatgatcttggtcttggaggtgccttgactgtcctaatgaaagatgctattcatcccaccctcatgcaaactcttgaaggcactcctgttttagtgcatgctggaccttttgctaacattgcacatgggaactcttccatagttgctgatagtggctacactcgtatcaaaggaaaaaacataattattgccactatatctgatttaaaattacttcctgggattacaattgactgagaagaatattgtcttat

SEQ ID NO: 85 - DNA, 151 bp, Triticum aestivum
  Clone ID: LIB3280-001-P1-K1-H6
gtgagtttggatgcggtctttagatgaatcaagcctgagatccacaggtgtcgtgggctaattagctgtgagttccaaaggtgcaaagtattttgtaccctccgtccggaattattgtagaagaaagatatgcctagacatattatagttc

SEQ ID NO: 86 - DNA, 320 bp, Triticum aestivum
  Clone ID: LIB3280-001-P1-K1-H7
cccacgcgtccgcccacgcgtccgcccacgcgtccggccgcagcatcacaggaggttggaggggaaggtggccatcgtcactggcggggcacgcgggatcggggaggcgatcgtgcgcgcgttcgtccttcaaggcgcgcgcgtggtgatcgccgacatcgacgacgcggcaggggaggcgctggcggctgcgctgggcggcgcctgctgcagctacgtgcactgcgacgtgtcggtggaggccgacgtggaacgcgccgtcaggtgctgcgtggcgcggtacgggcggctggaccttctttgcaacaactccggcgtgc

SEQ ID NO: 87 - DNA, 400 bp, Triticum aestivum
  Clone ID: LIB3280-001-P1-K1-H8
gaagagttgaatcctgtggataggccttcaacaagagctgcaacgtctgccttgcagccaccagcagcaataggtcctcctcatgcagaaaatacttcaggcactaggagacgtgataactatggtcggcgacataggagccctttgaactctggactatggatttctgttgaagttatcgttaatgttagccaaattgttgctgccattgttgtgctatccctgtcaaggaaggaacatccacaagctccattgtttgagtgggtcataggttacacagtcggttgttttgccactttgccacatctttactggcgctatatacaccgtaatattgtgaacggtgagaatgagccagcacactcacttcagggctcctcgcagaacaactcgactgagc

SEQ ID NO: 88 - DNA, 319 bp, Triticum aestivum
  Clone ID: LIB3280-001-P1-K1-H9
gctcaacatctcaatccttgtttcaatttccaccggacaagtcagataaaagccattcagatccaggagcactagtagtatcttacagtagtagtagcagtgccattttaaccagccagcccatcttccaggcaaacacacacacacacgcacacttgttgcggttaccatcctagcggtttttcatcagttgacaacaacaacaacaacaaaacagccagcatcatcatcatcatcatctggcacaaaagcacagtacacagacacactcaggggactaataggacaccgagcgaccgacgaatcaatcagcaacgct

SEQ ID NO: 89 - DNA, 354 bp, Triticum aestivum
  Clone ID: LIB3280-002-P1-K1-A1
cgctcgtctctccgggctccggcgacggccgtgccaggcagcagcggctgcgcgggccgagcagccggagtgtcggccccatcctgttgtgtttagtcagtcaccgaattgtgggcccgtgtccgggagcgaccaaaccggaatcacgatcctcctgatccgggtccgacccaaccgccgccactcgctcgctccaaaccctagctagctacctacctcgcgccgccgtctccggcgccctcagccctgagcccttccgcagcgtcaaccgccggcggctgtgcgcggttcccctccccagcgtggcgctcttcagcatctccgcccaccccgagggcgccggcctccacaacg

SEQ ID NO: 90 - DNA, 383 bp, Triticum aestivum
  Clone ID: LIB3280-002-P1-K1-A10
cttttccccacggacccttctcgtcttccacgtgattcgagtcgcctcgcctctcccccgtcagcccaaacatggactctagcaggcgcccgagtggaatccagcaattgcttgctgcagagcaagaggctcagcaaattgtaaatgctgctagggctgctaaaacggcaaggcttaggcaagccaaagaagaggctgagagagaaatagctgagtaccgtgcacaaatggaggctgatttccagaggaagctcactgagaccagcggtgactctggcgcaaacgtcaaacgccttgagcaagagacaaacgtaaagattgagcagctcaagcagcaggcagcaaacatctctccagaggtgattcagatgcttctgaggcac

SEQ ID NO: 91 - DNA, 238 bp, Triticum aestivum
  Clone ID: LIB3280-002-P1-K1-A11
caaaaatgacatcagtttgataatgggccaaatctaaagcccaagttatgttatgtattattcagtgttgaatttgtcattttttttgagttatgtttcaaattttgatttgaaattttgtgacaacctgcattgatgttgtgtgagtgtgataattttttttcagaattctttaaacattttaaaagcacacattgacgctgggtgcacaagagatgtttctgatagtaccaccccc

SEQ ID NO: 92 - DNA, 384 bp, Triticum aestivum
  Clone ID: LIB3280-002-P1-K1-A12
cccacgcgtccgcggaccagcagcgcctgatctttgctggcaagcagcttgaggatggccgtaccctggctgactacaacatccagaaggagtccacccttcacctggtgctgaggctccgtggtggcatgcagatatttgtgaagaccctcaccggcaagaccatcaccctggaggtggagtcatctgacaccatcgacaacgtcaaggcgaagatccaggacaaggagggcattcccccggaccagcaacgtcttatttttgctggcaaacagctcgaggatggccgcacccttgcggactacaacatccagaaagagtccaccctccacttggtgctcaagcttcgaggtggtatgcaaatttttgtcaagaccctgaccg

SEQ ID NO: 93 - DNA, 356 bp, Triticum aestivum
  Clone ID: LIB3280-002-P1-K1-A2
gcccgcgggtcccggtccggggttcgagccacgcgtccgacactggtgtccatcatcctggtcgacaagatcggccgccgcaagctactcctcgaggcctgcgtccaaatgctcatcgcccaggtccgtccactaactataacttaccaatcacctgaaaatatataagacgttattcacatctgaaattacgatggatgatccgttgcactgccctgcaggtgacggtgggagggatcatgtgggtgcaagtgaaagacaacaacaaccctagccactcgtgggcgctggccatcgtggtgctgatatgcgtctacgtgtcgagcttcccgtggtcgtggggccccatggggtgg

SEQ ID NO: 94 - DNA, 388 bp, Triticum aestivum
  Clone ID: LIB3280-002-P1-K1-A3
atcgagcacagcacttcccgagcattgaaaaagcaattgaatggagtgtcaaaggtgggccgctacggaacatcgattctgcgcgtatctctattccatctaccttgaagtatgatgaatcaaaggaatgctatacataccgtactcctcttgagaaaacagagaagtactggaaaggatggtacgaaggtctttcagacaagttcttatcttgtcctgtacaaaagatactattattagctggcaccgatagattggacagagctttaacaattggtcaaatgcaagggaagtttcaaatgatagtagttcgacacactggacatgccatacaggaagatgtacctgaagaatttgcatcacacatactgaacttcatatctcgcaa

SEQ ID NO: 95 - DNA, 205 bp, Triticum aestivum
  Clone ID: LIB3280-002-P1-K1-A4
gggggggaaaatgggtttataaaatttttagagagaaaaaaaaaaaaatttccccacgagaaaaaaaattggccccttaaaaaaaacttttttaaaccggcaaaggtatattggacgggtcccgggcccctgaaaaaaaaaccggtatgttaacatcgggggggaatccccgaaaaaccctcctataaaaggcgctggggggggg

SEQ ID NO: 96 - DNA, 362 bp, Triticum aestivum
  Clone ID: LIB3280-002-P1-K1-A5
agccgggggcccgtttcttatctaaaataattcaagatgcgtcgggtttcccccgttagcccaaacatggactctagcaggcgccccagtggaatacaacaattgcttgctgcagagcaagaggctcagcaaattgaaaatgctgctagggctgctacaattgatgtggtgtgagtgtgaaaattatttctcagaagaatttaaacattttaaaagcacaatatgacttgggtgcaccagatattttccgcatggtccaacccccattttctctcaccgcctcttaagttaccaccaatggttgctaacgctccaccgttagactgagaaacaagaattttttttttggctcttgttgcatg

SEQ ID NO: 97 - DNA, 343 bp, Triticum aestivum
  Clone ID: LIB3280-002-P1-K1-A8
aatttaccattgaatcaaccactgatatattttatttcacgaattataacactatgatcgaccaattcaggcacatacttctgggtatcttacacaggtccttgaacaactattggctctaacattaactcagctgctcatccaactacacatggcctaggggatgctactagacacattcatcagctactcctccatctacacatggatcaactgttgcaactaccatacttatatatcagggtatatatcttagcacttataataacttataccttacccttagtcttaggcccgcatacactcacacattaactataattgttatcatcactgtaaccaa

SEQ ID NO: 98 - DNA, 376 bp, Triticum aestivum
  Clone ID: LIB3280-002-P1-K1-A9
ggcgtcttcgtactcgcctctctccgcgcaaccgagccttccgcccacctcctccccatttcgccagcggcgcacccaccaaccacccccacccgccgccatgagggagtgcatctcgatccacatcggccaggccggcatccaggtcgggaacgcgtgctgggagctgtactgcctcgagcatggcattcaggtacggatccatccgctcgctcccctccccccttttacctgtcgtgttcagcgtcggatctggggtttgtagtggttggtggtgcgctcggtcggtctgatctggcgcagatctggccgcggccggtcagatctgcccttggtagaaggggggatctgcatctgacggaatggggggtgcatg

SEQ ID NO: 99 - DNA, 282 bp, Triticum aestivum
  Clone ID: LIB3280-002-P1-K1-B1
gatttgaagattgccattaagaaaaacttgaaagagcataggtaccccatgaattccaactccaagcaatagcatgtcgagaatttgtcttattgaacatttgaaatgagcacatgtaaaggccagtctcacacttaagacggggaaaggaaaaggaaaaaagggactgagtagctcaactcagcgaccagcgatggggccctaccgacgtattgctcgctattaaccaacgagcaacaaaaagaagtttcccaatgttttcttttctactgtaccattcct

SEQ ID NO: 100 - DNA, 372 bp, Triticum aestivum
  unsure (1)...(372): unsure at all n locations
  Clone ID: LIB3280-002-P1-K1-B10
gcggaggaggcgggcgctcgtgcaactacttctgaggttcgagctccgctgcgcaccagtctatttgcatgctgccgccgcgctactcaccaactcctgccacgggaaaggcgggggcgggccggcgggtgtccctggtggggctcggcctccgcggtggaggcaggcgcgggccggagctactcgatccggtgggcaagctccaccccgcatttgtcgtcaacatcgacgggcttgtggtcgtgggggggcaatggcttgttcgtcaggctgtcgctgcggcccaataactactacaatcatggagacatccgcgcgctcgatgtgatcttcaggaaggcctttctgctccatgctcctncagcacgcgat

SEQ ID NO: 101 - DNA, 320 bp, Triticum aestivum
  Clone ID: LIB3280-002-P1-K1-B11
ttctcccctctcgctctctccaccaaccaagaacagcaggaactcgacctcggagcagcaacgaatccgtcgccgcccggcaaaagggatccaaagctccaatggctggcaagtacatcgtcgccggcctcgtcggctcctgtgtcatctcgtatgcctgtgactacatcgtttctcagaagaagatcttcggtggcaccatcccagggactgtgtccgacaaggagtggttgaaggcgacggagcagaggttccaggcctggccccgggtcgctgggccgccggtcatcatgaaccccatcagccgccagaactttatc

SEQ ID NO: 102 - DNA, 272 bp, Triticum aestivum
  Clone ID: LIB3280-002-P1-K1-B12
gggaaggaatattcggcaaattacatttcataaaacaaatacaagggttacccgggcttaatcgattaacgggtcatgcccacacacccccacccaggcgtttgttttttttggggccccagccaaactaagacaaattaatttccccaacccggggcatataaattaacccacgcaagaaaaacctttttaccccccgcccgtttttggcttgagaaaaaaaaattgggaacaaaaaaaaaaaacttgctgggtgccccggccaatccttc

SEQ ID NO: 103 - DNA, 359 bp, Triticum aestivum
  Clone ID: LIB3280-002-P1-K1-B2
gcatgcacaagtgcgacggctaccgtgatgccgccgcccgctccgtcaatcgtactcagcccgccgtccacacaaccgtcgacgatggtgcagcagccgcctccatccccgtcaactctatcgatggcactgcagcaatcacacactccaccgatggcactctagccgctgtcgacaaaaccgatggtgcagtcgcccatatcgccgacggctacgacgacagggacgacgatgacaagggcgacaaaaaggatgacgatgactacggtgataagaatgacaaggacgacgatgataaggatgaccaggatgacgacgatgatgataaggacaacaaggacgacgacgacaacgacgat

SEQ ID NO: 104 - DNA, 167 bp, Triticum aestivum
  Clone ID: LIB3280-002-P1-K1-B3
attaatgtaattttttcattatcacacttaacacatgacactttacacgtttcaaacaaaaccgtaggtgcagaagggcacaatgacattttttacgacgacaagaaccacaataacacgggcgacaaaaatgatgattattactacggtaataaaaaagaaaagga

SEQ ID NO: 105 - DNA, 391 bp, Triticum aestivum
  Clone ID: LIB3280-002-P1-K1-B4
gcggggagcgcgagggacgaaggaggggcagggcgagaccttcggggagactcccacccataccgcgccaccgagcgagcgagatcccgccctttccccttctccacccacccgccctgccggacccgatcccgatctgatctcgccgccgccgccgcgcgccggacaagatggcccccgtgtcggctctggccaagtacaagctggtcttcctcggcgaccagtccgtcggcaagaccagcatcatcacccgcttcatgtacgacaagttcgacaacacctaccaggctacgattggtattgatttcctgtcgaagacaatgtaccttgaagatagaactgtgagactccaactctgggatacagctggtcaggaaagattcaagagttt

SEQ ID NO: 106 - DNA, 386 bp, Triticum aestivum
  Clone ID: LIB3280-002-P1-K1-B5
cggacgcgtgggagcccacccaggcacaggtagagacagacaaccaggagcacccaagaagcggtgcaggaggaatcccggcctctgtagcaaacaagaatccatccacctgtcctcctcatcgagatctcgcacggggcggctcgtggtgaggtgagtgagtcgaccggccatggcgttcagggcctgcctctcgtcccacaaggcctcgccgtcgccttccgtcgcgcagaggagggccagcaatggggcaccgccggtggtggccatggcctccaccatgaacgaggtcaaaattgccaaaaagccctatgctcccccacgcgaggtgcatctccaagtcatgcattcgctaccagcacaaaagcaggagatctttgattcac

SEQ ID NO: 107 - DNA, 371 bp, Triticum aestivum
  Clone ID: LIB3280-002-P1-K1-B6
cccacgcgtccggactcgcaaaacacagaattatgagagtccctattacatggtatggtaaattcactaagcatagaagctaagacggcggggttgggatggcccaagcgacgatgccagagatcgacggaggccagcatggatgttggaggggtggcggcaggaactccattaagagaataaagatcaccggagctattgaagcgagcaatctcggccttggtcaggtaatccttcacagataaaccaaaagggtcaaattcagccgaaactagattgtcgcaagtaaattggcgaacagagataagatttttaataagggcgggtgcaactagaacatcgcgaagtaaaagaggtttggtggaagaggg

SEQ ID NO: 108 - DNA, 76 bp, Triticum aestivum
  Clone ID: LIB3280-002-P1-K1-B7
actacttcattaaacgcctccatcttcccttcaaaaatgaacggctactggcagatattaaagtatcccctataaa

SEQ ID NO: 109 - DNA, 360 bp, Triticum aestivum
  Clone ID: LIB3280-002-P1-K1-B8
cagatccaacataacaagtactttattatacaggtactaaactgaacaaataacaagttgctacaacttgtcaagtctgaacattacacaaccctgaacattacaaaattctgaacattacacttctaaagtttacagcagtttgagagagagagagagagagagagagagagagagagagagagagagagcttcaggttcagaagagaagcaagaaccagtagcagaggcgtagggaacaggagcagctggcacaagtgaggagcagcaacggagcttggagaagcagcaggttgaggcaccatgagaggattaggaggaggagcagtagcaagtgaggccgtccctgaatgaatcttt

SEQ ID NO: 110 - DNA, 145 bp, Triticum aestivum
  Clone ID: LIB3280-002-P1-K1-B9
agaactagctagacgcgagcggtcgatcattcaggttctaaacataacaaatcccaagtttattcatcttggcagcaaccaatatttcacaactttcaaccttacaaaattttgaacactacactttttatagttacaataactt

SEQ ID NO: 111 - DNA, 167 bp, Triticum aestivum
  Clone ID: LIB3280-002-P1-K1-C1
acgcctatcgatctagagcggcagcaccttcttttttcgcccgattcaaatatggccatggggaaaaactcgaacgaggctcttttccacatgatccaccacctcaacaaataacacccccagactttttcttattgaacattcaatacgagctcatgtaaagggct

SEQ ID NO: 112 - DNA, 270 bp, Triticum aestivum
  Clone ID: LIB3280-002-P1-K1-C10
aaccaaaaggttctctccgatatagatagcagcgaaattgtcaaaacattaaagacctgatcacaaattgtgcttgaccaaccaactttcagtacaaccgattgcagcaaaaactaggtagaatagtccaatatccagatacgagtaaaactagggctggcgcatatcacggacaaagcattcccaacaagcacggtcgcggccacgttaagtacatccgttgcttcaactgcgccaagtgctgccccaaggacaaggctatcaagcgtt

SEQ ID NO: 113 - DNA, 298 bp, Triticum aestivum
  unsure (1)...(298): unsure at all n locations
  Clone ID: LIB3280-002-P1-K1-C11
gccgctggcgcccagatccaatccctcccgccccagatccaatccctccagcggagctcgccgccctccttctctcgccctctccatcaaccgcactagagccactatgacacacaccagagcagctgagatccgcgtcccagcacctgcgcggaagatggtcattctctcaccgcctacacgacacccacctgtctcctctcctgtcgcccgccgcacgcacgcctngaacctttctcaagccaggtgggggggggttccgcgaaccgcggaggggaagggggcgatggcaagtact

SEQ ID NO: 114 - DNA, 285 bp, Triticum aestivum
  unsure (1)...(285): unsure at all n locations
  Clone ID: LIB3280-002-P1-K1-C12
ctctcatctggtacaagcccgaatggaagattattgatctcatatgcaccctcatcttctctgtgattgtactgttcaccacaatcaagatgatccggaacatacttgaggtccttatggagagcacgccccgcgagattgatgccaccaggcttgagagtggtctccgtaagatggaaggtgtgattgctgtccatgagctgcacatctgggctatcacagtggggaaggtgctcttggcatgccatgtgacgatcacgcangatgcggatgctgataaaatgc

SEQ ID NO: 115 - DNA, 189 bp, Triticum aestivum
  Clone ID: LIB3280-002-P1-K1-C2
ttttgttaatacaatctttataaattttgtatatttttttatatctttttcaattttaaatatgtttttgtttatttatacactctttataggaaaaaaaacccgtggggataaaaaaactgagcaggtctgatattgaatttttattctcacaaacaaaacttttgaggaaaactacgcagaagctga

SEQ ID NO: 116 - DNA, 400 bp, Triticum aestivum
  Clone ID: LIB3280-002-P1-K1-C3
cgcaggggtcctaccactacggccagatcaacatcacccgcaccatcaagctctcccccagccgcggcaaggtcgacggcaaggagaggtacgccctcaacggcgtgtcccacaccgaccccgagacgccgctcaagctcgccgagtacttcaacgccaccaagggagtgttcgagtacaacctcgtcaccgacacgccgcccaaggagggcacgcccatcaaggtcgcccccagcgtcatcaccaccgagcaccgcacctacattgagattgtcttcgagaaccccgagaagagcatcgacaccttccacctcgacggctacgccttcttcgccgccggcatgggaccggggctatggtcggtggagagcaagaagacatacaaccttctggacacggg

SEQ ID NO: 117 - DNA, 297 bp, Triticum aestivum
  Clone ID: LIB3280-002-P1-K1-C4
ggctcaagcttaaaatacgctatcaatgacacaaactgtacatgctgcctgcggtagttctaaaacaaatatactgtacatgctacgttcatgcacatagtacacctgacacaacttgtttggcagaatcaccatgacaaagatagaaaatgagatggttcacgacacatgacaaagaattccctctgtaaagaaatataagagcatttagatcacaagtggtgatctaaacactcttatatttctttatggagggagtacaagttcaccgttttcataaacggccacacaggcacc

SEQ ID NO: 118 - DNA, 379 bp, Triticum aestivum
  Clone ID: LIB3280-002-P1-K1-C5
gggaaatggagttctctcagttgatataaatgcgccgcgtaagctgtgtgcttatgctcacttcagcaagcgacacacaggtgtcatgctcctcctgttcaacctaagcgacagcactgggtacaacgtgaccctctagaatgacctcaagtcctcaacctgaacttcaaaaaaagaagcggccactagaggcgcagcggcggcctcagaagagcggtgtcatggctgggaagcaagccgtcgagcgagagcacgaagaggaatgagtaccatctaaacaccaagggcggcgaccaccagagtaggacgatgctgctgaacggtgtgcagttggagctggcaggcgatggctgcatcccgatcctgaacctcgtgtcgt

SEQ ID NO: 119 - DNA, 370 bp, Triticum aestivum
  Clone ID: LIB3280-002-P1-K1-C6
gggaaatggagttctctcagttgatataaatgcgccgcgtaagctgtgtgcttatgctcacttcagcaagcgacacacaggtgtcatgctcctcctgttcaacctaagcgacagcactgggtacaacgtgaccctctagaatgacctcaagtcctcaacctgaacttcaaaaaaagaagcggccactagaggcgcagcggcggcctcagaagagcggtgtcatggctgggaagcaagctctcctagcgagagcacgaagaggaatgagtaccatctaaacaccaagggcggcgaccaccatagtatgactatgctgctgaacggtgtgcagttggagctggtaagcgatggctgcatcccgatcctgaac

SEQ ID NO: 120 - DNA, 391 bp, Triticum aestivum
  Clone ID: LIB3280-002-P1-K1-C7
gaagtccccgtggagtttgagatgtctgaccttgtatcagagaacaaggaaaatgagaagccagctgaatctgaagaagtccccgtggagtttgagatgtctgcccctgtattagaagagcataaggaagatgaaaagccagctgaatatgaagtagctcccgtggagggtgagaaaactgaaaacggcctggcggttgaatccacagtgtcacctccagcaacttcagaggaaaagaaagtagaagcagatagcaccatcaatccggcgacccctcctacagcggaggtgaaggcagatgctccagcggcagaagcagcaaaagctgcggagaatccagcagacaacgctgctcacaaggatgaccagggtaacgccggcaccacaggag

SEQ ID NO: 121 - DNA, 253 bp, Triticum aestivum
  Clone ID: LIB3280-002-P1-K1-C8
gaagtagccgtggagtttgagatttgtgaccttgtatcataaaacgcggagaatgataagtcgggggaattttaagaactccccgtggagtttgagatgacttcctctgtattacttatagcatagggaagatgaaaagccagctgaatatgaagtagctaccgtgtagggtgagaaaacagaaaacggtcttgtctatgaatttaacattttaatctattacaaacttgtaaggttatgaaagtataagctg

SEQ ID NO: 122 - DNA, 385 bp, Triticum aestivum
  Clone ID: LIB3280-002-P1-K1-C9
atctggtggactcctctcagcagagttattgagcagcggctgggctggtttcttcgcgggctgcttacataccttatccgggcctgaccatcttgtcgcattggcaccactatcaattgggagatcaagactggagagtggactagtcggtgccctttggggctgtggtcatgatgctggacaaataatttttggcctgctcttcttgctactcaaggatcgtttgcacattgaggttctccgtatatggggaacaagagttgtaggtctgacccttcttatgataggcgcgacgggcatccgggaagcttcagaggtccaagagtcggggctaattctggagggtgtagacatgaatggcagtgagcccttgcaacaggcccct

SEQ ID NO: 123 - DNA, 350 bp, Triticum aestivum
  Clone ID: LIB3280-002-P1-K1-D1
caaacactctctcttggtctacatagtgagcagtcgcactgtttttttgagccagctcgccaaccagagaagatgagggtgatcctgcacatccagggtggacagagtggaaaccatattgattccaagttctgggaggtggagtgtgatgagcatggcattaaccccaccgggcggtatgtcagcacctatgaccatcagctggagcgcgttaatgtctactacaatgtggcctatagtggtctttttgtgccctgagctgtccttatggatcttgagcctgtgtacttggacagtgtccgaactggaccgtgctgtctgatcttaatgtattgacaactattgttttt

SEQ ID NO: 124 - DNA, 209 bp, Triticum aestivum
  Clone ID: LIB3280-002-P1-K1-D10
gagagagagaagaggagcactcgaccccgccgtcgcagcgccaaccaaacccttgtcgtcgtctccgatcccgccgtcgccgccgcagccatgccgttcaccccgggaccctactccggcaagagcaccctcgccctcgtcgccagggtctccgccgtcggcatcggcgtcgtctacggcttcgtcaagctcggcatcctcaagatgac

SEQ ID NO: 125 - DNA, 375 bp, Triticum aestivum
  Clone ID: LIB3280-002-P1-K1-D11
caacattcaaagctgattttcttgatggagttcctgtagcattgccttttgatgagcagaatctatccttctttatccttgaggtcatcactgatgactatgctgtgtttcaattccctatgcgcttggatagcttgtactgctgtgggtttcgatgtcttgatctttgtgataaccccttggagaagctttggtactcatttgggaaggtgtcgattcttccgaagagactattcaagaaccgaaagaaatctgggttatcattagcttacaataacttccgtaaaattcagatctttgctggtgtgattgcaaaattttgtgatcattttcgggggttcagacctgttgatagtgctgatgatgatctggtgg

SEQ ID NO: 126 - DNA, 260 bp, Triticum aestivum
  Clone ID: LIB3280-002-P1-K1-D12
tgctgcaacaatcagaagaccaatgcattgccttccagaaggctagattgcaacaatgcaatgtctaaatgtctaattcagagtgcaacaatgcaatgtctaaatgttctcatcacatcacagataaatatagagtttggaaagataagaactcaaccatgactacactttcttaacacacgcacgctacaggcgacgaaactagaacagatgcttccttcatccaaaagagaatgattgctccacaaaactgcacctgt

SEQ ID NO: 127 - DNA, 332 bp, Triticum aestivum
  Clone ID: LIB3280-002-P1-K1-D2
gagccatgatgtgatttattaagaaatgaagaaatggttacatgaacaagggtctctgttctacatccttttcaggccaatcagcatgggcgcgttacacactagacctagttacccagttaaggaaaggaggaatattagcaaaaaaaatgtacatggtctatgaacaatccccagagaaccaaaatttgtcgtgccattgatctccgaccgaaagaacaatccaacaatcatgttccttcagccagcttcggcggggaggtgccaagaagtgatcactgcacgtcttcagtgaaggccctgtagatgaagtccctgaacctcttgcagta

SEQ ID NO: 128 - DNA, 278 bp, Triticum aestivum
  Clone ID: LIB3280-002-P1-K1-D3
gagccatgatgtgatttattaataaatgaataaatggttacatgaacaagggtttttgttctacatccttttaggccaattattatgggcgcgttacacacaaaacctaggggcccagttaaggaaaggaggaatattatcaaaaaaaatgtacatggtctatgaacaatccccagagaaccaaaatttggggggccattgctctccgaccgaaagaacaaggggcaatcatgttcgttcagacagcttctgcggggaggtgccaaaaagagatcact

SEQ ID NO: 129 - DNA, 154 bp, Triticum aestivum
  Clone ID: LIB3280-002-P1-K1-D4
ggggtctttttttgtgggggtattttccaccacaattaatttaaaacaacacattctttttgttcttatagagaacacgccctatcgacattgattccaccaagaaaaaaaccctctcccaaaaaatgaaagccctaacctttccaagaaaata

SEQ ID NO: 130 - DNA, 88 bp, Triticum aestivum
  Clone ID: LIB3280-002-P1-K1-D5
gccgacagaaaccacagaggctctcgatccaattttccaagctgaaggaaagtggccgtgcctaccgtgcaggcgctcttattcttct

SEQ ID NO: 131 - DNA, 389 bp, Triticum aestivum
  Clone ID: LIB3280-002-P1-K1-D6
cccacgcgtctgaaccaaacgcaatatcgccctgcccctccctcttcctcgtcgacgcgcaggccccagggaaattctccgttggagaaaagtcgcgtgccgtctctcgcccacagcccgttggcagcaatggcacaagagagctggaaggagtctgaggagactgtccaaacacctgaggcaccaatattgtgtgtaaacaactgcggcttcttcggtagcagcatgacaaacaacatgtgctccaagtgctacagggacttcattaaggccacgacaatggctgcccctgtagtggagaagaaggtgttctcagtggcatcatcttccagtgtgacattggagcaagcaaaggcagatgaagtaccagcccgtgctgtagctgatag

SEQ ID NO: 132 - DNA, 291 bp, Triticum aestivum
  Clone ID: LIB3280-002-P1-K1-D7
gggggctgcaacactcagaggaccaatgcattgccttgcagaaggctagattgccacagtgcaatgtctaaatgtttaatgcagagtgcaacaatgcaacgtctaaatgttcacatcacatcccatataaaaatagagtgtggaaagataaaaactcaaccatgactacactttcttaacacacgcacgctacatgcgacgaaactagaacagatgctttcttcatccaaaaaaaaatgattgtttcacaaaactgcacctgtttagatggttagatatttataacttggt

SEQ ID NO: 133 - DNA, 340 bp, Triticum aestivum
  Clone ID: LIB3280-002-P1-K1-D8
tctccccctaccagtccacccgctcgaccccgcggacctagggttcgcgccgccagccggcgaccccgccacgtcccgtgcgccggtgaccacgccccgtcccgtccgccgctgccccgtaccgtcgccggcgacccgtcgcgtccgccgccgccccgtaccgtcgcccgccccgccccgtaccgtcgcccgccccgccccgtcaggtccgcccgcaggctgtttcaaagtcctagatccgccactggagctgactgtcccgccggcggttcttctgtagtttctgtcaagatggggttgtcttcggccggtgagatcgacggtgcgcagctgtgcattt

SEQ ID NO: 134 - DNA, 338 bp, Triticum aestivum
  Clone ID: LIB3280-002-P1-K1-D9
ggacaaactgcgcacaaagccacctctgcgctggttattacttcatcataccttcagcgtggatgaaggaaaccgtcatccgtgaaaaaaaatctgttggttcgcctataacaggttaaacaatgaatagcagtcgtatttcagtgcctcgtatgcgagggctctaggttacaacatcctctatacctaggagcgggttcgttcgtgtgcctgccgggaacctgacagaagataacagaaccatttcgacgagcagcagcagcagcagagatacctcaaaagttccgacgaggccttctttgccgccaccgctagagcgagggagagcgggcacctgc

SEQ ID NO: 135 - DNA, 71 bp, Triticum aestivum
  Clone ID: LIB3280-002-P1-K1-E1
cccacgcttgttctcgagctagagcccgagcgctccatcttttactacctgggccgggggcccgcggtgac

SEQ ID NO: 136 - DNA, 354 bp, Triticum aestivum
  Clone ID: LIB3280-002-P1-K1-E10
gacgaggtagccatgggcgacagccagtactccttctccctcaccaccttcagcccatcggggaagctggtgcagattgaacatgcactcacagcggtcggatcaggccaaacctcccttggcatcaaagctgccaatggtgtagttatcgccaccgagaagaaactgccttctattttagtggacgaaacatctgtgcaaaagattcagtcgttaactccaaatattggagttgtctacagtgggatgggtccagattttcgtgttcttgtcagaaaaagtcggaagcaggcacagcagtattatcggttgtacaaggaaaccatccctgttacccagcttgtccgagagact

SEQ ID NO: 137 - DNA, 310 bp, Triticum aestivum
  Clone ID: LIB3280-002-P1-K1-E11
ttgaatgtatcgttttttattttttttgtcatttatttttatttttttttttttggaaggaatatttcgaaaatggcatttgataaaaaaaatccaggggttacaggggctaaaacgattaattggggaagcgcccacacccacaccgagtggtttgtatttttggggggagactgccaaactaaggaaattaaatttcaccaaaccggggctttaaaataaacagccgcagaaaaatctatttaacaaccgcccgttttttgctggatgaaataaaattgggaactaaaaaaacatacttgcatgggtg

SEQ ID NO: 138 - DNA, 374 bp, Triticum aestivum
  Clone ID: LIB3280-002-P1-K1-E12
cgagccgcagccaaggaaaaaatccttctcgaaaagggcagcggcgagcagcgtatatatacggcgcggagccggctgggagagtgtcccgcatccctccctccctccctcgccgctatccgctccccgtccgtccgtaggctcctcctcctcctccccctcccccgtcccggccgtctccgacccctcactgctcgagtttggaaccagggaggagtatctagaggagagatggcggcggagagggtcaaggacgccggcgtcctcgccatggacatctacttcccgcccaactgcgtcctccaggaagaactggaaactcatgatggcgtgagcaaagggaagtacaccattgggcttgggcaggatagcat

SEQ ID NO: 139 - DNA, 324 bp, Triticum aestivum
  Clone ID: LIB3280-002-P1-K1-E2
gagccatgatgtgatttattaagaaatgaagaaatggttacatgaacaagggtctctgttctacatccttttcaggccaatcagcatgggcgcgttacacactaaacctagttacccagttaaggaaaggaggaatattagcaaaaaaaatgtacatggtctatgaacaatccccagagaaccaaaatttggcgggccattgatctccgaccgaaagaacaatccaacaatcatgttccttcaaccagcttcggcggggaggtgccaagaagtgatcactgcacgtcttcagtgaaggccctgtagatgaaggccccgaacctt

SEQ ID NO: 140 - DNA, 359 bp, Triticum aestivum
  Clone ID: LIB3280-002-P1-K1-E3
cggacgcgtgggcggacgcgtgggctccgattccaccacatccgctcgcagctcgagatcgtcagccatgtccgggcgcggcaagggaggcaaggggctcggcaagggcggtgccaagcgccacaggaaggttctgcgcgacaacatccagggcatcaccaagccggcgatccggcggctggcgcggcgcggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccc

SEQ ID NO: 141 - DNA, 382 bp, Triticum aestivum
  Clone ID: LIB3280-002-P1-K1-E5
cggacgcgtgggttcagctggctaggaggatccgtggcgagagggcttaagatgcttgctttccctgtgggaatggctctggcgggcatctgtgtctgcttttgcagctgaacgcttatcatgtgtcgtgaactactaatacttgtcgtgtgtagtaatatgtcagtgccgtactctgtgccatactatgttggtagagctggatcatttgttcgttggtcgtcctaaatcatccacctggtgggtgcttatctgaaccttgcattttatgtctgagaattagtgattgtgtgaaccaaaaaaaaaaaaaaaaaaaattaaaaaaaaaaaataaattatttttataatatatatatattattatttttttaatttttatatt

SEQ ID NO: 142 - DNA, 458 bp, Triticum aestivum
  unsure (1)...(458): unsure at all n locations
  Clone ID: LIB3280-002-P1-K1-E6
cgttcccgcncaactcggttnccccggaatcctcccacccttcggccttccccttcgggtcttcccccttcncctggggccggccccggcccccccccctttccctggccaacggccaccaaccgaccaccaacaccacctaccatcggcccgcccaccccttgggcctctgggaggcacccgcgccttgagccccccaccggccggcaacccggctgccgcggatgacccgcccgccggcgacgacctcctcctccccgcgtcgttcttccaccccgagcaaccacccgagagcgccgccgtcgcacttccgaagaactcgcggccaccgtgccccctgaggcccgctagcttgaccaagggctccaccgtcatcctctccttcacctacggccgcccattggagcgcggcgccgttaccccgcctgcatcgcccgcttcgtcaacctccggccacc

SEQ ID NO: 143 - DNA, 183 bp, Triticum aestivum
  unsure (1)...(183): unsure at all n locations
  Clone ID: LIB3280-002-P1-K1-E7
gtgattgtggnttttttgtttggttttttttttttgttttttanttttttgtttttgttttattttttttttattttgttatttttttattataatttttttttttgttattatttttattattttgttataatattatttttattttttttattttattattaagtttattataaatatttt

SEQ ID NO: 144 - DNA, 247 bp, Triticum aestivum
  Clone ID: LIB3280-002-P1-K1-E8
ttttttttttttttttttttttttttttttttttttttttttttttttttttttttttttttttttttttttttttttttttttttttggaaaaccaaaaaaaaggggggggggaggggaataatggaaggcccccccccgaaaaaaaaaaaaaaaggggtaaaaaaattatttagggggacaaaacccctttatattatttaaaaggggggggacaaaaaaagagggggtgtatatttcccatatt

SEQ ID NO: 145 - DNA, 348 bp, Triticum aestivum
  Clone ID: LIB3280-002-P1-K1-E9
aaacataaaataaggtatcattacatatctgttatcccagaccaatgtacatatatactatattgcttaaataagtatatagtataagcacacacgaggggtcatcatatgacattgtttctattgtaacaaacatctagatataaatatgcatcagtgatcgaactcagtaatatgttatcgatccagcacgatttatacatctggatatatatcttcatgacgcatgtatatttttgaagttaacccttataccatattgcactaatatgacggggatcatgcaaggtaattgtcgcccgagttggaggggtccatccgcgtaagggggcgggctgggtgggtggg

SEQ ID NO: 146 - DNA, 385 bp, Triticum aestivum
  unsure (1)...(385): unsure at all n locations
  Clone ID: LIB3280-002-P1-K1-F1
gcgggctgcatcgccgtcatccgcgccgccccctacatcctccactacctcacccgcgagcccggcatgacggagctcaagctcgagctctaggtgcgactgggatggtgaagttactctcaggagcagactttgaagtaccttgtcaaacatgaaattagttttccttgttagtatttcgtctttctatagtgtgagaattcaatgacagtgttcgcataaactctgttggttgtggttaccactgccactgccccagcaactttgtgggtttttaacaatcagtgatgcgtgcctcatatatttcattattggtgggatgtgatttggcgttgctatactgaatgtggttcgggtggtccaaatnaataaatttataaatttt

SEQ ID NO: 147 - DNA, 380 bp, Triticum aestivum
  Clone ID: LIB3280-002-P1-K1-F10
gttgaatttagtgcccctgcatttacatgactaggtgttatcagtttttgtttcctttgatggctctgagtacaaattggagcttgttgggtacaaaatgttgccaagattagtttaggatcagaattgttgtcatgttgtccagatattgctctaagaggttcctagaattagtttaggatcagagttattgtcatgttgtgtagatattgctctaaagatttcggacgtacttttcaggttgcttggttataatttttgccccccaaaggaaagctttggccagcttcttgctagaatattatcataaggcttgattaatttagaacatacttgtgtcttttcactcttattttattttaatagttatctgacatgtt

SEQ ID NO: 148 - DNA, 378 bp, Triticum aestivum
  unsure (1)...(378): unsure at all n locations
  Clone ID: LIB3280-002-P1-K1-F11
acgcaaggaactacagctatagccttgaggtgggtgccaatggcaggaagatgatatgggagggcacgccccggagcatccgggacagtcaccgcaaagtgcgtgacagccatgacggcctcataatccagcggaacatggcactcttcttctccggtggggagaggaaagagctgaaactgcgggtgactggccgcatctggaaggagcagcagaaccccgactcgggagcctgcatccctaatctcttcagctgaagtgaatagttggcaacaggatatcatgtgattcaggtgtatattgaagaaatgtgattgccgatttgcttttctctctttacagnttgtgtttgtgtcttttcgctttttcagccacttt

SEQ ID NO: 149 - DNA, 380 bp, Triticum aestivum
  Clone ID: LIB3280-002-P1-K1-F12
cccacgcgtccgacggtgaagaatccgagggccttaacatcgtgcaggagtacgtcaagtctcactagatgagaatgtttcatgatgcaaacacttgtgttgggcattttggtcctcggtttcatttatactttattctcgggcttcctattgttcgaagtttcaagtgtgagcctagcagatatcgtcaatttggacctctgaacctttgtttatcaggcagctgctgcctttagcgtaaatcatcaagagctgataatatatttctctttgcaatattacaattttgattttttgctctgtcgctggtgcatgttccatttgacatcattgtgtttggccctatgacttatatttggttatggcgatgatggtataaa

SEQ ID NO: 150 - DNA, 360 bp, Triticum aestivum
  Clone ID: LIB3280-002-P1-K1-F2
cgccactcggtcaacctcatcatggagctatgtgagggcggggagctattcgaccgcatcatcgcgcgggggcactactccgagcgagccgccgccctgctctgccgcgagatggtctccgtcgtgcacagctgccactccatgggggttttccaccgggatctcaagcccgagaactttttgtttctcaacaacaaggaggactcgccgctcaaggccactgactttggcctctccgtcttcttcaaacacggggagcaagttaagggatctcgttggaagtgcgtattatgttgctcctgaggttctgaagcggcactatggagcagaagctgacatatggagtgcggggattattct

SEQ ID NO: 151 - DNA, 384 bp, Triticum aestivum
  Clone ID: LIB3280-002-P1-K1-F3
tgctgacactaggcgaggtgtcacttcattgaattgcattatgggcaacaagctttctgttttggctggtgactttctcctgtccagagcatgtgtggcacttgcagcacttgggaatacagaggtggtatctcttatggcaactgcagttggacatctagttaccggtgaaactatgcaaatgtcaacaagcagagagcaacggcgaagtatggagtactacttgcagaagacgtactacaaaacagcatcattgatatcaaacagttgcaaggctgttgctattcttgcagggcacactgctgaggtttcagtgcttgcatacgaatatggtcgaaacctgggtctagccttccagttgatcgacgatgttcttgatttcac

SEQ ID NO: 152 - DNA, 388 bp, Triticum aestivum
  Clone ID: LIB3280-002-P1-K1-F4
gcccgcttcgctcctcctcctccaacaagatctctctccgaatctttggatgcaccggctccgatgtctggcccgccgccccccgcctcctccgatgatgatggtaagcccgccgacgaggagggcgtagagatccgcgaggtatgggcgaacaacctcgaggcggagttcgccgtgatccgtgacatcgtcgacgattacccgtacatcgccatggacaccgagttcccgggcatcgtgtgccgcccgctcgggagctttcgctccaatgacgagtacaactacgccaccctcaaggccaacgtcgacatgctgagcctcatccagcttggtctcaccctctccgacgagaacggcgcactcccggccaggggcaccggggggcgcc

SEQ ID NO: 153 - DNA, 385 bp, Triticum aestivum
  Clone ID: LIB3280-002-P1-K1-F5
caaccacctacgccgccgccatctccagctgcagccctccactagttctctctccctctgccgccccatctcccctcacatctccctcgcccctcgccgccacctccatcctctcctggcctccgcgtccgccacccaagcttcaagccccaacactgagcccgcaccggcgccggcccccgccgcggcctcgtccggcgcgaagctgctccccctcatcgcctccatcgcggtcggcctcgcagtgcgattcctggcgccgcggccccccgaggtgactccgcaggcgtggcagctcctctccatcttcctctccaccatcgcagggctcgtcctcggcccgctccccgtcggcgcgtgggcatttctcggcctcactgctacc

SEQ ID NO: 154 - DNA, 296 bp, Triticum aestivum
  Clone ID: LIB3280-002-P1-K1-F6
acgcggacgcgtgggcggcgccagacttacacttccggtggacgccaaaaccctgacgggggtaaggtatggcgcgcggcgcatctttcatgacacacacactagtgtgggtcataggcaggacggcccttaattcaccgggacatgtggctcttctttttccctggggttcaagtgtgagcctaacagatatcgtcaattcggacctttgaacctttgtttatcacgcacctggtggcctttatcgcaatcatctagagcctgagatatatttctctatgcgatattacaatttt

SEQ ID NO: 155 - DNA, 339 bp, Triticum aestivum
  Clone ID: LIB3280-002-P1-K1-F7
gtcttggatataatattttatcttaaggtcatagcaatatcatgatgttacaaacacagtgacggtttcaaaccacaaagtgaactattaaagttcaatacaatatatgatatacaatacatatcaaagaatatactgtgtgtgaagatgcaatgatgtgcttcataacaccaaagttgtaaattattacccccaaagccacaagtatagtagaacaatttgaaataactcacagtttccatgtcaaggatgattacagtggtggtacataagggaacttgacaaacatccctagtcagccattttgttcaatcgatgaatcatactcctggcaagacg

SEQ ID NO: 156 - DNA, 369 bp, Triticum aestivum
  Clone ID: LIB3280-002-P1-K1-F9
gcaaaagaaaccatgcccaggagctccatagattttggccaaatatattttgaagaactgagttggaatactagggagagcaggcccgggacattgttctttacagttaattttcttcatcaaatttggtagccccaagatgcaccaggagtaggcacaaggaggcggacgggggcagttaatttactatgtgttagttgttaaatatatgtccaaatgttgatactcctacttgcacgtcgtatgattttttttgaaatgctttgtatgttaaatgaaccatggcgatgtttttgtttagttgcctctgatgtgcatgcttttattttctctttttctcataattcctagatttaggaaaagatatgg

SEQ ID NO: 157 - DNA, 390 bp, Triticum aestivum
  Clone ID: LIB3280-002-P1-K1-G1
ggagaggtaccgcagctgggcgcccgaccgccaggacaggttcgtgcgccgcttcgccgacgccctcgcccaccccaaggtcagccacgagctccgcgtcatctggatcgacttcctctccaagtgtgacaagtcgtgcggtatgaaggtggccaaccgccttaacgtgaagccaagcatgtgatgatggatggaccgttctaaactttgtgctatacgtacgcatcatggaccagcaataagagaccatgccagctataatgtggatcatgtggtcgattacctactgtgctgctactaataagttactatcattttcttttatgtcgcagtaacttacctgtaatccagcaaatgaaatttaagtgggtgctttggagcctatgaaat

SEQ ID NO: 158 - DNA, 384 bp, Triticum aestivum
  Clone ID: LIB3280-002-P1-K1-G10
tccaagattccaagagttgactcctgataagcttgggcaggctggattggttagagagaagtcatttggaacaacaaaggatcgaatgctttgcattgagaggtgtgcaaattccagagctgtaactatcttcatccgtggcggcaacaaaatgattattgaggaggccaagcgaagtattcacgacgctctgtgtgtggctagaaatctgatccgcaataactctattgtttatggtggcggctcagctgagatatcttgctctgttgctgtcgaagctgcagcagatcgatatgctggagccgagcagtatgcaatcaggtcgtttgctgatgcgctggatgggattccactagccttggctgaaaacagtggtttgccacc

SEQ ID NO: 159 - DNA, 384 bp, Triticum aestivum
  Clone ID: LIB3280-002-P1-K1-G11
ggtcataatactttcatacaggaagtatgtactgatttgcccatccctgagccgatgctacagttaccgtacaggatattcgggtcatctccgcctatgagtaattttgatccagctaaaatgctcacggattctgggaagctccacacgttagataaactactgcggcaactccgagctgaaaatcaccgtgtgctcctatttgctcagatgactaaaatgttggacatccttgaggactacatgaatttcaggaaattcaagtatttcagactggacgggtcttctgcaatttctgatcgtcgtgacatggtccggaatttccagaacaggaatgatatatttgtcttcttgctaagtacaagagctgggggactaggaatt

SEQ ID NO: 160 - DNA, 199 bp, Triticum aestivum
  Clone ID: LIB3280-002-P1-K1-G12
ctccctcaccatggccgccgccgccgccatggcccgcaggctgctctcccgcaccaccacctgccactcgaccaccgcccgcctactcgtatcccgtcgcctcgactccgacccgtgctacccgcgcgccccggcaggcggcggccaacgaaatgctgaaaccagcgggcgaacccttatctgaaaactactttctgcg

SEQ ID NO: 161 - DNA, 106 bp, Triticum aestivum
  Clone ID: LIB3280-002-P1-K1-G2
aaacttcagaaccctgtatttgatgctcaacattattgtgttactgcatgtaaaagatcatacattgtattactagagtggctatgcgtgatgatattttcccctt

SEQ ID NO: 162 - DNA, 388 bp, Triticum aestivum
  Clone ID: LIB3280-002-P1-K1-G3
cggacgcgtgggtgccgcatcgtcgcacacgtcgcctagcccccaacgtccacgactccgccagccgaccaccgcagcagtctccggtgacccgtgtgcggccgcaggtgacgcacacatcgagcaacatcgaccgggcacgggtgctggatctggtcgccgttcggagagcatgtactaatctccggcgagttccttgcgcagatcagaagaggggtgcctcgatctgccacagcatatggtcaggcttcggcgggattggcaggcctgtggccagggttgcgctctagagccacgatgtcgagcttgtcgccgtcaaagaccccttcatcaccaccgactacatggtaccgttctcgaatctcttagcttatgagatctacgggca

SEQ ID NO: 163 - DNA, 360 bp, Triticum aestivum
  Clone ID: LIB3280-002-P1-K1-G4
cggacgcgtgggtgccgcatcgttgcacacgttgcctagcccccaacgtccacgagtccgtcagccgaccagcgcagaagtctccgttgacccgtgtgcggacgtaggtgacgcacacatctgggcaacatcgaccgggcacgggagctggatctggtcgccgttcggagagcatgtactaatctgcggcgagttccttgcgcaaatcagaagaggggtgcctcgaactgccacagcatatggtcaggctattgcgggattggcaggcctgtggccagggttgcactctagagccactatgtcgagctttgtgtcgtcaaagacccgtttatcaccaccgactacatggtaccggtcttg

SEQ ID NO: 164 - DNA, 87 bp, Triticum aestivum
  Clone ID: LIB3280-002-P1-K1-G6
ccgaagtggaggaattttttgagtcttcggcacataatgtgcgtggatgtggcctgaatatactgatgccaaaactagcgatcatct

SEQ ID NO: 165 - DNA, 338 bp, Triticum aestivum
  Clone ID: LIB3280-002-P1-K1-G7
cacacacaagggctactttgacaagagcaaatgacagtacaattcccgatttccttctcgccgatacctagattgcaggaaacgctcccgatacagcagcaaacataatttcaatcctacagttaaatagcctagctcatctcatgcactgtacaacgccacgtttttttctgcaccagcaatggaggggctgacgccataaacagtgcatctcctcaccggggatggtttttgttgaagcgattacctcttccgccttttcggctcaaccttagaatcagaacttggtgaactcgggtatgaatttgaaggtctctttgcaccattttctttagcac

SEQ ID NO: 166 - DNA, 76 bp, Triticum aestivum
  Clone ID: LIB3280-002-P1-K1-G9
tcgaagatagcaaacacgcgcatgcgatgtaataattttgctatagtgtaacctaaagaacaattgactggacagt

SEQ ID NO: 167 - DNA, 250 bp, Triticum aestivum
  Clone ID: LIB3280-002-P1-K1-H1
ggagagggtccgcaggtgggcgcccgaccgtcaggacaggttcgtgcgccgattcgccgacgccctcgctcaccccaaggtcagtcactagctccgcgtcatctggatcgactttctctccaagtgtgacaagtcgtgcggtttgaaagtggtcaaccttctttacgtggagccattcatgtgatgatggttggaccgttttaaactcttagctatgatgttcacattatggaccaggtattttgggacc

SEQ ID NO: 168 - DNA, 326 bp, Triticum aestivum
  Clone ID: LIB3280-002-P1-K1-H2
cggacgcgtgggtcctcctccacctagggttttgctgcctccctcccccaccgccgtcgtcgccgcccgcgtccaccatggcgctgccgaaccagaacaccgtcgattaccccagctttaagctcgtcatcgtcggcgatggcgggactggcaaaaccacatttgtgaagaggcatctcactggagagtttgagaagaaatacgaacccaccattggtgttgaagttcacccgttggatttcaccactaactgtggaaagatccgtttctactgctgggacactgctgggcaagagaagtttggtggccttagggatggattacta

SEQ ID NO: 169 - DNA, 218 bp, Triticum aestivum
  Clone ID: LIB3280-002-P1-K1-H3
cggacgcgtgggtgctgcttcgcttcacacgttgcttagtccctaacgtacacaagtccgccaggcgagcgtcgaagatgtctctggtgacccatgtgcaggtctatgtgacacacacattgagcgacatcgaccgggcacgggggctggatctaatcaccgtttggagagcatgtactaatggccagtgagttacttgatcatatcataataggggt

SEQ ID NO: 170 - DNA, 334 bp, Triticum aestivum
  Clone ID: LIB3280-002-P1-K1-H4
accacgcgaaaaatcaaaggaaaatcttaatttgaaacagaagtgattctagaagggatacctcaagcgagtactggcccaactgaaggccacatgatactcaacatgatcctgattattgcacagaaacatgcagatgaacagccaccaacatatccaccaacgaataaccaatgccagaaccaaatccagctgtggatgatgtcctcatggatgcctcaaagactgccgtacatactgctgtaactactgcgttatgcaatgcaatatctgatgttccttatggtcccccaacaagtgctggaacgacggcattaaatgcaacatttgactt

SEQ ID NO: 171 - DNA, 188 bp, Triticum aestivum
  Clone ID: LIB3280-002-P1-K1-H5
gaatccggagatttcgacccacgcgtacgatcacgcgaaaaatcaaaggaaaaacttaatctgctacagatgtgattctagaagtgattctttgaggaagtactggcccaatttatggccacatgatacgtttcatgattctgattattgcaaagtatcatacgaatgaacagttacttttattttat

SEQ ID NO: 172 - DNA, 362 bp, Triticum aestivum
  Clone ID: LIB3280-002-P1-K1-H8
atattttacagataatgttggccatgactctttgacgctttgtgggctacactttcttgatttctgctgcagttgtcctagattctcgctccaacaagcttcggtgaagtgtgaagtccagctgactggaattgaggaatgcctgttcatacattggaacattttgtcaatctgtgtatcgtgtatctaatgttttcattcaagaactccagctccctgcttagttgtagctttttactcggtactttagttttcgtcttcaaaagatgtctcgatgatcactgacaaaattacaagggcgtccttgaagtgtgtcgctgtacttggaaacttaccggtgtacacttatggtctcttttttt

SEQ ID NO: 173 - DNA, 373 bp, Triticum aestivum
  unsure (1)...(373): unsure at all n locations
  Clone ID: LIB3280-002-P1-K1-H9
tgaagatggcagcttcgaccaagctgtttctggctgcgactacgtcttccccgtggccgctccggtgaacatgttgtcagcagatcccgaggtcatttttcaacaacttaaaagaaccttctgcattactactagcctgctattctctccggacggagggagtgttaatgcaggttcctctttcccccagaggatatgatatgatatttgcagctcatcatagtgtgccaacaaccactccagaggaaccaccttacaacctctcgttcctgaagcgaggggagcaagcgaataatccttctcttttccacgagaggttcgatcgagtggtggccggcgatgtcngcgggtgaggggaagaggacggcgtgcg

SEQ ID NO: 174 - DNA, 236 bp, Triticum aestivum
  unsure (1)...(236): unsure at all n locations
  Clone ID: LIB3280-003-P1-K1-A10
gggggggggggtnnnttnnntttggngggngnnnnnnnnnnngnnnggagttttggtttttttttttttttgtttttttttttttttttttttttttttttttttttttttttttttttttttttttttttggggggggaaaaaaaaaaaattaaaaaaaaaaaggttttaaaaaaaaataaaatgttaaaaaaaaaaattttgattttttaaaatttttaaaaaaaaaaataaaa

SEQ ID NO: 175 - DNA, 407 bp, Triticum aestivum
  Clone ID: LIB3280-003-P1-K1-A11
acgccctcctcctcccctcctgcccccgagcgccgccgccgccgccgccgccgactgcagccatgtcgctgatcgcgggtgaggagttccagcacatcctgcgtgtgctcaacaccaacgtcgacggtaagcagaagatcatgttcgcgctgacctccatcaagggtgtgggccgccgcttctccaacatcgtctgcaagaaggccgacatcgacatgaacaagagggccggagagctttcctcggaggagatggaccgcctgatggcggtggtgcacaacccgcgccagttcaaggtgccggactggttcctcaacaagaagaaggactacaaggacggcaggttctcccaagtcgtgtccaacgccgtggacatgaagctcagggatgaccttgagaggctcaag

SEQ ID NO: 176 - DNA, 444 bp, Triticum aestivum
  Clone ID: LIB3280-003-P1-K1-A12
cggtctccgtccccatctccccctccgccgcttccgccgcgccgccggcgacgaccccgtcgacagatctccaccggcgccctccaccatgtaccgagccgcctccggcctcggcgccctcaagcagcatggggcggatacccaactgttgaatatcgcggttaggtctgctagcacaagtgttgcacagaggtcatcgggcggcttcttgggttggctgacaggtgcacgttcaaatgcactaccccctccagatttcgcactcccaggagtcactattcctcctccattagctgatcatgtggagcccggcaagacgaaaatcacaacactttcaaatggtgtaaaaattgcctctgaaacatctccaggatcagcatgttctgttggagtttatgttcactgtgggtctgtatatgaaacacctgagacactgggtgccac

SEQ ID NO: 177 - DNA, 421 bp, Triticum aestivum
  Clone ID: LIB3280-003-P1-K1-A3
ggaattgacacccatgatcccggaggctaccctgagggcttagagagaccaaaggagccaggactgagctccttgcggaccataagagaacttaaagaaggcatggttattacggttgagccaggctgttatttcatcgatgctttgctgaggcctgccagggatgatccaatttcctcaaaattcttcaactgggaagagattgagaagtacaaaagttttggtggtgttcgtattgaaagtgatctgtatgtgacggcacaaggatgcaagaacctgacaaactgcccccgggagacctgggaaatcgaagcggtaatggctggcgcgccatggcctccacgtgcttccgtgacaaaagcaaaaaacggtctacccaaagcccgagctttcgcttgttgatgctccctgggcgaaacat

SEQ ID NO: 178 - DNA, 455 bp, Triticum aestivum
  Clone ID: LIB3280-003-P1-K1-A4
acgcgtccgggaattgacacccatgatcccggaggctaccctgagggcttagagagaccaaaggaggggggactgagctcctggcggaccataagagaacttaaagaaggcatggttattacggttgagccaggctgttatttcatcgatgctttgctgaggcctgccattgatgatccaatttcctcaaaattcttcaactgggaagagattgagaagtacaaaagttttggtggtgttcgtattgaaagtgatctgtatgtgacggcacaaggatgcatgaacctgacaaactgcccccgggagacctgggaaatcgaaactgtaatggctggcgcgccatggcctccacgtgctttcgtgacaaaagcaaataacggactacccaaagcctgagcattcgcttgttgatgctccctgagctatacataaccgtaaaaattgaatgaacgaag

SEQ ID NO: 179 - DNA, 209 bp, Triticum aestivum
  unsure (1)...(209): unsure at all n locations
  Clone ID: LIB3280-003-P1-K1-A5
ccggtaattgacacccatgatcccttatgctacccttattcctaaaatataccaacagagccaggactaatctacttgcggaccatatnataacttaaataaagcatgtttattactatattatccatacttttatttcatctatactttgttatacctcccttttataatccaatttccccaaaattcttcaactttcaagagattta

SEQ ID NO: 180 - DNA, 442 bp, Triticum aestivum
  Clone ID: LIB3280-003-P1-K1-A6
attcaagctcacttgttaagacctatcctgatataggtgaactggcttttggccggaaaggaagaatcatagtagcaatattcatgtacctggagctgtaccttgtggcaatcgatttcatgatactggaaggtgataacttggagaaattatttccaagtgtcgacttccatgttgctggactcaagattggaggcaagcaagggtttgttctgattttcagtctgttggttttgccaacgacatggtttcggagcttaagtgcgcttgcgtacgtctctgttggaggaatcatggcctccgttattctcatcgctgctgttatctgggtaggagcatttgatggtgttggcttccacgagagaggcgtgcttgtccactgggctggtattccaactgccatgagcttatactcattctgtttcagcggtcatgctgtttt

SEQ ID NO: 181 - DNA, 375 bp, Triticum aestivum
  Clone ID: LIB3280-003-P1-K1-A9
ggccaatccacgcacacggtgtcccgtcccgcaaggctcgctcgcctcgcctcgccctgatccgatccccaaatccctcgccgtcgacgccccgaatctcagctccggtgaggccgacccattagcagggcgtgacctcggcgcgcccgccctcccgcccgccgctccctcctctccgcccgccgtcgtccccggtcgccggaacccgacaagttggatatctaggaggcaccgcagcgttgcggcgcccaccgcgcggacaccatgtctgcggcgccagccgcgtaccccaccaccagcctccgcgccttcgcgttcggaaactcctttttcccctgctcccaccggcttaagctcttcttcttgcattggtta

SEQ ID NO: 182 - DNA, 397 bp, Triticum aestivum
  Clone ID: LIB3280-003-P1-K1-B10
cccacgcgtacgggtgtatcacgtacatctctgccggttgggaatattttttgggcgtccattcccttggggggtgtcatccgatgcacatggagggagatccacttttcgaaaagagaaaaagctggctcggagtgtttgcttttctatggcagagtgcaagggatgttgaagtcgatcgtcggaggctgagggcctgtgtggattcctacgctcgcagcgatgattggggtctccttcctgctcacgttgacgaggagccagaggggcatgctgcagcggctagtccccctgtagcacaaagctgtgagcctcccaacaagacacggcggcagggccacgcatgaagatgcatggcggcagggccaccatgaacaagacacggctaacccttggc

SEQ ID NO: 183 - DNA, 391 bp, Triticum aestivum
  Clone ID: LIB3280-003-P1-K1-B11
cggttggctgctacaaggagatctaccgtgtattaaaacccgggcagtgttttgctgtatatgagtggtgcattaccgatcactatgatccaaacaatgcaacccacaagaggattaaggatgaaattgagcttgggaatggcctgccagatatcagaagtactcggcaatgtcttcaagctgttaaagatgctgggtttgaggttatttgggacaaggatcttgctgaagattctccattgccttggtacttgcccttggacccaagtcggttttctttgagtagtttccggttgactaccgtgggacgaataattactcgcaatatggtcaaggtattggaatatgttggtctggctccggaaggcagccagagggtctctagtttctt

SEQ ID NO: 184 - DNA, 327 bp, Triticum aestivum
  Clone ID: LIB3280-003-P1-K1-B12
ctgttttctgctacaaggatatctacctttttttaaaaccccctcattcttggtgtgtatatgaaagggggatgaccgatcactatcatccaaacaatgcaacccacacgaggattaaagataaaattcagcttgttaatggccttccatatatcataattactcgtctatgtcatcaagctactaaagatgctgattttcatgttcctcacgtcaatgatcttgccttaaatttttcatagccttgctacttgcccttctacccaagtcatttttcttttactaactttccgtttaactaccgttgcactaataatcactcacaat

SEQ ID NO: 185 - DNA, 109 bp, Triticum aestivum
  Clone ID: LIB3280-003-P1-K1-B2
cccacgcgtccgttctcttcttccacgtgattcgagtcatctcgcctctctccgtgagcgcaaacatggactcaagcgcgcgcccgattggaatccagcaatttctttc

SEQ ID NO: 186 - DNA, 173 bp, Triticum aestivum
  Clone ID: LIB3280-003-P1-K1-B3
atttgtggtagccactctgtaactattcctctatttctggtactcccttattttgtgcggttttcagtgggttgacaggcaaggtccaagggaaaaaactttttttttaaacccactcatatcctcaacagcatcccccggaatcttttaatcacctttaaattttaattttt

SEQ ID NO: 187 - DNA, 409 bp, Triticum aestivum
  Clone ID: LIB3280-003-P1-K1-B4
acccaaagtcctccctttcccctccccctccccgctttccaccatttcgtcgaacacggggtccgatcgcgcgcgggcggccatgggggaggcctccgagtatgacggggtggatgtggcggctgtatcggcgaggttgctggagctggtggccgacgacgatgtgacggcgctcgtcgacctcctcgccgcgcacccgctcctcgcggatgagccggcgccgtggtactctccggcgcggggcgcggagcccatgacgccgctcatggtcgccgccgcgtacgggtccgtggcttgcctcgacgccctcctctcgccggcccacctcgccgaccccaaccgctcctccgcctcctcgctctccaccccgctccacctcgccgccgtgggcggcgctccatccgcaccc

SEQ ID NO: 188 - DNA, 449 bp, Triticum aestivum
  Clone ID: LIB3280-003-P1-K1-B6
ctacctaatcccctccccggcactccccgcctgacaaccgcggccatggcgtgcgcgttgtccgcctccaccgtgtgcacggcggccgcgctcgtcgcgtccccgaagccagccggggcgccgcagtgcctgtcgtttccccgcgccatcgcaggcgccgccgccaggccttcccgcctcgccgccgccagctcgaggacggccagggcccgcagcttcgtcgcccgcgcctcagcggagtacgacctgccgctggtggggaacaaagcaccggacttcgccgcggaggccgtgttcgaccaggagttcatcaacgtcaagctatctgattacattgggaagaagtatgtgattcttttcttctaccctctggacttcaccttcgtctgcccaactgagattacggctttcagcgacagacatgaggagttcgagaagataaacactga

SEQ ID NO: 189 - DNA, 68 bp, Triticum aestivum
  Clone ID: LIB3280-003-P1-K1-B8
ctccccccttcccctctcggcctcttccttctcgcgccgcccagatctctcgcctgactccaaaccct

SEQ ID NO: 190 - DNA, 300 bp, Triticum aestivum
  Clone ID: LIB3280-003-P1-K1-B9
caactccttatccaaccctccctctaccatatcacaccccacacctcctccagctcgttcctccaaccgggtggcggcttcgccaattccttctccccttccgtcctactcctcccgcatacccccctttcataaccctagcaatggatgaggaggctgagccgctgcccgccaccaaccatggccttcctctcctcttccttggtcgcctcttcctcatcaaggcacttagagcggatggcatgtccgtgcagaaaaacaaaagctgccctctctgcccttcgaccacagaaaaacggc

SEQ ID NO: 191 - DNA, 457 bp, Triticum aestivum
  Clone ID: LIB3280-003-P1-K1-C1
ctctccgcggctcccaactcctgaccaccccgcacccctccggctttcacgcgagtcggcgtccccgttcaaccggaccgggtggccttgcgttccaacccattcgggattccggccatcgtttctgaggtctgtgcattccaaaccagcccttggacgccccttgtgacagcaacagcatgcctaagataaagacaagccgcgtcgaatatcctgaaggatgggtgcttattgaacccacaatccgtgagctggatgccaaaatgagagaagctgaaaacgatacacatgacgggaagaggaagtgtgaagcactctggccaattttccgcatttctcatcaaagaagccgttacatttatgatcttttctataaaaggaaggaaatatcaaaggagctgtatgagttctgcctggaccagggttatgcagaccgtaatctgattgcaaagtggaa

SEQ ID NO: 192 - DNA, 253 bp, Triticum aestivum
  Clone ID: LIB3280-003-P1-K1-C10
aatggggaatagagtgggcagcgaccagcacagggggcacagatttgctcttcttttctcatcatatccccgtccaacaaattagatgtatcagcggaagagttccgacaaatgcggtaattagatactggaaagaaggcaggcaccgttcctttttagctgtgagtggagttcactatgcccatgacaacatggtggtcgaaaccgacgagaagaatcaacccatctcagtctcccgcatcctcatggctag

SEQ ID NO: 193 - DNA, 402 bp, Triticum aestivum
  Clone ID: LIB3280-003-P1-K1-C11
cccacgcgtccgggtgtatcacgtacatctctgccggttgggaatattttttcctgggtccattcccttgctcgctctcatccgatgcagatggagggagatccacttttcgaaaagagaaaaagctggctcggtgtgtttgcttttcgatggcagagtgcaagggatgttgaagtcgatcgtcggaggcggagggcctgtgtggattcctacgctcgcagcgatgattggggtctccttcctgctcacgttgacgaggagccggaggggcatgctgcagcggcgagtgcccctgtagcaagaaagctgtgagccctcccaacaagacacggcggcagggccacgcatgaagatgcagggcggcagggccaccatgaacaagacacggctaacccttggcga

SEQ ID NO: 194 - DNA, 446 bp, Triticum aestivum
  Clone ID: LIB3280-003-P1-K1-C12
ctcttaaggtgcgttgggatgagccgtcaactattccgcggccggatagagtctgtccttggaaaatagagccagcttcatcacctcctgttaacccgcttcctctttctcgggtcaaaagacctagaccaaatgttcctccagtttctcctgaatcatctgttcttacaaaagaaggtgcaactaagattgatatggattctgctcaagcacaacaaagaaatcaaaatagcatggtcttgcaaggtcaagagcatatgaccttgaggaccaacaaccttactggcagcaatgaatctgatgctactgttcagaagcctatgatgtggtctccatcccccaacattggaaaaaaccatgcatccgcgtttcagcagaggccctctttggttatttgaatcgcacctgggaagatgtgatgctagttctggtgctcaatcttttgg

SEQ ID NO: 195 - DNA, 364 bp, Triticum aestivum
  Clone ID: LIB3280-003-P1-K1-C2
ggtgggggaggatcgatcgtacagggcaacactggtactgcggtagcttagtacgtagtagtacatcagtcccctgcaagctttcgagggcggtagcgaggccaaaaccggcatcgccatgccattgaatcttaaggcgcggaaactactcccaagtcacccaatcgatggatcgatggatccccctacgtttccttcccaccttagttcgggacacaccttggatcatcacggtacgtacgtacgtacgtatgtatgtatccatccatagttgattagttgcaaagggcgacggcggcctcctggataaccccttgggtggggtgggcaacgttatgagcctcgcgctccacctgctcccggc

SEQ ID NO: 196 - DNA, 352 bp, Triticum aestivum
  Clone ID: LIB3280-003-P1-K1-C3
gttgggaggagtacaacggacaaaaacagagcagaggtaattcacacttgcaattacaatttgagattttcggagtactgtctaatagctctcccgtaggctggcctttggggagaccgggagagagttccgcaccagctttctggcaaatgtacgtacgtaccatgtcaagaaacaaatcaacaaggcagacaccgacgatctggttagcataacagctctactaactaattaagcagcggccttatgctgctgtcacctcatgcgaactctctttgcagcggcggctacacctgggcggcgaccttgtcaacggactgctcgtcaacttcaacggcggggtcggcgacct

SEQ ID NO: 197 - DNA, 61 bp, Triticum aestivum
  Clone ID: LIB3280-003-P1-K1-C4
acccttcctttctacaccttctagtccgccgtcaggcgcgtctcctgccccgtcgccctcc

SEQ ID NO: 198 - DNA, 276 bp, Triticum aestivum
  Clone ID: LIB3280-003-P1-K1-C5
attgcaacgttgaggctttaagcagaagcagttgaaataatggctggcgttgtatatttttgctactagggttgtctcccatcataccttgggtacaatctcttttgttttcttcctctgctgcaaaagcatttctccaaggagcagttattttcaaatattttttgccagttgatacctgatggtaccaacatacttctaacagaagagttgataaatgctttatattaaaaaaaaaaaaaaaaaaaaaacaataaacaaaaaaaaaagtgaaaa

SEQ ID NO: 199 - DNA, 416 bp, Triticum aestivum
  Clone ID: LIB3280-003-P1-K1-C6
gcagtttgaggcagacaaggagcaggtgataaaggagatatcagcactgtaacttcgctgatgtagcttgcttcgatttgtgactagtatgttcacaacctcagctggtttgtttttatttgcagcgaatagcttgaacacatgaaaagattctatctgaatatttttgctcgagtcccttaaaagattcatcagaatcataagattatcttttgaactaacatatcgcatcatgactgcagaatttgatctatcaagcagcatgtctcccaacagcttgatagcctgcctttttgttatgtagttgcttgatgacagcagccaaagttgtgatactagttgtgcacctgtgccatagctcacaccaactcagtacgaatgatctgaatctgcaatgacgaagatttgtatgcgtc

SEQ ID NO: 200 - DNA, 296 bp, Triticum aestivum
  Clone ID: LIB3280-003-P1-K1-C7
ggaagactttaaccatccagagagcctagagtgcatgaggcgggttcgtcaagtggggcaacataactgggagcaggtctttgccaatgaggtgactgagatgagaggccacctcctcaagtaccctgtaagtgttgaccgtaaaggcaaggtgaaacccttgccaggatgtgcgacattcccagacatgggcggaaacatttgtggctccttcacgggcatccaggaaaacctcacaatatgaattctgcttatgcaagaatgcaattgttggcttcttgggtattctggacaac

SEQ ID NO: 201 - DNA, 449 bp, Triticum aestivum
  Clone ID: LIB3280-003-P1-K1-C8
cccacgcgtccggcaggctgaagctgctagcctattgtacaagtcaaatctcaacggagggagcgtgctggagtacgctcttgctttcacaagtgctgccctggatagacattacagcaaatggagtgcaactccaaagacaggtttcattgacataaccacatcgaaggacttctatcgtgtttttagtggtcttcagtatagctacttggaagatagcatgaccaatccttcaaagaaacgagaaatgttgggcgactctgtagcatgggctggttgtactatcatgtacttactggggcagcagctgcatttcgagcttttcgatttctcctaccaatttctcaacgtggcagaaatagaaaccgcaacggtttcactttaccaacctgcggataggagcaaaagcccaaatatcttccaaggctacgaggtcatccttgaagcga

SEQ ID NO: 202 - DNA, 372 bp, Triticum aestivum
  Clone ID: LIB3280-003-P1-K1-C9
gaaaaatgctctaggaatgatgatcatgggggttttattggttacaacatatgaattaccactcgaaactagaacaggatatgactctatatgaatgcctccgacggtgtaccgggatggtgcaatgaatcaagagtgacatgtatcaaaaataatgcatggtggctttgccacaaatatgatgtcaactacatgatcatgcaatggcaatatgacaaaagtaaaggatgtcatgatgatgataaacggaacagtggaaagtttcatggcaatgtatctcggaatggctatggaaatgccataataggtaggtatgggggctgttttgaggaaaatataaggaggtttatgtgttatagagcgtatcctatc

SEQ ID NO: 203 - DNA, 434 bp, Triticum aestivum
  Clone ID: LIB3280-003-P1-K1-D1
ctcctcaggatgacatgcccgaggacagtagagatgctgatgacttattgggggagtctgcggctggttttgatgtgcttgtggccaacgatgcagatgctggtgcttatatgcacgaccctgacgattttggaagggacatatatccagtagaagattatgaatatgctccggctgattttgaaatccagtctcatcatgaaagagagctattcaacggaatgggtgagcaaggaccgatcggacaaatgtatgatggctatgacaggaaacgtcgtagaacatcttctgagaggaacttggacagaccttcctattcagaaaggaggtctcggcagagagagactggccctgttgagatagatggatcagatttacgtcaccggctcccgaagagaaaaataaatgggtctccaagcatcaacccggaacgc

SEQ ID NO: 204 - DNA, 375 bp, Triticum aestivum
  Clone ID: LIB3280-003-P1-K1-D10
cggacgcgtgggcggacgcgtgggcggacgcgtgggcgcatccggccatgggtaggaggctgggccgccgcgtgctccacttcgccaacctccccatcaagctcatgctccccccagcgcccctatcctccgtccaggagtttgctgtcaggaccgtcccctccgcctccaaggtcgacatccgccgctgtctcgagtccgtctacggcttcaacatcgccgaagtccgcaccctcaacatggagggcaagaagcaccgccgggggcccttcctcgccgccaagccagactacaagaaggcctacgtcactcttcaagccccgctctccgtttcccccgacatcttccccatcggcgcgatcctcggggagaggg

SEQ ID NO: 205 - DNA, 415 bp, Triticum aestivum
  Clone ID: LIB3280-003-P1-K1-D11
ggatggtactccaagatgctgtagttgtgaaagaatggagccaagggaatcaagagatgtattgcttgatgatggtcgtaagctctgcctggagtgccttgactctgcagtaatggatacaaatgagtgccagcctctttacctcgaaatacaggaattttatgaaggtctcaatatgaaagtggaacaacaggttcctctgcttcttgtagaaagacaggctctaaatgaggccatggagggagagaaaactggacaccaccaccttcctgaaacaagaggtttgtgcctatcagaagagcagactgttagcacgatattgataaaaaccaagattgactggaaacaaaattatggaaatgataacagagccgtataggttgacacggcggtgcgaagtgactgctaattctca

SEQ ID NO: 206 - DNA, 394 bp, Triticum aestivum
  Clone ID: LIB3280-003-P1-K1-D12
atgtcctggctgctggctccaaacattatccacaagaacacgctcgctacttgtggaccggctggcacagggaactcaatgtgctacttgaaacattccaaaatgcttatgcatatcccaccctgaggagaagatactagagcatgaccagattgaatagtgcacgtttggagcaacagaagccaataaagccgatcactatagaagctccaagatgacacacgcaggcatgcatggacactgctccagtctagatgtaatgatgacacatacagtgggctgacccaatcaacgcttggagtgcctgcacatttgattcgcccagaacataaggctggacaatcattgccgtttcgccagcttaccacctagcacgctgaccaggaaccctacc

SEQ ID NO: 207 - DNA, 373 bp, Triticum aestivum
  Clone ID: LIB3280-003-P1-K1-D2
ttcgatccttctgaattattaactgaggcgtggggtgattttgatgggggtggggccaacgattcatatgctggtgctcatatgcacgaccctgacgattttggaaggtacatatatgcagcaaaagattatgaatatgctccggctgattttaaaatccagtctcatcatgaaagagagctattcaacggaatgggtgagcaaggtccgatcggacaaatgtatgatggctatgacaggaaacgtcttaaaacatcttctgagaggaacttgtacagacctttctattcagaaaggaggtctcttcagagagagactgaccctgttgaaatagatggatcatatttacgttaccggctccgcatgagaaaaa

SEQ ID NO: 208 - DNA, 451 bp, Triticum aestivum
  Clone ID: LIB3280-003-P1-K1-D3
caagaagctgtccctttcgctctcctctcttcttccgttaccactcaccctcccggtgcggggccctttaagggatgggcctctccaatcctccttgaaccttagagagagagagaccaagaatggctcgtgagatgaatggctacttcagccaccctccgcctccgcctccggttccggcgccgtaccaggaggaggcggccgcggacgtggacgacgcggaggacggcagcggcgggcaggggaagctctgctccaggggccactggaggcccgccgaggacgccaggctcaaggaactcgtcggccagtacggcccccagaactggaacctcatcgccgagaagctcgacggcagatcagggaaaagctgccgtctgcggtggttcaaccagctggacccgcggatcaaccgccgggcgttcacggaggaggaggaggaccggctgat

SEQ ID NO: 209 - DNA, 120 bp, Triticum aestivum
  Clone ID: LIB3280-003-P1-K1-D4
ccagctgtaagtttactctttttgcaccccatgttctcagccatgttcatctgtaagaagtgctgcacatctttgtggtgtactttggttaataacttgatatctgaactaaattacacc

SEQ ID NO: 210 - DNA, 57 bp, Triticum aestivum
  Clone ID: LIB3280-003-P1-K1-D5
gtctagttctagagaaagatcggccgctcgcgcagagcgcgtcttcggacacttaat

SEQ ID NO: 211 - DNA, 322 bp, Triticum aestivum
  Clone ID: LIB3280-003-P1-K1-D6
cccccggactttttctttttttctacctaaaaaaaatcctttcttttttaacagataccaattttctcccacctttccatataacatacttcttttttacaacagggtaaaattaaaatacttcaaccaaaatgacatcttttttaaactatatcactttctgacatcacatatttcataagattatgcatattccttcacaattttactgataaccgtatatttcaaataataacacaaatctattacaaactttcatacaacacctgaatctactaaacttcaatcttttttaaaaacacatcattattattattaatta

SEQ ID NO: 212 - DNA, 373 bp, Triticum aestivum
  unsure (1)...(373): unsure at all n locations
  Clone ID: LIB3280-003-P1-K1-D7
gcgtaaagcgtctgtaggtggcttcaaaacgtatcctgaaggaactgaaggacttgcgagaaagatcctccgacatcatgcantgcangtccttctggtgaggatatgttccattggcaggcaaccattatgggtcctcctgatagtccctatgctggaggtgttttcttagtgaatatccatttccccccggactaccccttcaagccgccgaaggtatcgttcaagacaaaggtcttccatccgaacatcaatagcaatggaagcatatgccttgacattctgaaggagcaatggagtcctgctttgacaatctctaaggttctgctttcaatctgctcgctgcttaccgaccctaacccggacgaccctt

SEQ ID NO: 213 - DNA, 441 bp, Triticum aestivum
  Clone ID: LIB3280-003-P1-K1-D8
gtgtaaagcgtctgtaggtggcttctaaacttatcctgtaggaactgaaagggtggcggaaagatcctgcgggatcatgcactccatgtccttctggtgaggatatgttccattggcaggcaaccattatgggtcctcctgatagtccctatactggaagtgttctcttagtgaatatccatttccccccggactacccattcaagccgcctaaggtattgttcaagacaaaggtcttccatccgaacatcaatagcaattgaagcatatgccttgacattcttaaggagcaatggagtccttctttgacaatctctaaggttctgttttcaatctgttctctgcttacctaccctaacccttacgaccctctcgtcccctatatttaccacatgttctagacggatctttccaagtatgatactacagccctcatctgga

SEQ ID NO: 214 - DNA, 420 bp, Triticum aestivum
  unsure (1)...(420): unsure at all n locations
  Clone ID: LIB3280-003-P1-K1-D9
cacaagtcagaacaaacacgatcgacacggtcgatatgggttccctctcctacgtggtggcngcngccgggcgggcggctctnntctccagcngcgcttacatcccgagggtaccgccgggccccaacatcaccaccaactacaacaaccagtggctctccgccaaggccacctggtacggcaagcccaccggctccggccccaaatacaacggcggcgcgtgccggatcaaagacctgaacctggctccctacaacggcatgatcgcctgcggcaacctccccatcttcaaggacggcaagggatgccgctcctgctacgagatcaagtgccagaagccttctccgtgctccgacaagcccatcaccatcttcatcaccgacaagaactactagcccatcgcgccgtaccacatctacc

SEQ ID NO: 215 - DNA, 227 bp, Triticum aestivum
  Clone ID: LIB3280-003-P1-K1-E1
ggcgcgcgtccggtgccgttcgttcggaggggtcttgatggtcgtcagcgaggaaatcggattcgcctgcgtggcggagaggcgatgacgatgacattgttggtagggtgacggtgtcctctcctcggcgttgtgtggggtcttgtaagtgccaggtcggtcggattgccctgttcgatgggcgagttgtaacggttttcgcccggttttccgttaattaaccggac

SEQ ID NO: 216 - DNA, 220 bp, Triticum aestivum
  unsure (1)...(220): unsure at all n locations
  Clone ID: LIB3280-003-P1-K1-E10
agattgaatggtatgacagctccaataaacacagacatcaacaccgaaatgttaagactacttgcacaacgcangaaacaacaattaaaattcaattgtctaaccttataaaacataaaaccaccacacccaaaaacctccttaggccggtgttaccaaaccccgttaattattatttaaaccagaaattaacctaaggacctaaacaccacaacaagaa

SEQ ID NO: 217 - DNA, 370 bp, Triticum aestivum
  Clone ID: LIB3280-003-P1-K1-E11
gcctcgctcaccgtcgtcaacgtcggccccgggttccgggaccagtaccactctttccccccgaattcccctttccgtttcttgaaaattaaccccccgccggcgccccccaaacaaaccattcttacaacattggaaaacaaaaggcgggggattccattgtggattggtttgggctggggaggctgcaaaggctcgtgttccctctaacccggcaagccgcggggattgatatgcatgtatgccgggatgcttccgaggatatgagaaactctccagggaggtggagaagagcaatcaccgcgtgcttgaccaggaaaagcgcaaccccttgatgaggtgcaagacaccgggactgcaactgcaataa

SEQ ID NO: 218 - DNA, 339 bp, Triticum aestivum
  Clone ID: LIB3280-003-P1-K1-E12
tttttggtgggtttttttttttttggggtttttttttttttttttttggagttccttttttttcctttttaaaaggacatttgaaaaaaaatgggtggtttgaatcctaaaaaagaccgaaaactaaggccgcacaaaaaaggaacaaacctaacaaaattcaaaagacgattaaatcggaacttatttgggacaagcatatgcgggaaaaaaagacttttgcctaacaagctaaagaagaaaataaaaaagtttcaacaccgcgtctgggaagagccagaaaaaaggaatttggggacattatcgggagctaattaaaccgggggccaaaccagcgcg

SEQ ID NO: 219 - DNA, 448 bp, Triticum aestivum
  Clone ID: LIB3280-003-P1-K1-E3
cgccaagcaattcgggtgggagatcaacggggacatcaactacaactggaaaaagggggtggaaaataagactgaagaaattgtgagattaaatggagtgtacaagagaatccttggtggttctggtgtgacgatgatcgaaggggcaggaagtatagtggatgctcatactgtcgaagtcacccagccagatggttcaaagcaaaggcacacgaccaagcacatattgattgcaactggtagccgggcaactctggtcgacattcctggaaaggagctggctattacttcagatgaggctttaagtttggaggagctaccgaaacgcgccgttattcttggtggcggatatattgctgttgaatttgcttctatctggaaagggttgggtgctgaagtaaatctattttataggaaagagcttcctctaaggggttttgatgatgag

SEQ ID NO: 220 - DNA, 452 bp, Triticum aestivum
  Clone ID: LIB3280-003-P1-K1-E4
ctttttcttgaaggatcagattttgagaagattcaacgggaggaaccattggatctgacggccgatgccacggcagagaagaaattggaagggcgctcttgtagcaccttttgctagcaacaatatgttggctttataccaatgccctggcaaaaatgatggcaaaaaaacatctcaggaccaaaaaagctcatattttttgcaagttctacacaatgaagccccagtttcgatgccgggctgcagcaacaaggatttatgcccattcgaggagttcaaggaaaagatagtgaagccgcacctgaagcacgactacaatatgctatgcaagaagccgggggtggcagcagaggaggagccatcctctttcagctccaagctcaacttcttccttgatctgctctcgcggaaaggttaccgttttaaggggcaagatgttaagacggagctgt

SEQ ID NO: 221 - DNA, 439 bp, Triticum aestivum
  Clone ID: LIB3280-003-P1-K1-E5
tgctgctgctgtctgtgttgccgccccgaccgcctcctccaccacccacccacccggacggggccggcctgtggggggtggcccgtctccctcatggcctccgccgccgcttccgccgtctccttcgccaggcccgtcaagacaatcaatgccaactcggtctccttctctgctccaaggaaagacaatgtatccttccgtcttcagccagttccccagagattttctgttcgctgtgctgccaaaaaggagacagtagaaaaggtttgtgatattgtgaagagccagcttgcgcttgctgatgacactgtagtttctggctcctctacgtttgctgatcttggtgccgattctttggacacggttgagattgtcatgggcctcgaggaggctttcgggatcagcgtggaggagtcgagcgcgcagaccattgcaacgg

SEQ ID NO: 222 - DNA, 431 bp, Triticum aestivum
  unsure (1)...(431): unsure at all n locations
  Clone ID: LIB3280-003-P1-K1-E6
attcccttttcaagccacgcttcctctctcctcttctctcctctccaanaccaacacctattcttaccaccaacacacccacaagggccctctctctcaccgatagcctctttacataatcttctnctctcctacttcaccaactcttcttacacacccccctcaatataaccaatcccaacttacacatcctaatcttatccacaaacaaacaaaatcatattacaacatcaaccacatccttcaagactttcttttccctcttactccaaatatctcacattacaaatacattactttattatccatattcatcttaccctttaacattactctataatttcttcctaatgtacctttcctcatccattaccccattctttcaacaccatttcattctcatcatcctcctttaacctttctacaacatc

SEQ ID NO: 223 - DNA, 351 bp, Triticum aestivum
  Clone ID: LIB3280-003-P1-K1-E8
cgcccgtgaggcagtgaggcacttcgtaaggctcctggtgtgccgcgcatccatacgaagccttatgtccggtgggaagggaaggaagtttgagaaggcaagaggaaggaggaacagcagaggcttcaaggtctaggttgctgcttgttcatgtgctacacagctcttgtttgagtctgagttatgttataattaagtgctaggatcatctaaattttgttcgaacgtcatgcactgtgtaagaaatttacatctgttttaaaaaaaaaaaaaaaaaaaaaaaaaaaaaaaaaagaaggagggtaaaaaaaaaacaaaatataaatacaattgcatgcgacgtaataggtg

SEQ ID NO: 224 - DNA, 447 bp, Triticum aestivum
  unsure (1)...(447): unsure at all n locations
  Clone ID: LIB3280-003-P1-K1-E9
ctacaaggtcggcgagcacgtctacgtcttggtgaacggcgccctccacaagggcgggccgcacaagttctgggaggggcgcaccggcctcttcttcaacgtcaccaagcgcgccatcggcgtcgagatcaacaagcaggtcggcaacaggatcatcaagaagaggatccatgtccgtgtggagcacgtgcagccatccatgtgcaacgaggagttcctccagaggaaactcaacaacgacaagctgaatgctgatgccaatgctctcggctaggtcatcagcaccaataggcatccagcatggcccaagccggggttcatggttgagggcaccaccatcgagacggtcacccccatcccgtatgacgtcgtcaacgatctcaagggtggctactanagcgctttcttcctgagctgaaacttgagccaattcttattatctatgct

SEQ ID NO: 225 - DNA, 444 bp, Triticum aestivum
  Clone ID: LIB3280-003-P1-K1-F1
cccacgcgtccgggctggtgctgccatcactggagggactgtgactgtcgaaggttgcggcaccaccagtttgcagggtgatgtgaaattcgctgaggtacttgaaatgatgggagctaaggttacatggactgacactagtgtaactgttactggcccaccgcgtcagccctttggaaggaaacacttaaaggctgtcgatgtcaacatgaacaaaatgcctgatgtcgccatgactcttgccgttgttgccctctttgccgatggtccaactgctatcagagatgttgcctcctggagagtgaaggaaaccgaaagaatggttgcgatccggaccgagctgacgaagctgggagcaacggtggaggaaggcccggactactgcatcatcacgccgccagagaaactgaacgtcacggcgatcgatacctacgatgaccaccg

SEQ ID NO: 226 - DNA, 138 bp, Triticum aestivum
  Clone ID: LIB3280-003-P1-K1-F10
ccttcctctcccacatcactttacacccttcttttttcttttagtttcccctccaccaaagtaagacctctacaaaagggaggagaaacccctctcatccttcccttaattctcaccaaatataccactatttttcca

SEQ ID NO: 227 - DNA, 390 bp, Triticum aestivum
  Clone ID: LIB3280-003-P1-K1-F11
cccgatcggcgcgttctttttctcggccctcctcgccggttacgtctacgagaggggggcggataggcggaagcctggcgttctggacccttcaaactgctttggacctgactgtttcaggctcacattctacgtctgtgccatggtgtgttgctgtggaaccctgatctgcctagttttcatcgcgaggatcaagccggtttatcagatgctctacgccagcgggtcgttcagacaccctcgacagcagcagctgtactgatggagtaagtggcatcaataggaaaacttgaaagtatgagaacagaaaagaacagaggaagttgtcagctggttgtctgtaattctgccttcttcttgcatcatattgcagcggcgtatattatccca

SEQ ID NO: 228 - DNA, 364 bp, Triticum aestivum
  Clone ID: LIB3280-003-P1-K1-F12
agagttctaaaatgacagaatagtggatttaatatgacagaagttcataataaatagggacagcatacatcaccctacagataacttgacataacaatgtataactgaacaacctaagcaaagattcttgctacatccagaatgccacaggaacctgcagggcaggatcgagaatcgttgctgcgctaggaagcttgtagcatctgcgccggcgacgtgatttggtccaccttgcaccattcacgctagactctagaattcggcaggtccagatgtctccattcttatcatacttgacagagaaagtaagcaatcaaagcaaatgcggcatgcaatcatcatctttaacactgaaataatgcag

SEQ ID NO: 229 - DNA, 459 bp, Triticum aestivum
  unsure (1)...(459): unsure at all n locations
  Clone ID: LIB3280-003-P1-K1-F2
ccgtatttccctggtcgggctaggcgtccgcccactcgtccgttctgttgctgccatcactttatatactgtgactgtcnaatgttgtggggagcaccatttggagggtgatgtgaaattctcttatttacttgaaatgatgagatctaattttacatttactgacactattgtaactgttactgtcccacctcttcatcccttttaaataaaacacttaaatgctttcgatttcaacatgaacaaaatgccttatttctccatgactcttgccgtttttgccctcttttccgatgttccaactgctatcatagatgttgcctcctggagagtgaaggaaaccgattgaattttttctatccatacctagctgactaatcttttatcatctttgtaggaatgccccaactacttcatcatcactctcccagaaaaacttatcttcacgtttatcgatac

SEQ ID NO: 230 - DNA, 418 bp, Triticum aestivum
  Clone ID: LIB3280-003-P1-K1-F3
ctcgtcgccccgcttgccgctggaattacccttgcagattcggatcacggcctcaggggggcgacgccgagccagaggtcactgccgccttccgcaaccccagccatggacgacccaggcttcgagatcgagtgcgagatacccggcgtcgtgcgtgtgcacaagagcggccgcgtcgtgcgcttgaacggcaccgagaccgtgccgccctccccgtccggtgacccagccaacggcgtcgcctccaaggacgtcgtcctcgaccccgcggcaaacatctctgcccgcctctacctccccgccgccaccgcggcggagcccgggaagaagctccctgtggtcgtgttcttccacggcggcgcgttcatgatctacaccggtgccttcccgctctaccacaagtacgccgtctccctcg

SEQ ID NO: 231 - DNA, 451 bp, Triticum aestivum
  Clone ID: LIB3280-003-P1-K1-F4
ccattccgatccccctcccggcgccgcctccagcctagggtttcctcccgccgccgggccgccccacccggcggcatggcccgccgcagcggaggaggaaggtcttcccgccctgctccacgtgctgctccagtgagaaacccaccagcgccagcccgtccagctcctccacctgctaccacccagagcagcggtggtggtatcatgagcgggattgggtccaccattgctcatggcatggctttcggtactggaagtgccatggcgcacagggctgttgatgctgtgatgggtccccgtaccattcagcatgagactgttgtcggtgaggctgctgcatctatgactccaatggacaatgctgctgatgacaagtgtggcaacccttccaaggccttccaagattgcatcaaccactacggaagcgatatcagcaagtgccagttctacc

SEQ ID NO: 232 - DNA, 395 bp, Triticum aestivum
  Clone ID: LIB3280-003-P1-K1-F5
ggtttatgtttttttttttttgggttatggtttttttttttttttttttttttttttttttttttttttttttttttttttttaaaaaaccaaaaattttttcctaattatttaaaaaaaatttaaaacaaaaaaggggttttttaaaagttttttaaattttttcaaaaaaaaaattaacccctttttttcccaaaaaaatttttttttccacaaaaaaaaaaaaaaaatgttctaaattttttttataaaaaacacaaaaatttttaaaacccctctgttaaatttttgactttaaaaaaattcccaaaaaaaaaaaaaccttttaaacccttaaaaacctttttaaaacccccaaaaactttctttagattttataacccccccccattttt

SEQ ID NO: 233 - DNA, 410 bp, Triticum aestivum
  Clone ID: LIB3280-003-P1-K1-F6
cagagaataaataacattttacttgtcgattggatctggagaaagtagttgacacaatagcaaaacatatgctccattgccaatagggttatagccagaaaattaaagataatacagtcttcttgggggaagttctggcacaacattctaaacataacgacaatatcatcagcttagaagagagatgttcccttgcccttcttgtctccaccgatttcgaagtgcttgcacctcttgatagcacgttgtgagtaatgcttgcagctctggcactgcaacttcagcacaatcttctttgttgtcttggccttcttgtggaaaacaggctttgtctggccaccatatccagactggttgcggtcataacgacccttcccctgggcaaaaaaactgtccttaccctttttgta

SEQ ID NO: 234 - DNA, 342 bp, Triticum aestivum
  unsure (1)...(342): unsure at all n locations
  Clone ID: LIB3280-003-P1-K1-F7
gaccctgttgactatagccgctcttccaatgaggtcaatcttgtcnagtggctcagagatgatgatagccaaccggagagcanaagaagtggttgatccaatcctcgaggttaggccaacaattagggctcttaagcgagctctgttaattgccctaaggtgtgttgatcctgattctgaaaagagacctaagatgggccaggttgctaggatgcttgagtctgaagaagttccattccgggaggaccggagaaaccggaggagtcgcacaggaagcatggacattgaatctattacagagggatcaacttcggctgaatttgcaatcaaggtagaaaggac

SEQ ID NO: 235 - DNA, 254 bp, Triticum aestivum
  unsure (1)...(254): unsure at all n locations
  Clone ID: LIB3280-003-P1-K1-F8
gtgggttttttttttttttttttttttttttnaaaaaaaacaaacttaaccccgatcccttttccgtgtccatagtactttatttggaaatcctgttttaaacaccagcccacaaaaagtttgctttttttcgcgacgagatacaaaaaactccccacccgtgcactttttacatacacaaactcgccacccaacgtttaaccacacaacaactggaaaagcctttgtttgtttttcctccctttacagcattt

SEQ ID NO: 236 - DNA, 416 bp, Triticum aestivum
  Clone ID: LIB3280-003-P1-K1-G1
cccactcgtccgggcggcggcgcgttgcacaggagaaggagcaggcggcttcgggggccgaatataataaggagggggacctatccctagctcgcaaccatggctaggggtttgaagaagcatctgaagaggctcaatgccccgtctcattggatgcttgacaagcttggaggatctttttcccccaatccatcattctgtcctcacatggccagaggagtgcctgcctcttatcctcatcctgaggaacagactgaaatatgctctcacctaccgtgaagagcaatctttccttattccagcggatattattgttgatggaaaggtccatactgacaagacctaccctgctggtttcatggacatcattttcattcccaaaaccggtgagaactacatgcttctttattacacca

SEQ ID NO: 237 - DNA, 418 bp, Triticum aestivum
  Clone ID: LIB3280-003-P1-K1-G10
ataaaaaatcaatctttcgtctcgatgagcggcggcggttcgggggcggcgccgggtgcggagagcgggggcgccggagattccatcaggcgtctccatgaccggctcgagtcgatgctgccgcgggtggaggcgctcgccgccgaccgcgcgcgcgtggaggaaaccaacagggcccagcacgagctgctgggagccctttatgcccacctcctccaggcggaggcgagcagggataggtggaaggcgctctactgtgatctataccggtgctctaatccaactctcccaactctaaaagagagacgcggtggattcccaagcctgtgaaactcttcctgattccaataactctcatctgcacgagactacgtgggatgcccgtgaaatggagcttgtacagaacacgatgcagatc

SEQ ID NO: 238 - DNA, 334 bp, Triticum aestivum
  Clone ID: LIB3280-003-P1-K1-G11
aaaataaaaggttttacatttgaacaatgctcgtctgaacaacaacaatacacatcaaacctgggcaagcatattcttttgctagaaaaaagcctgccaccggttttggttttaccactaacaagacaagttgttggccaatctttggcctgattacttggcctattcccaatccatatttacatgccacttacaaattttacaaaccaccccgtgccttaggcaaaaggggtgctgtctttagctttaacacccgcccggccggctgtagataaccggataagaagaaataccagaggcgccttgtcctctatcttggaaaatctctatttcg

SEQ ID NO: 239 - DNA, 334 bp, Triticum aestivum
  Clone ID: LIB3280-003-P1-K1-G12
ggctcattaacgtggattgccttcagtgccgtcgacaaattgaaggaggattgcgagatgctggaacatttgttttgttccctgcctagttgttgaattctgcagcttcgaaccccacacacaacccagagttgtcttccaggttgaaactgatttgccatcagagtcttgttgtatgtgtcttctcttcattcttaatgtttcgtgtctgctaacctgttcgggagaatcaacatctcatactggttgattgcggtctaccatggaggctatatcacttgaaagctgtattgaatgtgtcgttggcaaaatacgccgacataatcagtatctc

SEQ ID NO: 240 - DNA, 163 bp, Triticum aestivum
  Clone ID: LIB3280-003-P1-K1-G3
cctccgatatgatatatatgctctatccataactcatcataactgtgtgattgcgttatgcacgtgccatttaggttgatcttgcaacttcatgtaatccaatgatgggttgtgagtttcacctgtatctgcaatgaattttatatgtgtatatgtaattttt

SEQ ID NO: 241 - DNA, 383 bp, Triticum aestivum
  Clone ID: LIB3280-003-P1-K1-G4
atcaaggtgaagattatgcttgactgggaccccaagggcaagcttggccctaccaggccggtgcctgacctggtcaggatccaccccccgaaggaggaggacgagctgcgccccccggctttggttgaggtctaaagtcccagtagagcaagcagaccatgaaacgtcacatcattttggtcgtagctagttttctatccctgtgataagcgagggctatgcaacgcttggttacctattttactttttaatggacaaaaggttctggggaatggtgctatggtaatttcggttaaactaaggtttgcttaaaccagctatgtattggctgaaacctttgtttggattgattctggccagctagtgtgttgctgttccgtttg

SEQ ID NO: 242 - DNA, 181 bp, Triticum aestivum
  Clone ID: LIB3280-003-P1-K1-G5
gaaagaagaggggggcaattgttttatcactggtacagctgtcttttttgacatttggaaagaccgccacttgtggcgtcccccgcctccccttccctcccctcccttgttcttatccaaaacaacgtattgaaaaatttggccaccgacccaccgaccaccggtaccttgccgggcgccc

SEQ ID NO: 243 - DNA, 325 bp, Triticum aestivum
  Clone ID: LIB3280-003-P1-K1-G6
cgttgttagatagctggatcttgatcttgttgttgcagggccggcgatggacggggggaagaagggcggccgggaccgcagggcgtctcaggagcgcatcgaccgcaagtcgggcaccgggatgagcggcgacgccatgaagggcggccgcggcggcaagttcacctgggagggcgccgacggctacaccgacgaggaccttgacctcttccccagcaggggcgcgggggccggcgcctacttctgcttcggcaacaagaagtcctaggtggatgcctgctcgctcgtcgccttgccgtccgtccgatcgatacatagttttttc

SEQ ID NO: 244 - DNA, 442 bp, Triticum aestivum
  Clone ID: LIB3280-003-P1-K1-G7
cccacgcgtccgggcggcggcgcgttgcacaggagaaggagcaggcggcggcgggggccgaagaggagaagcacggcgacctatcccgagctcgcaaccatggctaggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacagactgaaatatgctctcacctaccgtgaagtgcaatctatccttatgcagcgtcatattatggttgatggaaaggtccgcactgacaagacctaccctgctggtttcatggacatcatttccattcccaagactggtgagaactacaggcttctgtatgacaccaagggtcgcttccgccttcactctgtca

SEQ ID NO: 245 - DNA, 194 bp, Triticum aestivum
  unsure (1)...(194): unsure at all n locations
  Clone ID: LIB3280-003-P1-K1-G9
tatcaaacattatactttcttcccaattttctacttatacatcaacaactntctgaagctttttactaaaaagacttgatcttctcataaccctattctttcacatctagcctctatactatacaagacatctatcacatccccttttcattttatccattacacctattataatatattaacactccttacat

SEQ ID NO: 246 - DNA, 445 bp, Triticum aestivum
  Clone ID: LIB3280-003-P1-K1-H1
gacccagataaggagaacctctgcctctacggccaccccgacgggacctgggaggtgtcgctgccggcggaggaggtgccccccgagctgcccgagccggccctcggcatcaatttcgcccgcaacggcatgaaccgccgcgactggctctccctcgtcgccgtccactccgactcgtggctcctctccgtcgccttcttcttcggggcgccgctcaccgcaaacgaacggaagcgcttgttcagcatgatcaacgatcttccaaatgtgtatgaaagtatggttgacaggaagcacagggacaggtctggtgttgatagcagtggcaaatccaggcactcatcaaagccaaagcaacgaactgatgatgtccgcccaaagaactccagggcagttgctcgagaggaagacgaggacgaggacgaagaaaacacaacgaaacctt

SEQ ID NO: 247 - DNA, 437 bp, Triticum aestivum
  Clone ID: LIB3280-003-P1-K1-H10
cccacgcgtccggaaaggtgtaatcatcgtgaataacgctcggggagcaatcatggatacccaagcagttgctgatgcttgctccagcggtcacattgctggatatggaggtgatgtctggttcccccaacccgcacccaaggatcacccatggcgctacatgcctaatcacgcaatgacccctcacatctctggaactacaattgatgcacagctgaggtacgcggctggagtgaaggacatgttggataggtacttcaagggcgaggacttccccgcggagaactacatcgtcaaggaaggcgagctcgccagccagtacaagtagtaacccaacccctccggagctgcttgtcaacatatctgaagcgaggtgcgagagaagaaaccattgtgttgttgtatgagtgttctctgagaactgaaataatggatgt

SEQ ID NO: 248 - DNA, 428 bp, Triticum aestivum
  Clone ID: LIB3280-003-P1-K1-H11
cgaggtgctactgctagccagctgcgccgacaggttacttccgagcaaatctgaagctaacaggctacagaagaagttacccaaatgcagagtcttcttctttgagaagcatggccatagcttgctgctggtgagtttttttaagcagactttatcaccccttctgaatctgcagttgctctggacatacgacgatatcaggagcgtgcccttcggcgggaagctgctgcgggcctacagcaaccatctgaagctaagggacactcaggaggtgatcttgcccggcgcagttccgaagattcccggccggttctactaccggttcgggaagccgatcccgacgagggggcggcaggacgtgctcaccgaccggcgggccgcgaccgagctctacttcgatgttaaatcggaggtggaggaaatcatcg

SEQ ID NO: 249 - DNA, 363 bp, Triticum aestivum
  Clone ID: LIB3280-003-P1-K1-H2
gacccagataaggagaacctctgcctctacggccaccccgacgggacctgtgaggtgtcgctgccggcggaggaggtgccccccgagctgcccgagccggccctcggcatcaatttcgcccgcaacggcatgaaccgccgcgactggctctccctcgtcgccgtccactccgactcgtggctcctctccgacgccttcttcttcggggcgccgctcaccgtaaacgaacggaagcgcttgttcagcatgatcaacgatcttccaaatgtgtatgaaagtatggttgacaagaagcacagggacaggtctggggttgatagcagtggcaaatccaggcactcatcaaagccaaagcaacgaact

SEQ ID NO: 250 - DNA, 445 bp, Triticum aestivum
  unsure (1)...(445): unsure at all n locations
  Clone ID: LIB3280-003-P1-K1-H3
agcaagctcactacacacgccatggggatgaagcgatgcatcgttcctaccatcctgctgatgcttgcactggagtctgcagccctcctcgtcgccggcgacgtgggcgccattctcctgccgagccaaggccaagttgcagacgaagcagccatggcggccaagaagaggccgtggaagtgctgcgaccaggcggtgtgcacccgctccatcccgccgatctgccgctgcatggaccaggttttcgagtgcccctccacctgcaaggcctgcgggccgtccgtgggcgacccgtcccgccgcgtctgccaagaccagtacgtcggcgaccccgggcccatctgccggccgtgggagtgctgcgactcgcctacctgcactaagtccaacccgccgacgtgccgctgcggngacgaggtcgacaagtgtgctccgacctgcaaga

SEQ ID NO: 251 - DNA, 448 bp, Triticum aestivum
  Clone ID: LIB3280-003-P1-K1-H4
agccagcgcagcactgtgctccgtgctttgaccacaatcaccgccgaacgcggccatgctcgcccgccgctgcggccactactgacgcaggtgagttttcccctcccccaccgctgccgttatggatccggcgtccgaggagctcgagcgccgcagccactacctcagctcactcatccgccgcaccaagctcaatgccgcgcccgccccgccacctcgtacttctcacccgaagccggagacgaagctggagctggagcgggagcgctcgcccatccgccgcaccaagctcaagctcaacgccgcgcccgccctccctccttctaccactcacccggagaccgggaaactggagcgggagccgggccctaagaaccagaacctcgttgaggccaaagcgttggtggagaaggaagtgaaagagggcgacggataggggaaggaggag

SEQ ID NO: 252 - DNA, 416 bp, Triticum aestivum
  Clone ID: LIB3280-003-P1-K1-H5
ggtgaaggctggtatcattgacccacttaaggtgatcagaacagcactggtggatgctgcaagtgtgtcgtctctgatgactaccacggaagccatcatcgttgagatccccaaggaagacaaggcggcacctgcaatgggaggcggcggcatgggagggatggatttctaacttgctcccaggctcatgtcaaaacaatgtgattagatggaacatctaggttagaactttttgtagcgcggatgtggattcatcggtatttaatgtgggtgaataaggctgtcacattttttgttctgctgcaagatgattttgcaacttgaatcatgtatgaacatggcgaacagagcctacagttgttaacaagcccgaaatgcccccaaattaagccaaagcgtaggaggataagtataat

SEQ ID NO: 253 - DNA, 347 bp, Triticum aestivum
  Clone ID: LIB3280-003-P1-K1-H7
atgaagagctatcaactcagcaccataaaaaggaccaacgcatcacagcagagacatccttccacacccagggaacaagaacaattctgtagattaacaaccaacagcgcaaaacagaacagcagaagctagccggaccatcaaaccacgaggcaacaagttgctcaagaatttatcatgagtcgtcgatggaacacctcagtggccatctccaccggcaaccttgctccgccgcactgtcattttcaaagtcttggtttctagtcatggaagcagcttcccggccatgaaacacgcgaacttattgctccgggagtactcataccgcaccccaacgaccgtgagca

SEQ ID NO: 254 - DNA, 441 bp, Triticum aestivum
  Clone ID: LIB3280-003-P1-K1-H8
cgccaggccaaggtgtccgtcgtcccctccgccgcagccctcgtcatcaaggcgctcaaggagcccgagagggaccgcaagaaggtcaagaacatcaagcacagcggcaacatcagcctcgacgacgtcatcgagatcgccaagatcatgaaggtccgctccatggccaaggagatggccggcaccgtcaaggagatcctcggcacctgcgtcagcgtcggctgcaccgtcgacggcaaggaccccaaggatctgcagacggagatcgacgacggcgaggtggagatccccgcttaagaaggcttggctttgggcaggttgttatgtgaggctgctgaagtagtttctcctatctagatgcttcctgatgcatttgagagaatggatgtgatatcttcacttgttctactcttgctgaagaagaaacttttgtcatgcttt

SEQ ID NO: 255 - DNA, 440 bp, Triticum aestivum
  Clone ID: LIB3280-003-P1-K1-H9
cccacgcgtccgaggaggtctctgtgcagtaccgtctcgtcgattcatctgctgggtgccgcgtgaccagcgggacctgttcctccatctcctggagatgaaggacttgaggcgggatgtcgctgcacgcctgctgcggatgattttcgacaagaagcctgcgaaggctggctccgttttagcgaagaagtgtcatatgctggagaaattttttgaaggaaaccctgagcggatactgcaatggtttagccactttgctgctactggggagtcagcacacaaaaagggtgctcgggcacttgctcagtttgcatttgttaatcgtgatgtttgctgggaggagcttgagtggaaaggcaggcatggtcagtctcctgctgtttgtgctactaagcctcactactttcgggaacttgatgttctccagacaggggaaaaat

SEQ ID NO: 256 - DNA, 240 bp, Triticum aestivum
  Clone ID: LIB3280-004-P1-K1-A1
accgcagaaactagaacatggcccagagcaggaccaccgtcgtcgcgctgctcctgatcgccgtcctggtggcggccgtgtgggagccgaaagcgaccgccttcggctgctacgacgactgctactagcgctgcgccaacggcgccaaggaggacccagcctgcaccaaaatgtgcggcgaggcatgcggggtcaccggcaaagccgtgggcgcggaaggcgggtatgccaacctattaa

SEQ ID NO: 257 - DNA, 228 bp, Triticum aestivum
  Clone ID: LIB3280-004-P1-K1-A10
gcaccaataggttaatatattgtagttttcaatattaggtttttacaataccatttgaaattatgataaatccagatcgacgaacatagatgacactgccataagtatgtgtatgacatgtggatatgaatatcaagctatgcaacgcaaagcctgaattcattcattttcatcaagccgcctcccttctattgaccttaaccatgaggccgtgcttggagtggagca

SEQ ID NO: 258 - DNA, 427 bp, Triticum aestivum
  Clone ID: LIB3280-004-P1-K1-A11
atcaaaccgaatcccaaacacacggtacgcaggccacgcccacgtggacgctctccggctccgcccgtcgccgccggcagcatgtcccgcggcggcgtcttcctcggcgtcgatgtcggcactgggagcgctcgcgcaggcatctttgatgagaagggtaaattgctcggttcggcgagcagcccgatacagatatggaaagagaaagattgcatcgagcaatcttcgacggatatctggctcgcggtgtgcactgctgtaaaatctgcatgctcgcttgcaaatgtcgcagctgaggatgttgttggcctcggattcgctgctacttgctcccttgttgctgttgatactgatggttcccctgtttcggtttcttggagtggtgatgcaagaaggaacatcatcgtgtggatggaccatagggctg

SEQ ID NO: 259 - DNA, 395 bp, Triticum aestivum
  Clone ID: LIB3280-004-P1-K1-A12
agaaccgtaaagcaagatatatattatcgcgtagttgcattacaactgtagtttctttccccccacaaaaccgatctttctccatttgcttcacacgaatagttggtcatactaaatgtatatgggaccaaatggaccaactggaaacacccggactataccaataccaattatgcttcggccatggcccaattaatggcttggttgcaaaatccaaacattgggggctttggtccataaaccttaattggaagaccaagctttgatcctagagcacgcattttggccagcccagattgggagtttggaccacctcttcgaacataaatgttcacccttgcagcctttaatttggattccttctctcttaaagcccgaatgatgccactgaatgt

SEQ ID NO: 260 - DNA, 408 bp, Triticum aestivum
  Clone ID: LIB3280-004-P1-K1-A2
cggacgcgtgggcggacgcgtggggccagaaatccatgggtggcggcagcggcgacctcagccccaccggcatccccgcctccccttcttcgtcctcatcggagccccttcctcgagagtttgccgattatgtgccggtctctgacggcgactccgaagggggttgcatctgcgacgaccccgaggtggaggcccttctctacggcagccaatttcagcaccggtcgctgcgggaggcgaaagacctcatcaggaggtataagcctgggtactggattgaaggagttggcgacacaaaagctggggattatttgttgcctgataccaccacattgttattggcgggtcccagaggtgctgggaaaagtacacttgtgaaccgaattacacgggtctttgacaaaaatg

SEQ ID NO: 261 - DNA, 394 bp, Triticum aestivum
  Clone ID: LIB3280-004-P1-K1-A4
gccacaccaccaagaagccgtactcacgggcgattgttggtgccactatgaaagctatccaaaagaagagggccgagacgcctgaagtacgtgatgctaacaagaaagccgctatgcctgagatcaaggatcgtatcaagaaaaccaatgttgagaagaacgccgagaaggtaaaggtgaccaaggacgagaagtcacacgggggcaagggcgccacccagaacgattccacggacccaaacattggcgccggccacaagaagcgcaaaaagttgattactccatagacatagagttgggctgcctagccttgtaccctatactactatcatagacctgtgtcaagttattacctatccctcttgaatagacaccttatatgtgatgctgaatg

SEQ ID NO: 262 - DNA, 315 bp, Triticum aestivum
  Clone ID: LIB3280-004-P1-K1-A5
ccctgttattgtgagaattcttaattcaagagttatagggagggacttatgtcaccacaaacagaaactaaagcaggtgttggatttcaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaagacgatgctatcacatcgagcct

SEQ ID NO: 263 - DNA, 295 bp, Triticum aestivum
  Clone ID: LIB3280-004-P1-K1-A7
ggggaaacaaaaaaggagaccagccaggactaggccttgggggtttatatatatgatcatagaaaaagcatgctcggttttttacagcgggtacaattgacaagagatggggacgaccctcacacatttacatggaaccagggataatgaaatcaattaaaaatataaactttcaacactggcgggaacgtgattccgtacctatgatgcatccacccactgggttgcaaatcaaggacaagagcaaatgagttcaacagtaactagctggtcaccaacgaatgaatgaacgaac

SEQ ID NO: 264 - DNA, 217 bp, Triticum aestivum
  Clone ID: LIB3280-004-P1-K1-A8
atatcatatcatattgagggggggggtcttctctgcgagaaggccaaaaacgagaaccgctctgtacttccgcgtcgagctcgacctttttgcaagcattacgtaaagccgaacgcaggtgctacacggtgcgcatcaactccatgatatgcctgacgtgacactgcgacatggaatgcgaaaaccagagcccggaccaggtacaaactctgaccat

SEQ ID NO: 265 - DNA, 446 bp, Triticum aestivum
  unsure (1)...(446): unsure at all n locations
  Clone ID: LIB3280-004-P1-K1-A9
gtcaggcccgcatgcactgcagctgctcactttctcatcgcccgctgtcggcgacaacactcccttcctccagcgcgtcaccggcgcggccaaccacctacaccggcttcggctgcaaccatggcgcctctttttgtcaacctctagcatgttttttgtttcttgataacagcctattgcttatgcttatgatttgtttgttctacggatatgaaggttatgccaccgatagctcaaatcctctctccatcaactcatgtaaattgtcgcatttgacacctgagaattactctccccaggatatgaagaacccagccggtgcttcttagttgaggcatgtcagaagctcccctcctatcgtgtagtggtacaaaactgtgtgtggacgctntgttgtgtcagctgaagaagttcaatgcagggaaacaggaactacgccatgtaca

SEQ ID NO: 266 - DNA, 134 bp, Triticum aestivum
  Clone ID: LIB3280-004-P1-K1-B1
accaatccgcgcggcgagttggcttgaacacagagggcaccgggaaataaggcaattttgactttcacaatccccgggcggtataaaaaaaaccggctacgggttctgcccacctccctttgggaagggagctt

SEQ ID NO: 267 - DNA, 441 bp, Triticum aestivum
  Clone ID: LIB3280-004-P1-K1-B10
tgcacgagtttcctttccctgctgtctttccaactctagcatggtatcatcctgttagatcctcaacttccgctgcctccactccttcctcgcaacatgagctcctcgtctgatctctcctccggcggctctgattccgacgaggagttcggccctcccgtcgccacccagagcctccccactctccaaatccagagccttcgcatccgcgatcatgtcatggtcaccctcgacttcgagaaggagaactatggcctgtggcgtcgtcagttcctcgacgccctcgccaagttcgggctcactcatcatgtcgatggctcgccggcgcaggccacctccgactgggtgctcgccgacttcgcgatcctatcgtggtacaacgccacggtgactccctcgaccctggagatcgtcgcggaccgcaaggacaaggcgtacacg

SEQ ID NO: 268 - DNA, 441 bp, Triticum aestivum
  Clone ID: LIB3280-004-P1-K1-B11
agagatcgagaccacgccgcagtccctctccacccttcttccccatccccgtcgtcggtcttcgatcccgccggcgattccgtagacgagcggcgagaggcgagtagcagagcgagcggggaagctagggtttcggcgtgtgtgtgcgggaggggagaagaggagcggggatggcgcaggcggtggaggagtggtaccggcagatgcccatcatcacgcgctcctacctcaccgccgccgtcctcaccaccgtcggctgcaccctcgagatcatctcgccctaccacctatacctcaaccccaagctggtggtgcagcactacgagatctggcgcctcgtcaccaacttcctctacttccgcaagatggatttggattttctgttccacatgttttttcttgcgcgctactgcaaacttctcgaggagaactcattcaggg

SEQ ID NO: 269 - DNA, 437 bp, Triticum aestivum
  Clone ID: LIB3280-004-P1-K1-B12
cgtcgatcctctcatcggacctgacaccgtctctacgatgcccgaccaagctctggacgcgttcatcgaccacggcacagttgctaggacaatcgacgctaacgtgtcagaagctgagggcatatacagtgccctggagaagctgggcatcgactgggaagaggttggcaagcagctggagcacgagggggtgagctccttcaaggggagcttcgacagcctgctcacgagcttggaggagaagggcaacgccctcaagactgccgccaacctgtaggcgctaaaattatcggatagaatggtttggtaccggcgctggccatcaaacgattaccgaataaaaatgccagcttgctggctctctccttccatttggaaatgaaatgctcccagttatctgggtgagcttgcttcttgtattctaggcgtgcctggct

SEQ ID NO: 270 - DNA, 388 bp, Triticum aestivum
  Clone ID: LIB3280-004-P1-K1-B2
cccacgcgtccgcgactagagctaaactcagtattgcatgacatcgctcagtcactgaagggggaagattctgaaaatgcaaaatcaggttccaaaaggaaacgttcccagaaacatattttaaatgccatcagatatgtacgtcgactttactatacatgtccctctgaggctgtctctgttcttttggagttttgtcagctcgatgccccagaaatctctgaaaacagcgatgtacatcaatctgatagcttggatgtgaatcactcatctgatgttcaaattcggaatcaaatatcaaatggagatatgaaaaccatcataacaaaactatcagaaaaagaaccaagagtgcttcttggcttactaaagtccgtaattgaaatga

SEQ ID NO: 271 - DNA, 332 bp, Triticum aestivum
  Clone ID: LIB3280-004-P1-K1-B3
gattttagtgatgacgaggagctgcagaccccgatagatgaggttgatccatttatggtgtgtggggtggaaccatccaagctgtacaagcatccgacccagccaggttccagagccttatgcagacactggattttcactaccaggcactggctaatggcgttgctcagcatgccgaggaaagaaaagttgaaattgagaaagagaagttggagaaagcaaatgcacagtgatgaatgaattatagcaatggttgtttgtctcgagttttgttgcaggccaccgcctgtgattagcagatcgtaggcgatgggcttttgcagactcggtct

SEQ ID NO: 272 - DNA, 396 bp, Triticum aestivum
  Clone ID: LIB3280-004-P1-K1-B4
aggcacggattttaccaattacatggagggcctgtaacaagtcgatgaactatacccagatcagaacctatgctcaagagtctctattctcaacacagcggtctcccccaagttcagcagtgacccaacgatccatgagtccgccgaggacatatggctatatcgagaacgatcaacatcccctgaatagttcacgcggcttccagaaaccttgagagtctatgaggcgcgacaggtcgtatatttccctagactcagagagaatgcattgctcccccgcagttttgtataggcatatgcacgttctgacatggacctgagtgctcagagcatgcaggatagttaatccttagcaatcctgcttgacagttgaccagtattacccacgcttatggt

SEQ ID NO: 273 - DNA, 332 bp, Triticum aestivum
  Clone ID: LIB3280-004-P1-K1-B5
gacacggatttgaccaattacatgtgggggctgtaactagccgaggatatctaccatgatccgaacctatgctcaagaatctctatcccaaacacaccggtctctccaaagttcacgcatagacccacacgatccatgtgtccaccaacgacaatattctaatcgaaaccctcaacatgccctaaatagttcacgcagcttacagaaaccttgctagtctatgaggcgtcgacggtcgtatatttccctcgtcacagatataatgcatacgtcccctgcagttttacatattcatatacactgtcctcttcatacacctgtctcgctcattt

SEQ ID NO: 274 - DNA, 446 bp, Triticum aestivum
  Clone ID: LIB3280-004-P1-K1-B6
ggaactctgttcgacaacatcctgatcactgatgaccccgagtacgccaagaagttcgcggaggagacctggggcaagcacaaggatgctgagaaggctgcctttgatgaggccgagaagaagaggcttgaggaggaatctgcaaacgctaagaccgaagacaatgacgatgcagctgatgaggatgagggcaaagctgccggtgccagtgatgaggagaacaaggatgcctccggcgatgagaaggtggaggaaattagcaaggatgcttcttcttcttctgacaagaaggacgagctttagagtgtggcaggcaggctctatatctaaactttttcctcttgaggcagtagaacttcccatccagcaattagaagaacattttctctgaaagttgagagaagaagtaatgcaatctcggctcttggaatttggtatgtgttttt

SEQ ID NO: 275 - DNA, 434 bp, Triticum aestivum
  Clone ID: LIB3280-004-P1-K1-B8
agctctactcgcctcgcaaacgaaagagcagatcacatcagatcagagtgagtttgcatctgcgcgctgcgccaatggaggggaggagaaccgctctctgtttcctcgtcgtgctcgcgcttctcgcaagccctactctcgcagaacgcaagtgctacaaggagcgcttctactccatgatatgcatgaagtggcactgcgccatggagtgcgtcaaccagagcccggacctggtgctcaagtcggcccactgcaccaccaagcacgtcatcatgcgctactgcaactgcgagatgtgtaccaaggagtagactggtcttgttattagctagggaggcgtaccaccaataaatccacatgtagctagacaataatagttattctaggagtatatatgcatgtcgtcgtcgatgacatgcattatgttactagct

SEQ ID NO: 276 - DNA, 361 bp, Triticum aestivum
  Clone ID: LIB3280-004-P1-K1-B9
gcctaaactggtggatgcctttttccctctgaatgggcaaccatagcctccttctggggtgtccttctgtgctaccctgaggttttcctagccattgcttgcttcttctgcctctccctcttgcgccttgtccgacactgccacaagagtgacctcccggtgaactggcctgttcttgggatgcttcccttcctcgtgaagaatctgtaccacattcatgacagggtcaccggtatgctccgggaggcgggatgcaccttcaggatcattgccccgtggttcctcaacatgagcttgctggcgacctgcgacccattcactgtcaaccactgctggaacaccaacttcgacaactacccaa

SEQ ID NO: 277 - DNA, 405 bp, Triticum aestivum
  Clone ID: LIB3280-004-P1-K1-C1
cttatttccatacaaggcagagtgcatttctctatcatctcggggtccagactatgccaaaggctcaccattgtttgagcatgagattgacagtacagtattttaaatctgtatctcctcaaagggagctattaaataagcagaaatttgaagaccctgccttctatcactatgtaatgttctccaggaatgtacttgcagcttcgactactatcaattcaacagccatgaactccaaggattctggcagcgttgttttccatgtattcaccgacacccagaatttttatgcaatgaagcattggtttgacaggaactcatatttggacgctaatgtccacgtgactaacattgaggatcacaacacgctctctaaggatgttgaatctcttgagaggcaacaat

SEQ ID NO: 278 - DNA, 353 bp, Triticum aestivum
  Clone ID: LIB3280-004-P1-K1-C10
ccgaatcgcaattccgggggggacgcacgcgtacgcgcacacccacgcgcacgcgcaagtctgctcccaccagaagaggaaaaaacaggggggggcgataaggaacgggagctttacattatcacaagaatcctaactgccaaaagaaaaacgagctcctcatcagtaactgaataatcaagaggattatttgatatacaccacatgactttaaccctgaactttaataagacatccataaaggagccgctttagattatactaaaaaggccaatctaagtattacatcatatgcccccaatataacaaaacggtattatttcaaatgaaacaaattgcctatgaacatttat

SEQ ID NO: 279 - DNA, 425 bp, Triticum aestivum
  Clone ID: LIB3280-004-P1-K1-C11
cccacgcgtccgcccacgcgtccgcctccggcgtcgggaagaccttcacccaagaagtgatcgaggccatggcctccttcaacgagaaacccgtcatcttctcgctgtcgaacccaacgtcgcactcggagtgcacggccgaggaggcctacacctggagcaagggcacggcggtgttcgcgagcggcagcccgttcgaccccgtggagtacgaggggaagacgtacgtgcccgggcagtccaacaacgcctacgtgttccccggcttcggcctcggcgtcgtcatctccggcgccatccgcgtccacgacgacatgctcctcgccgcctcggaggcgctggcggaggaggcgacccaggagaacttcgacaaggggctcatcttcccgcccttcaccaacatccgcaagatctcggccagcatc

SEQ ID NO: 280 - DNA, 414 bp, Triticum aestivum
  unsure (1)...(414): unsure at all n locations
  Clone ID: LIB3280-004-P1-K1-C12
cccacgcgtccgcccacgcgtccgcctccggcgtcgggaagaccttcacccaagaagggatcgaggccatggcctccttcaacgagaaacccgtcatcttctcgctgtcgaacccaacgtcgcactcggagtgcacggccgaggaggcctacacctggagcaagggcacggcggtgttcgcgagcggcagcccgttcgaccccgtggagtacgaggggaagacgtacgtgcccgggcagtccaacaacgcctacgtgttccccggcttcggcctcggcgtcgtcatctccggcgccatccgcgtccacgacgacatgctcctcgccgcctcggaggcgctggcggaggaggcgacccaagagaacttcgacaaggggcttatctttccgccctttaccaacatncgcaagatct

SEQ ID NO: 281 - DNA, 62 bp, Triticum aestivum
  Clone ID: LIB3280-004-P1-K1-C2
cttactcgtatacaactagcgctgaatttattttttatttgcgtcgccaaactactgcgggg

SEQ ID NO: 282 - DNA, 439 bp, Triticum aestivum
  Clone ID: LIB3280-004-P1-K1-C4
cccacgcgtccgcccacgcgtccgcgtaagtctgctcccaccactggaggagtgaagaagcctcaccgttaccgccctggaactgttgctcttcgtgagatccgcaagtaccaaaagagcacggagctgctcatcaggaagcttccattccagaggcttgttagggagattgcccaggacttcaagactgacctccgcttccagagccatgcggtgctggcccttcaggaggctgcagaggcctacctggtcggtctcttcgaggacaccaacctgtgcgccatccatgccaagcgggtgaccatcatgcccaaggacattcagctggctaggaggatccgtggcgagagggcttaaggtgctgtgcttgccttgcctgtgggaatcgctctggtgggcatctgtgtctgcttttgctgctgaacacttatcatgtgtc

SEQ ID NO: 283 - DNA, 445 bp, Triticum aestivum
  Clone ID: LIB3280-004-P1-K1-C5
gtgactcgcaaccccatgttcatatgtgactggcaatgcattttacatgaaaatagcacaggagcttggtgatcaactcgctgataacaggaacacagaaaaccaactagcagagtggaaaagtgggccgtggccgtgagctgaatcatcattggatttagttcatctacaccacgtgccttggcccctgcacctcaacaagcctgcctcaaaggagccccttttgctttcatcaaatcgtctaatctaagttttacatcatatacaccaaggaaaacaaaacggtgtcatggcaaatgaaagaatcggtatatgaaggtttgtcagtgcaaatctcccagtctctgaacgagctgctcacgcgctggtgacacccgacatccagggcacaacaacaggggctctcggatgagaatctctgtaggactcggaatacttgtctttg

SEQ ID NO: 284 - DNA, 447 bp, Triticum aestivum
  Clone ID: LIB3280-004-P1-K1-C6
cgtcgcgcaagatgacggtgatcggcacggtggacccggtggacgtggtgagcaagctgcgcaagggctgggcggcctacatcgagtccgtcggcccggccaaggagcccgagaagaaagaggagaagaaggaggaggccaagaaggaaggcggcgacggggccaagaaggaaggcggcgacggcggcgacgccaagaaggaaggcgacggcaagaaggacggcgacgggaagaaggacggcgatggcaagaaggaggagggcgacggcaagaaggacggcgacgggaagaaggacggcgacaagaaggaggagggcgacggcaagaaggacgaccagaagaagccctgcgccggggccccgctgccgtacccgcaccacatgccgatgccgcaccacatgccgccgtcctacatgttcaacgccgactacatgatgaaccagtacc

SEQ ID NO: 285 - DNA, 432 bp, Triticum aestivum
  Clone ID: LIB3280-004-P1-K1-C7
cccacgcgtccgggcgggggcgctcctcttgccgtgtgcaggcgaggacgaccgcgacgacaccggggaagtggacggaggcggtccggcaggctgggtgaagtagacgacggcaacggcgggagctgctagggttctgggagcagagaggtgggagagggaggtggaggcgaggcgtgccagccgggatcccgatccaactccagccggccagccctatcgtcgccggcgagaccaccccaccccagggcgcctacctacttctatcctccctacgaattttatcttctgcagggacgcatcaatggggatcgagagatcggcgaaacgagcagccggccgccgaagcgaggcccacccccaccatcgaaaccctagcaggggaaatcgatgggggtgaccgcatgaggcgaggaaaagtagatcgacgcg

SEQ ID NO: 286 - DNA, 225 bp, Triticum aestivum
  Clone ID: LIB3280-004-P1-K1-C8
ccacacacctacaggatgtgcccattcattgtgttggtgcaggactgaacaagcgcggggacatctggtttgcgtgacagaaatttatccgcacgtttcttaacaggataactatgacaaaggtgagctactggggttcgtaattcagcatagtgaaatagggaaggtatggtaggaccaatactattttaagcccatatatacacaggactccaatggaacagc

SEQ ID NO: 287 - DNA, 166 bp, Triticum aestivum
  Clone ID: LIB3280-004-P1-K1-D1
ggggtgtggggtgtgtttttttgtggggggggtttttttttttttttttttttttttatgtttattataatttggggtttaaaatgttgttggggtgggggggggaaaaaaaaaaacgggggcggggggaaaaaaaattgtctttgggaggggggggggaaccggg

SEQ ID NO: 288 - DNA, 156 bp, Triticum aestivum
  Clone ID: LIB3280-004-P1-K1-D10
agcacacctgcgatgacgcgtggtctttattatgtaatctattctccatgggtggcgggagatctatgtgggagtacaacatctacaacctcccgatcatgctcatgctcccaccaaagcccttatcgccggtgcaggacataactgcaaggaccg

SEQ ID NO: 289 - DNA, 439 bp, Triticum aestivum
  Clone ID: LIB3280-004-P1-K1-D11
cccacaaccaacccttcctccttcctcaatttcgtcagctcctccgccccggcgaccggagcgagatggtgtccgacgacccatctcgcaacgtcgtctgtatcatcgggaatgtcatctccttcgggctgttcctctcccctacgccggttttctggcggatcatcaaggccaaggacgtggaggagtttaagccggacccctacctggcgacgctgctcaactgcatgctctgggtcttctacggcctccccatcgtccaccccaacagcatcctcgtcgtcaccatcaatgggatcgggctcgtcatcgacggatcctacctcatcatcttcttcctctactccaccaacaacaagcggctgaagatgataggcgtgctcgccgccgaggcggcgttcatggcggccgtcgtgcttggcgtgctcctcggtgccca

SEQ ID NO: 290 - DNA, 365 bp, Triticum aestivum
  Clone ID: LIB3280-004-P1-K1-D12
agcagatttcctctctagctcgatcgatcgatcgaatccttccgtcgcgttcgcgtttgcgtttcgtgtgtttagaccaagttttcaatggctcctcttggtgacgctgttggccacgtgttcgccgccgtcccaggcctcgacgtctctttcggcgagatgtagatcgacttcgtgcctgacgttgccggagtcttcctcgtagcgtgcggcggttttcaaaaggctcctggaggcgcgctcgacaacgttgattgtgccatctacaagctcggtggcttctctgacttcatcggaaagtgtggcgatgacgagatccgacacaagctggtggagactctgaagcacaacggcatgaacgtcga

SEQ ID NO: 291 - DNA, 268 bp, Triticum aestivum
  Clone ID: LIB3280-004-P1-K1-D2
gaagttaacaacaaactagggtataaaacatacagatcttcattcccatccatggtcagtgatccattagtggttggtagtctgcgtgatcctagctagtaggaaactgcagcaggcaggggtagggtaataagttctgttctactggtagataactagagtttacgctccagcatctgttcccatcttatattctgtaggatgtctgcatattatattcttgtgatacatacattctgcctggccgtcttgacactcatttaagacc

SEQ ID NO: 292 - DNA, 417 bp, Triticum aestivum
  Clone ID: LIB3280-004-P1-K1-D3
ccgcccgttcccggctcgaccgcgctgccgtcaccgtccgtccccggctccaccgcggcggcggcgtccgtctccacctgcaccgcgccgtcgcagctggtccctgcctccactgcgccgccgtcgggacccttgtccattgcgccccccacccgtcctcctccaatggcacgaccgtcaccgggccgtcctcccctgccctagcggcacggctgtcgtgggcagcaccactgccggctcccttctacgcatccgccgccactggttaccaccgaagtggggcaccaccttcccttttgccccaccccacgcggttggaagaaagctggagctagcaggggaaagtaccgacacgtgaacggcgtccttgtgagccttattaaggagcattaccctggcatggtttctttgcctggg

SEQ ID NO: 293 - DNA, 313 bp, Triticum aestivum
  Clone ID: LIB3280-004-P1-K1-D5
tgtgtttggtttttttttttttttttttttttttttttttttttttttttttttgggacaaaaatcagggcttttctcagtttcattcctaaagggccattcagagaaaattaaagaggggtttgtcctagcgggcaagctagccagttgggccatttttggaatgacttccggcaggaggggcttggtttcagcgtaccaggccccgatgtcggcgtcttccttgggggggacgggggcctgcacccttttaaatctttaaaaaaggcggttggcaagcccaaggaccggcggtttggcctcggggtcgggg

SEQ ID NO: 294 - DNA, 419 bp, Triticum aestivum
  unsure (1)...(419): unsure at all n locations
  Clone ID: LIB3280-004-P1-K1-D6
cacgaccattccttcctaccagccgactctggatttattcatttcaaaaccaaaaccggcaatcagcatcaccccggatcaaatccaccaccgagaaattccggaataaacccgagagaacccggcgagaagggtcagcgcaaaaaccctagccagctagctccccatggcggccaactcctcctccccgtcggccggcggcgacgcgccggccccggcgctgccgccggtgcggctcgcggcggggcatgcggccacgatccagccctcctncccgcgctacttattatactcgctggccggcaaggacgcctcctcccaccgtcgcatcgccatcgccgtcgacctctccgacgagtccgccttcgccgtgcggtgggccgtgcagaactacctgcgctccggcgacgccgtcgtgc

SEQ ID NO: 295 - DNA, 441 bp, Triticum aestivum
  Clone ID: LIB3280-004-P1-K1-D7
tgatactatctatctgcgcccagatagacttgctgctctccttgcaaaggaccgactggatcaccggacttatattggttgcatgaagaagggaccggttgtcagtgatccgaatatgaaatggtatgaaagttcatatggattattaggtaatgagtacttcatgcatgcatctggttcactgtatgctctttcttcagaagtggtgggagctatagctactacaaacaatgatagtttaaggatgtttgattatgaggatgttactattggctcatggatgcttgccatgaatgtaaatcatgaagacaaccgcgcaatgtgtgattccacatgcactcccagttccattgctgtatgggacagcaagacatgttcaggctcttgtaaccccattgagaaaataagggagctgcacaacacaactttgtgctcaaaaag

SEQ ID NO: 296 - DNA, 441 bp, Triticum aestivum
  Clone ID: LIB3280-004-P1-K1-D8
gcaataaccaaaagatatgcgcatttatcgtatcgttgttgtactcataaggcccccagacatctcctttccctaaattcaatttatttgtcttttcttaacggggtaactatgacaaaggtgaactactgaggttggtaattttgcataatgaaatagtaaatgtatggtaggaccaatactattttcagcccatatatacagaagactccaatggagcagccaatgtgggtaacttacttgttccatgcagttaccaatgtcctgcgtgtctgcacggtgaatcagttagcaccaaggtcacgtcatttgcagttgtcgggcatgggaggcattgggatcagttcaagaagaataagcacaaattgaaggattcagattccagcgagatcaagctttgtagggtgatggttcagcttatactcaccatcctttgcacat

SEQ ID NO: 297 - DNA, 191 bp, Triticum aestivum
  Clone ID: LIB3280-004-P1-K1-D9
gcaataaccaaaacagatgcgcatttatcgtattgttgtgggactaaaacggggccggcgcaagtctgtggcgtaaatgcaatttcaaagccgcttcttaacagggccgactgtgactatggcaggctacacatgtcgagcatgttgcatgatactgtattcaactgcaaggccctgaaccgcaccgttca

SEQ ID NO: 298 - DNA, 403 bp, Triticum aestivum
  Clone ID: LIB3280-004-P1-K1-E1
atgtgaagaaaactggttagttctcagcctggataacatttcaacgacaaaacagcctgctaacaaggccgcatggaagtatccatgtatttacatctcaagcaagttgcaagttactgcctccaactgcaaggccctgaaccgaaccgctgcagaaccacctcagtcccatatcgtcgccgccttcttcggcgtctgcatctcgctgtacggcgccccgccgttcctggtgaccggccgaccagaccggagcgctggcgccagcggcgccgacatgtagctgccgtctcgcgcgtaaccgccacgcgtgttgtacctcccggccacgccggtgtggtgcggcacgggcacgggcgctggagagtactgcggctgtgggctgcggtaggggttgtagctagcc

SEQ ID NO: 299 - DNA, 104 bp, Triticum aestivum
  Clone ID: LIB3280-004-P1-K1-E10
agctcaccagtgatcatgcgtgttgctgaatatctcatctatgtgcgtgttgggtaatgagattaatgtgggaatacatcatgggcggagtcaggatttgaaaa

SEQ ID NO: 300 - DNA, 384 bp, Triticum aestivum
  unsure (1)...(384): unsure at all n locations
  Clone ID: LIB3280-004-P1-K1-E11
ggcacaacaaacctttcttctttcttaaagcgcgtaagctattcccccccggggaccggagcaagatgtgttccgccaaacaactcggaacgacgtttggatcatcggggaatgtcatcttncttcgggctgttcctctcccctacgccggttttctggcggatcatcaaggccaaagacgtggaggagtttaagccggacccctacctggcgacgctgctcaactgcatgctctgggtcttttacggccttcccatcgtccaccccaacagcatcctggtcgtcaacatcaatgggatcgggctcgtcatcgaggggatcctacctcatcatctttttcctctactccaccaacaacaagcggctgaagatgataggcgtgct

SEQ ID NO: 301 - DNA, 415 bp, Triticum aestivum
  Clone ID: LIB3280-004-P1-K1-E12
agcagctttcctctctagctcgatcgatcgatcgaatccttccgtcgcgttcgcgtttgcgtttcgtgtgtttagaccaagtttccaatggctcctcttggtgacgctgttgcccccgcgttcgccgccgtcccaggcctcgtcgtctgtttcggcgagatgttgatcgacttcgtgcctgacgttgccggggtctccctcgtcgagtccggcggttttgacaaggcgcctggaggcgcgcccgccaacgttgcttgcgccatctacaagctcggcggctcctctgccttcatcggaaagtttggcgatgacgagttcggccacatgctggtggagatcctgaagcagaacggcgtgaacgccgagggctgtctgttcgaccagcacgcgcgcacggtcctggccttcgtcacgc

SEQ ID NO: 302 - DNA, 160 bp, Triticum aestivum
  Clone ID: LIB3280-004-P1-K1-E2
gcgcacgcgtacgcttacacgtttattttaagcaccatacaatttattatcttattatgcgaaacaaagggtcgggcacagtctatcgtagaccaaacatataactggaacagctatcgcttggccagggcaccatactttggaaaacaactcaaggatg

SEQ ID NO: 303 - DNA, 428 bp, Triticum aestivum
  Clone ID: LIB3280-004-P1-K1-E3
aatcaccatacaatttatcatcttattattcgagacaaaaagataccaatagagtttatcttatacaaaacatatagctggaacagaagtagctaggcgagggcgccgtacgtcggagagtcatgagatgatgatgatgatgatgatgggaagcaacagagcgagactacatggatgggatgggtgttcatgggttctcgggcgcgtccttgaggtcgtaggcctggaggatgccgccgcactccttgcgcggctccttggggaagaaggcgatggggttcgcaaagcgggtgccctgctgcttcatgccgttgttgctggtgagcgggacgcgcgcgcggtcgcggaactcctcgatctcggcgcacgacgcgtcggggctctttgtcagcaccacctcgcagatctcgtcctggtggtcctggtcg

SEQ ID NO: 304 - DNA, 391 bp, Triticum aestivum
  Clone ID: LIB3280-004-P1-K1-E4
aagatgggtcacacatctatataaataagagaacggattacattattttggagcgcatattactcttattcatatacatctggtgcactccattcggaagtgcatatgcacacctatttatgcttgctacataaaaagtagccacaaacacaaatctgctccaaagaacggaaaaagccaacacacacaattgcagagcattaagtcaactcaagagctccttcccgaaaagcccagcaatggctcgcccaggatcttcttccttgatcagagactctcctaccaaaacagcagaaacgccagcgctatgcacatatgcaacatcatcgggagtgaacaggccagattcaccaacaacaaatattcccttctcctttatgatatcaccacg

SEQ ID NO: 305 - DNA, 234 bp, Triticum aestivum
  Clone ID: LIB3280-004-P1-K1-E5
aatattgtttataggttttgtttaatatgtttttgggttacatttttttttattttttattatttttatttatatacattttttgtatttatttttttttttatatggggaaagagaaaaccaattacataaaaagggggggggaatgaatttaaaaaaaaagagggggaaaagtttttacagaatggttttagtattataaaaactaacgatcttataaaaaaaaagaagagt

SEQ ID NO: 306 - DNA, 173 bp, Triticum aestivum
  Clone ID: LIB3280-004-P1-K1-E6
gtgtatagctcgatgttccaaaaatgctttggtgaaaatttgtctagcattgtatggagcttgcgcagagtgcttgttaatctgatagcagctggtgattcttttgtcgactacaaataaaatgtgtcagtgtaatcctatatcctgggagagaaaaagctagttagctgttt

SEQ ID NO: 307 - DNA, 243 bp, Triticum aestivum
  Clone ID: LIB3280-004-P1-K1-E9
tttcttttattcttactaaatataaaaatttttatcattaacattagtctcaaaaggggacgggatcactagatgtaagtcgaaacattttgctactacagacattattttgcatccacgacttaattggtcaactcttatgatcataaccattttgatgatctgacgtaactagacccacactacatagacgttatgtgtctccaaggagttcttgtcgacaaattatggtcctattgccta

SEQ ID NO: 308 - DNA, 55 bp, Triticum aestivum
  Clone ID: LIB3280-004-P1-K1-F1
cccacgcgttcgtcataagcggtcaatcatatatttaccgacaacggcaaacaac

SEQ ID NO: 309 - DNA, 419 bp, Triticum aestivum
  Clone ID: LIB3280-004-P1-K1-F10
cgccaatgggggacgcgtccacctccgccgctcccgccacgcccacctccacgctcatctgcctcgaggacggcaacgacctcttcctcgacgacgatagccccgacggcggcttggcggactcgcgcctcgccgccgacgacggtctcctgctcctcgaccgcgacgacgagtacgtcgcgctcatgctctccaaggagggcgccggcggcggcggcacgtggggtgaggagctggacgagtggaccaaggccgcgcgcgccgtgtgcgtcgactggattgtcaagacgaacgcgaggttcctcttcagcgggaagacggcgtacgtggcggtgacgtacctcgatcggttcttggcgcagcggcgagtcgatagggggaaggagtgggctctgcagctcctctcggtggcgtgcctg

SEQ ID NO: 310 - DNA, 271 bp, Triticum aestivum
  Clone ID: LIB3280-004-P1-K1-F11
acccttcccggacccctgggttggcgaagaaaaattttgttatttggagggggcacttgggctattgggagaatatttcattaactgaatcataacttttggaacctaagaccaaaatcgtgatatgcagctgggtgatttttcaacataaagactagagaattgcttcaatttgagatggcagggaatgcttatgagacttgctttgcttcaaaggggaaaataaaatataccttgcgtggaaggaggccgccgatggtgcctggggagc

SEQ ID NO: 311 - DNA, 216 bp, Triticum aestivum
  Clone ID: LIB3280-004-P1-K1-F12
cgcacgcgtgggtggtggaggaagaattcgattatttggagtgtgcactggagctatggggagataattccattactggagtcataacttgtggaacatcagtacagaatcggtgatatgcacctggttgatttttcaacataaagacttttggattgctacaatattagatggctgccagtgcttattagactcactctgtttcctacgagggat

SEQ ID NO: 312 - DNA, 297 bp, Triticum aestivum
  Clone ID: LIB3280-004-P1-K1-F2
gcgcgacgcgtccgaaaaaacttattaaatctcccgccgatcatatatttttttgcaacgacggccacctgggagggggtgttggcagtcaggcttatttcttatttaggcttagcttctctaacactaggatttgcctgccgtgcgatgtgcaggccgagtagggaaggtcgcttggctcttcttctcacttatgcaaaagccactacaatcctatccaggcggagccttatggtttgactacacccgatgatactcttatcgtttacgctgctagatcagggatataatgttaat

SEQ ID NO: 313 - DNA, 446 bp, Triticum aestivum
  Clone ID: LIB3280-004-P1-K1-F4
ggaggaggaggaggtcaaggctctgaagcaagagaagaaggtgaagaaagacaagaacaagaaggagaaaaaagaaaagaagaagaaaaataaggttgaggatagtgatggaggggatagcagtgagcagagtatagatgccacatcagaggaccagcagatgggcgatgacactgatgccattacatttgatgaggctttgatgtccaatcttcaaaagcagtttgagaaggctgctgcagaagccgggatgccggtgacaccagttactgctaaagtggcaaagaagaggaaccgctcaaaatcttccgataggtcatcagaagtttctggtggaggtgttggcagccaaggtaatgttcctgctcaggatggagataagagtggtaagaagtgaggttctcaatgaaagagtatctagtttggaaccctcctactctttacca

SEQ ID NO: 314 - DNA, 257 bp, Triticum aestivum
  Clone ID: LIB3280-004-P1-K1-F5
ccccaattcattcagcacccacccatctgcaggtcgcacgcatccatcccgtacctgggcgacgagggagaaaaaaaatgctgcgccacgccgtccggcgacttgcctaccgcgccggcgatgtcggcagcggctccatgagccgcaaggccctagcgacggcgcacgcgcccgcggaggcggtcgaggaccctgactctctggaggctacgaaggaggggaccacatttatctggcccggacagacgcccatgttg

SEQ ID NO: 315 - DNA, 351 bp, Triticum aestivum
  Clone ID: LIB3280-004-P1-K1-F6
gtgggcggagcgaagtgggagccaacgccaggccagccgagccgactcctatcctccggtccgccttccccgcagcagtttccccaaatccagcgccctccccgccggaatccggcgccgaatcgagcagagagcttgaactgagctatggacaacttgtggcatctcggagatgagttccgtgggcaatcaaaggtggtggaggaccgccaatggtctctcatgacatcaaagcttgctgagatcacaaagtcaaaggctgagaggatgaatgactttgagtatgcacggatgaacactggtccctgatgtcaagcaatgggataagctatcctaccaccaggagacaac

SEQ ID NO: 316 - DNA, 340 bp, Triticum aestivum
  Clone ID: LIB3280-004-P1-K1-F8
caagatggtacagggcaccagagcttctgttgaactcctctgaatatactgcagcaattgatgtgtggtctgtgggctgtatatttatggaactgatggatcggaaacctttgtttccgggaagggaccatgtccatcagctacgcctactaatggagctcattggaacaccaaatgaggccgatttggattttgtaaatgaaaacgcaagaagatatatccgccaacttccccgtcatgcaaggcaatcattatctgagaagtttccacatgttcacccttcagcaattgacttggttgaaaagatgctgactttcgatcctagacagagaataaacag

SEQ ID NO: 317 - DNA, 449 bp, Triticum aestivum
  Clone ID: LIB3280-004-P1-K1-F9
attccgcgggtgcgacgccacgccgtaccgcgtgctcttagcaagggaagagcgacacacatatactagcaatggaggtcatatgggggggggggttcgccgccagagcggcgccaactctagggctgactcggctgagacttgccagggccgaggggctgaggtgcagggtcagcaagaaggcgtcttcggctctggctccgatggtggccaagggcgcgccgctgctctccaaggcgagcggcatggcgttagcagccccgatgctggcctcggctctggcgctggtagacgaggggatgtcaggcgagcgcgccgggcagagcaacgacctgctggggtgggccctgctgcttgtcttgggcctacgttttgtgcttactacgccgtctactccaccatcttcgacgacgacgacgaccggtcaggtggcggcggcatcatgcttt

SEQ ID NO: 318 - DNA, 443 bp, Triticum aestivum
  Clone ID: LIB3280-004-P1-K1-G1
cccacgcgtccggcatctcccgcggagcacacatctaccggcaatggcggccacctccatcgtcgtcttcgccgccagaccgtcgccggctctagggctgcctcggctgagacttgccagggccgaggggctgaggtgcagggtcagcaagaaggcgtcttcggctctggctccgatggtggccaagggcgcgccgctgctctccaaggcgagcggcatggcgtcagcagccccgatgctggcctcggctctggcgctggtagacgaggggatgtcgggcgagcgcgccgggcagagcaacgacctgctggggtgggccctgctgcttgtcttgggcctcgtcttgcgcttctacgccgtctactccaccaccttcgacgacgacgacgaccggtcaggtggcggcggcatcatgctctgcagtctcgacaccaccaccatct

SEQ ID NO: 319 - DNA, 379 bp, Triticum aestivum
  Clone ID: LIB3280-004-P1-K1-G10
cggcacgacaaaacagatagataggagatatcccggcattgcatggatctgctacaaaattcacaaggcattatctatcatgaacaacgctacacaacagggtaaggaaagcaatcacattattattcgagcccaacactaattgaatgccctatgctcagattagaaatattgggtttaactcagcagtctttaactagcaggagaaagacctgtatcatgtgcagaacaaaatccagatgcgcaaatcgaagatgataatccatctaaaactgagaccactgtgagctccccgcactaactaatgaccaccttcttcattggacgggcacctctggcagtgtacgaccactatatctgccttacgatgaccatgcct

SEQ ID NO: 320 - DNA, 446 bp, Triticum aestivum
  Clone ID: LIB3280-004-P1-K1-G11
cccacgcgtccgcccacgcgttcgcccacgcgtccggcaacccgcaaccagactgaagaccgacatggcccggatcggcgtcgccctgctcgcgctcctggtggccgccgcggcggtggcgtgcctgccggccccggcctccgcgggcgagcaggactccatgctgctgacgcgcgcggcgacctgcgacggcgccgtcggggagtgcggcgtggacgaggacaaggagatgggcacgggcgcctacggcaccggcgaggccctgcgccggtcgctggcgcgcaagccgacggccaggtacatcagctacgcgggcctgcgcgccgaccaggtaccctgcaacaagcgcgacaagtgctactacaccaactgcggttcgatgcaagaagccaacccctacacgcgcggctgctccgccatcacgcgctgcgcgcgcaacatgaact

SEQ ID NO: 321 - DNA, 288 bp, Triticum aestivum
  Clone ID: LIB3280-004-P1-K1-G12
acgccgacgcgtcggactatgttttaggatacgcgtccggcaacccataaccagacggaagaccgacatgggccggatcggcatcaccctgctcgcgctcctggaggacgccgaggccgtggcgcgcctgtctgccccggtctccgagggcgagcaggactacatgctgttgaagcgcgcggggaccttcaacggagccggttggagagtgcaggggggactgaggacaaagagatgggcacgggcgcctacggcaccggcgaggccctgtgccgggtgctggcgcgc

SEQ ID NO: 322 - DNA, 255 bp, Triticum aestivum
  unsure (1)...(255): unsure at all n locations
  Clone ID: LIB3280-004-P1-K1-G2
aaaaaactcattaacccccgcgccgctccgatcttcttttccggcgacggcggcgggggaggcggcggtggcagtttggcttcnctcttccttggtctgaggatctccacccgcaggatttggttgccgggcggggtccgcccgctaggcaagccggggggcccgttttcttggttaagccaaaatcaagtacaatcccatcctgccggagcctcgtcctttgcctccagcgggggaaccggtttgggttaagcc

SEQ ID NO: 323 - DNA, 449 bp, Triticum aestivum
  Clone ID: LIB3280-004-P1-K1-G3
cgcagccgcctccctccctcactcgctcctcatccggcaacggcgacggcggctcccgggcccgcgttcttcctcccgcaacacgtctcctctcaccgccgatccccaacccagacgtcagcgcacacacgccggtggctcccaccaaccacagcgacggcggcagcggtcacagaggagggcagcggatcagctgcaccggcgatggcgtccgtggcggcggtggaggacgcggctgcgacgcttcagtgatgtcgcgcgtgcagcaggtggcgacgcggtcggggcgcgcgcaggagtcgatgcgcgtggtggcggtgagcaagacgaagcccgtgggcgtcatctgcggcgtgtacgacgctgaccaccgctgcttcggcgagaactacgtacaggagctcatcggcaaggccccccagcattttcccttgattatgttcagaaga

SEQ ID NO: 324 - DNA, 443 bp, Triticum aestivum
  Clone ID: LIB3280-004-P1-K1-G5
cccacgcgtccgcccacgcgtccgaagagatcgtcatcatccgccaaaccagatcgggtggggtgcttcctcttcttcaacttcgcagaatcgctggtcttctcgtcctctagttaagtccctcgacagcaatgggaggaggcaacgacggtcatgggtacccacccggtggccaggggggataccctccgcaagggtacccgccgcagcagggaggttaccctccacagcaaggatacccgcctgcacctggagcttacccacctgcacctggggcataccctcctgcacctggggcataccctcctgcacccggagcgggtggcagtgacggggagaaggggctcctctccaacatcatgcacggtgttgccggtgctcatggtggtggccatggctacccatctggtggccacgggtaccctccgcagcagcatggatac

SEQ ID NO: 325 - DNA, 310 bp, Triticum aestivum
  Clone ID: LIB3280-004-P1-K1-G6
cccacgcgtccgcatttcagagtcttgtaagatgctgctcgggtacatgaagaccctggcctgtgtccccatggcctcggatacaagaggtccaagtcgaaccagtacgagacggcgtcgctggtgcagattgagggggtgaacaccagggaggacgtgacctggtacggcggcaagaggatggcctacgtctacaaggccaagaccaagagcaacggcacccactaccgctggatatggggcaaggtcttggggcctaacgacaagaccggggtggttcgcgccaagttcatgtggaatatgcctcgtc

SEQ ID NO: 326 - DNA, 399 bp, Triticum aestivum
  Clone ID: LIB3280-004-P1-K1-G7
cataataaaccaacttggttaaaagttttccatcaacacaagtcaagtatgattacaactttgaactctgataaagaagcctaataagaagttataaactgatctctgcaccagcttcttccaattattgctgaagcacactgatactatgaacaaacctctcactttgcaccttctcaaattcttcgggaaggtgcagaatcaacaaggagaaaaccagagcagcatatcatttcagaatgacacctgcttcatgaaaattaagacttctacaccatttcttcagcagctaagtaagcaaagccagatcaaatatctatcatcagccatgggaatctagctatatatgccgaccaggcgacttcagcagtgctgtttctttctagatagtattactcg

SEQ ID NO: 327 - DNA, 420 bp, Triticum aestivum
  Clone ID: LIB3280-004-P1-K1-G8
cttggtgaactctccaccggcgacgatgagccggaccaccgtgtgtgcgcggcctccggcgtgcctgccgctcgtgatgacgaagtacaagggccgtcgaccatgcacggtcgttggcgcaccctccgctgtccagcctgccggcaacaccatcgtgtctggactcgtcgacacgcatcgttcgactcggcgccatctagggcgccaccccttctacctacaccctcggcggcgcctgggcgaggctccgccgcatcacgaggtctccttcgccgttgtcttgccggtccatggaggcgccatgggctggccgggactcggcgacatggtccgttcgacgcgtcggcggcggagcggcgctcgacaggtcacctctcctcatcgtaaccatggcggcagagcggcgctcgatgagtcacc

SEQ ID NO: 328 - DNA, 301 bp, Triticum aestivum
  Clone ID: LIB3280-004-P1-K1-G9
cttgttgaactctccaccggtgacgatgagccagaccaccgtgtgtgcgcgggggccggggtacctgtcgctcgggatgactaaattcaagggccgtccaccatgcacggtaatgggcagcaccgtccgatgttcagcctgaccccaacaacatcgtgtgtggactatgcgacacgcatcggtctgacttggtaccatataagggcgccacccgatctacctacacacctgggtggcacctgggagaggcttcgccacatcacgaggtatcgtctcacaatgtcttcccgctgcatggata

SEQ ID NO: 329 - DNA, 350 bp, Triticum aestivum
  Clone ID: LIB3280-004-P1-K1-H10
tccacgaaaggtgaacagaaataaccagaagaaggcacgtggcggccctcacgccggtggtgaccaggaacaggaatgtggaaatcttatctatcaccttatatttataaaaggtgggggtgttaagagctcttaaggggagacgaccgacacttacatgagatacgctcgtgacattttcgcactatcacaccggtgagcacgaatctaccactgtttatggtgagctacattggcggggtgaagagtggtaaaaaaaattgtctccgccaaagaaaaaaaatgtgggcccaatcttttagcaaaactagagtgatgggttgctcagcaagtttccactgccttctttt

SEQ ID NO: 330 - DNA, 372 bp, Triticum aestivum
  Clone ID: LIB3280-004-P1-K1-H11
cgatgctgcagaacatgccatgttgcaacattaaagcatggtttttcttacactgaaggatggacagacacaacttgcagataacatggtgcttgcctcttcggttctttcggaacagtggcttgaagaagaaagcatacacacagaatggtagctgacggaagcatgaggaaatgcagggagcgtggcggcgatctagatgcagggttgtttatttcttggtttttatgtacgtgacagatgggcattgccatgacgactaagtttctggatgaaatgggagggagtggattgattggtcaggcctgtgcctgggcccgcttcgcggttgcgctgccagggctccaacgctgcttcggttcagacttggac

SEQ ID NO: 331 - DNA, 297 bp, Triticum aestivum
  Clone ID: LIB3280-004-P1-K1-H12
cgatgctgcaaaacatgccatgtggcaacattaaagcatggtttttcttacactgaaggatggacagacacaacttgcagataacatggtgcttgcctcttcggttctttcggaacagtggcttgaagaagaaagcatacacacagaatggtagctgacggaagcatgaggaaatgcagggagcgcggcggtgatctagatgcagggttggttatttcttggtttttatgtacgagacagatggccattgccatgacgactaagtttttggatgaaatgggagggcgtggattgatt

SEQ ID NO: 332 - DNA, 148 bp, Triticum aestivum
  Clone ID: LIB3280-004-P1-K1-H2
attttctttttctgggggggaatttattgagatgggtggtaattaattttaattcaatgctcatattatgggcacacctcggagaaagaaaaaacggccgctgtttatttaattggaaatgaattccctccctttttttcaggtgaaa

SEQ ID NO: 333 - DNA, 151 bp, Triticum aestivum
  Clone ID: LIB3280-004-P1-K1-H3
aagaatctaatttttgggggaacaaacttattgagagtggtggtaaataatccccactccaaacatatatatgggcactacacggggctcctttcctgggacgcccacttcgcgcgcgggcacggggtgccaaccgtgctttactggatcc

SEQ ID NO: 334 - DNA, 267 bp, Triticum aestivum
  Clone ID: LIB3280-004-P1-K1-H5
ccctgcaggagggtggagaggaaggaccagaagaaggcaagtggtggcggtgacgccggtggtgacgaggaagaggaatgaggaactagtagctatcaccttatatttatcaaatgttggtgttatgagtactttagctgagaggcctgagactttcatgggttatcctcttgtcattttgtcactttatcactgttgttagcatgtatgcactgctttatgtttggagctatttggtcgtgatgaaagttatctaaaaatgttctt

SEQ ID NO: 335 - DNA, 355 bp, Triticum aestivum
  unsure (1)...(355): unsure at all n locations
  Clone ID: LIB3280-004-P1-K1-H6
catcacactccacctgcaccacccccatccatccatccatcatagaagagagagagagacagagagagaggagccatggccaaggaggtgagcgaggagccggagcacgccgcgccggcgcacaaggactactccgacccgccgtcggcgccgctcttcgacatgggggagctccggatgtggtccttctaccgggccatcatcgccgagttcgtcgccacgctgctcttcctatacatcaccggcgccaccgtcatcggctacaaggtgcagtcggcggccgacccgtgcggcggcgtcggcgtgctcggcatcggctgagccttctgcggcatgatcttcgtnctcgtctact

SEQ ID NO: 336 - DNA, 414 bp, Triticum aestivum
  Clone ID: LIB3280-004-P1-K1-H7
gccggccaccgccggtgacaacaccccggcgaggcgccggctgggttgggaagggagggagatggcgacgacccgggaccgcatgtcgcatctcacctccttccaggagcagtgttgaacgcctgagtccggtgaccagtacccagggacgtctccgcagccggaggagagtccgttcatgagttggaggagagcccacctatcatgttcttggactagcgaggaggaagcggcggcgatatggtggaggaggaataaggtggcaatggttgtgaagcatagtgttctctggcgatggaaggccattttcgactagttgtcgacgaggccctggctttgtgggagcagaggatggggagttcggtttgaaaatggaatgggccgtatagcgaaggcttttagcattattaaaaa

SEQ ID NO: 337 - DNA, 439 bp, Triticum aestivum
  Clone ID: LIB3280-004-P1-K1-H8
aaaatctctcctcgctctcgtccgagtcgcgtgaggagaaaggagggaagccggaaaggggttctcgccgaggcggaaggaggagatggccgggaagggaggcaagggcctgctcgcggccaagacgacggccgccaagaccgccgagaaggacaaggggaagaaggccctcatctcccgctcgtcccgcgcgggacttcagttccctgtgggccgtatccatcgtcagctgaagcaaaggactcaggccaatggccgtgttggtgctactgcggcggtctactctgctgccatcctggagtacctgacggctgaggtcctggagctggctggcaacgccagcaaggatctcaaggtgaagcgtatcacccctcgtcacctacagctggccatccgtggagacgaggagctcgacaccctcatcaagggcaccattgct

SEQ ID NO: 338 - DNA, 66 bp, Triticum aestivum
  Clone ID: LIB3280-006-P1-K1-A10
ttaacacatccgagagggagcctcctattttttaagagccaacatcacatcggggggggttctaaa

SEQ ID NO: 339 - DNA, 282 bp, Triticum aestivum
  Clone ID: LIB3280-006-P1-K1-A12
cggacgcgtgggcggacgcgtgggggcgacacccccacgaggccacaaagccaaagctgctcccaacgcagacgcaagcgatacagagcgcgccgttagcatgagctcgtcggtgcagctcaagcggctgtaccagctggcggtgagcaacatcgtggccatcgcggccgtgccctttggcgccttcgccctggttaagggggcggagctagggcccgaggagctgctcgcccggctgcgcgcgctccggcccgtgcacatgttcctggccgccttcgtccc

SEQ ID NO: 340 - DNA, 62 bp, Triticum aestivum
  Clone ID: LIB3280-006-P1-K1-A2
gccctcctaactgccaccctggttattattaaagctggagggcatatggcacaagcacaagc

SEQ ID NO: 341 - DNA, 452 bp, Triticum aestivum
  Clone ID: LIB3280-006-P1-K1-A4
cggacgcgtggggcggccggtcatcctgtccatctcgcccggaaccgaagtcactccggcgttggccgagaacatcacccaacacgttgatatgtacaggataacaggggatgactgggacagctggaaagatgttcgcccgcatttcgatgttgccagatcatttgccgatgcgaataagatcggcgccactggattgcaaggaaggtcttggcctgacttggacatgcttccgtttggcaggcttactgatgcaggtgttaaccagggccctcacagaagcactaaccttacatttgacgaacaattaacacagatgctactttggtcgatggccaaatcccccctcatgtttggaggtgacctgaggcatctcaacgatgatacattggatctaatcacccaccctactctactgaagattaatcaccacactaaaaacaacatggagt

SEQ ID NO: 342 - DNA, 411 bp, Triticum aestivum
  Clone ID: LIB3280-006-P1-K1-A5
agacaaacaacaatctcataacattagcctgctaagctgaaccaacatgtctgatttactagctcacaagtttcgtggttcaacctgaaccagcgatcaacatacacactcaagcgctacgccataatgtcaagcacacaagcagcgatacttctggtcttggtaacacatataaatagatgtttcaggacatttcacacgacggctttagtaatacgttaacctgtttcacgatagcgagctcggagtgctcagacgcgatcatcgacctcctcgtacatcttgaggatctgcgcgcatgcagccagaggggtgttcttctcaaaccccagagcattcgccaaacggacgttggacgcgacgccgttgttgttgtgaggaagacaggggccctctcccgcccagcaactg

SEQ ID NO: 343 - DNA, 452 bp, Triticum aestivum
  Clone ID: LIB3280-006-P1-K1-A6
tagagaccgcctcccggccggccggagtggatcgtgctcatacgtcgaccatggccacgcgccgcagcagcacgggcggctgccacgtctcctccctcctcgtcctcctcttcctcgcctccgcctcggcgtccctcctcggcgcccgcgccaaaggccccgtcgtggacgtcaaggcgtcctgcgccaagacggacggcccgatcacctgcaactccttcctcgggcccgagccggacaccaagacggcggacgcgcgcgggctggcggagatcgccatgaaggtcaccgccaagctcggcggcttggtgggggcctacgcgcgccgcgagctggatctggtcaaggacaacccgacgtggcagtgcctggacgagtgcgccgaggacatcgaggacgcgctgtcgcacctggacgacgccctgggcggcgtcaacgacgcccagttcgac

SEQ ID NO: 344 - DNA, 167 bp, Triticum aestivum
  Clone ID: LIB3280-006-P1-K1-A7
agagattatttcttcttcctttttggctgtatccatataatgtatttccctgaaattaattatagtaggagtgaaatctttaatgaaaagattgcttttgaggatatttagccaaaaaaaaaaaaaaaaaaacacaaaaaaaaaaaaaaaaaaaaaaaaaacaaaaa

SEQ ID NO: 345 - DNA, 353 bp, Triticum aestivum
  Clone ID: LIB3280-006-P1-K1-A8
cacaaccttggaaacatttattaataactattttcgccctaaggcatcagtacaagcttcaggtgtggggtaaataaataataatacaaattccggactactgaattatggggcgggcacagaagcttcttgcagctacataggcgagaaataagagtacatatgccatgaatgattacatggaatctagattttactgatgacaccatgcatcttattcttcaattattaattaggacctgaagtgaattacagcaagcgaagccattggcaactccttagtaatttcctccctcaacatatccttcttcttagaggttcgtggataccgagaaggacagaccttgattttt

SEQ ID NO: 346 - DNA, 433 bp, Triticum aestivum
  Clone ID: LIB3280-006-P1-K1-A9
acgcccacgcgttcgagcggagccgccgagccgggaagagccaccatcccatcgcctccgtttccgaagggtcagagatggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagcagctacatgactcaaaaccttggcatcagtgtcccaatgatgtcatcttctccattggttgccaatgcaccccctgagaagaaaggtgtcaagaactttgcgattgacttcctcatgggaggagtgtcagctgcagtttccaagactgctgcagctcctattgagcgtgttaagcttgttatccagaaccaggatgagatgatcaaggctggcag

SEQ ID NO: 347 - DNA, 298 bp, Triticum aestivum
  Clone ID: LIB3280-006-P1-K1-B10
caaaagccatcttgttccattccagctcaggcgagcagcgaccaccttccggcgagggtagcagcgatggagggcaaggaggaggacgtgcggctcggaacgaacaagtactcggagcggcagcccatcggcacggccgcgcaggggtccgagggcaaagactacaaggagcccccccccgcgccccttttcgagcccggcgagctcaagtgctggttcttctaccgggccggcatcggcgagttcatggccacctttctcttcctctacgtcaccattctcaccgtgatgggctaca

SEQ ID NO: 348 - DNA, 445 bp, Triticum aestivum
  Clone ID: LIB3280-006-P1-K1-B11
gacatgcaaggccctcctggtctgcgtcctccggctccattctaccccggtggataccctcccccgccgggctggcctggttaccctatgccatttgttccggtgcaagggtacggagctccacctggtgcgtatcctcaacccggaggataccctccagctgggtatccacaacaacatggccattccgccgcaagctggttatgccgtccatgataaatcgaagaagaagtcttcaaagaaaggaaaaaaaggtaagggtggtggcttcggctcattcctcgccggtgccgctagcggtgcagttacggtacttggagctgtattggctgaagatgaagaacagtcttctggcaagttcaaaatggagtgctaaaccaagaaaaaaaatgcaattaccattttgtcttttgatcggtggagcgaaaaactactactttttaga

SEQ ID NO: 349 - DNA, 78 bp, Triticum aestivum
  Clone ID: LIB3280-006-P1-K1-B2
cccacatcctcaaatcagtccaggctaccgagcctctttatccatcctctcacttagaggcagggctcggcgaacaat

SEQ ID NO: 350 - DNA, 411 bp, Triticum aestivum
  Clone ID: LIB3280-006-P1-K1-B3
gttacaaatcatgcgggcacaaatgcttggaccaccaccaccaccaccaccattacgatcaggaccaccacccaagcgcgggttcaaagcccccgagtccgaagccatcaaagtcggagactaagcccgcgccaacaaaagccacaccttcaaaggccggttcaacggaagccattgcggcaacggtggccattttggccgccgtggccaatgcggccgaaaccaacccggccgaagccgttgttaaggcggccgtcccatcttattgcacggaagccaaggttaccgtgtccgtcgaaaattaattcgaacccgaaggcaaagtcaaagccgaagccaccgtgcccgtggtcggccattgtatttgtgtcgacaacaattagcaccaactgatggttatacaccatgacg

SEQ ID NO: 351 - DNA, 373 bp, Triticum aestivum
  unsure (1)...(373): unsure at all n locations
  Clone ID: LIB3280-006-P1-K1-B4
agagagggcatgtctactgatgaaacagtggaccggtgccgattatttttgttgctgagagtctttgaagctgtgaaaaacaccagcttttttgcgtgcccatagagtttaatactcatgccaaccagtttgcttgtctcaagtgtcatgactgggaaatcagagcagcagagggccctggaaacatagtttttcttttctttttggggaattgccgacacgaaatatgtgattcattaaacaaacagtgactccctttttattttcaaaaaaaaaaaaaaaaaaagnnaagggtataggggggcaccaaaaaaaaaacaaaccgggggagcgctcttaaaaaaaaaaaaaattttacctgcggggggggggg

SEQ ID NO: 352 - DNA, 380 bp, Triticum aestivum
  unsure (1)...(380): unsure at all n locations
  Clone ID: LIB3280-006-P1-K1-B5
cggacgcgtgggcagctacctgggcagccccggcgtgagggacaacatcagcatggagaaggtgttctacgtctcccagcagtgcggcgtcagcatccctggcaactgcggaggatcgaaggtctgaagcaggaacaggccagctgaatggcaagcttggataacgtaagcagcgcagttcgcactgctggaataaataagacgtcctggtcaactcataggtggacgatgccggagcacaaggaatgcattgccattcagttgctggaaatatttataatattgtactttgactacgttgcaacttgttgcaagactgttgtattgccattcagttgctaaaattattatactttgactaaaaaaaaaaaaaaaanaaa

SEQ ID NO: 353 - DNA, 388 bp, Triticum aestivum
  Clone ID: LIB3280-006-P1-K1-B6
agtaaacaagtgagtgtagcattgttctgtctttcattggataaaacaaattgatcatctgagaggaatagatcacatatcctgagagaaataacatctgcatcacatatcctggctagttttcaaatggactagagctactctcagaacaagcatcattggaaccgattacgttgcattacaaaatattatccataagctgtcctaaagttttgcaaaacccaacagcctacttgttcagggctggaggcttgctgaagtggttggggcgcgcaaaattgccggggacgacggcatcgagctctgcaatagcgctgtccaggctatgcagcagccctgccagttcgttgtcaagtttcttcagtaattcttcattgtccttggtctc

SEQ ID NO: 354 - DNA, 441 bp, Triticum aestivum
  Clone ID: LIB3280-006-P1-K1-B7
cccacgcgtccggaagccatcagccattcagcaaagaggaattgttcccttctgtaagggtcttgatgtgattcagcaagctcagtctggaacaggaaaaactgccaccttctgttctggaatcttgcagcagcttgactacggattggttgagtgccaggcattggtccttgctccaacccgtgagcttgcacagcagattgagaaggtcatgcgtgctcttggtgactacttaggcgtcaaggtgcatgcatgtgttggtggaacttctgttcgtgaggaccaaaggattcttgccagtggtgtgcatgttgttgtcggcacacctggtcgtgtgtttgatatgttgcgcaggcaatccctccgcccagataacatcaaaatgtttgtgttggatgaagctgatgagatgctttcacgtggtttcaaggatcagatcta

SEQ ID NO: 355 - DNA, 448 bp, Triticum aestivum
  Clone ID: LIB3280-006-P1-K1-B8
cttttctcatggcatgtagtaaatgtgtttcttagtgacttggccatcacatcacagtatagtgagattaatgtgttcaaagtaccgcaggcctataagttgcaatttcaacattatatccatcgatctggctaggtacttaaatggtagtttacttcctgaatatttgattttttttatgtctgcattacatttcataataaagatatatgtaagtaaactggtgcgagcaagacctaaacgaataaaacatactactgcatttcttattaattttattgcagtaatgttttcttgtcacagaaggggagccttggcgcagcggtaaagttgttgccttgtgtgagtcctggaaacagcctcttgcagaaatgcaggaaaaggctgcgtaaaaaagacccaaagtggtcagacccttcccttgcaaaaaggacagcgaagcgggagc

SEQ ID NO: 356 - DNA, 446 bp, Triticum aestivum
  Clone ID: LIB3280-006-P1-K1-B9
ccacccagcgccgccgcggaaagggaattgggcgatggcgatgtggatgtcggcgggcacccgcgcgatgcgcgtgcacgcgcgccgcacccccgcctccttcctcctccgcgactccgcccgcccggaccccaaccgggcgctgctgcagggccaagcgcccgcgccccgctggtactcgggagccgccgcgggcgccgatccggcgtcgatcccattcccagcgcaccttggcggggccacagtgccggacctacatgtgttcgtcgtcgagcgattcgggcactaccacaagatcctgccctctggggttcactttctcttgcccgtcgtcgaccgcatcgcgtacgtccactcgctcaaggtgaagcccatccgcatccccaactatcctgcggtcaccaaagataacgccttgatccagtttggaggagtgctcatctaca

SEQ ID NO: 357 - DNA, 142 bp, Triticum aestivum
  Clone ID: LIB3280-006-P1-K1-C1
ccacccagcgcccttcttgatcaaatgattgtttttagagaaatcatatatttcgggtgttcacacctttgatcatcccccctttatcccaaaccagtattttcttttccacccaaaagaaaactgctagcatctactacca

SEQ ID NO: 358 - DNA, 449 bp, Triticum aestivum
  Clone ID: LIB3280-006-P1-K1-C10
gggaatgacaggatgtgaagagtacactttgatcacgaacctgcagacacatttcaagatcaaccatcctgaattgccgctgtcatactacacaggagtacttggcatgcctggtcttactgcctatgctggattttttgacgtggccaagccaaagaagggcgactatgtcttcgtgtcagcagcgtcaggtgctgtcgggcagcttgtcgggcagcttgccaaaatctctggctgctatgtggttggtagtgccggttctgatgagaaggtcaacctcctaaaaacaaagttgggttttgacgatgccttcaactacaagaaggagcaggacctgaacgccacactgaagaggtgcttcccggagggcattgacatctacttcgagaacgtgggtggtgcaatgctggatgcggtgcttctcaacatgaggctgcacgggcgggtgt

SEQ ID NO: 359 - DNA, 395 bp, Triticum aestivum
  Clone ID: LIB3280-006-P1-K1-C11
gggaatgacaggatgtgaagagtacattttgatcacgaacctgcacacacggttcaggatcaaccagtgtggattgccgatgacatactacacagcagtactcggcatgcctggtcttactgactattctggattgtgggacccggacacaccacatagggttgattgtgttttcatctcagcaacgttaggtgctgtacataagctggtcgtgcaacttgtaccaatctgtctttgccaactgttatgacagtttaggttttttatgataacgtcatccttataaaaacaaacttggggttcgactactcttttaactacatgatggagcatggacctgaacgccacactgctgtggtgcttcccgtagggcattgacatctactacgataact

SEQ ID NO: 360 - DNA, 439 bp, Triticum aestivum
  Clone ID: LIB3280-006-P1-K1-C12
ggtgtgaatgatttttttttccagcaggcaaaacttatacatcaacatgtaggaacaagcatcctgaagatccatctagaaattgatgttgctaagcataaaaaaacaaaccaaaatcaaataaacggtaatggcaacaagactatgtgtattgtgtccacgcgcccaatctgaacctgttacatatccttcttttaatggtcagcaacgcgtgaagatgagttcatcagcgtcgaatttggcacacagaaaatttgtgcccggtggccaaaacggcctgtgctgccgagatgtgtctgtgtcgattgaagcttgaggaggctcactttgtcttcttgtcctccgtgctcgtctcagccttggcctcgatctgttgggcagccgctgctccttccaaagtttggggtgctgcgggttcgtcttcccctccaaagccaaa

SEQ ID NO: 361 - DNA, 399 bp, Triticum aestivum
  Clone ID: LIB3280-006-P1-K1-C2
ctcccgaagcaaaacggaagggaaaaaaggaagagttaccgagagacagaggaggcaggggaggggggtaaaatcaagaataaattataaccgcacggccaagaacaagggagggtaaataaatcgcccatcgcctcaccgcccgggaggggatgatgtccgaaagcgaggagcacgggtcgctcctggaaaagattggcgataagatcggcgacaagatccatgagttcaagaaggattcatcgtcctcggactcggacgacgacaagaagaagccgcataaatccaagaagaagcacctgtttggcaggaagcatccgctccacaacgttcttggcgggggcaaagctgctgatcttgtgatgtggagggacaagcagaagtccgggagcatcctgg

SEQ ID NO: 362 - DNA, 363 bp, Triticum aestivum
  Clone ID: LIB3280-006-P1-K1-C3
ctaattctagagggacagagctaatcttgaaggttatagccctgtttcttccctgtggtagatcaaccgttcttctttcttcctaggagctccactgttttggatgaactggactaaccctagaagggatgaaggtcatccacgtggtgtctcaaggtgaacccagtggtacccgaccaagtggctggagggaatggtgtatgctcacaagtatgtacagaccaatttgcttcactcggacaagaatcccacgaaccttaatgtggcctttaagtttcaggtccttggggttggatgcggcaactattggatcgaagacaatcttttgtggtggagcgacatcaccgccggctggttctgcaa

SEQ ID NO: 363 - DNA, 292 bp, Triticum aestivum
  Clone ID: LIB3280-006-P1-K1-C4
acggggaatgacaggatgtgaagagtacactttgatcacgaacctgcatacacagttcgagatcaaccatcctgaattgccgctgtcatactacacaggagtacttggcatgcctggtcttactgcctatgctggattttttgacgtggccaagccaaagaagggcgactatgtcttcgtgtcagcagcgtcaggtgctgtcggcccgtttgtcggccagcttgccaaaatttttgcttgttttgtgataggcggtcctggttttgatgaaaagccaaccttctaaaaacaa

SEQ ID NO: 364 - DNA, 433 bp, Triticum aestivum
  Clone ID: LIB3280-006-P1-K1-C5
cccacgcgtaccgcccagcgcgtccgggctgaaaattaaccgggattttcttaaacccatagtaatactggagggagagggcgaaaggcggccaaccattggccgcgccgaagacggttaagcaggctccgacgaggtcacgcatgtgaggtacaacatacgaggcacttggcacggtttttgcttgaacagcgtcaacactgctcttcggcacatatgtggtggcactaaaaaggacctccagggctgatacaacaatcagaataaataaatgtctaagcatactgctctgattggagttccataactgtaaatctgtaactatatggtaatgtgattctgtcgcaagtagaataaagaccccgtgtatgctgtaaaaaaaaaaaatatacatttaaaacaataatattgcaaaaatatgggtgggggtttt

SEQ ID NO: 365 - DNA, 316 bp, Triticum aestivum
  Clone ID: LIB3280-006-P1-K1-C6
aggataatatatgggcttgagtcaaatgtggcgagtggtttcatacacaggagtgagccttgatcagggcggcagtgtttcagcttctacctttggtagggggtaccccgacgttaccattgggattataggaatttgatacacacagaatcatcactcttttttaatcccacaaaaagaaaagaatttatggttttttttgaacactccatacaatgtactggtgtctgcatacggagacacgaacttactagccttatttaaccgctttggtgctggaaaaccgtcgatcagttcttcatctgcaggctgggca

SEQ ID NO: 366 - DNA, 427 bp, Triticum aestivum
  Clone ID: LIB3280-006-P1-K1-C7
gcaaggcacgtccttcttgatcaaatggttcttgcgagactgatcagctgtcgcatgtgtacactttgatcatccgccctgatgccacatacagcattctcattgacaacgaagagaagcaaactggaagcatctacgagcactgggatattcttcctcccaaggaaatcaaggacccagaagctaagaagccagaggactgggatgacaaggagtacattcccgatcctgaggacgtcaagccagagggctacgatgacattcccaaggaagtcaccgatcctgatgctaagaagcctgaggattgggatgatgaggaagatggtgaatggactgccccaaccatccccaacccagagtacaagggcccatggaagcaaaagaaaatcaagaaccctaactaccagggcaaatggaaggcacctat

SEQ ID NO: 367 - DNA, 85 bp, Triticum aestivum
  Clone ID: LIB3280-006-P1-K1-D1
aaaggaaaactagagccacattctttgcggtaacaccggatcatctgatgtatgtacatcaatccaaattgtcaatacaacactg

SEQ ID NO: 368 - DNA, 241 bp, Triticum aestivum
  Clone ID: LIB3280-006-P1-K1-D11
cccacgcgtacgatttaatgttgagcttctgttttgttgttttgtcgtgtgaacttttgatgctcgtcgattaactgactgtttgacaccattgtgctaagctattagtggcataaataagctagatgcagttttcttccccgtcaaggtttgcataaggctgttccgatttcttgtccgaacaagtgtgtgtactgtgtaggatccggtggtgctgaagttttgtaacctagcaacgaga

SEQ ID NO: 369 - DNA, 326 bp, Triticum aestivum
  Clone ID: LIB3280-006-P1-K1-D12
gatcggtttccgagggagtatcttttttaaccactacgtggacgtatatcatgtgacgtggcgtgcccagcttaatcacttcccgctcggaacagtcgcactgattaagagctcggcaccgccccctgcctgcatcacgacgacaatgccctcctcggcacccggcgagacgatgccgcacgagacgtgcacgggcttgcacccatccagcacggcctcctcgagaccggcctcttgccagcacgcgtcccgaagcaggtgccccggaggcgtcgtcgtcgtcgtcgtcgtctccccgtcacctcccgcgcaggagcgcaagacgt

SEQ ID NO: 370 - DNA, 82 bp, Triticum aestivum
  Clone ID: LIB3280-006-P1-K1-D2
ggatattaatattgccttctacaacattccgatgctgaaaaggttgagagagctgggacgagaattggtagctcacactgta

SEQ ID NO: 371 - DNA, 420 bp, Triticum aestivum
  Clone ID: LIB3280-006-P1-K1-D4
aataacggatgaactactaacttctagtggtgatacctaccgggacagaactaaatacactggccagggggatacaaggtggtaaacgtggtccttaatatagaaaacacaatgacggggggtttatttttgggaaaatttattttttgcggtttaagttttggcaatttttgtttatgcaacttaagaattggacatctcattttggccactttaaactttggacaatacatcacaaatcccattcaggggcaaaaacaatattttttcatttcactttggccactatgaggttttgcaatgtatcataattgccactttgaaaattttgcttttgccactgaatggcaaaattgatatattgtcaaaaactaagagtggcaaaagtgaattgttaaatcctagagtggcataagcaaa

SEQ ID NO: 372 - DNA, 59 bp, Triticum aestivum
  Clone ID: LIB3280-006-P1-K1-D5
cttacgggacaacccaaaaagctttaacccgggccattttttcttcccttcgtttattt

SEQ ID NO: 373 - DNA, 200 bp, Triticum aestivum
  Clone ID: LIB3280-006-P1-K1-D6
cttcctccaaccctacgatagaatgtttaccttttttttttttgatattacatatgaacttgtgatgctcaacgatgaactgactgtctcacaccattgtgctaagctactaatggcataaattatctagaaccaattttcttcctcgtctaggttctcataacgctgattctattttttgtccgaacaaatgtttctac

SEQ ID NO: 374 - DNA, 355 bp, Triticum aestivum
  Clone ID: LIB3280-006-P1-K1-D9
caagactggcggcctcggcgacgtcctcgggggcctccccgccgccatggccgccaacggtcaccgggtcatggtcatctccccgcgctacgaccagtacaaggacgcctgggacaccagcgtcatctccgagatcaaggtcgttgacaggtacgagagggtgaggtacttccactgctacaagcgcggggtggaccgcgtgttcgtcgaccacccgtgcttcctggagaaggtgaccgatcgctcgccgtcgatcgatcaagctagctcctcgtcgtctcaacccgcatggtgtttgataatttcagtgagtctttgcgtctgctggttacaatttccaggtccggggcaagac

SEQ ID NO: 375 - DNA, 383 bp, Triticum aestivum
  Clone ID: LIB3280-006-P1-K1-E1
cagcagaaaaaaggaaaaagcagaggacccagctcccctgcccccttcctccgccaacggcgcaagaagcagaggagggcaagcctgcggagcatagcacaacagagggacaggggagatggcggcaccgcgcccacagccgctgctgctcctgctcctcgtcgcgctgttggttgcctccgggcccggccgggccgacgcttggggcaaggagggccacatcatggtctgcaagatcgccgagaggtacctgtcgaaggaggcggtggccgctgtacaacatcttctcccagactcgcgcgggggagatctctacaatatgcccccgggcggacacaatatgcttttgctatcacagtggcagagcgctctactactccaac

SEQ ID NO: 376 - DNA, 410 bp, Triticum aestivum
  Clone ID: LIB3280-006-P1-K1-E10
catcatgcaattgtttataggtggtgcaatcatacgatcctggtcctcatagtggaattatgtgtgcatacagagtgtgcctcctgaacgatttgggatcatatttttttttttatctacgagacggcttgtaaaatttgtatcaagcggttccatttccatgtgaatataccgaactccttcatccttccgttttcatctggtgcacattctcttttctgaaaccacatggtagagttgggtatagatcaactgcagactgcacaatcgccttatctataccactgactatacactgtacaacaacctaaatatcctcctactagatactactactagtaacctacagtctacagattgaaatgttcaaaaaatccaactgaacttccagtacgagattcctacacctt

SEQ ID NO: 377 - DNA, 139 bp, Triticum aestivum
  Clone ID: LIB3280-006-P1-K1-E11
ctacgcctcaggtaccgaactcgcaattgcgacccacgcgtacgcgtacgcttatggctagttatgaatgaacaacacctagtgatcgctatcgtgacgcgggcggaccctttccacacctcgaagcccagccaggaat

SEQ ID NO: 378 - DNA, 294 bp, Triticum aestivum
  Clone ID: LIB3280-006-P1-K1-E12
gaaagatactcaaatacggcagatgcaaacaatgtcgaaatcaaatcaaggccaaggccaaatccaaccttgtcctgaagacctatgtttttgaaaaaaaaatgttggtaaaaattggaaccagataacacctcccggtggtggtcctaattacctaaagagttccaggaaccgggaccggaaaacttccctcgcaggtggattattaaggacttgtggaccgttggaacccttggggggcttcgccttttgttttttaagggccctttgacaattcggccgacaaaatttccg

SEQ ID NO: 379 - DNA, 344 bp, Triticum aestivum
  Clone ID: LIB3280-006-P1-K1-E2
cagcagaaaaaaggaaaaagcacaggacccatctcccctgtctccttcctccgccagcggcgcgtgaagcagaggagggcaagccgtccgtgcatatcataacagagggacaggggtgatggctgcacctgttgccacagccgctgttgctcctgcttctcgtcgcgcttgttgctgcctccgcgccccgccgtgccgacgcctgtggcatggagggccacatcatggtctgtaagatcgcctagaggtacctgtcgtaggaggcggtggttgcggtgcacgacctgctgccggagtcggtcggcggtgagctgtctacgatgtgcccgtgggcggacactatg

SEQ ID NO: 380 - DNA, 251 bp, Triticum aestivum
  Clone ID: LIB3280-006-P1-K1-E4
cgccctctgaataaattacgacgacaatgccctcctaggcacctgaaaagacaatccccaacaagacgtgcacgggcttgcacccatccagtacggcctactaaaaaccggcctttggccagcacccaccccaaaccagggcccccggggccttatctataccactgactatacactgtacaacaacctcaatatcctcctagtagatactactactagggccatacagggtaaaaaccgaaaaccgcaaa

SEQ ID NO: 381 - DNA, 280 bp, Triticum aestivum
  Clone ID: LIB3280-006-P1-K1-E5
attctggatgccgcaaaaaggcatttggtgtagtgcatggtgacgcgcaggtggatacgagctgagaatcacattttagctgccggtgaagataaccaaattaaattctgcgatgttgataacaccaacatgcttacctttattgatgccgactgaggcttgccaggcctttcccggttaaggttcaatggagaagggaatcttggtgctgatactactgtagacaatggttctaagatacttgcaaacactgatgggctcagaactctacgggcttttg

SEQ ID NO: 382 - DNA, 452 bp, Triticum aestivum
  Clone ID: LIB3280-006-P1-K1-E7
cccacgcgtccggaaaatccccctctctctccccaatcttcctctcccacatcaccagggcccgccgcgcgccaccaccccgccgtgcccctaccggccctgctccaccgcgccctaccagccctgctccgccgcgtcgcctcttcttccccttctctaccacatcggtgacccaatcggaccatccggcggtgggcacgatgtcctcacgcggatctgactgccgccactgtcgccgcctccatgccacctcgagctgctccttgatgcagttgtccccgacgagcaccacccccacacgactgtcgctgacgagctactccccgacggccacatcctctcctacacccggggtactacggcgatgacaagggcctccacttacctgctagatcaagatcgcgtccaccaccttgacttcactccgaaagttctctccctgtcttttggtt

SEQ ID NO: 383 - DNA, 273 bp, Triticum aestivum
  Clone ID: LIB3280-006-P1-K1-E8
cccacgcgtccggaaaatccccctctctctccccaatcttgctgtcccacgaggagcagggcccggcgcgcgcgaccaccccttcgtgcccctaccggccctgctccaccgtgccctaccagccctgcttcgacgagtcggctttttatccccttctctaccacatgggtgacccaatcgttccatcccggcggtggtcacgatgtccttactctgatctgactgcctccactgttgtcccctccattgccacctagagctgctccttgatgc

SEQ ID NO: 384 - DNA, 364 bp, Triticum aestivum
  Clone ID: LIB3280-006-P1-K1-E9
acgtcttcgagcttctcgaagatgtccatcatgaactccttcatcaacgacatcttcgagcttctcgaagatgtcgttgatgaagctcgccggcgagtcggccaagcttgcgaggtacaataagaagcccaccatcacgtcccgggagatccagacctccgtccgcctcgtcctccccggcgagctcgccaagcacgccgtctccgagggcaccaaggctgtcaccaagttcacctcctcctaggctaggatgcttttctgtaatagtcaggtggtcaaaccatggcttcctggaacttggggtggttctgggggaacaccctggttcattaccctcaggaatattaatggtgtttctttggtc

SEQ ID NO: 385 - DNA, 407 bp, Triticum aestivum
  Clone ID: LIB3280-006-P1-K1-F1
ggtttcttccacatttccactgagcaaagagaagcaaatcggcagagagcgaagcaaaccggcggttcctggcccctcgccatggccggcaaagctagggtgttcatgtgcgtggcgctcgtcgtcctcctgctccttgtcgagaccaccgctccgagtggacaagctcacgccgtcgattgcggcagcgcgtgctcgtaccggtgcagcaagtcgagccggccgaatctgtgcaacagggcgtgcaacacgtgctgccggcgatgcgactgcgtgccgcccggcaccgccggcaacgaggacgtctgcccctgctacgcccacatgaccacgcacgacggccgccacaggtgcccatgatccaaccgccttctcgacgaccgatcgaggctaatgcatgctcgatc

SEQ ID NO: 386 - DNA, 443 bp, Triticum aestivum
  unsure (1)...(443): unsure at all n locations
  Clone ID: LIB3280-006-P1-K1-F10
caagaaagaacctcccgatccggaaaaaacggatcggagatctcgcgcacatccccagccaccacattccaccggcggccgctaggaggctgtatctcggggatggctgtgtccagggcggagggagatggctggggcggcgggtggtgctcggagggtggcatgaggctaacgatggcacacgcgttcgcggcggaggtcgtggctacggcgtcgtcgcgtgcatccatgcgccggcacgagggtgagacatcccttgtcggtcctggttgcggcgccggccaaggcgcctnctcctcctcacacctgtacccgcccatgcagtaggcggcggccagtggcatcggcgcggctgcccgtaactgcagtggtgagcgctgtcaggagtgtgtgcgcagccacggagatcccaatgctgcacatctcagcactttcttatacgt

SEQ ID NO: 387 - DNA, 102 bp, Triticum aestivum
  Clone ID: LIB3280-006-P1-K1-F12
accggccgctccaatgccggcggccatggcgctcttcgaatccgacttcggctccgactccgccgaggacttcggcccgagccaacagcttcccgggccccg

SEQ ID NO: 388 - DNA, 104 bp, Triticum aestivum
  Clone ID: LIB3280-006-P1-K1-F3
ccaggacatgcacagccttaataaattgatgttcatatgcatgcatgtgtgtgtgcatggactgaaatgtatgtcggttgcttatggttcacgagtttatacag

SEQ ID NO: 389 - DNA, 160 bp, Triticum aestivum
  Clone ID: LIB3280-006-P1-K1-F5
gtagacgaccaaaataatggacccactgaagaagaaggaaagccgaaaaggcattacaaatggaacttgttagagcaactggtcatcatgagtgatggatgccagagccgcttgaagagggggaaaaaggcccacatatatttccgtagatatttaaaag

SEQ ID NO: 390 - DNA, 391 bp, Triticum aestivum
  unsure (1)...(391): unsure at all n locations
  Clone ID: LIB3280-006-P1-K1-F6
aatgcatggttgcaaactccccaagccacggggcactccacttccactgcatcaggcggtggcttaagacccgtgaagggtgccctctaaacaacacaggnggtgggggttcacagatgtttggcaattaacacagttatggccaggggcgaagttgcttcatggttgtcgtactttagtgctattagtgataactcctggttaagaatagtggatgggtggttgatgtttctggagcttggatttttgttaaaccacatgcatccttgtggagtactgttcagcaaatcgtccctgagagctaccgatggatctctctgtttttctggaattgaagtgtgaatttggtgggtactcaaaaaaaaaataattttttttatttaattaaaaa

SEQ ID NO: 391 - DNA, 350 bp, Triticum aestivum
  Clone ID: LIB3280-006-P1-K1-F7
agcggggcgtacatggctaggggcggcaaggcggagacgacgacggtgttctttcacgaggaggcggtgcgcgtcggcaggaggctcccattccacttcccgccggcgactcccgccgctctcggtttcctgccgcgccaggtcgccgactccgtcccgttcacgacggccgcgctgcccggcatcctcgcgacgtttggcatcgcgtccgactccaccacggtgcccagcaatgaggcgacgctgcgcgcctgcgagtcgcccaccatcgccggggagtccaagttctgcgcgacttcgctggaggccctggtggagcgcgccatgggagtgctcgggacccgggacat

SEQ ID NO: 392 - DNA, 122 bp, Triticum aestivum
  Clone ID: LIB3280-006-P1-K1-F8
tcgagcggggcgtacatggctaggggcggcaaggctgaaactacgacggtcttctttgagcgaggaggcggtacgcgggggcagaaggctcccattacacttcccggcggggactgccgacg

SEQ ID NO: 393 - DNA, 425 bp, Triticum aestivum
  unsure (1)...(425): unsure at all n locations
  Clone ID: LIB3280-006-P1-K1-F9
gcggcgaagcctcgagactcctccccccggtcccgtcctgtctcccccggccccggcggctcactcccgcccgacggccgccggcgagcgccgccagggaggcaggtgcaggatatacagaaggcggcggcgcacgcccaaccgaccgcgtggagcggagcggaaaggatggacgcggcgtgggcgtgcgcggtggaccgggccgccggcgccgccgactccaccaggcgcttcttcctctccttncggcgcccaccgnctncgncggccgggcccaacccgatagacatcttgaagcgtcttcagcgacaagcgttccatgacataatgcaactgaaggacaggcaagagaaggtcgagaaggggctcaccctcttcaaggctcacaaaaccggcccgtttgccgaagagagcacccgggtcaa

SEQ ID NO: 394 - DNA, 455 bp, Triticum aestivum
  Clone ID: LIB3280-006-P1-K1-G1
ctgctttgaaaatttagggcgctcaacatgtacaacttatcgactaagaaagcaataccacatgaggcacaacactctaggcgcaataggacatggaaatatcacacaacctggattgttcaagtcagcgctgctgggacgcgttgttctgcaagcaacagctgctaccatccagttcaatagaccaggaaaatcaaaaccttcataaattcatgttgagatgcaggcgtgtgtataagcatgaagtgaagtctatgtcggttgctcatggtacacgagtatatacagcagttgctgcgtgttcggccaggagtagtgtgaactcttaagcagcttcaattgcagacgatgggctcacatccatctccatagcataaacatcgtgcacgtcactgattcgtgcatatatgtaaagcggcgaaacaagatcagcaggctagcacatccaacgccta

SEQ ID NO: 395 - DNA, 333 bp, Triticum aestivum
  Clone ID: LIB3280-006-P1-K1-G11
caaaggcaactgagatttttgaagaaattgctcgtcaatcaattaacaacaatctgctgaagtataatggcagaagccatcctcctaaatgcagggacctgccacctatttaaagctgatgctgttgctatacaaaattcatgggagagataccaggaaatcgacccgactttttaaggacctggggaatacaaacttttagctgtatgatacaacatttatttgcctttccgttgcaacacttgccccttttgatcattgcatttccttgctttaatagtaaaaatggaatccattggttataatgaagattagggatggtaatttaggatt

SEQ ID NO: 396 - DNA, 435 bp, Triticum aestivum
  Clone ID: LIB3280-006-P1-K1-G12
caaaggcaactgagatttttgaagaaattgctcgtcaatcaattaacaacaatctggtgaagtatagtgtcagaggcatcctccttaatgcagggatctgccaactatgtagagctgatgctgttgctatacaaaattcattggagagataccaggaaatcgacccgactttctcaggaactcgtgaatacaaacttttagctgtatgatacaacatttatttgcctttccgttgcaacacttgccccttttgatcattgcatttccttgctttaatagtaaaaattgaatccattggttatcatgaagtatagagatagttatctaggattttgggtttttattgtaggatcttgctgcatcaatggatgacggagatgtgcccaatttaacggatgccatcaaggaattggacggcatgacacgcctggatcc

SEQ ID NO: 397 - DNA, 402 bp, Triticum aestivum
  Clone ID: LIB3280-006-P1-K1-G2
aacaacagtagacattgcattactcacacagattattcatccgtacgtaaatacgtttcatcaccattccacaccggcagctcatccttcagcgtagtataagtggtaagtagtaacgacgtcgtgctagcttgcagcacacaagcaaggagcattatactcctaccacacaacgtatctgatgatcgcaagcagaaacaagcccctcgtatacgtcttactcatggattgtactgcccggtctggttttcctggacgccgccgtcgtcgttctgcttctccgccaccctcgtgtcgttctcgtatccggccgcctcgtcgtagctacgttggcggccggggcggccgtacccggagccgttagcctcgggcctcgagcgcgccgttcgcaccgggttggac

SEQ ID NO: 398 - DNA, 128 bp, Triticum aestivum
  Clone ID: LIB3280-006-P1-K1-G5
gaccatggaatgggatgcagagatagcatcttctccaattaaataaaattgaggcgagaaaagaaaacattgtttatgtggaaagggtggcaagcaaaaaaaagaaaggggaacccgagaaaaagggt

SEQ ID NO: 399 - DNA, 154 bp, Triticum aestivum
  Clone ID: LIB3280-006-P1-K1-G6
ctagagtgaaattttctattgtgcgtggaataaaaagaccagactagtggatagcgtgggtccggggaaatatagtgtcagaggcatactacttaatgcaggagaggtggcaacttttaaaagatcaaacttttcgtacgcaaaattcagaggg

SEQ ID NO: 400 - DNA, 298 bp, Triticum aestivum
  Clone ID: LIB3280-006-P1-K1-G7
cggacgcgtggggcaagccaaactcactaatcatacacgtacgtgcttggcttaaacccttccggcgaagtcaagcacaatggcgtcgtccggcaagacctgcgccgcctccgtcctcctcctgctgctggccctcgccgtcgccacggcggccgacgcggcgaagaagagcatcacgtcggagcccaagtccatcttctcgaggccgtcgggacccatcatctcgaggccggcgtcggagcccgccatcccgaggccgtcggcggaggtggacgtgtcgggcgacgtgcatggggtc

SEQ ID NO: 401 - DNA, 206 bp, Triticum aestivum
  unsure (1)...(206): unsure at all n locations
  Clone ID: LIB3280-006-P1-K1-G9
tttttntttgggggtttttttttttttttatttttttttttttaggttttttttagtatttttattttataagatggctgtcactgtgcgtcaacccgcaacatttttatatagcccacgccacacgcaccttatatctagaacaccatacctttacaaaataaaaagcacaagcactccacttttaccaatagctgactaaaaat

SEQ ID NO: 402 - DNA, 343 bp, Triticum aestivum
  Clone ID: LIB3280-006-P1-K1-H10
cggacgcgtgggccgaggtcatggtagttccaaatcaaatgagcgccgcgctgaacgaatactatagcgccggatttcgtccttatctaaagcgggctatcaaaaggttgtggaaagggtcatgctacggtgatatataagggtttgtattgttaaaggctacttgaccccactgtttaaggatttacataaaaaaacatttaggtttttcatagaagggggactttgtggttctttttaaacactgaatatttttattatttgttttccctgggttaaatatctaactttgtatgcattgcggataaagaactcttaattttagttttatagttctctgttt

SEQ ID NO: 403 - DNA, 394 bp, Triticum aestivum
  Clone ID: LIB3280-006-P1-K1-H11
cggatccggtccgagagtagctagcctagtctagggtttccgtagctcggagaggagagaaaggaagagatccatggctgctacttagtaccgctgcttcgaggtctgtctagcttgtgccaccgactaccacaacctcaatgaggcgttacaacagtacggaccgatctttgtcgcgaacatcataaaccaccgtttgacgtgcatgatccaagatttatttttctttacgttcgaaaactagcagtttttgctcatggcattccctgggtttaacagcaagaattttatccatcgcaaaacaagaattattgtgctcggtctctaggattctgggtttttattgtaggatcttgctgcatcaatggatgacggagatgttgccaatattact

SEQ ID NO: 404 - DNA, 377 bp, Triticum aestivum
  unsure (1)...(377): unsure at all n locations
  Clone ID: LIB3280-006-P1-K1-H12
gataaaaataaaaattcaaggannaaatttatttttttttttttttttttttttttttttgttcaatttttttttatattttaagggggggttaaaataaattgttttgtatttttaagtaaaaataataaaaaaaatttaaaaggggaagagggggggggaaaaaaaaaaatgtggaaaaaaataaaaaaaaaaaaaaagggtttttaaaaaaaaaaaaaattatgggggggacccccaaaaaggccccaaaaaacacgggggaaaaaatattaaaaaaaaacttgttgttctttttggagagggggaaaaaagggggtaaaaaaaaaaaaaaaaacccccggggggggcccccctcttgggggggggggggcgcc

SEQ ID NO: 405 - DNA, 209 bp, Triticum aestivum
  Clone ID: LIB3280-006-P1-K1-H3
cgtactcgtggggccgcagtcgccccggtgtctctttatgcagggccgccccgacgaggccggttcggttctccggaaagtgtgtaacacggtgggagaggcctacttgcggctcgcggacattaagagcgcttccgtttttgttgagggagacgccgtgttcgttctcgcgccctttagttgtggtaaaggcgtgttataggagttgt

SEQ ID NO: 406 - DNA, 413 bp, Triticum aestivum
  Clone ID: LIB3280-006-P1-K1-H5
gggtcggcgctcccaccaagcagcagtggacaccggcggtttgcgcggcgcggcggcggggaccggcggcagaccggccgtgcggcggcaggccatcgggctccgtcagggttgctaaaatggataagctcaggggctctgcgcgtcttatgattgtttcagatctcgatcacacaatggttgatcatcatgacgaagagaacttgtctttgcttaggtttggggccctttgggagtctgtttactgtcaggattctcttcttgtcttttcaacaggaagatcacctactctgtataaggaattgaggaaagagaagcctatgctaactccagacatcactattttgtctgtgggctctgagataacttatggtgaagccatggtccctgatcatggctgggaggaatatttg

SEQ ID NO: 407 - DNA, 275 bp, Triticum aestivum
  Clone ID: LIB3280-006-P1-K1-H6
aggaaattaaaatagggatacccttgtttatgttggccatgcgaaaccaaaacatattgaagcatatcttgtcgagtcgttcgttcgctgaatgctggccgacactgggcgtcgacccgacaacatttttatttagcccacgccacgcgccacccggcgcaaagcaccccacactttgtacgtagtaaaaggcaggagcactccagtccactccattggctgactaagcatcacgccgtgccacgtaggagcacatgaccgccgccgtggacgct

SEQ ID NO: 408 - DNA, 308 bp, Triticum aestivum
  Clone ID: LIB3280-006-P1-K1-H7
gccggagcccggatcgcgcgctgctgttcgccggcgggctgaggcgggcgtccgggcgcgcgccatggacgtggacagcgtctagtgcctctcgctgcccgacgccgccatggacgcggacgacgtcggcctcgccctccacccgcacggggggatcctcgccgccggctcccgcccggtcgcctaccccaaggccggtgccggcgcggggggcatcgtcgcgccgtggagcagcgtgcacgagctgtttgagtgccccggttgcaccaacttcatgtacccgccggtccaccagggccaaaatggac

SEQ ID NO: 409 - DNA, 55 bp, Triticum aestivum
  Clone ID: LIB3280-006-P1-K1-H8
gccgtagacccgatcgcgcgcttttgttcttcttcgagctgaggcgggcgggcgg

SEQ ID NO: 410 - DNA, 264 bp, Triticum aestivum
  Clone ID: LIB3280-006-P1-K1-H9
ctcatacgttcgagcggagccgcctagctttttagagccaccatcccatcggctccggttccgaagggtcagagatggcggaccgtgctaaccacccgtctgtcatgcagaagtttggtggacagtttcacctttccttcagcttttttgagggtgttcgtgctcgcaacatctgcccttctttgccattctatttgaggcgcttaccacaagcatgctacatgacttataactcttttcatctgtgtcctaatgatgttcatt

SEQ ID NO: 411 - DNA, 375 bp, Triticum aestivum
  Clone ID: LIB3280-007-P1-K1-A10
ttgacaagaggatccaagttcacaacaggagcgtaatttctggaggaatgcccctggctttggtattgcacaattgggggctaaagagaggaccacaacaggttgaagcaataaaagggatgggcttgattatattaatttggctggtggtgtaaaatctttttgaggttcagtatgatcattttccaaatccacagcctgaaacccgaagtgataccaatagcacacttttatttacgggccatgttgtttttgaaccttaatttttggttgtggtttggaaaaagggatggaaaatttgtattctggcagggcatttttaaagggccaaatggattaaatttgaaaacctggcttttgttgccagccgagctg

SEQ ID NO: 412 - DNA, 190 bp, Triticum aestivum
  Clone ID: LIB3280-007-P1-K1-A11
gggaaatcagagcagcagagggccctggaaacatagtttttcttttctttttggggaattgccgcacacgaataatgtgattcattaaacaaacagtgactcccctttcattttcgacccgcctttcatctagtcaataaggttttaattgcttctttgcatggacggctccaattttagtggccacatc

SEQ ID NO: 413 - DNA, 409 bp, Triticum aestivum
  Clone ID: LIB3280-007-P1-K1-A12
accaacaaatccccacccaatctcgtctccgatcgactccacgctcgtcgaatactcctcccccaccgcctcaagatgcagatctttgtgaagaccctcactggcaagaccatcaccctagaggttgagagctccgacaccatagacaacgtcaaggccaagatccaggacaaggagggcattcccccggaccagcagcgtctcatcttcgctggcaagcagctggaggatggccgtacccttgctgactacaacatccagaaggagtccaccctccaccttgtcctgcgtctgcgtggtggcatgcagatcttcgtgaagaccctcaccggcaagaccatcactcttgaggtggagagctccgacaccatcgacaacgtcaaggccaagatccaggacaaggagggca

SEQ ID NO: 414 - DNA, 215 bp, Triticum aestivum
  Clone ID: LIB3280-007-P1-K1-A2
tttttccaatttagctaaaagaaagaaacgggggtgaaggcctccatgtccatcactaccatcttttctcgtggtcgttatggccgcaccctccctagctcgtactgacaaccattttgaggactttgtgggccgtctacaaaaggcaggactaacagcccacagtcgacaacccaaaacaaaacaaggcaatgagcttttttaaaacagggaat

SEQ ID NO: 415 - DNA, 368 bp, Triticum aestivum
  Clone ID: LIB3280-007-P1-K1-A3
ctctagtagcctcaccaggcatctgattaaatttgattgaataaaccgaacatatgtgtccaaaatcacaagtgagaagcacaagtaggaatagatattacagtctttgaataggagaaaacggtaaccgataggccagccgaaaactttgtccacgctaacaaagaaacagcaacaaaatagagagacgaagcaggagggtcgcgataaaggctcctcttggctttctttcttgggtccgaagaattagaagcatttcctgtgcacaatggatgggccagactcgtcgtactcagcctttgcaatccacatctgctggaaggtgctgagagatgccaagatggatcctccgatccagacactgtact

SEQ ID NO: 416 - DNA, 359 bp, Triticum aestivum
  unsure (1)...(359): unsure at all n locations
  Clone ID: LIB3280-007-P1-K1-A4
agttgagaaaattgaggagggtaatccttcttctttttttcccacttaaggggtcaccaccccaacttcaattaaaaaggtgttaacacagcaaaagtgacagaggttttttttctaccaagcgcctactgacaggtgctctactctgggaacttgggaagtacacaaaactacagtaaaagaaactgaagcagcgtacatttctaacaaagcataccaggaataaggatattacctaagaaagcaaaaaccagagcacgcatcaacattctgatagttcacagcaccttcttttttttaccacttcaactcattgctttttcttttcattccagnctttggcaacgatgcccagcctc

SEQ ID NO: 417 - DNA, 127 bp, Triticum aestivum
  Clone ID: LIB3280-007-P1-K1-A5
cttagattttaattatttcctatacaaattttatgtgagattgttatgattcaaaatgcctgccctgtgggttctggcctgtgtaaaatctaggggattatccaatttttcaaccttattgcacttc

SEQ ID NO: 418 - DNA, 425 bp, Triticum aestivum
  Clone ID: LIB3280-007-P1-K1-A6
aaggcagcccgattggcaaatggtggggcatatcccccagatctcagccttatcacgaaggcaaggcacgatggccagaactacgtgtttgctcttcttactggttaccatgacccacctgctggtgttcagattcgtgagggtctgcattacaatccctacttccctggtggtgccatagccatgcctaagatgcttatggatggggctattgagtatgaagatggtactcctgcaactgaagcccagatgggcagggatgttgtgtcattcttgtcgtgggctgctgagcctgaaatggaagagaggaaactgatgggtgtcaaatggatcttcctactgtcacttgctcttctccaagccgcatactaccggcgcatgaggtggtccgtccttaagtcccgcaagctggtcctggacgtcgt

SEQ ID NO: 419 - DNA, 342 bp, Triticum aestivum
  Clone ID: LIB3280-007-P1-K1-A8
gcatttgccacatctgtgggacttattttcggctgagataattgttaggtctgcgaagcatgttgtcaaggacatactgaggcaaagcccggaccataatattgcacctgctgttgctcatttcttgaattgtttctttggcaaagttttggctgcttcaacaaaaggtagtactggcagcccgcagtcgaaaacccagaagaaatcaagtcaatcagcttcttcaaaaaagggtcaatctgcattttcccagctaacatctgacggagtttggtctgacattaaggagttcgcgaaacataaataccagtttgaagcgccggatgatgtgagggttggggc

SEQ ID NO: 420 - DNA, 371 bp, Triticum aestivum
  Clone ID: LIB3280-007-P1-K1-A9
cccacgcgtccgaaaaagcagagcgaaggaggagagaagcttcggagctcgggatcggcgatggagacgggagcgaaggcgccgaagaaggccgggcgccgggccggcggcggcggccccaagaagaagtccgtctcgcgctccgtcaaggccggcctccagttccccgtgggccgcatcgggcgctacctcaagcacgggcgctacgccaagcgcgtcggctccggcgcccccgtctacctcgccgccgtcctcgagtacctcgccgccgagctcctcgagctagcggggaacgcggcgcgggacaacaagaagaaccggatcatcccgcggcacgtgctgctcgcgatccgcaacgacgaggagctcgg

SEQ ID NO: 421 - DNA, 430 bp, Triticum aestivum
  Clone ID: LIB3280-007-P1-K1-B1
cggacgcgtgggcggacgcgtgggatctctgccgaatggcaggaggtataaaagagggaataaatgccaagtttttccaagaagcggatgaaaaactcaagctcttggacctggctcatactgaaaagaagccggtgaagggtctggagttgtttctggagagcaccaaggaagccaaggcactcgactccaagcctaagaccatcgtgcagaacgatgccaagaaaccgatgaaggcgttcgacgtgcctgtgaagagtgctgcggtgcacaggtcaaacaggttcttaattcgcaaggaaggcctcgcgctgtgatcagcgcctgaccgtgttgctcgtgatgtacattgcgttattggttgctttgtttgatagaaaatatagaagaagaataacctgcatcccgagtggtgattttccaggataga

SEQ ID NO: 422 - DNA, 422 bp, Triticum aestivum
  Clone ID: LIB3280-007-P1-K1-B10
accaacaaatccccacccaatctcgtctccgatcgactccacgctcgtcgaatactggtcccccaccgcctcaagatgcagatctttgtgaagaccctcactggcaagaccatcaccctagaggttgagagctccgacaccatagacaacgtcaaggccaagatccaggacaaggagggcattcccccggaccagcagcgtctcatcttcgctggcaagcagctggaggatggccgtacccttgctgactacaacatccagaaggagtccaccctccaccttgtcctgcgtctgcgtggtggcatgcagatcttcgtgaagaccctcaccggcaagaccatcactcttgagggggagagcttcgacaccatcgacaacgtctaggccaagatccaggacaaggagggcattccttcgtacca

SEQ ID NO: 423 - DNA, 390 bp, Triticum aestivum
  Clone ID: LIB3280-007-P1-K1-B11
tcgcgcacctgagacgggggagatgcggcggccgtcggcttcgtcgcctccggcgaggggcccggtgttggctgccgcagccgctgtcgtgctcctcccggctattttccccgcgctgttctccccgctcggccgcgccttcccttccctattctcggagtggaatgcccctaagccaatgcacaagtctcttttgaacgcgtctttgcgatggacaataccagatgaacaaaagagagagatctggacacccttgcctgaccaggggtggaaaccatgcataagatcatcgattactcgtgggttaccttcggaacctagtgggtacatacaagtatttcttgatggtggcctgaaccagcaaaggatggggatatgtgatgctgttgc

SEQ ID NO: 424 - DNA, 336 bp, Triticum aestivum
  Clone ID: LIB3280-007-P1-K1-B12
cccacgcgtccgcgcacaccacaaccgcccgccccaacgacatcggagacggaccaggccatggtttacggcggagaggaggcgctgaggcggcagtactccatcggcgacgagatcgggcacggccgcttcggcacggtccgccgctgccactccaacgccacgggggaggcgctggcgttgaagaccacacccaaggcgccgctgcgggacgcgctcgacctggccctcgcggagcaggagcccaagctgcacctcctcgccttctccccgtcctgcagtccgcacctggttgcgctccacgcggtctttgacgacaccgactccgttcacctt

SEQ ID NO: 425 - DNA, 446 bp, Triticum aestivum
  Clone ID: LIB3280-007-P1-K1-B3
tcccggggggggccacgcgtccgcgccccggcgaccacttcgagatccagtggcggaagaacaaggatttcccctacgggtggtggtacggcgtcgtgggtcacctggagccgtgcaacgccaacgagcatctctgccgctgccatgaagacgatacgatcatgctggagttcaagcactacgcggctgggtcgaggtggaggcagacgacggtgagcaggaaagaccaccgggagaagggggacgagaccgacggcttctacggtggcatcaggaagctgcagaccaaagacgagatctccacgtggcggcgattctggccggtggacgtgctcagctgaacatggacatatggccgctcagttgtgcagctgtttatttaccagtggtcgcggagctgcggcgttcctctgaagaatgcacccacctggtggtggtgctgctgc

SEQ ID NO: 426 - DNA, 347 bp, Triticum aestivum
  Clone ID: LIB3280-007-P1-K1-B4
agattttattcttattactgaaggcgtgtgtactttgttcagaactacttttttttttttcttactgttaccatgacccacctgttgttgttcagattcgtgaggttctgattacaatccctacttccttggtggtgccatagccatgcttaagatgcttatggatggggctatagagtatgaagatggtactcctgcaactgaagcccagatggacaaggatgttgggttattcttgacttgttctgcagagcctgaaagggaggagaggaaactgatgggtgacaaacagatctttctactgacacttgctctttttcaagccgcatactaccgtccgatgaggt

SEQ ID NO: 427 - DNA, 410 bp, Triticum aestivum
  Clone ID: LIB3280-007-P1-K1-B7
ggactaccaccgaagagttgactctagacctgaaatcgagcatggatcttactgaagcgctgcgtcttcagatggaagttcagaaacgtcttcatgaacaacttgagacccagagaaagttgcaattgcgaattgaagaacaagggaagtatcttcagatgatgtttgaaaagcagtctaaatccaatacggagaaggtgcaggatctatcctcgggagctacaacaaccctatcatctgaaccaagccatcctgcaaccagaaataggggtgatgatgcagctgatgacctaaatagaacaggagagaaccccgtgagtgccgaaataggagaaactttgatgcatgcaggtggcaaccaggagatggcagaaagcgagtcttctgagccccttgcaaatactaatgat

SEQ ID NO: 428 - DNA, 187 bp, Triticum aestivum
  Clone ID: LIB3280-007-P1-K1-B8
cccactcgtccggcaactcatccggctatacgtgcggtcacatggacgttaaaggtggggagttatccgagaaggggacaaaaaccatggtctgcgcatgacggataaggggatttacaagaaagaggcaggtaaggctgtaaagctttctaaaaatacatggtacaagaatggcagtggtagaggc

SEQ ID NO: 429 - DNA, 372 bp, Triticum aestivum
  Clone ID: LIB3280-007-P1-K1-B9
gactgtacagtatagggggccacataacagggacacatttacgctgcatgtatcggctaatctggcagtaaccactatacactaagcttgggacggtaatacacactcgcaaatttctttgtaatggagtcaacacacgccatccttatcctttcaggcgttgccgggttgtcgagggggaaccagtcgagatggccctcctccgccctagccgccgcgatcgcgttttttatcgcaaacaagacggcggaagcgaggaagaacggtggctctcctacagccttggatgagtgaatggcccttggatttggaacacccttcaatagtgaaacccttgaattgagaggtttttatttacagagggtattttgt

SEQ ID NO: 430 - DNA, 378 bp, Triticum aestivum
  Clone ID: LIB3280-007-P1-K1-C1
ggaggtgaaatcatatcacatcatgcttggacaacaaatcaggtaaagaaccaatgctagcacaggcacatacaatcatcacatgccacttgaaggttccaattcaaccgcatcactcaacaataggacgatcatcatcaccaggaaaagaagaagaaagaaaccaaaactctcaatttgtcctagcaaaaatttggcaacatattggccaccaatcgccgaattaaccgtctagcagctagcctcttctcgcgaatcgcatgaagagggcggtaggaaagaatcccctgatgaacagggtcggctgggagccgcccggacgacgggacgagcttccggagtcttcagcggtgcgccgtgacgagcgtctcgatgaac

SEQ ID NO: 431 - DNA, 396 bp, Triticum aestivum
  Clone ID: LIB3280-007-P1-K1-C10
gcgctcgaccgcctcggcgacctcctccgcaccggcgcgctgcgcgcggtcgccggggtgcccacctccctcaagacggaggcgcacgccgcgcgcgtcgggatccccatgctcgcgctcgccgacgccgccgagatccacctctccatcgacggcgccgacgaggtcgacccggacctcaacctcgtcaagggccgcggcggctcgctcctccgcgagaagatgatcgagggcgccggcgcccgcttcgtcgtcatcgtcgacgagtccaagctcgtcccccgcctcggctgcacgggcgccgtgcccgtcgaggtcgtccccttcggcagcgcctacacgcttggcctcaatcggaaggtgttcgacaaattgccgggcttccacgccaggctc

SEQ ID NO: 432 - DNA, 384 bp, Triticum aestivum
  Clone ID: LIB3280-007-P1-K1-C11
cgccatcactgagagcgcgcgcagcagccactacacacagtatggctccgccgatctgcgccgacgtcgtggtggaggctgcaccggcacctgcgtccatggccgtgctaaaccaaatggtttgcgcgagcgcgccagcgccgatcatcaccgtcgtctccaagcagctggttctgccggagggcgcctcgccggttggagacctcaagctgcccgtctccgacatgcctatgctgtcgtgccactacattcagaaggggctcttcttcccgcccgcgggcatgccgaacgcccgcctcgtgtcgtcgctcgcgctgtcactgtcccgcgcgctcggcgtcttcccggcgctcgcgggacggctcgttacgctccccgacgacc

SEQ ID NO: 433 - DNA, 372 bp, Triticum aestivum
  Clone ID: LIB3280-007-P1-K1-C12
atcgaactcggcggcccccgttccggcgactccggccatgtcgatcttcgagtacaacggctccgcggtggtggcgatggtggggaagaactgcttcgccatcgccagcgaccgccgcctcggcgtgcagctgcagaccgtcgccaccgacttccagcgggtcttcaagatccacggcaagctctacatcggcctctccggcctcgcctccgacgcccagacgctgtaccagcggctcgtgttcaagcacaagctgtaccagctgcgggaggagcgagacatgaagccagagaccttcgccagcctcgtctcctccatgctctacgagaagagatttgggccatacttctgccagccgattattgctggact

SEQ ID NO: 434 - DNA, 383 bp, Triticum aestivum
  Clone ID: LIB3280-007-P1-K1-C3
ccgcagcctggggccgacgctgccgcttccccgcgatctctctcccgctctcttctccccaccaccacccaagtcgtcgtctccgtcgccggccgccatggctccgggcctctacaccgacatcggcaagaagaccagaggtgccgccagtctctctcccctcctctgattacctctccggtgccgatcttgacgatgctgtgatgtgatgatttgcacgcagatctgctctacagggactactgcacgcaccagaaggtcaccctcaccacatgcacccccgggggcgtcgcaatcacagctgcaggaactaggaaaaacgagtctatctttggcgagcttcagacccagcttaagaacaagaacttggcaggtgatatcaa

SEQ ID NO: 435 - DNA, 374 bp, Triticum aestivum
  Clone ID: LIB3280-007-P1-K1-C4
ctcactcgtccggccacgcgtgcggccacgcgtgcggtcactggacgtgttacctttggagttatccgtgtaggcgacaacattcatggtctgcgcatgacggatgaacgtattcacaagattgacgctggcatggttgtcatgcttattaaaaacactggcacaagcatggcagtgatagaggctgctggcgctgctgatatactcacaatggctgaatcgtctggtccagctgttgtacacaccgtggcaaatccccctgctacgactgctatgactgcaggtgagtaggaccctcccacaattgctatgactttcgctgagaatgattcaccactggctggccagcatgtcactcatgtaacttgagccaa

SEQ ID NO: 436 - DNA, 432 bp, Triticum aestivum
  Clone ID: LIB3280-007-P1-K1-C5
ataaggcctcctgtggtcaagaacatggagaaagctctctggttccagttcactgttggttcgttgcctctgtatgctgtgacctttatgggatactgggcttacggatcctcaacctcgagttatctactgaatagcgtccatggtccagcttggataaaagttgtggcaaatctctcggcctttcttcagactgtcatagcattacatatatttgcaagcccaatgtatgagtacttggacacaagattcggcagcggacacggtgggccttttgcaatccataatgttgtgttcagagttggtgtgagaggaggctacctggcggtgaacacgttggtggctgcgatgctcccgttccttggcgacttcatgagcctgaccggcgccctgagcaccttccccctcacgttcgttcttgccaaccacatg

SEQ ID NO: 437 - DNA, 444 bp, Triticum aestivum
  Clone ID: LIB3280-007-P1-K1-C6
ccacgcgtccgataaggcctcctgtggtcaagaacatggagaaggctctctggttccagttcactgttggggcgttgcctctgtatgctgtgacctttatgggatactgggcttacggatcctcaacctcgagttatctactgaatagcgtccatggtccagcttggataaaagttgtggcaaatctctcggcctttcttcagactgtcatagcattacatatatttgcaagcccaatgtatgagtacttggacacaagattcggcagcggacacggtgggccttttgcaatccataatgttgtgttcagagttggtgtgagaggaggctacctggcggtgaacacgttggtggctgcgatgctcccgttccttggcgacttcatgagcctgaccggcgccctgagcaccttccccctcacgttcgttcttgccaaccacatgt

SEQ ID NO: 438 - DNA, 299 bp, Triticum aestivum
  Clone ID: LIB3280-007-P1-K1-C7
agccatctctgtgagcgcccgcagcacgtttttacacagtatggcttcgacgacagcggcccacttgggggtggagggtgtaccgaacaactggttcatcatcgcgcgtaaaccaaatggtttgcgcgagcgcgccaaccgccgtcatcaccttccactggaactaaatgatccgccggagggcacctcggccattggcgacttgaacgctgaccgccatacacatgcctatgctgttgtgccaaaacacacacaatgctatcttcttgccgaccgcgaccatgccttacgcacctctt

SEQ ID NO: 439 - DNA, 386 bp, Triticum aestivum
  unsure (1)...(386): unsure at all n locations
  Clone ID: LIB3280-007-P1-K1-C8
cacagatcggaaacctgaccgcacgccacagccttccccgcccgccccatccgccaccgtcgccatgggcagaggccgaggaggccgcaaccgcaagccccgcaactccgccaccttccgcctctgcccgcgccccggcgccgccgacccctccgaccgcgtcctcgtccgcgtcgacggcaaccagtaccacgtccccggcctcgacgacgacgacgacgcctgctacttcgagggcgccttaggggacgacggcgccgagccctcgtcctccccatctggggcccgccttcccgaccacgtncgccgcgcgatcctcgagctcggcctccccgacgacggctacaactacctcgcccacatccgcgagatccgcccctcatact

SEQ ID NO: 440 - DNA, 369 bp, Triticum aestivum
  Clone ID: LIB3280-007-P1-K1-C9
cgacgtcagcctcaccggcaccggcacgcacctccgggtcttcctgcagcgctggatcgccgatcatcctgagttcgcctccaacccgctctacatcggcggcgactcctactccgggtacaccgtccccgtcgccgcgctcgagatcgccgaccagccggatagcgcaggcctgaacctcaaggggtacctggtgggcaacgccggcacggacgacaagtacgactccggcggcaaggtccccttcatgcacggcatggggctcatctccgacgagctctacgaggcggcgaagggcagctgcggcggggacttcgtgacgacgccccggaacgcgcagtgcgccaacgcgctcatggcgatcaccat

SEQ ID NO: 441 - DNA, 428 bp, Triticum aestivum
  Clone ID: LIB3280-007-P1-K1-D1
cccacgcgtccgcaacttatctgctcccagaagcaaagacgaggccgaggcgaagcagacaccagtaccggattgcctttatgtcaaggttagcatggatggtgctccttacctcaggaaggtggatcttaagatgtacaagaactacaaggacctctcgctggagctggagaaaaagttcagcggctttactgttggtcatggtgaatcgactggaaaatcgggaagagatggattatctgattgtcgactgatggatcttaaaagcgggactgaacttgtgctcacttatgaggataaggatggcgattggatgcttgttggtgatgttccatggcgaatgttcacagacagctgtaggaggatgaggatcatgaaagggtcagatgcagtgggcctcgctccgagggccgccgagaagggcaaga

SEQ ID NO: 442 - DNA, 405 bp, Triticum aestivum
  Clone ID: LIB3280-007-P1-K1-D10
cgccgtgtgggggaacatcatctgggcgcactcggtgtcgaccgacctcatcgactgggtggcgttggagcccgggatctacccgtccaagccgttcgacatcaacggttgctggtcgggctctgccaccattctgcccaacggcgtcccggtcatcatgtacacaggcatcgaccccaaggaacgccaggtgcagaacgtcgcgtacccggccaacctctccgaccccttcctccgtaagtgggtcaagcccgactataaccccatcatcaaccccgactcatggcatcaacgccagcgccttccgtgatcccaccaccgtttggtacgggccagacggacactggaggctggtggttggcagtatggagaacatgtgggtgatctggttgttgttcaggtatc

SEQ ID NO: 443 - DNA, 302 bp, Triticum aestivum
  Clone ID: LIB3280-007-P1-K1-D11
ccaacaaaatcattggtcacatcccaagaagttaaatacaattcgaaccattattcagatcagttaatttcgccggcggggggactcatacccgatttattttaccccacgcgtattacaaaacccataggattttcggcaaatttttattcacctaacaaaacttcgctcatcttaattcttactgatgatgactctacagcggctgtggcctgctctgcactatgtagatgtcctccccgaccatgcagccctccacgtcctgggcgctcccgaacctctgctccaggtactgccccacg

SEQ ID NO: 444 - DNA, 427 bp, Triticum aestivum
  Clone ID: LIB3280-007-P1-K1-D12
agcagtccggcgaaggcgatggccgcgttgttcacggcgaagctagggcgtcaggcgtccgggtacctgcaggacaagtacaagcaggcgaggctggccctcggcgacgtaactccggcagagctggctgtgcaggaggcgaccaacgacgacgcgtgcgtcccggacgccaagacgctggcgtccatcgcggaggcggccttcgacatcgacgactactggcggatcgccaacgtgctccaccgccgcctcggctgcgtccacgactggaaggagtggcggccggtctacaaggcgctcgtcgtcctcgagttcctcctcacccacggccccgaggagctccccggggacttcctcccggacatgcaggccctgcgcgacctccgcggcttcacctacaccgacgacaagggcttcgactggggcg

SEQ ID NO: 445 - DNA, 365 bp, Triticum aestivum
  Clone ID: LIB3280-007-P1-K1-D2
gaaaatagaacggttatcataatttggattgatcatgaacggggcacagaagtacaagacttggttttgaagacttggcctcatacaaatgcgtttctaaatgctgtggtacaccatacacagcatgtggaaacacaaaacaacaaatgtaagggggtcataatactcataatacgctccagaagaacgtagactgctacttgtactcttcattcatgctaacctgtcacggcgcttctccaggaagcgctgaagggagtgtctcctggcgatgggaagatcagcctgaagcttgcaaatcgagcccttcagcaaatccgggacaggttaccaatttttatggtgggtcagtatgagtgtatgac

SEQ ID NO: 446 - DNA, 326 bp, Triticum aestivum
  Clone ID: LIB3280-007-P1-K1-D7
cgaccgatcaccacacacagcagcagcatggctaccaccagctgtgccctcctcggcggcctcgtcgtcctggccgggctcgccgacctgcaggccgccgcagccgccccgaggcccgttcacgccgcggagcacttctccatggcggcaatgacggcggagcacccaatggcggacgaggcggacccggacctgaacgggatgatgcagtgcatgttcgggtgcttcacgtcggtgatgagctgcgcgttcgggtgcatgggcaagggccccgacctgccgctctgcgtcatcagctgcaaccagaagagcatcgtctgcatgat

SEQ ID NO: 447 - DNA, 384 bp, Triticum aestivum
  Clone ID: LIB3280-007-P1-K1-D9
cacaaggttggctcattcagaggccaaattactgcatgagaagattgagcataagggtgatggtgatgatgaggtcatcagaattctcaccactaggagcaaagctcagctgcttgcaacattcaataattacaatgatacatttggtcacccaatcactaaggatctgaaggctgaccccaaggatgagttcctcaagaccctgcgggctgttatccggtgcttcacctgccctgataggtactttgagaaggtggccaggctggccattgcagggaatggaacagatgagaactccctcactagggtcatcaccacccgtgccgaggtggacctgaagctgatcaaagaggcgtaccagaagaggaacagtgttcccctgga

SEQ ID NO: 448 - DNA, 312 bp, Triticum aestivum
  Clone ID: LIB3280-007-P1-K1-E1
gattaatgcccttaattacacgatcgacattggcaaaagaaagacaaaaattgattgatctcagaattagggaatgaatgttcccctaatacaaaaacaatggcatataaataaagaaaagaaaaggaaaagctttgggcggcgtacgtgacacatatggatcagcacgtacgcattattattacaactgatcgagggaaagaggccatggcgaccgacggacggacggatggatcattgctctagacccatctcatctcatctcatctctggccggtggatcctcaatcggaggtgctggagctgctgggc

SEQ ID NO: 449 - DNA, 123 bp, Triticum aestivum
  Clone ID: LIB3280-007-P1-K1-E10
gggcgattaaaaccttattgactagatgaaaggcgagtcgaaaatgatagggacgtcactgtttgtttaatgaatcgcattattcgcgtgtgcggcaatcctccaaaaagaaaagaaaaactt

SEQ ID NO: 450 - DNA, 369 bp, Triticum aestivum
  Clone ID: LIB3280-007-P1-K1-E11
tcacccaagcgttcggtcttgttgttaagttgaaacaaccccttccaccagggctggaacgaggggttgttttcggcaccagaaaaaaccagaaccgtttttatgggggttccaccccccctccaattagggtgttagggccaaacctttttcttgggacccaaattaagcccacctccaggccccagaaggcttgtggaataattctttaagttggggccatgaccacccgcaggttagggaccttttaaggacaaaatattcatgggagggagttttcgaagggggtcgtatgggtttcgataaactgtttaataaaagaaaggcttcccaaagcttttttttcttctcaagcataaaggatttgaa

SEQ ID NO: 451 - DNA, 128 bp, Triticum aestivum
  Clone ID: LIB3280-007-P1-K1-E12
agccggtgaaccactactgaattctgatcatctacacaacacaaaaacttagatagccaaggccgcaagaacacttactggtagtagtagtgccgtatgaacaaaatcagggggacattaatgaaaga

SEQ ID NO: 452 - DNA, 257 bp, Triticum aestivum
  Clone ID: LIB3280-007-P1-K1-E4
cggcaagatctcagagatgcgatcgtcgtagttgtagtggtggtgcttgcactgctagaggtgtagacaaacgcagcttgtagcccaatcctattatcaagttgggctctggtatgcaacggatgaaacgtctgtgtaaagaactgtagtctcagggtctgtgtggtcagctacgtccgagagtggtttgtgtgtcgtccccatgggtaattttttttctctccctggtgctaaatgagactttgatgctacggatg

SEQ ID NO: 453 - DNA, 424 bp, Triticum aestivum
  Clone ID: LIB3280-007-P1-K1-E7
cccacgcgtccggctggacattggcccagattcagtcaaaacatttaatgatgggggggacacaacacagacaatcatttggaacggaccaatgggtgtctttgaatttgacaagtttgcagtaggaactgagtctattgcaaagaagttggccgagcttagcaaaaagggtgtgacaactatcattggaggcggagactccgttgcggctgttgagaaggtgggagtggctgatgttatgagccacatctcaactggtggtggcgctaggcttgaagctgttggaaggaaaggagctgcctggagtcgttgcacttgatgaaggtgtcatgacgaggtcggtgaccgtatgaggctaagcttcattttgtcgcgtctcaattcctttcatgtaccggtctaaacctgccatgttgccctccct

SEQ ID NO: 454 - DNA, 425 bp, Triticum aestivum
  Clone ID: LIB3280-007-P1-K1-E8
caacccccaagcaccagagcctcctcaacctcccggcgccggcgcatcgacggcatggcccgcaccaagcagacggcgaggaagtccaccggcggcaaggcgccgaggaagcagctggcgaccaaggccgcccgcaagtccgccccggccaccggcggcgtgaagaagccccaccgcttccgccccggcaccgtcgcgctccgggagatccgcaagtaccagaagagcaccgagctgctcatccgcaagctgcccttccagcggctggtgagggagatcgcgcaggacttcaagaccgacctccgcttccagtcctccgccgtctccgccctgcaggaggccgccgagggctaccttgggggcctcttcgaggacaccaacctctgcgccatccacgccaagcgcgtcaccatcatgcccaagga

SEQ ID NO: 455 - DNA, 297 bp, Triticum aestivum
  Clone ID: LIB3280-007-P1-K1-E9
aaaaatcttgtaaaaaaactagtaatgtaaatatataagaaaaagactagtacggataggattattggaagctaggcaaaagggccgttataatcgagctggacggagccgccccacatttggcctttccttttgggcacctcgctgagggtcacgccctgggccgccgccagaacctcaacctcaacgcccccgccatcgagccggacacttaccaagggcttgattgggcctggggccccccccggccgccctttctcctggtagaaggccacctagtagccccgctttacgttc

SEQ ID NO: 456 - DNA, 339 bp, Triticum aestivum
  Clone ID: LIB3280-007-P1-K1-F10
actagttctagatctctagcctgcgccgccgcctccaccgcacccccaaaacccgagcgctcgctccgccccaccaccatggccggagcgcaggagtccctcgtgtacgccggcgtgatgcgcggccacaacgacgtggtcacggccatcgcgacgcccatcgacaactcgcccttcatcgtctcctcctcccgcgacaagtcgctgctcgtctgggacctcaccaaccccatccaggccacccaggactccagctccgagtacggcgtcccctttcgtcgtctcaccggccacggccactttgtccaggacgtcgtcctcagctccgacgggccagtt

SEQ ID NO: 457 - DNA, 388 bp, Triticum aestivum
  Clone ID: LIB3280-007-P1-K1-F11
gtggcaatgggagctagattataaaggcaatagtagatctttgacgcattacagtctgcactggtagcaaaaaggttggaataacagatatccctgacagtcacacaacgaagaacagcggaatactttcctacatacgaaccagaccaaaacatagttctgacagacagtctactcatcctcctggctgcggagcctggcaagcttgttcgtaaccacgatgtcgagctgcgcggcacgctcaacaatgtccttgcgcttctttgtggagacgttgtgggcaatctccgcacagtaggtcctgttgtgcatcataagcagctccagctcagacacattgtggacaacaaacttcttgaactttgtgggaaggtaatgcctggtcttc

SEQ ID NO: 458 - DNA, 386 bp, Triticum aestivum
  Clone ID: LIB3280-007-P1-K1-F12
agaaatcatccggtctccgatttcataagaacaatagatacattaatgcacaatcttcactcaaaccttaggtctgcaccactctaatggcaagaccaggtacatcttatttcttatcagaaacggcaagcaggacaggacaccatcaactctcaattgcgacaccaggcgctgcaacctcgatcatcctcggcttcttgctggttcctgtcaagatggttgctgggagatgctcctgttcataggccgagagatggactccaagtgctgctctccctgagggatccaggttccccgaccactgagcatcccactctaccgcctttgccgtgctgcatgcaacgcttggcccgcctggcaccgtcaggatcgccgagttctggggg

SEQ ID NO: 459 - DNA, 422 bp, Triticum aestivum
  Clone ID: LIB3280-007-P1-K1-F3
gaaaggaagcaagcgtccattggttgaagaaagtttcttcacctggttcactgatacagagcacaagagccttgctgatggggtgcaagatgaggtggcagagatcatcaaagaagatttgcggccgaacccattgaaatatttcaacaatgaggttgaagagtttgaaggagatgacgaggatgaagagggatctgatggggaggatgctgaggaggatgaggacgaggagaactgaggccttggttggctttggtgggtcctgatgaatcgttgtctgcagaggctgtgggtatctgaagggtgtagtcatgtgaccctttcgagactgttttgttttgtgtttgacttagccggaacttagccttaggagctgttgaatgcggtatcgagtacgtactgtcgtattttcgacttaaagg

SEQ ID NO: 460 - DNA, 249 bp, Triticum aestivum
  Clone ID: LIB3280-007-P1-K1-F4
ggacgaggtagcaatctgctcccaggagttctataagacatagtacaagtatacaacattggggaagtggcatgctggaaccaaagtggcagcttttttaatcctatatcactcctggcatcagaaactgcataagaggatccaaaagcgaacacaaaattcctgatacccggggttttaaaataaaagcacaatttttgggcaaacatcaaaacaccacttgaagttccaaaattgggattggtttta

SEQ ID NO: 461 - DNA, 435 bp, Triticum aestivum
  Clone ID: LIB3280-007-P1-K1-F5
accacgcgtgcgcggatgcaaggggggcaggtccagatgaggcgagatcccagcagggcgagacgggggcggccagccgcggtcgcgttcgttcacctaccagagctccacggtgacttatggtgggattaatggagcctactacacagcttccaagacccggaggagcggcagcgatgggatcactgtcgaagaaagcaaggaggcagatactacgactaaagaggccactcacaggatctccaggggaattcatgataagggacactcagtaacaaggaagctgaaatcagatgggaaggtggacagtacacagatactgcacaatctcaatgaagatgagttacctggatttgaagaatcatggaagggcagtgctggacaacacttaccaggctggaaccagaatgccggtatatctaatggtgacaactc

SEQ ID NO: 462 - DNA, 365 bp, Triticum aestivum
  Clone ID: LIB3280-007-P1-K1-F8
gccaagaacatgatgtgcgccgccgatccttgtcatggccgttacctcaccgcctgtgccatgttccgtggaaagatgagcacaaaggaggtggacgagcagatgatcaacgtccagaacaagaactcgtcctactttgtggagtggatccccaacaatgtcaagtccagcgtctgtgacatcccgccgacggggctctccatggcgtccaccttcgttggcaactcgacctccatccaggagatgttccggagggtgagcgagcagttcactgccatgttcaggaggaaggctttcttgcattggtacactggtgaaggcatggacgagatggagttcaccgaggcggaaagcaacatgaacga

SEQ ID NO: 463 - DNA, 399 bp, Triticum aestivum
  Clone ID: LIB3280-007-P1-K1-F9
gaacgaacatatattctggcgatgcgatttctgcacaaaagaaaggtcaagctcttgatttacaccgctatgtgaaaccacagtaaccgaaagaagaaaactgctgattatacaggataagaattgtacggcctacagaacagcaaattgcatggagataaaaattccacacgaagctacctagtgacatggcttcctttccctatccctagctctttggcgaggtcccgcgtgagggtgatggcatgcgtgttatgccatgggaaaagggtgcgggtaaccggaagtttcctccgaagatccttgaacgttgcgtcggagagattcaagtatgattcctcgagagatgaaaaatactcggactcgtgatgccgaatgatgttagcaactgtgtgtgca

SEQ ID NO: 464 - DNA, 410 bp, Triticum aestivum
  Clone ID: LIB3280-007-P1-K1-G1
cggacgcgtgggcgtggagcacgaccggcggaaccaggagggcgcgttccggcggatcctgcggcgggagtaccggccgtacctggtgatggcggtggcgttccccgtgttcctgaacctcaccggcgtgaccgtgtcggccttcttctcgccgatactcttccggaccatagggttcggtagcgacgccgcgctgatgggcgccatcatcctcggcctgatgaacatcggcggcatcatcgcctcgggggtcgccatggaccgctacggccggaagctgctcttcgcgatcggcggcgcactcatgttcacctgccaggtggcaatggcgagcattgcggggacgcacctggggcacggcagcaagatgcccaaggggtacgcggtggccgtgctggttctcacgtgcg

SEQ ID NO: 465 - DNA, 443 bp, Triticum aestivum
  Clone ID: LIB3280-007-P1-K1-G10
cccacgcgtccgctataggagtgaaggaagtgacggtggacgcggccaaggacctggtgaaggtgactggcaccatggacgcagccgccctgccgggctacctcagagacaagctcagtcggcctgtggaggtcgtcacccctggcaagaaggacggcgacaagaaagacgacggcgagaagaagaaggacaagggagccggcgacggtggcgaaaagaagaaggacggcggtggcgaggacaagaaggacaagtccgcggcgtccgtggcgccgatgcccatggcggacccgagcatgtaccagatgcccccacagtacggctacatgccgtaccccccggcgcccgtcggctactacggcgcggcgccgtcgtcgccgaacccgggcttctacccgaacgccggtccccagtacccgccgccctacgcgacgtaccccgct

SEQ ID NO: 466 - DNA, 440 bp, Triticum aestivum
  Clone ID: LIB3280-007-P1-K1-G11
aaaaaagcaggcgactcgcacgcacgagcgagagtgccctcgagcgaggcctccagatttcgccgccgctctcgcacttgccgtcgccgatgcctgcgctacctcgacggaagccatcgcaaatccatcccttcgccgccgccctcgcgctcgcatcaaggatcgaggactccagagtgccctaaatccctgcgctacctccgttcgtcgccgccgatctcgtcgctacgtcgctcgccacgggcagggatcggcgtctcgccggcgtggagcgtggcaggggagagaagggtgggtaagatcggcggggcagagttcatccggaaggacggcgcggtggacgacatgtacggatacctcaactacctgtcccttgagtatgactcgtctcggacaccaatcctgcttggctgatctgctatggctgcggttccttgtgg

SEQ ID NO: 467 - DNA, 130 bp, Triticum aestivum
  Clone ID: LIB3280-007-P1-K1-G12
acgaaaaaagtaggcgactcgcacgcacgagcgagagtgccttatagcgaagacaggagagggagacatcgatctggcacttgccatctacgatgcctgcactacctagacagaagccatagcaaattca

SEQ ID NO: 468 - DNA, 337 bp, Triticum aestivum
  Clone ID: LIB3280-007-P1-K1-G2
tcgcccaaatctaaatatattgctctcctgtttacgtttgcatagccacgtctgcaaagaagatggataggaagagttccgatggagaaactgtccaggttgatgaggcggtggctctcgagtcacacaccatagcgcatatggttgaagactactgcgtagacatctgtttccctctttctaacgtcacgagcgagctcctcggcaaggtgatcgagtattgtaagaggcacgtaaaggctgttgcctctaaggtcgtggccgtcatgggtgctgcttccttcgatgactatcttaaggcctgggacgctgtatttatgaagatcgttcaagcttc

SEQ ID NO: 469 - DNA, 429 bp, Triticum aestivum
  Clone ID: LIB3280-007-P1-K1-G3
ggcggtttgtggtaaagtagtgtgtggagcaatccggagtgattccaaggttcttgtgatgccttcgggagagctagctacagtgaaaatcatcgagcgggactcctctcgtctcagctcggcaagagctggcgacaacattgcgattgggctgcaagggatcgaccctatccacgtgatgtcgggtggagtcctgtgccacccagattaccccgtgtcggtggcgtcttccctggagctgaagatcctggtgctagacatcacagtacctatactgccgggccttcagtttgagctccacgtgcaccatgcgaaggtgtcggcgtccctggtgaggattgtgtcgctgctggaccagaagactggcaaggcctcggcgaagaagccggggatgctgactgcgaagcaggctgccatcgtcgaggtgaa

SEQ ID NO: 470 - DNA, 211 bp, Triticum aestivum
  Clone ID: LIB3280-007-P1-K1-G4
attaaaaaaaaattattttttattttttttaaattaaaaaataaatatataactttattctttaattttttaactatataataaaattaaaaaataaataaaaaaaaaaaaaaacccctcataatgcttaaataaaattactacctcactcctctctttttttttcttatttttatttaaaaaaaacaaaataaattattttttaataatt

SEQ ID NO: 471 - DNA, 203 bp, Triticum aestivum
  Clone ID: LIB3280-007-P1-K1-G5
gccaaagcataaatcaaacccagacccgtgcccatatattcatccatccattttgaggcgggtgaggttttttcgatttcgttcagatttaactttattcttttttttactttaggttttactttcgaacttaaacttttatcttttttttttttattctatttcattttatcttgtgtagatatttttttttttattttctt

SEQ ID NO: 472 - DNA, 313 bp, Triticum aestivum
  unsure (1)...(313): unsure at all n locations
  Clone ID: LIB3280-007-P1-K1-G6
cccacgcgtccgcgatcgtgcatctccccttgtaccactttgaagacatcgaccacagtagcgatacggctacatccggagatgcgtcaagttcaacttccttcatgggaacgactacctctcgcgggcgtgtatcgtagccttgtaccatttcggttcttcaaggccaccaagttccgctacgagatgtacccataccatcgccgaagacccgtgtaacacaagcgtcaagttctgctaccgtcgcgagaacgactactttcactaaaaaaaaaaatnatcaaaaaaaaaaatggttaggataaaattgaag

SEQ ID NO: 473 - DNA, 411 bp, Triticum aestivum
  Clone ID: LIB3280-007-P1-K1-G7
cccacgcgtccgggccgccctttgtttattttgctgggtaaaaagcatggtatatgggctctataccgcctgtcactttgtactccctcgccccggctggcgcacggccgagagagtagcatattctttactttatactccacaagagaagagagacgaagaactaatcgtggatcgaatagtacgaagggctgcactcgtgaatcaatcaatgctggccgagcgcgaagcctatgccgtggcgtgtggcggagaaggtgccgaagagcatgctcccgaccaccccaatgacgatgggcagcacggcgagcacctgcgccgtgaccttggacgacacggactagaagcaggacacgacgttcgcgtccaagagcgcgactgtcacgaagaccatgacggttacgacggctt

SEQ ID NO: 474 - DNA, 202 bp, Triticum aestivum
  Clone ID: LIB3280-007-P1-K1-G8
ctcacttctttcaactacaattttaccatataaccatacatataaacttacaatggggggtcttaaacatgcttgagcagcgtctctatataaatacattcttcattcctagcaagtactatatattttactcataatacatcttaggatatatgagccatcgaatcattcactttttgaataataaaaagatcaaatttta

SEQ ID NO: 475 - DNA, 457 bp, Triticum aestivum
  Clone ID: LIB3280-007-P1-K1-H1
cgaaattccggggggggcccacgcgtccggacccttttccgccgtacacgcccactctccacctaagcgcgccagggaattctctcgcgccgctcgccccttcgtccccgccgccgccgtcgccgtcgccctcctccgcgcggaggggatccgcccgggcccgaactcgacccctcccgctggacagccgttgcagtttggtctcggagaagatatcggtgtgcttatctactgcggcatggaatgaaggtcttgagtgccgtgtctttttgccgagcttgacactagttgcgcttcgcctcggaaagtaacaaaccatgacttctgtcgccgacggtgtttcaggtgatcatagagctgatgagcagcagaagcaagctgccgctcaagggaaccaggaagaggccccagctactagtataggtagtcaggcaatggtggcaacaccttccacaga

SEQ ID NO: 476 - DNA, 419 bp, Triticum aestivum
  Clone ID: LIB3280-007-P1-K1-H10
acgcccacgcgtccgccgtattgatcaattcacttcggtctgatcataccgtgatcgaggccttgatcgatccatccatccatggccatcaagggcaactctggtgagtacaaggcgcggagcccgctgggcatggtgatcaccgtcctgctgtgctgcttcttctacgtgctcggcgcgtgatagcgcagcggctacggcatgtgtgaccgcatcgcggtggcggtgacccggcatacggcctgctccggcgcctctgccggggggctcagtttcgagacgcaccacaccggcggcctggccaacgcgacgacgtacggtcttggcggcgagccgccgtcgccgtgcgcggcagcgcttgcggaccacactccctgccacgaccaggatcgcgccatgaaattcccgcgcaagaacat

SEQ ID NO: 477 - DNA, 400 bp, Triticum aestivum
  Clone ID: LIB3280-007-P1-K1-H11
cccacgcgtgcgcccacgcgtccgcttccgctggttgcttggttgctttgaagtcggagctgcggtggagtgtgttcaggcggtgactatgacaggcgctcggtggtcggtttcggaggggacgggcggcgcaaggactgcatattttccttggatgaacaacggcaaaaatcgagttttttggtgttcacgcgtgtggccttctgttggcatgtgccatcatggttttctgtgcagctgtttgtagctctattatcccatgtcggtggccaggttggccgatggtgcccatgttatgttgggtgagttgtaatggttttagcccggtttttagtcaattaaaacgggcaattcttttttttttaataaaaggaaaatggcagattttttgcctttgttt

SEQ ID NO: 478 - DNA, 352 bp, Triticum aestivum
  Clone ID: LIB3280-007-P1-K1-H2
gtattagaactgacttattctgaactaaatacaattatttcatggtcctatatataagcaacaagaaacaacaaaacgtctagaaaacgctaactatagaagaagaaaaaggaaacccaattggccgtacgtctagatgcatggctctgggtgctggtagccaacataggtggcattggcgttctcgcagtgtgacaaggtgcctggctggcccgtggagctgaggtcgacggtcttcaacaagacgttgcgggacgggacgccggaacggaacaagacgggcacgggcaacgtcgatggttccttggtggttctggacttgatggccttgattgtgaccccgggagacgta

SEQ ID NO: 479 - DNA, 226 bp, Triticum aestivum
  Clone ID: LIB3280-007-P1-K1-H3
ggctgatccaaggcatctcaatcttggtcttcgacgacgacgaggcctccgggaaggtgcgcgttcgcgtgcgccgtaagcgcaaccgtcacccggtctaggaccacccgacgttatcttctacgagccgcgcggttgggcggaccgattctgctacccgatctggccgtcttcttgttggactattagtactattgcctgtccacgtactactcattcaccttgt

SEQ ID NO: 480 - DNA, 378 bp, Triticum aestivum
  Clone ID: LIB3280-007-P1-K1-H4
gcaatcgaaagaaacatagtactgatagtttccttttgttatttattccaagagaaaaaagttgaaagaaacagtggactgacgcatgggaaataaaaaagatggcgccaaaacaaactccggcggtgaaactaaacggcgacgagacgcccgacgacctcgctacgaccatgagtgacacgatacaacatcaccggccggttcgaccggtgatagatatagaaagagctcgccctcacacggtgagcccgcgcatgaactcccactcctcgtcatcatcctcggcggcgccggcagccgacccctccgagtcgctgctcatgccgctcgactccgcgccggtcatggccgaggcctccttggcgttgaacgacaggt

SEQ ID NO: 481 - DNA, 434 bp, Triticum aestivum
  Clone ID: LIB3280-007-P1-K1-H5
aacagttgtgctcgtggcagcccgaagcgacaggaaattttcaagaaacatggcctgttccaggcgccttatatcgaggatcctaacacgggggtcaagatgttcgaaagcgccgagatcgtggagtacctaagggcaacatacacactctatcctcagtaccaaaatctctgaagtgtcgatatatgatggcgacttggggttatatagtagagaagcaagaactgggccaagtattctcaagtaccggcaattgtcaccctttgagatttttttatagtggtgcgaaaccatgtggagatgattttgtagcatgggaaacatgttggatttatgatgcaaaggaagacatatgtaatgtgtgtaatcatacataggcaaatacggtagtcgaaactagaaatacttttttgcagagagaaactagaaatact

SEQ ID NO: 482 - DNA, 347 bp, Triticum aestivum
  Clone ID: LIB3280-007-P1-K1-H6
cgtccggctatttatagatggcgggcggcctctctagaggatgcaatcttacgtccgcgtgcgtggggagagatattttatttagtgtgctaactaaaattaattgaccggccggtgacaaacaaccgactggctggaaaaaccctggccttacctaacttaatttgctgggcagacatccttcttttgctagctggataaataaaagagagggacggaccgatcttccttaccaataggtaggctgactggatggtgggaggggccctccctcggccggttcaataagggcgggggggggggtgggttcactcagaccgatccatttacttgcgcgcgagcgcgcg

SEQ ID NO: 483 - DNA, 417 bp, Triticum aestivum
  Clone ID: LIB3280-007-P1-K1-H7
ctcagttgcgacaacggcaactctaccacagaaccatacatagtagctcaccatgttgtccttgcacatgcctcagcagcgtctctatataaagacaagtaccaggccaagcaaggaggaaatattggactcacattgctcggttggtggtatgagcctgcgacgcaaacacctgaggatatagcagcagctgaaaggatgaacgacttccacattggatggtatatgcatccgttagtgcacggagattaccccccggtgatgaggaagaatgttgggtccaggctaccatctttcaccgacgaagaactgaagagggtgctcggatctttcgattttgtcggatttaaccactacattgcgttatatgtgaaggatgatcttagcaagctggatgatgagctgagagattacatc

SEQ ID NO: 484 - DNA, 94 bp, Triticum aestivum
  Clone ID: LIB3280-007-P1-K1-H8
acgaatatagatagagggcgagcgctctatataaattaagcaatcttacgctcgcgtgggaggtaaaaaatatgggatagagtgacataaataa

SEQ ID NO: 485 - DNA, 230 bp, Triticum aestivum
  Clone ID: LIB3280-008-P1-K1-A1
taattatttgggcatcatattcaaccactttaagcaatacattttgttacttaaaccacctgatgaatgaagaaatgactctttaacagccacctatctcatttttcttaaactggctgacatgaatcccaacaaaatggatggagatatacatacatgctactataaggagctataccttaccaagtacaaattggtgtgctaatttgatacactttatgaggcacaac

SEQ ID NO: 486 - DNA, 414 bp, Triticum aestivum
  Clone ID: LIB3280-008-P1-K1-A11
cccacgcgtccggccggcgccggcccccctcctacctacccggacgagatggaggacggtgtgtcaacttatactgtcgatgaggcgctggtgtccatggggttcggaaagttccaagtgttcgtgcttgcctattccgggatggccaagatctcagaggcgatggaaatgatgcttctgtcgtttgttgggcagtcggttcacgctgaatggggcctttctgcacaggaagagagtttcatcacaagtgttgtatttttagggatgctcgtaggagcatactgttggggcttagtttcggacaactacgggagaagggttgggttcaacttcacagcccttgtaaccggtggggcaggtcttttcagtgccttcgcgccaaactattcatctttgattgtactaagatttttt

SEQ ID NO: 487 - DNA, 241 bp, Triticum aestivum
  Clone ID: LIB3280-008-P1-K1-A12
caaatgtctttgtaactgagacaactctagtctacattttatgcaaacattgcttattctggtttttacatacaatgacagcaaaattaaatagctgatcacacaccgattctgaatggcatgacctttccgatcacgcacagaacctcgtctactacatcttttcttctctttttgaactagagtcctagttttatcatagcatcatgtttgttatttaacctaagtatatatatcgatc

SEQ ID NO: 488 - DNA, 428 bp, Triticum aestivum
  Clone ID: LIB3280-008-P1-K1-A4
cggacgcgtggggatcaagatctggtagcgctgagcttgttttgcgttggatatactgcttactagtaattcatggtcgttttatcccctcggagaaatcaagaaaactaattagcgacctggagaagatgtgtgcagaaagatacacagcaactgaagatttactgaagctttctggtcgtcttcggctgataatggcacaggttgacaaggatgtgaaagatgtatcggcgaaggccgcagtccaatctgatgaagaggaagaagatgaaattgatgaaatggatggtgaagacgtggatttgtctgaaaatagtgacgatgatgctgagtagaatcgccgcattgttggcatgtctccaagagacttttcgactttgtgtacggtcaagatgtatttttcaagcttagagcccatagtcgagttt

SEQ ID NO: 489 - DNA, 422 bp, Triticum aestivum
  Clone ID: LIB3280-008-P1-K1-A6
cacacgcaaggagcacgaggaggaggcaagggaagccgccgccgccgccccgtccctcctcgccggcccgccgcgacaggtttcaagatgtcaacctgcacgtttgcgacctcctgcgtgctcttgggcaatgctcgaacaaccgatgccccccagaaagcggtcaagagccgcctgagcttccttggccgaggcgccgtgcaggtgccgagcctgaggtcctcctctttcaagaagctggacgtctccgcggcggccacgtacaaggtgaagctggtgaccccggagggggacgagcacgagtttgaggcgccggacgacacctacatcctggactcggcggagacggcgggggtggagctgccctactcgtgccgggcgggggcatgctcgacctgcgcgggcaagattgaggcgggcgc

SEQ ID NO: 490 - DNA, 163 bp, Triticum aestivum
  Clone ID: LIB3280-008-P1-K1-B1
tcgctatacatccaatatgatgaatttgacattgctgctaccactattatgaaccattctgcagatgcatgggatcatatgcaatttaaggatgttgctgttaaggttgcaaatgttgagaaatataacaaggctgcgcacttttatttgcaagaacaccctg

SEQ ID NO: 491 - DNA, 156 bp, Triticum aestivum
  Clone ID: LIB3280-008-P1-K1-B11
agcgaatcactgtaaatcttccggtgcgttctttctggttttgctttagtaataatttgagcaacttaccagaaatttgccaagttataactggaaacaccaagttatagctggaaataagatcgaaaatataaagaaacgttctcttttgcatcc

SEQ ID NO: 492 - DNA, 204 bp, Triticum aestivum
  Clone ID: LIB3280-008-P1-K1-B2
cccacgcgtccgcccacgcgttcgcccactccgtcgagaaacagcaacagccacaggcacacgcccacgcgcacacaccagatcgtcgacagcgatggcaaaggcagcggcagcgggaacgagggaggagatggtctacatggcgaagctggcggtcaggccgagcggtacgaggagatggtcgagttcatggagaaggtcgtg

SEQ ID NO: 493 - DNA, 420 bp, Triticum aestivum
  Clone ID: LIB3280-008-P1-K1-B5
caccagtcccgcccgcccccagctgcccacaggcgccatggcgcgggaggagctgtcgacggagatcgtgaaccgcggcgtggagccgtcgggcccggacgctggctcgccgaccttctcggtgcgcgtgcgccgccggctgccggacttcctgcagtcggtgaacctcaagtacgtgcggctcgggtaccactacctgctcagccacggcgtgtacctggccaccatcccggtcatcgtgctggtgtgcggcgccgaggtgggcagcctcagccgcgacgagctgtggcgcaaggtgtgggacgaggccacctacgacctcgccaccgtgctcgccttcctcgccgtcctcgccttcaccatcttcgtctacattatgtcccgccccaggcccatctacctcattgacttcgccattta

SEQ ID NO: 494 - DNA, 352 bp, Triticum aestivum
  Clone ID: LIB3280-008-P1-K1-B7
gcgtgagaagctcgaaagccgcttcattttggatgtaacggtgctggatggcacacttatgtcaccttcaagcccgttcactaagatttggcgcatgcacaacaatgggtctatcatgtggcccttgggcacacagctaatttgggtgggtggagatcaatttgcactgcagacctctgtcccactagagattccattgaatggatttccggtggatcaagagatggatgttgctgttgattttgcggcacctgcaaggcctgggaggtatatatcttactggagactggcatcactcttttgtcaaaaatttggtcagcgagtttgggttcatatccaggtggaagaatca

SEQ ID NO: 495 - DNA, 319 bp, Triticum aestivum
  Clone ID: LIB3280-008-P1-K1-B8
gtcacccgcgatgcaaatcactcctgccaggaggacgcacctgccatttccagtagttcgtctttctctctgactcggaggggcatcagccatgggagatcaggaggagcaggggaagaagattggcggcgatggcggtgggaggacgaacaagtacgcagtcgcctgctccgtcatcggctccatcatctccatcctcatgggctacgacaccggcgtgatgagcggcgcgatgctgttcatcaaggaggacctccggaccaacgacacgcaagtgcaggtcctggccggcatcctcaacgtctgcgcgctcgccggc

SEQ ID NO: 496 - DNA, 343 bp, Triticum aestivum
  Clone ID: LIB3280-008-P1-K1-B9
cgacggtcggacgccgtgaggagctcgacccctccaccactgctcccccccttctctgctactcaccgcgggcgaccaaattaaggcggggattagggtttacgccaccgccccctcccttcccctgtctccctctgcggcgaccccagccacctcggagccccccgctcgtcgctttgcatcgacgccccagaccctcgccgcggagcccagatcgccgaccaagctcgtcacgacgctgggcccagccgacgacacccctatcaactaaaagatggaggccaatctgaagaaccaggcgaccaccgcggtggcgatgcttggaattgtctccctcgcaagc

SEQ ID NO: 497 - DNA, 412 bp, Triticum aestivum
  unsure (1)...(412): unsure at all n locations
  Clone ID: LIB3280-008-P1-K1-C1
ctctctgttgtccgagccgagatcctgctggatgaggctggtgacggtgaagtggcggaaatcgatgctgtgctcgaggaagctgctgagcttgttgatgactcccagcccaagaagcccagttattacagtacctatgaagttcagtacacgctgaggaggcaggacgaccgatcgtggaaaatctgcgaggctgctgtccgggacctgtcgtgatctctgccagaaggacgactaacgcatcatctcataggacacanggcagcgtctaaacaaagttccagcacattagatatctgtaggtcactagtcttaggtcagcattgaaccaattcgaatgcacgaaaccgttcgatgatctgcgttgggatgctctagctgctcgtggtgactttgcaataggatttgacac

SEQ ID NO: 498 - DNA, 312 bp, Triticum aestivum
  Clone ID: LIB3280-008-P1-K1-C10
gttcaccacgagaggggcggcagcccggaggccatgcagggctggctgcctagcatggtgcccaagttcctccccgccgccaagggccccgagcctcccccgcctgaggccgttgccgccgccgccaccatgcgcaaggcccgcgtctccgtgcgcgcccgctccgaagccgtcatgatcagcgacggttgccagtggcgcatgtacgggcagaagatgtgccaagggcaacccgtgcccgttcgcctactaccggtgcaccatggcctgcggctgccctgtgcgtatgcaggtgcagcgctttgtctagga

SEQ ID NO: 499 - DNA, 427 bp, Triticum aestivum
  Clone ID: LIB3280-008-P1-K1-C11
gtccaaggggcatcactacattgtcaccgacgacaaggaggggttgaacagcgagctggagaagcacattgaagacatgcatgttctgataaccaccccattccacccagcctatgttactgcagagaggatcaagaaggcaaagaaccttgagctgcttctcactgctgggattggatcggaccatattgatttgccagctgctgctgctgcaggcttgacagtggcagaggtcactggaagtaacactgtctctgtggcagaagatgagctcatgcgcatcttgattctgctcaggaacttcttgcctggctaccaacaggtcgttaaaggtgaatggaatgttgcaggcattgcccatagggcttatgatcttgaggggaagaccgtcggaacttgcggggcatggttgtaatggcaggctttt

SEQ ID NO: 500 - DNA, 263 bp, Triticum aestivum
  Clone ID: LIB3280-008-P1-K1-C2
agaagttaaaaacaatcataaaatttatatccagagagaaaataattgctgtacacaatattagctgggacaagaggacattttaagatggcaagccagtcactaacttgtaaaacccgttctcatgtgaggatactaaatggtataacaacagctcattccatgtatcaggcactccaggaaggcaccagtggctgcagtcctgggtgctggatgctgtaaaaagtactgccttactcccatacatagaggggtgggcattt

SEQ ID NO: 501 - DNA, 208 bp, Triticum aestivum
  Clone ID: LIB3280-008-P1-K1-C3
aaaaaataaggaaaccctggttttggttgccctgggaaaacaaaacattagggagctttttttggcggggccctcgctcggtggaggggggccgacactggggggttcccccccaacctttttttttagcccccgccccgcgccaccccgggcaagggaccccaaaccttgtgcggagaaaaagggaggggccccccagtccactcca

SEQ ID NO: 502 - DNA, 185 bp, Triticum aestivum
  Clone ID: LIB3280-008-P1-K1-C4
gcgtgacgtgggctaaataaaagtgttgtcgggtcgggtcgacgcccagtgtcggtcagcagcgagcgacgcagtgccactctcgccggcctgcgtctgcgtctgcttagctggagccttgttacggtgtgtgtcacagtgtcagttccacctatgatcgatcggtatcctaaccggtttgcgtt

SEQ ID NO: 503 - DNA, 380 bp, Triticum aestivum
  Clone ID: LIB3280-008-P1-K1-C5
cccacgcgtccgcccacgcgtccgcccacgcgtccgctcctccccttccggttcgggttctggttcggttcgggtccgagagtagctagcctagtctagggtttccgtagttcggagaggagagaaagggagagatccatggcggagacggagtaccgctgcttcgtgggcggcctcgcctgggccaccgacgaccacaacctccagcaggccttcagccagtacggcgagatcctcgacgccaagatcatcaacgaccgcgagacgggcaggtcccgtggcttcggcttcgtcacgttcggcagcgaggagtcgatgcgccaggccatcgaggagatgaacggcaaggagctcgacgggcgcaacatcaccgtcaacga

SEQ ID NO: 504 - DNA, 132 bp, Triticum aestivum
  Clone ID: LIB3280-008-P1-K1-C7
agaggcgtgtcaagcaaaggaaagcacgtgatgattttctcactatgctggaagaatgtaaggaccttacatcatcactgagatggagcaaagcaatcactatgtttggggcatgatgaaagggttaaatgc

SEQ ID NO: 505 - DNA, 307 bp, Triticum aestivum
  Clone ID: LIB3280-008-P1-K1-C8
gtccctgcgcaaccagcagcgggtcatctacacgtcgcccatcaaggccctcagcaaccagaagtacagggagttcaaggaggagttctctgacgtcggcctcatgaccggggacgtcaccatcgagccaaacgcctcttgcttggtcatgaccacggagatttggcgcagcatgcagtacaaagggtccgaggtgatgagggaagtcgcctgggttatcttcgatgaggtgcattacatgcgtgacagggagagaggagtggtgtgggaggagagtattgtgatggcgcctaaaaactcacggttc

SEQ ID NO: 506 - DNA, 313 bp, Triticum aestivum
  Clone ID: LIB3280-008-P1-K1-C9
gcgtctcgtactagggaagcagatagcaaagatcttgcttactagaagagaaaggttgttgctggcgctgacgttatagccacccaacttaactatgccaccgatatctatctcaagaaggcgaacgactggcgtgcgataggtataacctgacctatcgtggctgccataacgccaatagataacatacaaagcgattgggcgcatgactggatttttgaaaaataggataccagctgagataactggtgccttgggtcctatgaaagacaaagacgaggctgatccagaatgcagagtgcatcttggtgct

SEQ ID NO: 507 - DNA, 393 bp, Triticum aestivum
  unsure (1)...(393): unsure at all n locations
  Clone ID: LIB3280-008-P1-K1-D1
atccatcttccattataattctggcaatcctttgctcccttcattttaactaaaccttttcttcagatctgtgaaagccatataatttgcatgctccaattttaattttaactataatggaacaggttacttttctggtttcattttaactatcatggaacaagttacttttctggtttagtgtatctttttgcttctaccttgaactaagcgcaattgctttattataaacaattgatccaaaatgcatagtgcatcttattgttcggcgaaaaactttcctggtcgacactatagctaaaccatcttttcacaaaatcctgctattctctctgtacatttgcttcacttattttggtgtcttagtttgataattcgngtatggttgaaaaa

SEQ ID NO: 508 - DNA, 430 bp, Triticum aestivum
  Clone ID: LIB3280-008-P1-K1-D10
cccacgcgtccgcactgctcaagtagctggcaagagctttgaacgcgttgcaaccttgcatcccggtcgatcgatcgatggcgtccaaggtcgagctggtggtggaggtgaagtcgccggcggagaagctgtggacggcgatgcgcgagtcgacggagctgttccccaagatcttccccgagcagtacaagagcatcgagaccgtggagggcgacggcaagtccgccggcaccgtccgcctcatcaagtacccccgagggggttccgatggtgacgttcgccaaggagaaggtggaggtggcggacgacgagaagaaggtggtgtcgtacagcgtggtggacggcgagctggtgagcttctacaagaacttcagggtgacggtgcaggtgaccgacaagggcgccgacggcgcccgcgcggtggtgaact

SEQ ID NO: 509 - DNA, 392 bp, Triticum aestivum
  Clone ID: LIB3280-008-P1-K1-D11
ggcagaggcacaaatggtgggcttccttcgggccttcaccgtcgcatccgccgtgccagcagcagccgtcgccgcggccgccctctgctcctcctcctacccctcccgctccccctcctccaggctccgtttccccctgccctcctttttcgcgttcggcgtcttttcgtcctcctcttctcccgtgcgcgcgccgaccgtcgaccctccgatggccgacgtcgtcacagtcgatctctctgtctccgacaagggcaccgcgctttctgagctcacgtccgaattcatggtggacatgtaatgtgagggctgtgtcacagcagtgaaaaacaggtttcaaacacttgaaggaatacaaaactattgagtggatttgaataaccaagtagtta

SEQ ID NO: 510 - DNA, 387 bp, Triticum aestivum
  Clone ID: LIB3280-008-P1-K1-D2
atcgcgccgggcggttaccacttcatgctcgaggagccgaagcacgcgatcaagcccggcgacaccgtgcacctgcgcctgaaattctccgacggcgaaacggtcgatgcgccgttcgccgtgaagtcgccggcccaggcaaagtgatgcgcgcgcgatgaacctcctgtactggctcgatccgtgggaaccgtcgccgaccgtcgtcgtcgcggtgctgacggccgccgtgctgttcgcgcgcggcgtgaagaaggcgaaggtgtcgccgctgcggcagttctcgttctggttcgggctgacggcgctgtacatcgcgctgcatacgcggctcgactatttcttcgagcacgagttcttcatgcaccgcgcgcagcaccttgtgct

SEQ ID NO: 511 - DNA, 419 bp, Triticum aestivum
  Clone ID: LIB3280-008-P1-K1-D3
cggacgcgtgggtttttttttttttttttttttggcaaaagaaaggaagacaaaaattgattgatctcagcgaacaattaattagggaggcataattaaataaagcaaaagaaaaagaaaagcgtgacacatatagatcagcacgtacgcattattagtttattacaactgatcgatcgagggaaagagaccatggcgacggacggatggatcattcatctctgtccggcgtccgggcatgcagggcgggcgatcatcgatcagtcggaggtgctgctgctgctgctgggctccggtgcatctgcagcggagggctcggaggctggggagtcggcggcgggcgcgtcggcgggcgccctggcggagggcgccggcgcttcggccttcttctcggccttcttcttgcccttggcgtcggc

SEQ ID NO: 512 - DNA, 429 bp, Triticum aestivum
  Clone ID: LIB3280-008-P1-K1-D4
atcaaacgcggcggcagcagcagcagcggcagcgcaagaggtagattggagtatcaccaccaccactcaagaaatggcggccgagactttcctcttcacctctgagtctgtgaacgagggccaccctgacaagctctgcgaccaggtctctgacgctgtgcttgacgcgtgcctcgcccaagacgctgacagcaaggttgcctgtgagacatgcaccaagaccaacatggtcatggtttttggtgagatcaccaccaaggccactgttgactatgagaagattgtgcgtgacacctgccgcaacattggcttcatctctgatgatgttggccttgatgctgaccggtgcaaggtgcttgtcaacatagagcagcagtctcctgacattgcccagggtgtgcacggacatttcaccaagcgccctgagga

SEQ ID NO: 513 - DNA, 407 bp, Triticum aestivum
  Clone ID: LIB3280-008-P1-K1-D5
cggacgcgtggggtggtgaactacgagtgtgctacctaacactaccacgtaccaccatggtgcatcaagctcagggcctgctcgtgcaggaggtggccgccgacggggagctgccgagccgctacgtgctcaaggagcagcagggccgccccgccgccgccacggccgccgccgcacagcgtgccgctccatccatccccaccgtggacgtgagccgccttgccgacgctgaccccggcgaggccgacaagctccggtcggcgctcggctcctggggcctcttcgcggtgaccggccacggcatgacggacccgttcctcgacgcgatcctcggcgcggcgcgagggttcttccacctgccgacggaggcgaagcaggagtacagcaacgtggtcgacgccgacgac

SEQ ID NO: 514 - DNA, 369 bp, Triticum aestivum
  Clone ID: LIB3280-008-P1-K1-D7
agcaatacaaagacacgttacatcaacaaaagaagatggttcatataaagaccaaagccggcttgctctgtccaattattagccattcaaattccgtcaacagaagaaacacacgacgagtgctcaagtatgtattcctcgtagcaaatttcggcgtatccaggtctgaaagccttattcatgccctcaaggcacgacgccatcctggatgggctgaagcaagaccttggaccttaccaaacctctggacgcagctcaccggttgcaggaggcatccatttcccagaattggacacgctcttaccgactttccattcaggaacattttttatgatcctcgcttcttctaagatacttttttcattcttt

SEQ ID NO: 515 - DNA, 338 bp, Triticum aestivum
  Clone ID: LIB3280-008-P1-K1-D8
tgagataattgctgcaggcagccttcacgtcaggagtatgccgcccagcaaacaaacacagagtaggctgtggcgctgtctgggttactcagctccatgctctgataagcccccagctcgtcttgctgatagtccgaagctcgtggcatgaatggaacctaaatcttgttctggagatcccgcaacatgatgatgcggtttattctcttgtccggttgttagttttagcgtgcgccggtcttatttatcatcttgcaagcccgccggttggtgtttgcagatggtgcatagttattctcgatatggagtagcttcttgttatatacatcatttttcca

SEQ ID NO: 516 - DNA, 350 bp, Triticum aestivum
  Clone ID: LIB3280-008-P1-K1-D9
gtcactagttgttcatgcaaatttcgacatgtctttcagggagctgcaccaggtgctgcagaaacgaatgggaaaaatgagcctggcaaaacatctggtccatctgccaatggggttacgtccaacagtgaaagcggaagtgatagtgagagtgaaggaagggatgccaattcttaaaatgattcacattcaaaggagaatgatgtaaatgaaaatggcagtgctcagaatggcgtatctcattcatcatcgcatggaacatttaataaatccatgccgttggttccagtacaatcaggtgccgtgataggaggagttgctggtcctgcgacgaacttgaacatagggat

SEQ ID NO: 517 - DNA, 308 bp, Triticum aestivum
  Clone ID: LIB3280-008-P1-K1-E10
gcctagccaaacgcgacacaatgcttattgctcacatcagttttttcaatactacaaacatcatcattaccatcactctccctttattatgcagtatatgtacatgatgtgtcacttcctatgcgtctgacgaactactcgtctgcctcggccgccttcgtcttctttgcctcgtagtccttcactgcggccttgatggcgtcctcggcgagcatgctgcagtggagctttcaccggtggcagcgacagatgcttggcgatctctgtgttcttgatcgctaccatttccttcctttgcctccgctcca

SEQ ID NO: 518 - DNA, 250 bp, Triticum aestivum
  Clone ID: LIB3280-008-P1-K1-E12
ggacccgacgaaggtgaaggggaagatcgtggtgtgcctgcgtgggacgagcgcgcgtgtggccaagggcctgacggtgctccaagccggcggcgccgccatggtgctcgccaacgacgccgccttcggcaacgagattatcgcggacgcgcacctgctcccggccacgcacatcaggcacggcgacggcctcaccctatacaactacctcaaatccgccaagtcaccagagggctacattgagaaagcc

SEQ ID NO: 519 - DNA, 360 bp, Triticum aestivum
  Clone ID: LIB3280-008-P1-K1-E6
ccaaccaccactaaattaagaacaagtttgaatgactcgtagcattcaattacagcgcacttcatatactcgtctgcacatatacgcttccacaaatcactgtctcttggtctaaattgtgctgccatgtctaaagctataggtatcttgctagcaagcaagaacaacggccactgcatcaattttaagctcgggtctgatgagtatggaaccaccaataggtccatctccttatcacttataaaatcttcgtcgcggaaactgcaaatcacttcattccacagttgagcaaacttggcagcttcagttctctttgtgggggaaacctctgcaaagcgctttgcgagtgaaaaacgtctg

SEQ ID NO: 520 - DNA, 371 bp, Triticum aestivum
  unsure (1)...(371): unsure at all n locations
  Clone ID: LIB3280-008-P1-K1-E7
gtgtgtgttggctttttcccttctttggaccagatttgtgtttgtggctactttttatgtagcaagcataaataggtttgcatatgcgcttccgaatggagtgcaccagatgtatatgaataagagtaatatgcgctccaaaataatgtaatccgttctcttctttatatagatgtgtgacccatcttaaaaaaaaaaaaaaaaaaaaaaaaaaaataaaaaaaataaaaaaataaataaaaaaaaaaatatntttattaaataatttaaaaaaattttaataaattttaaaataataataaaatttatggggggggccgttttagaggatccaagttttactccccttgcatgcgaagtaaaagtttttt

SEQ ID NO: 521 - DNA, 428 bp, Triticum aestivum
  Clone ID: LIB3280-008-P1-K1-E8
caaatcccatcaccggagaagcatccacacccaagcccctccagctccgatggcccgcacgaagcagacggcgcgcaagtccaccggcggcaaggcgccgaggaagcagctggcgaccaaggcggcgcgcaagtcggccccggccaccggcggcgtgaagaagccccaccgcttccgcccggggaccgtggcgctccgggagatccgcaagtaccagaagagcacggagctgctcatccgcaagctccccttccagcgcctcgtcagggagatcgcgcaggacttcaagaccgacctcaggttccagagctccgccgtgtccgcgctgcaggaggccgccgaggcgtatttggtggggctgttcgaggacaccaacctgtgcgccatccacgccaagcgcgtcaccattatgcccaaggacatccagc

SEQ ID NO: 522 - DNA, 269 bp, Triticum aestivum
  Clone ID: LIB3280-008-P1-K1-E9
gagcacccaaccataataattaaccacgtgattccaggatcccggcataatcaacagcatttcgtagcatagcacagcacaccaacaccggtctataacggtgtcaaagagagagaacatcctgatggtgcgtggggagcgatatacccaaagaagcgacctttttacacattatcttcgcctcggatacccaaattcagttcaccagcatcacccttaagctaacaccttgtttgggcctgtccacggcatattttaggccaccttac

SEQ ID NO: 523 - DNA, 351 bp, Triticum aestivum
  Clone ID: LIB3280-008-P1-K1-F11
cggacgcgtgggccgacggcgctcatgtcgtccgtggccatgacgtccctcgggtacctgctgccgctcatggcggccaccggcgccgtcgacgcgccgccggagcaatgggggaacggcttcttcgccgacgccgcaggcacgatcgctggcgactggctcaagtactggatcgaggtgggcgcggtgctctcctccatcggcctctactcggcgacactaagcagtgcggcattccagcttcttggaatggcggacctaggcctccttccccgcgtgttcgcgctccgcgccccaatcttcaatacttcctgggtcagcattgtggtcaccagcctcatcacccttggc

SEQ ID NO: 524 - DNA, 313 bp, Triticum aestivum
  Clone ID: LIB3280-008-P1-K1-F12
cggacgcgtgggttcccggagagcgacggtgagaggggtaaaatggcgaggatcctgctgcatgggacgctgcacgtcaccgtgttcgagggcgaggggatcaccaacaacagcaggcccagcagtcaggcgccgcaattcctccgcaagctggtggaggggatcgaggacacggtgggcgtcggcaaaggcgcgagcaagctctacgccaccgtcggccttggcaaggcccgcatcgtccgcactcgcacgctgaacgacgagtcggccaccccgcgctggttcgagtccttccacatctactgcgcgcacc

SEQ ID NO: 525 - DNA, 431 bp, Triticum aestivum
  Clone ID: LIB3280-008-P1-K1-F3
cccacgcgtccgaaggcgcggctggcgcgcgacctcggcctgcagccgcgccaggtcgccgtctggttccagaaccgccgggcgcgctggaagaccaagcagctcgagcgcgactacaacgcgctgcgccactcgtacgacgcgctccgcgtcgaccacgacgccctccgccgcgacaaggaagccctcctcgccgagatcaaggatctgaaggggaagctgggggacgaagaggccgcggccagcttcacgtcagtgaaggaggagccggcggcgtccgacggcccaccgcccgcgggcatggggtcatccgacagcgactccagcggggtgctgaacgacacggacgcgaccggcgccacgccaacagaggaggcgccagctccggagatggggacgctgctcggcgggcccggggcggccggcgcggc

SEQ ID NO: 526 - DNA, 413 bp, Triticum aestivum
  Clone ID: LIB3280-008-P1-K1-F5
aatgactacttgtccatgcttgaatttacatctaggttgccgatacttcgctggaagcaagatacataaccctccacgtctgcgacaaggtcgcggagagaggcgcgcgcctggctgccgccggcatatacggcatcctgaagaagctgggcagggacagagcgccgagtgacggcagtccgaagcaaaggaccgtcgtcgccatagatggcggcctctacgagcactacaagaagttcagctcccgcgtcgaggcgacgctcgcggagctgctcggggaggcggccgcctcgtcggtcgtcgtcaagatggccaacgacggctccggcatcggcgccgcgcttcttgcggcctcacactcccagtacaatgtcgtcgagtagtcccaaggagagggagtgagctcctggcgc

SEQ ID NO: 527 - DNA, 430 bp, Triticum aestivum
  Clone ID: LIB3280-008-P1-K1-F7
cgcaaactcgttgcacaagaattcctcccacccccaccgtctcgccgccgccaccaccgccgcagctagataagaagaaaaatagagagagaagaactcgtcgggagggctcgagatctgtgtcgggagagagggaattcttgagatcggaatcggaacaagcgggcgcgctcgggatcggtgttaccatacaatttttcccaggaacctttagtgaatgtgctaatggagtcaaagggtggcaaaaagtctagcagtagtagttccctgatgtacgaagcacccctcggctacagcattgaagacgttcgacctgctggaggcgccaagaagttctctgctgcatactcgaactgcgcgaagaagcccatctgatatcgtttttggcattcctttctttgtagtttaggatttttatgcaatttaattc

SEQ ID NO: 528 - DNA, 178 bp, Triticum aestivum
  Clone ID: LIB3280-008-P1-K1-F8
aacaaaaataatagtcaattgtaatcattttgggcgctagccggccattggattagattgaattcaaacataccaccaccgtgttattcacaaattaaatggctatggaatgggatgcattatataggatttttctcaatttaatataattgtagggggaaaagaaaacattgattta

SEQ ID NO: 529 - DNA, 230 bp, Triticum aestivum
  Clone ID: LIB3280-008-P1-K1-G1
cctccacccgctcctccgcctgaaccctagccatggcgtggcgcggcgctgcgtcccgcaccgtcctcgccgcggtccgccgcccggcaccctccgtcgcgctcggcggccttcgcgcccctcctcccttcgtggtcccgcgccgccggatccttttcctcttcgcctccttccactccacctacatgtttggggccgtactgacactgtcttctattatgggttctccg

SEQ ID NO: 530 - DNA, 212 bp, Triticum aestivum
  Clone ID: LIB3280-008-P1-K1-G10
tttttttttttttttttttttttttttttttttttttttttttttttttttttttttttttttttttttttatttttttttttttttttttttttttatttattatttttttttaaaaaaaaaaaaacgctttaaaaattttaaataaaaaagggggggaggaaaaaaaggaattttaaaaaaaaataagggtttgaaaaaaattttttttt

SEQ ID NO: 531 - DNA, 422 bp, Triticum aestivum
  Clone ID: LIB3280-008-P1-K1-G11
cccccgccgtgcagtcccacctcaagctcgtttacctgaccctatgctttgccctggcctcatctgccgtgggtgcttacctgcacattgccctgaacatcggtgggatgctgacaatgcttgcgtgtatcggaaccattgcctggatgttctctgtgccagtctatgaggagaggaagaggtttgggctgctgatgggtgcagccctcctggaaggggcttcggttggacctctgattgagcttgccatagactttgacccaagcatcctcgtgacagggtttgttggaaccgccatcgtctttgggtgcttctctggcgccgccatcatcgccaagcgcagggagtacctgtacctcggtggcctgctctcctccggcctgtcgatcctgctctggctgcagtttgccacgttcatcttt

SEQ ID NO: 532 - DNA, 149 bp, Triticum aestivum
  Clone ID: LIB3280-008-P1-K1-G12
cacactcactcccactccacctctttactccccacgccgccgtgccgggttcgccgacaagttcacgcctcgcccggttgccccaccccaacattgcggccggaccatagctgcaattgcattgcggccgttccaacaatccaccatat

SEQ ID NO: 533 - DNA, 313 bp, Triticum aestivum
  Clone ID: LIB3280-008-P1-K1-G2
aaaaccagcccaactatatatattagcataactgaagatttatcacggctcacagggccttatcctgacttatcagggggattgcatattatccatccatgcaatgcaccaccacataaatgctagagaaaaattacaaagggaattattaatgcaatggcactgtgtcgatcgcgccgttaaatgcatgaaggaagggaaagggaaaagctagctagcgccagcagctcacagattgtagccgcctgcggcagcaggcttggtcgcggcatcggcggaggccttggaaccggctttgccatctgggggcttg

SEQ ID NO: 534 - DNA, 257 bp, Triticum aestivum
  Clone ID: LIB3280-008-P1-K1-G3
ggtagtttttgtgggcgactcttttaataaacccagctgagctatatttttaaccataactgaagatttattacggtttacagggctctatcattgcttatcaggggggcatctatttatccatccaagcattgcaccaccacataaatgcttgtgaaaatttacaaatggaattataaatgcaatggcactgtttcgatcgcgccgtttaatgcatgatggaagggaaagggaaaagctagttagctgccatcatt

SEQ ID NO: 535 - DNA, 430 bp, Triticum aestivum
  Clone ID: LIB3280-008-P1-K1-G4
gtcaccactcgctcgctcctcctcctctccgacggcgaggagacggagaggcctcggcagggttgcggtgatctcttctccttctcgcgatgggggacattgccaaggacttgacagccggaaccgtcggagggatcgccaatctggttgttgggcacccatttgacaccatcaaggtcaagctccagagccagcccagccctgctccaggccagcttcctaagtatgccggcgcctttgatgctgtcaagcaaacggttgcggccgaagggcccaggggactgtacaaggggatgggggctcctcttgctactgttgcagccttcaacgctcttctgttcactgtgaggggccagatggagactctcttgaggtcagagcccgtggctccattgacgataaagcagcaggtcgtcgcttgtgctggtgc

SEQ ID NO: 536 - DNA, 270 bp, Triticum aestivum
  Clone ID: LIB3280-008-P1-K1-G5
gaagaagatcactaaattcgctatgtatggctctacgctacgctgattcaaggcgcgcgcgtgcgttttgatcgatgcatgcgcgtgctttgatttatatgtcttgattttattttgtttctcctccttttggcgaatccatttgcaccggtccgattcatctggtgctttattattattctgttcttccttttgagagagggctcgatggatattgtattattatttgccatttctttggcctgattaatttaaagattggattcaatc

SEQ ID NO: 537 - DNA, 425 bp, Triticum aestivum
  Clone ID: LIB3280-008-P1-K1-G7
atcctgctcgctgggaggtacatggggaagcgcgtggtgttcctcaagcagctcaagtctggcctgctcctcatctctgggcctttcaagatcaatggtgtgccagttcgccgggtgaaccaggcttatgtcattgccacatccacaaaggttgacatctctggtgttaacgtggagaagtttgatgacaagtacttcgccagggacaagaagaccagggcaaagaagactgaaggggagctgtttgagactgagaaggagaccaccaagaatctgccagaatttaaaaaagatgatcagaaggccatcgatgctgagttgatcaaagctattgaggctgtccctgaccttaagaactatctcggtgctcggttctctctcagggatggtgacatgccccatgagatgaccttctaagttgctac

SEQ ID NO: 538 - DNA, 422 bp, Triticum aestivum
  Clone ID: LIB3280-008-P1-K1-G8
cacccagctgacaaccttgtttcattcctcaacaatgccaagggagcaactgtgggcgacgctgtgaagaaacttggtctgtggggtctgtttactcgtggtctccctctgcgtatcgtgatgattggtaccctcactggagctcagtggggcatctatgatgctttcaaagtcatggttggactgccaactactggtggagttgctccgactcctgctgccgctggagagcagctcaagggctgaagctttgattctatactgcatataatatctgacaagactttttggcgccgaattggatgagatgacgaaatagctcatctttcatccttttaagagcaaaatttgatatttttttttcaggactgcctaaccgcggccctggtaattagaagtccaagacagtttaagaacaattt

SEQ ID NO: 539 - DNA, 421 bp, Triticum aestivum
  Clone ID: LIB3280-008-P1-K1-G9
gaggagttcgagttcagtgaaatatttgttcaccagctgatccatacaattgagtttgttcttggtgcagtctcaaataccgcttcatatcttcgtctctgggctctcagtcttgcacactcggagttgtccactgtgttctatgataaagttctccttctgacgctggggtacaacaatatttttatcctcgctattggtgtcgttgtcttcatctgcgccactgtcggtgtgttgcttgttatggagaccctaagtgcattccttcacgccttgaggctccattgggtggagttccagaacaagttctatgagggtgatggttacaagttcgcaccattctcgtttgctctaatcagtgaggacgaagagtgagctcgtccaaattcttgtatctattgtagtctctgtaatgtcttgc

SEQ ID NO: 540 - DNA, 271 bp, Triticum aestivum
  Clone ID: LIB3280-008-P1-K1-H1
cctccctagtcctcgctccagcaaccttttttcttccttcttggttgattgatccatcagcccccggtcagagctcgatcgccggccggccggagcaggcgcagcaatgtggttcacggcgcgacccgcggtgtgcatcgtcggcgtcctcctcctcgccgccgccctactggcggcggcggagggcgagtgggacgcgccggagtcgtgcgcaaccccggtgagcgtggaggctgcgtgccgggtggcctctgacacgcaccatggcttt

SEQ ID NO: 541 - DNA, 201 bp, Triticum aestivum
  Clone ID: LIB3280-008-P1-K1-H10
ccagaaaacacatattggatttacaaaaatgtagctgaatatacaaagcaaaagctgaaggaaaacctgtaaacagcagatatcagatcacttttgtagaggctccaagttaatacagttagttactcgattccatatcctgggagcgagacttgccttcaattaaaggacatcacggtttggatatttagtaattagctg

SEQ ID NO: 542 - DNA, 310 bp, Triticum aestivum
  Clone ID: LIB3280-008-P1-K1-H11
gatcagttggttctgaaaactcgctgtaaacatcatggcaagctgaagctgagacccttaagtccatcttaactggagctccccatagtaagctaggtatgagtttctttggttagcgccattgctaagcatatacgtaaaaggatgaaagtgcgtcttcctaacctattgactggccttcagggttaatcccagatggtgcaagctgagctggctaggcttggtgaatctatggtacaaagttctgaaggaacccgagcagttgcattggagctgtgccgggaatttgaagataagttccttgcttata

SEQ ID NO: 543 - DNA, 328 bp, Triticum aestivum
  Clone ID: LIB3280-008-P1-K1-H12
caagaaggctattgccgactgttcgaaggtgctcgagcaagataatgacaatgtgtcggtgctagtgcaacgtgctctcttatatgagagcagtgagaaatataggcttggggctgaggacctgcgtttggttctgaagattgaccctgggaatcgtcttgccaggagtatgattcatcgattgaacaaaatggctgactagggatgtttgtcaagttcccttatgtaccaccattgtaatcatccttgacacggaaactgtgagttatttcaattttttttactatacttgtggctttgggggtaataatatacaactttggtgtta

SEQ ID NO: 544 - DNA, 341 bp, Triticum aestivum
  Clone ID: LIB3280-008-P1-K1-H2
caggggttggcttctcctccccactcagtcctcggttcccggcccggttcggttcgttagggtttagtagtggggaagaggaggaagaatggcggacgtcgagtaccgctgcttcgtcggcggcctcgcctgggccaccgacgaccagtccctccagaacgccttctccaagtacggcgacgtcatcgactccaagatcatcactgacagggagacgggccgttcccgcgggttcgggttcgtcaccttcgcgtcggacgaggcgatgcgccaggcgatcgaggccatgaacggccaggacctggacggccgcaacattaccgtcaacgaggcccagtccc

SEQ ID NO: 545 - DNA, 378 bp, Triticum aestivum
  Clone ID: LIB3280-008-P1-K1-H3
gtggaggagtagctcgttggtggctgagctaaagaggaaaaatgaggccttgacactcctcgggcctccctcgaatcgattgtaggcgaggaatgtggtgtatggaggagcaggagggcgagatggtgttcataggagaatcgggtgtccgggaggaggaggtgggggctcatgtgcagaccaacgggatcctcttatgatgaccactggcgagagcaaccaagagtattcgtggatcaacacgatgatctcgagcacagcacggggcacaattagacagcagatggacaatagggggggtgttcttgaacataacgcacaatgacagcactgagaagggacggtcattctttacggcaccgagagcccgggacgccg

SEQ ID NO: 546 - DNA, 403 bp, Triticum aestivum
  Clone ID: LIB3280-008-P1-K1-H6
gattaccggcgagcggtggccggagctctcgacaaaaagatgccgcctttccctctccccgtcctggccgtcgtcctcctcctctgcctcggggccccgcacgccgccggcaacccgccggacccgcccccggccccgaccccatggccgcaccagttccacgcgaagctgctgatggactacaagggcaacctgtcgctggcggacctgtggtacgactggccggggggccggaacctgcacgtcatccgctaccagctggccgtcgacgcgccctactacgacgcggagtggaacaacggcacctccttcttctacacgccggcgcgccgcacctgccgctccgccgccgtcggcgtcggcatcctgcgccccgactggctcgcccccggcgccgtctacc

SEQ ID NO: 547 - DNA, 317 bp, Triticum aestivum
  Clone ID: LIB3280-008-P1-K1-H8
gcagaaaaatgcattgaaatggcgacataaaatttcctcaaatgtatcaaccgaaagagaagctctaataacatggacaccaatttcacatattatttaggagtatgcaaacatgcggccacagcatggaaagggaatttagcatcatgtaactacaatctgtagcgaaggtcgcatttcacagttccgcatttgaaacaagcttacaacaaaaaagaaattgatgtttctagaacgcattgattgaaaattatttcaaaaacttgccaatttgtttaagcttgcagctgaacttacatcagaaatcacatgtggat

SEQ ID NO: 548 - DNA, 296 bp, Triticum aestivum
  Clone ID: LIB3280-008-P1-K1-H9
ggacgtgctcaccgaccggcgggccgcgaccgagctctacttcgatgttaaatcggaggtggaggaaatcatcgcctacctgctggagaagagggaggaggacaggtacaggagcatcctgcccaggctcctctacagagctgtgagggggcccaaaactgaagtcccagccttcaacccttaacatatacagtactactagtaatgttgcacgtagcactaaatatggatgtatatatattctcaaaaactcatgacccataccataatactaatactctacatgattatactgc

SEQ ID NO: 549 - DNA, 424 bp, Triticum aestivum
  Clone ID: LIB3280-009-P1-K1-A1
cccacgcgtccggtcagggtatttgaggatcgtatggatctcatgagagctgtgattattggagcaagtggcacaccataccaagatggtctgttcttctttgacttctaccttccacctgagtttccacaagctcctccgtcggcatactatcattctggcggcttgcgtgtaaatccaaacctttatgtggatgggaaggtttgtttaagcctcttaaatacttggactggcagagggaatgaagtatgggatccatcctcatctagtattctccaagtactagtctcacttcagggactagttctcaatgaaaagccctatttcaatgaagctggatatgagaagcaagtcggtactgttgaaggggagaagaatgcactgccatacaacgaaaacacatatctgctaaggcgtgaaatca

SEQ ID NO: 550 - DNA, 384 bp, Triticum aestivum
  Clone ID: LIB3280-009-P1-K1-A10
cccacgcgtccggtcggctcctcggaggccatcatgctggccgggctggccttcaagaggaagtggcagaacaagatgaaggccgagggcaagccccacgacaaacccaacatcgtcaccggcgcaaatgtccaggtgtgttgggagaaattcgcgcgctacttcgaggttgagctcaaggaggtgaagctcagggaagggtactacgtcatggaccccgcgaaggccgtagagttggtcgacgagaacaccatctgcgtcgccgccatccttggctccacactcaacggcgagttcgaggacgtcaagatgctcaacgacctcctcgttgccaagaatgcagagacagggtgggacacgccgattcacgtggacgcggcgagc

SEQ ID NO: 551 - DNA, 386 bp, Triticum aestivum
  Clone ID: LIB3280-009-P1-K1-A11
atcgctgcacaagttaccaagctgaagtggtaaggcagaatatactgccttgtagctatagaagatgctcttggagttgccgggcagctccccggtggtctgcacccaggagttgcaggcgaagtgcacggatgctcttatgtgggatcaaaagactggacgatccagagggtccggttttgtttcttttaggaatcaacagaatgcacaaactgccataaatgaattgatggtgcactccctgttgcttattgctagcaatgtctaattctggagttaacaaataagcttcattgcaaccgccaaatccccccctcctgtgtttttaggttcgtaacagttgagtgatcttaatgtgaggtggatgttcttctctgatgtacatg

SEQ ID NO: 552 - DNA, 87 bp, Triticum aestivum
  Clone ID: LIB3280-009-P1-K1-A12
tatcgctccacaagttaccaatctgaagtgtttaagcataatatacctcctcgtagctgtagaattatcctcttatagttacccccc

SEQ ID NO: 553 - DNA, 381 bp, Triticum aestivum
  Clone ID: LIB3280-009-P1-K1-A2
cccacgcgtccgcccacgcgtccgcgctaataatccaccgcaataagcagataaccaacctccgtccgcgcaatctctaaatcttccacaggcatcaatggcgggcgcaaggaacaacgagctgcgcatgaccctgctcggcctggccctgctggggctcctgctgctgagccacaccgcggctccggtggaagccgacgaggtcgtgcaggagaacagattctccatgaacggcgccggtggccgcagtctcaacagcttcagcatgaacaccgccgagagcgctgaggtcgccaagggggggaaggccaaacccgccgccggcgacttctgatcgacgaccctccgcccgccgccgtcgagtactaattaaataattta

SEQ ID NO: 554 - DNA, 112 bp, Triticum aestivum
  Clone ID: LIB3280-009-P1-K1-A3
accacgcgtgcctacacactttcttgccttatattgatttgcataagtagatagactaacttcggtccgtgacactagtaaatcatgcacaactctgaattgctgccgcctg

SEQ ID NO: 555 - DNA, 160 bp, Triticum aestivum
  Clone ID: LIB3280-009-P1-K1-A5
attatttattttatttacagggtttttttttttttttttttatacttttacttttttttttttcattgggtaaagatgacagcaacccggtcatttttttttttagatgggaggggggaaaaaaacaaacccgccggggaatattaaatgggtgaggggg

SEQ ID NO: 556 - DNA, 333 bp, Triticum aestivum
  Clone ID: LIB3280-009-P1-K1-A6
agacaacaaccactctgaatttactatcagcaacttagacagcaaagcatacatcagcgcttaccaaccgacaccgatgatcgggtcgatggcatgcttgcaggtgctgatactactgcaagtctttattcaaccttgttcacacagatggatagacagagactccactaatgctactactactgcaacaacaggattattcattattcaacttgtgtccagcatggggtagatggtcactagagaatcatcaatcaaaccacaccactaatgctgctgctgtccataccaggaggaaagaagcagcattgattgtctgggctcaatcaacgc

SEQ ID NO: 557 - DNA, 375 bp, Triticum aestivum
  Clone ID: LIB3280-009-P1-K1-A7
ctcaagcaggaggttttgtcacgggccgaaaccataaagaccggagcgctcggcggcggcagccatggcggacgacgattacaatgaagttgacatggggtatgaggatgagcctccagaagctgatattgaggaaggggttgaagaagatcctgagaacaatgaggatgcccctgatgatgtggtagggggtgagggtgaagaaaaggaacaggaaaagactgcccgtccacgcaatacaacataatatatgaccaagtatgagcggtcacgcatccttggcacacgtgctttgcatataagcatgaaagccccaattatggttgaagcttgaagtcaaaaccgatccttttgagatctgcattaaaagaactg

SEQ ID NO: 558 - DNA, 354 bp, Triticum aestivum
  Clone ID: LIB3280-009-P1-K1-A8
cccacgcgtccgcccacgcgtccgagatcagaccctgtataggcccgatcaggtgttcccgagattccagaaaatgcccaccagtcccgcacctccctgccgcagatcgctctcccccgattcctcctcctgcgacgaactcgccgccccgccctcgatctgacccctaccccccgcgccctgcctgaagatcaggccgtcgcgccgacaccgacccccgtatcaggccgccccggcgccaccggtcttggatccggccgccgcgctgtctggctctgctccttacctgtccggctccgcgcccgcacgaggggatgccaagcccttgtgctcctcgatcgacagccacagggg

SEQ ID NO: 559 - DNA, 427 bp, Triticum aestivum
  Clone ID: LIB3280-009-P1-K1-A9
cccacgcgtccgcccacgcgtccgaggatattcaacaacatatcctctttaaaagctgcatacattcagctgcaggaagctcacaccccttacgacccggacaagatccaaactgctgataagcttgtcatagatgagctcacgaggctttcagaactcaagcatacttacagagagaaaaatcctaagccagtagcagcatcacctcaagattcacgcttgctttctgaaatacaggagcagcagaacttgctaaagacatatgaggtcatggtgaagaagttccagtcacagatccagaatagagataccgagattacccttttacagcagcaaattgatgaggcgaaacatcggaaatcaaagctggagaagatattgaaacagaggggcttacttaacaaagaatctgaggaatctgatgaag

SEQ ID NO: 560 - DNA, 375 bp, Triticum aestivum
  Clone ID: LIB3280-009-P1-K1-B1
gtccccacgcgtccgagcagatgtagcgagactttatggggaagaggattactataattttgttgtttcaaataggaaatgaacaaaacaggattttgctaacctctatatgacccagcttctgcttggatccctccgttggttttatgaatgttttttccggagatctttgcatgagttttggagaaattcacatatcaccaaagagtgcagttttggcttttgcactgtgccatcttggtatttgatcaagatcaactgaggattcacggattccttatttcgtggggcatgaaactgcctcctgtattatggattctggaagcacaaagtctgcatcacccgtgacatcagagaccatagatgatcacatgc

SEQ ID NO: 561 - DNA, 254 bp, Triticum aestivum
  Clone ID: LIB3280-009-P1-K1-B2
aactttattttaaagaagtttgcccgatcagtggccagagaaaagccatggcgatgaagtctgattgatgacccgcgagcgctcggcggcgcttgatgtggtggatgcagaatagtatagctccgggtagagtagtaggccagatatggaaaaaaatatgtacttccattttttgctgtgtatttcttccttttttgataaagaagttatgtatatggtatatatatatatatatatgcaaactccttttttct

SEQ ID NO: 562 - DNA, 435 bp, Triticum aestivum
  Clone ID: LIB3280-009-P1-K1-B3
cccacgcgtccgcccacgcgtccgcccacgcgtccgctcccccgcccgccgccgccgccgccgcagagccgcagggagagaaggcaaggaggaaggaaggggaagatgccggcggggcacgggctgcggtcgcggacgcgcgacctgttcgcgcggccgttccgcaagaaggggtacatcccgctcaccacctacctgcgcacctacaaggtcggcgagcacgtcgacgtcaaggtgaacggcgccgtccacaagggcatgccgcacaagttctaccacggccgcaccggccgcgtctgcaacgtcaccaagcgcgccatcggcgtcgagatcaacaagcaggtcggcaacaggatcatcaagaagaggatccatgtccgtgtggagcacgtgcagccatccaggtgcaacgaggagtttctccagaggaaactc

SEQ ID NO: 563 - DNA, 358 bp, Triticum aestivum
  Clone ID: LIB3280-009-P1-K1-B4
agtttctgcgccttgtctataaattgggggcgacccctgaagaaacagtagcagcacaagtgctgtaccgtctgagccttgctgagggtatccgacatggaaggcagacaaacagagctttcagccttgagaacgcacggaagaaagccttgctgcttgaagcggagggaaaagaggatttgagcttctcctgcaacatactcgtcttgggaaagattggagttggcaaaagtgcaactataaattctatatttggcgaagtgaagtccaaaactgatgcttttggtgcagccaccaccagcgtgcgtgaaattgttggtaatgtggatggggtcaagatacggatcattgatacacc

SEQ ID NO: 564 - DNA, 301 bp, Triticum aestivum
  Clone ID: LIB3280-009-P1-K1-B5
gcctcgctcaccgtcgtcaacgtcggccccggcttccgggaccagtaccactccttcgccccggagtcgcccttcccgttgctgcagactaagccgccgccggcggcgccccaagcagacgatgcttacagcattggagagcagaaggcggtggatgcgatggtggatgggtttgggctggggaggctgcaagggctcgtgtgcgctgcagccgggcaggcggcggggatggatagcatgtatgccgggatgctccggaggatggagaagctcgccagggaggtggagaagagcaatcacc

SEQ ID NO: 565 - DNA, 355 bp, Triticum aestivum
  Clone ID: LIB3280-009-P1-K1-B7
acgcatcattttactatttctcatccatcatattccatatgacagttgctgcaacaaaatgccataagattgtggctcagtgcaaatggactagggagatcctcctccggatgcatagttgttatcatcatgttctcaccgtcatattgcaaactcgagtgttgccattggcgatgtgatcatccatagcatcgtcaaagaggacatattacgaatcatcttcccagaaaaatagccagaggacttgaatttgtttgactggtagaaatccaactatgaaaccatccagctatgattctcactcgtctgttccggactcattgtctcctgaaagcagtgcatacacttcatattc

SEQ ID NO: 566 - DNA, 273 bp, Triticum aestivum
  Clone ID: LIB3280-009-P1-K1-B8
ccggaacgaccgacgcgacctaccacgcggccgaccacgcgtaagaccacgcagactgataccagaccgaaaccgccggggaagaagagacgtagggagagaaggccaggaggaaggaaggagaagatgccgacagagcacggaatgggggaggggacgcgcgaccaaaaagcgcgggcggatcgtaagaagggggacaatgccgataagcaactaactggggaccaacaaggagggggggcacggcaaccaaaaggggaaaagcgccgtaac

SEQ ID NO: 567 - DNA, 330 bp, Triticum aestivum
  Clone ID: LIB3280-009-P1-K1-C1
ggtccacaaaaaatttagtgcggaaaatcacaaatagagaaaagaccagattatacatatacatctttttcacggagagtgtgctaatcatatattagtacacggtagcccaccatctatcggccacaatgattgactactctctactaacccacctacccttgagtagcccggcttgctgccatgtcctcccttcgatcacaattttcttgatgatcgtaagcacacaaagtgttgctccgccaaagacaatagcattgcggtgtttacaaagttcccaagtgatgagcgagagaatgatcctcgtttcatttcgcaaaaaagaaaata

SEQ ID NO: 568 - DNA, 419 bp, Triticum aestivum
  Clone ID: LIB3280-009-P1-K1-C10
ttcttggcagctgctgcaatttcctgaccttgttctacataggtatatgtggtttcttgctacagttcgttacttacatatgtgcaataagcttgcctagcattgtttcactgatcatgccttcttgtttgcagtcttcatggtgctttacaccgtgcctgttctgtacgagaagtatgaggacaagatcgatgcttttggagagaaggccatggttgagctgaagaagtactacgccatcttcgatgagaagtgcctgtccaagattcccaagggcccgtccaaggataagaagcagcattagaacggttgagagtaccctgcgcagatttatcttcaaagttgatcactactcgtcggttttcaaggatggttgtgatttcatgtccgtagttgatagtagataccactatcttgta

SEQ ID NO: 569 - DNA, 434 bp, Triticum aestivum
  Clone ID: LIB3280-009-P1-K1-C5
tcgaggacaagccgccagccagcccaacccaaaccaccggaccggagcagcagccgacgccccgcaaccgccgtcgtcgcgcaggcagacgagccagcgggagggagccatggatcggtaccagagggtggagaagccgcgggaggaggtgcccatcaaggagaacgagatccgcatcaccacccagggcaggatgcgcaactacatcacctacgccaccaccctcttccaggataagggttgcgatgaagttgtattcaaggcgatgggaagggccataaacaaaactgtgatgattgcagaattgatcaagaggagaattgtgggtcttcatcaaaacactgccactgaatccactgatattactgacacatgggagccactggaggaaggcctactttcgcttgagacaacaaggcatgtgtctatgatta

SEQ ID NO: 570 - DNA, 378 bp, Triticum aestivum
  Clone ID: LIB3280-009-P1-K1-C6
gtttttcgccgtcaaagatgcgattgggccaacgcttctagtcctcaggcaagacattcagcaaaatgttcaggtaatattgcgactctgcattgcacttgttcacataactaagcgactgatcgagcatatcgactctgcgttttaattgagtgaagcgatcacagttatctatcttccttatgcagagattacaggatctccatgcaagagactcttcacagtacgtgagcttgacggcgatcgtgatggaagaagtggaggaagggacctcaaagaagaccaacagttgtagcagggcaattatctggctggctaggtaacttaactgtacatggacatggctgatctatgcaaaaagataatgggtaaagaaca

SEQ ID NO: 571 - DNA, 376 bp, Triticum aestivum
  Clone ID: LIB3280-009-P1-K1-C8
gttcaactcaggagagggacacactctgggaaaaggttgcttgggcaggcttgcatctccgtatatttttccatataaattgtaaaagtgggcaactcgatgcttgttcctttgccattgaccgtgtcgggaagttgagctcagaaactgccgtgacagcactggatgcttgaacccaccggtagcatcatggagctaccaatgttaggaagggtaccacaagagatgattctgagaaggggtaaggggaaggtcctgaaaaggaacaagctggagaagatagatcttatcaccaaatatacgtggaggaagatgaagaagcaagaccctaagatggacgactcttagaacataactgacaaataagcagaggatt

SEQ ID NO: 572 - DNA, 394 bp, Triticum aestivum
  Clone ID: LIB3280-009-P1-K1-D1
cctggaccatgatccatcccttgggaagacgtttggccaatcaaatgtgactcctctgataactgcggcgattagaggccacctcgaggtagtgaaccttctgctggagcgagtttctgggttggttgaactatcgaaggcgaacggaaagaatgcattgcatttcgctgcccgtcaggggcatgttgaaatagttaagtctttgctagtcagcgaagctcagcttgctcggaagactgataagaaaggacagaccgctttgcatatggcggttaaaggaacaagcgctgcggttgttagagcacttgtgaatgctgatccggccatagttatgttacctgacaaaaatggcaacttagctttgcatgttgccaccaggaagaaaagatcagag

SEQ ID NO: 573 - DNA, 263 bp, Triticum aestivum
  Clone ID: LIB3280-009-P1-K1-D11
cgacaaagcaagtaatacttcatattaactttcatatgtaggttcatctgagctaagcaccattcctgtaccagaagatgatcctatatgaccaatggaccacactggtctaggcagaagatgctgctcactaattaggacaaaaccatgcctggaaaacgaatgtgcttgatgatatgcctgcgctttttacttagagcaccgaatgtacactacgcgttatttacagtgcatactgaatagacattttttacctgagaacc

SEQ ID NO: 574 - DNA, 362 bp, Triticum aestivum
  Clone ID: LIB3280-009-P1-K1-D12
ggatgccaagatgggaactgcacaatgaataatgatggttaaacatcagcaagtggatatgagctttctgaatgtttcctcaagagtcaaaactagtgtgatactatgatgttgcaacggtaagtaagttggctacggctcgaggcggtgacactttgtaccactactactgcattcaagacccggatccagcatagatctgcattcaaaagatacatgtcaaaataaaaatgtatttgcacataatgtgctaccattttttttcttgagcaaacatattgtgctagttagagccggtaaaattatcttagcttggaattcttattacaaacaagattaatggataactttgctttttttaa

SEQ ID NO: 575 - DNA, 377 bp, Triticum aestivum
  Clone ID: LIB3280-009-P1-K1-D2
cccacgcgtccgaaaatacaagacttggttgcacaggtggatcccctcggcaaacttgatccagaagtggaagatttggttttagagattgctgatgacttcattgaatcggtgactgcatttgcgtgtaccctggcaaagcacaggaagtcatccgttctggaagccaaggatgtgttgctgcacttacagagaaattggcatctgacagttcctggtttttcgaaggaagacaagcatccacagagaaattataactgcaacaggtaaaggcagtagtggatccccaacagccagagtgtgacgctgctggagttagaagcgcaagcaataaattagttgcttataattcaattgccaaccatcaaacaagaggt

SEQ ID NO: 576 - DNA, 433 bp, Triticum aestivum
  unsure (1)...(433): unsure at all n locations
  Clone ID: LIB3280-009-P1-K1-D3
attcgttgctgacaaaggaatcgcacagctcatggatcatatgaataacttgacaagggtgaaaatatggtgtgagtccactacggaagccagcagcataactcatctttcaaagtccattaaggggttcatccagagaggtagccatgcaagtgaccatcgttcactctcactgaatttcaacgaatgttcagaagacttgctgagttttaccctggaaaaatcctgccatctcagtaaactgaagctacaaggcaacatattcagtctacctccatttgttaccgcattggctggtctcactgagctatgcctttcatcccttggtaagttcaccggngatgtacttgcttccctgagcatggtgcactccttgcagtacctgaagctgatagcgactcacatggagaagtttgtcataagaaaggggcag

SEQ ID NO: 577 - DNA, 360 bp, Triticum aestivum
  Clone ID: LIB3280-009-P1-K1-D5
ggtagcctgtggacatagtatgactgttgcactcgccacatctggtcatgtcttcacaatgggtagctctagtaatggtcaacttgggaatccaaaagccgatggtaaactaccttgccaagtacaagacaagttgaacagtgagttggttgaagagatctcatgtggctctaaccatgttgcagtcttgacttcacggagtgaagtatatacttggggtatgggggccaatggaaggctgggacatggtggcattgaagataagaagaaaccaactattgtggacgcattaaaagaccgccacgttaaaagtatagcatgtggttcaaactttacgacattgcatttgcatacataagt

SEQ ID NO: 578 - DNA, 180 bp, Triticum aestivum
  Clone ID: LIB3280-009-P1-K1-D7
ccaacgcctacgagaccaggctcttcgtcaacctccgtagctactacacgaccaacaccctggaaacgaagtacggggcagggctcatgtcagcctttaagtggggcaccggagactcgcgcaagacacattccatggacgtgcgacggaacctgctccaatacacggacgggaggcagc

SEQ ID NO: 579 - DNA, 56 bp, Triticum aestivum
  Clone ID: LIB3280-009-P1-K1-D8
aggactatcattatgtatacttcgtactggtgatggaacaaaactacctactcatg

SEQ ID NO: 580 - DNA, 136 bp, Triticum aestivum
  Clone ID: LIB3280-009-P1-K1-E1
cgagaggatcatggccggcgtgaacaccagtgtggtcggcctcaagcccgccgcggcggtgccgcagtccgtctcgccggcggcggcaaagcgcgtgcaggtcgtcccgttcaaggaccgtgttgtggcgcttctc

SEQ ID NO: 581 - DNA, 250 bp, Triticum aestivum
  Clone ID: LIB3280-009-P1-K1-E11
actaatcactattaatcatgaaaagcgatggaaaaaaaaagcatctctcaagccgcagccgacttgcgcagttcactctcaccatgggcgaagtggcatttgtctccaaatgtgcaagagcctttggtgaagttgtcacacagcttggtcttgaagttgcttcccccaccaccacccgcaggccctttccctgggttctttgcttgaggaggtggcgttccgcctattgctagaatcattttcttcatca

SEQ ID NO: 582 - DNA, 424 bp, Triticum aestivum
  Clone ID: LIB3280-009-P1-K1-E12
cccacgcgtccgggaaaactttgtgatgctatgccctttgcatcagtcttccaagttgccaaatgaagtttctcagccacaaaagcaacccaaaaggataacagcaccaaaatgtccatctcaggtaagatctagccaagcttgcagtaataactggaaatggccatcaggatcaccacagaagtgggttctctgctgttcagctctttctgctgctgagaagggcgtcgtaacagaatttgcaaaattagctggtgtgcctatttccaagagctggagccccagcgttacccatgtcattgcatcaactgacccctctggcgcttgcaaacgcacgctgaagtttctgatggcaatcttgaatggcaaatggatcgtctccatcgactgggttaaggcttgcatggatggcatggaacctgtt

SEQ ID NO: 583 - DNA, 244 bp, Triticum aestivum
  Clone ID: LIB3280-009-P1-K1-E4
atggtataagcctctggtccatggtactagctattatactatcgctcttgggatattactatatgcagcacaaagaagatctcttagcaatgttgccacaatgaaatttttgttcagcctctactgctacctcgctgcttacctctgattatctgatcttgtgctggagataaatgctgtatcgtgtcggagctagagcaatttttgtatttaagtgaaagaaaagcgactcaaaaacgttcaa

SEQ ID NO: 584 - DNA, 405 bp, Triticum aestivum
  unsure (1)...(405): unsure at all n locations
  Clone ID: LIB3280-009-P1-K1-E7
aacgcattaaactccatctcgcagcaaagtgaagaatacgccatctgggtccaagctcaactatcaagctacgatggagatgaagaagatcgccttcgccgccctcatgggcgctgcctcggccaccgacgttgtggcctccgaagcagcaccagccagcgacgccaacaccgtggcagccgcccccgccgaagccctcgccgagggctgcttcatggcatatttgctctactgatggggacacggcaggagggagatcgatattagcatcacctcagttgcacccgcgcatgcatccatgcgaacaatggggtgttggcttgtccgctaattacatttcatttgtaacccgattatgtgaactggtgatgatacgagttatntgaatatatataattttcattc

SEQ ID NO: 585 - DNA, 392 bp, Triticum aestivum
  Clone ID: LIB3280-009-P1-K1-E8
gatttaatgagtggcgtgatgcgataagcgccaaccccagggtggataaccataagttaggaagcaataaattcaccacagaccaatttcagacagttttcttcaaaatgcgcccagctattatgcttgatgggtttacatcacatcaattaaagttaattcaacaggttttgagaaaaaactttagagacctcatgtatgtttgtacatttggcggggatgaaacatcagaaaggagagtagtttatacagacaacaccgaagacagtatattattgatgaaagatgtgcaagaagatctattcagaagaagaaatgcaatatgcggcatcagcaataggaaatccggctggtcattgattctatttgcctaaaaaagaaaattgattgtt

SEQ ID NO: 586 - DNA, 149 bp, Triticum aestivum
  Clone ID: LIB3280-009-P1-K1-E9
tttatactaggcctagatccctgagcccccgcgccgttccctccccggtgcgacacgggcggcgacccccgctcctcccgcagcctccccttaccagcccctgtccttctcgccgtcgccggtgaccttcgtcaggcaaagcctgtgcg

SEQ ID NO: 587 - DNA, 172 bp, Triticum aestivum
  Clone ID: LIB3280-009-P1-K1-F11
gtttatgacatgacaaacgacaacaaacattggtcttgtagtttgctgaatcgagataatcgatcccagtttgcgcatatctttgcattgatccatgtaataaacaatatcgggtatcttgttgatttcagatcaattgacgatggtactctttgaaaacatttgcaaagac

SEQ ID NO: 588 - DNA, 283 bp, Triticum aestivum
  Clone ID: LIB3280-009-P1-K1-F2
aacaaagtccaacttgaatatctgatttgaccctatgataataattttctgaacatgtaactgtttctgatgatatattataagaagcaacaaactaatggctggaaaaaactttttccagaacgaaaaaaaattccaattgtctactgtatcatcttttcccattcactcggtttcatcggcggcggcattcaggtcaatcttcggcttcttcccgctgctgtggacggcggtcttggtggggggcaggcggaccttaacctgacttccacggtgaccaccg

SEQ ID NO: 589 - DNA, 433 bp, Triticum aestivum
  Clone ID: LIB3280-009-P1-K1-F3
cttccaagctctactcgtctcgcaaacgaaagagcagatcatatcagaccagagtgagtttgcatctgcgagctgcgccaatggaggggagaactgctctctgtttcctcgtcgtgctcgcgcttctcgcaagccctgctctcgcagaacgcaagtgctacaaggagcgcttctactccatgatatgcatgaagtggcactgcgccatggagtgcgtcaaccagagcccggacctggtgctcaagtcggcccactgcaccaccaagcacgtcatcatgcgctactgcaactgcgagatgtgtaccaaggagtagactgctctgtctactctggtcgtctagttattagctagggaggcgtaccaccaataaactaaatccatatggagctagagaataatagttattctaggagtgtatatgcatgtcgtcga

SEQ ID NO: 590 - DNA, 385 bp, Triticum aestivum
  Clone ID: LIB3280-009-P1-K1-F4
tagaagccgcagcttcccattcctcgccgccgccgctccgtacccgctcgaagccaacccgaccatggcggacgtcgacgttgacacggaggtggccgcggtcgcgcagccgaagaagaggacgttccgcaagttcagctatcgcggcgtggatctcgatgccctcttcgacatgtccaccgacgaccttgtccagatgttccccgctcgcgcccgcagaaggttcaagaggggtctcaagaggaagcccatggcgctcgtcaagaagctgcgcaaggcgaaaaaggacgctcctgctggtgagaagcctgagccagtgaggacacatctccgtaacatgatcattgtccctgagatgattggcagccttatcggtgtctacaat

SEQ ID NO: 591 - DNA, 256 bp, Triticum aestivum
  Clone ID: LIB3280-009-P1-K1-F5
ggaacgggatggatacttgggcttaaggtaaccaggttggttgagtacaacgaacgcctgacagaattatggggggacaaccttggcgtccgggatgatcgggctcccccccacgtgtttttaagacccccagggggggttcccttgggccagttgcccggctttggggtgcccgtcgcctcccccgttgtttacggaaaccggaaatgtttttttctcaattgcggacgtgaactccagggactttggttccacc

SEQ ID NO: 592 - DNA, 418 bp, Triticum aestivum
  Clone ID: LIB3280-009-P1-K1-F6
gatcagttggttctgaaaactcgctggaaacagcatggcaagctgaagctgagacccttaagtccatcttaactggagctccccatagtaagctaggtagagtttctttggttagcgccattgctaagcagatacgtaaaaggatgaaagtgcgtcttcctaacctattgactggccttcagggtaaatcccagatggtgcaagctgagctggcaaggcttggggaatctatggtacaaagtcctgaaggaacccgagcagttgcattggagctgtgccgggaatttgaagataagttccttgctcatattacatctggcgaggggtctggatggaaaattgttgcaagttttgaaggcaagtttccagacagaattaagcagctaccattggacagacattttgatctcaacaatgt

SEQ ID NO: 593 - DNA, 418 bp, Triticum aestivum
  Clone ID: LIB3280-009-P1-K1-F7
ggcaacggcgcccgcttcggctgtcggcagccggtcctcacccattgaggatgagctccttcccaaactgcaaagtccagctcgccgcctctccttcttcctccatccacccaccactagcagctttcctcacgagctcgaccgatcgatcgaatccttccgtcgcgttcgcgtttccgtttcgtgcgtttagaccaagcttccaatggctcctctcggtgacgctgttgcccccgcggcggccgccgccgcccctggcctcgtcgtctctttcggcgagatgctgatcgacttcgtgcctgacgttgccggcgtttccctcgccgagtccggcggtttcgtcaaggcccccggcggcgcccccgccaacgtcgcctgcgccatctccaagctcggcggctcctccgccttcatcgga

SEQ ID NO: 594 - DNA, 410 bp, Triticum aestivum
  Clone ID: LIB3280-009-P1-K1-F8
cggacgcgtgggcgcgcgccgcccactatgatcatctccaagaagaaccgcaatgagatctgcaagtacctcttccaagagggggtgctgtatgccaagaaagactacaacctggcgaagcacccgcagattgacgtgccgaacctccaggtgatcaagctcatgcagagcttcaagtctaaggaatacgtcagggagaccttctcgtggcagcattactattggtacctcaccaacgatggcatcgagttcctgcgcaactttctcaacctgccatctgagatcgtgcctgccacgctcaagaagtctgccaggcctcctggccgcccactcggttctggcccacctggtgacccgccaagggggccacctctgtttgagggcgacaggcctaggtatggtgacaggga

SEQ ID NO: 595 - DNA, 350 bp, Triticum aestivum
  Clone ID: LIB3280-009-P1-K1-F9
gtcgctgctttgcgtcaggcccgacggcgccgtggcgctgcccgcggcgccccacttctggtgcaagctctcggtggagcacccgcgcggctacaaggacgagatggtcatgatggcgtccgccgtgagcagcagccccctgtccgccggcccgccggtgccggggcaggggatgttcgtggcggtgccgcacgagttgatgtccggcgacgtgctcgccatgagcgttcgcattgatcagctccaggctcctcctacttctgccttcggtgctgtcgcggccagggcaccggcgtcaccaccaccatcccatgctaggacaacataccagaggcttcagtgacaactgt

SEQ ID NO: 596 - DNA, 424 bp, Triticum aestivum
  Clone ID: LIB3280-009-P1-K1-G1
cccacgcgtccgggaagatgagagtgtgcaagacattttcatgacatgcctaggcctggccactagaactatgaaggataaagttgtcccccttgtgatgaaatttgttcatgagaatatcaatgggcctagtcgcatgatggccatttatccattaggttttatccttgaaggtccctctgttaatcaacttgctcctgtagttcctttattggttcgcatgatggaagatcctcaggaaggtgaaggtgtaagagggagggctgcatggattcttggacgggtgtttgagcttgtgggagcaaatagaatcatatcttgggaaaagaggaagaagtggtgccatcctgggatcatataattgaagttctgtacaagggtttccaagaattgtcactttaaccgtcaattttattaaagcttt

SEQ ID NO: 597 - DNA, 300 bp, Triticum aestivum
  Clone ID: LIB3280-009-P1-K1-G10
cgcctggtgcacgcgctaccaaagcttggttcagtggagttctcgctctgacgatttgataccgcgacggctccgaaatggagagcgactgccagttcctgctggcgccgccgccgcccattacgccgcggcgggggacgacggccacttccttcagcagcagcagctgagcggcggcggcggcggcgagaggaagcggcggttcacggaggaacaggtgcggtcgctggagagcacgtttcacacgcggcgcgccaagctggagccccgggagaaggctgtgcctgcccgttagctggg

SEQ ID NO: 598 - DNA, 337 bp, Triticum aestivum
  Clone ID: LIB3280-009-P1-K1-G11
gattcatccattgaacgcgaagagttcctaccggtatttgttggatgacgacaaaaaataacttgggccgttctagccctgttccaaacttcactcgtagagggttgagggcgggtggcagacgtccaacctagagcgcttcatgtactgcaccatcctggacgtcaaggcccacattcttctgaggtgacactattgcacctctcaaacctggcaccttaaatgctttgtcgtgttcaattttcactgttgcacctttcaaacctggcaccttaaatgctttgtcgggttcaattttgctcaagagttctgacaggttaaggatcttgcattgctt

SEQ ID NO: 599 - DNA, 414 bp, Triticum aestivum
  Clone ID: LIB3280-009-P1-K1-G2
tcgcgccggcccagtaggacctccccgcctgtggtgtacccggagaacagatgaacatcgtgagacggagtacactatgtacaggtgcacgtataaggcccagcaccagtgcacgcatgaagactgatcgccggctggcaatcactggagacggccacgtatgacgacagatgcctagccttgtcgctaagtttctagtctacctcttgccggtgaaatcatctttgtgttgctgtgcaccacgaagtggccattgcgcgcgcatgggccatgcacgtagtcatttgatggcagggtggcatgtttgtcaacctttcgttgaccggaaaagccatcggagccctcacgcgagatgactcgtgaccaagctcttctacgttctgcaacatcataaccatcgtctacatcgagcgc

SEQ ID NO: 600 - DNA, 113 bp, Triticum aestivum
  Clone ID: LIB3280-009-P1-K1-G4
tttgggtattttttggggcgcattcccgcatttgtttaattaaaattaaaattaaaaacccaatgtgtgctttttttttcgacggttcaatatcttggagaggaaggttgggt

SEQ ID NO: 601 - DNA, 248 bp, Triticum aestivum
  Clone ID: LIB3280-009-P1-K1-G5
ggtatcctcctggtggagggaaatgatcgaccaagtgtgcgctgacagagatacaagagggatacaccgtcgccgggggagacgacgccccttcggcgaccaacaccacgccacggactgaaacaccacccacactcaccggacaaacgctgctgctgcagcatcgtcttgtctttcacctcgaattagaacaacacgaacggtgaaatgacccccacacctaacagaacggacaccaggcacaagtg

SEQ ID NO: 602 - DNA, 381 bp, Triticum aestivum
  Clone ID: LIB3280-009-P1-K1-G7
aaagccatcacaatgtaggtggtcttcctaaagatatgaagttgaagctcattgaaccactgaagctcctttttaaggatgaggttcggaagttgggaagtatcttaaatgtcccagagtcattcttaaagcgacacccatttcctgggcctggtcttgctgtacgtgtcataggtgatgttacagcaggcaatgctttggaggttcttcgtcaggtggatgagatatttattcaatccattaaagatgcaggcatctatgatgaaatttggcaagcttttgctgtgtttttgcctgtccaaacagttggtgtccagggtggccagagaactcactcccatgtggttgtttaagggcaattaccagtagggtggcatggac

SEQ ID NO: 603 - DNA, 219 bp, Triticum aestivum
  Clone ID: LIB3280-009-P1-K1-G8
cacatagtactcctcatcccgatttgaaccagctcaagctccgtttatacggatgaggctccgcacagttgcaatgtatctcaaatttcccatagtcattctttaagcgacacccatttcctgggcctggtcatgctgtacgagtcataagtgaagttacagcaggcactgctttggatggttctttctctggtgattttgatacacattcaaatccat

SEQ ID NO: 604 - DNA, 59 bp, Triticum aestivum
  Clone ID: LIB3280-009-P1-K1-H1
tcgctaaaccactttttaactccttcttctcctgtctaaccaagacagccaccatggcc

SEQ ID NO: 605 - DNA, 253 bp, Triticum aestivum
  Clone ID: LIB3280-009-P1-K1-H12
cctaatttgggtgctcccgcttcttctttttttttattttttttttttttttttttttttttttttttttttttttttttcttttgttttttttttttgttttttttttttttattttttttttttctttttttttttttttttttttttttttatttttttttttttttttttttttttatttttttttttttttttttttttttttttttattttttttttttttttttctttattttttttttttttttt

SEQ ID NO: 606 - DNA, 247 bp, Triticum aestivum
  Clone ID: LIB3280-009-P1-K1-H6
ccttccccttcctcctcccgctcctcccctttcaaacccctctgccccctccctataaacctaggcgagggagcgcccgcagactactcccagagcccagatctatccagcccctcttcgatcgccccggcgtccttcgccatggcggctcgggcgtcgtcgtcgacgtccacgcgcgcctactgcggctcctttcttcaggaactgcaggaactatggggggagataggcccggatgaactgggaa

SEQ ID NO: 607 - DNA, 418 bp, Triticum aestivum
  Clone ID: LIB3280-009-P1-K1-H8
actagttctagaccgcatcactccactccacctacctgtctcgccctccttgttcacatcatccatctcccttggctttccgttggacgcttcgagagagagaaggaggaagaagaaagatggcggacgaggggacggccaactgcatcgacatcatcctcgccatcatcctgccgccgctcggcgtcttcttcaagttcgcctgcgggatcgagttctggatctgcttgctgctcaccttcttcggctacctccccggcatcatctacgccgtctgggtcatcaccaagtaggactgcaggaggggctcctctgcctctgccgctaggtgatccatggcgaacctgttctgtgtctggcacaagccgtttgtctgagatgcgagctacagttcatggtgctgcctgcctacatgtgt

SEQ ID NO: 608 - DNA, 57 bp, Triticum aestivum
  Clone ID: LIB3280-010-P1-K1-A1
ctccaatcggctcagggggaatgctggaaatagcctcctaagtatgcatggcgattg

SEQ ID NO: 609 - DNA, 390 bp, Triticum aestivum
  Clone ID: LIB3280-010-P1-K1-A10
ggactggcgcttaccgccagctcttccaccctgagcagcttatcagtggcaaggaggatgcagccaacaacttcgcccgtggtcattacaccattggcaaggagattgttgatctctgcctagatcgtatcaggaagctttcagacaactgcactggtctgcagggattccttgtcttcaacgctgttggaggtggaactggctctggccttggttcgcttctcctggagcgtctctctgttgactatggaaagaagtccaagcttgggttcacagtttacccatctccccaggtcttcacttctgttgttgagccatacaacagtgtcctgtccacccactcactccttgagcacaccgatgtctctatcctttttgacaatgaggcca

SEQ ID NO: 610 - DNA, 266 bp, Triticum aestivum
  Clone ID: LIB3280-010-P1-K1-A11
cctaggcgtgctctactaccacccccacctgattgtcgatcattataaattaaggatggctagctgtggcaaacttatcactcttctcctcgattattgctcgctatctacaagaaaactattttaggggcttgctgatcacaaggagcaacttggcgctgctctctgaccttgcaggtactacgatggcacgaacgccgaggcggcccaagattttaggaactgccgtgtgttcccatgcgagagagcttctgtgtttatcaaag

SEQ ID NO: 611 - DNA, 69 bp, Triticum aestivum
  Clone ID: LIB3280-010-P1-K1-A4
agcgcagatcgcaactgtcggtaggtcataagcagttgatggcgatagcgcgttcggtggtcaagggcc

SEQ ID NO: 612 - DNA, 426 bp, Triticum aestivum
  Clone ID: LIB3280-010-P1-K1-A5
cttggaggggtactaagatcacccttacctcaatgacgatcagtataaatcaagggttacttgctggccaaactgatgacgcatctcctcgatgatgggttgttaactacaagaaaactattttaggggcttgctgatcacaaggatcaacttggagctcctctctgaccttgcaggaattacgatggcaagaacgccgaggcggcccaagagttcaggaactgccgtgtgttcccatgcgagagagcatctgtgtttatcaaagcgaaggaagcctgctgctgacatcgctggaggaatactggagatggtgggcctgcagctgacattgctggaagtttgatctttcagagggcggagcaatcccgaacgagaaaactgctggcgtgagcaaaacatggaactgcatctgtgtttatcaaagcg

SEQ ID NO: 613 - DNA, 230 bp, Triticum aestivum
  Clone ID: LIB3280-010-P1-K1-A6
atcggagtccaaacatcaagcaaaaaaggcattggtttggccctccaacattcccctataacatcgaaaagccaaaccggcattaccatattaccggcctaacatacctcctgtacacagctacatttggacaccacacatactgagaagcaacccaggtccgattctaagataccccggatgctcctatcaactgagggtagtgacccagccatataaccttgcatcac

SEQ ID NO: 614 - DNA, 53 bp, Triticum aestivum
  Clone ID: LIB3280-010-P1-K1-A7
ctccaatcggtttatgaataatgctgaaaatagcctcctatggatgcatggag

SEQ ID NO: 615 - DNA, 461 bp, Triticum aestivum
  Clone ID: LIB3280-010-P1-K1-B11
ttcgtcccacgcgtccgcttgtcttcactcatcctgttttccctgatttacaaatgttatctacagcaagactagggggtgtgttggattgtcaatcagaatgttgcataattttttcatgcacaaacgttgaaataatgatgaattagttatcatcaaagctgtgtatgctattgatataatgttggccatccacacacttatacatacatccttccttaccatagatcgtttcgtgcgacaagttctagattgtcacgtattgagatgcaaacgagtctttctgttggagcagcatatttttttgtatacaacattcagccgcctatagacgaaagatgccattctaagagatacatatggttggtttatgtttaagaacaagtacgcatatttttatatgccgattatagaatgcaaccaatcgtacactccaagggcaattttagcatagtggtgag

SEQ ID NO: 616 - DNA, 395 bp, Triticum aestivum
  Clone ID: LIB3280-010-P1-K1-B12
aagaaataataactttggtaatgatcagggaggccacatacatactaacagacggtccttacactgaagaacacaacggtggggtgcaggacacgcactgcatgtgctcattcaaattacacagacaaacaaatatcacgatacctaatcaaacgatcgtggcatcattagcgcgcgtgcatgcaggatctccgtgcggtcgatcgatcgatcgatcctgcgcgcccaccgcacgagcaatgcatgcatgcatgcccggtgtaaccggcggataaatatttaattagtactcgacgccgacggacggagggtcgtcgatcagaagtcggcggaggtggattttccccccttgtcgccctcgcctgtctcggcggatttatgctgaaacttgtgag

SEQ ID NO: 617 - DNA, 195 bp, Triticum aestivum
  Clone ID: LIB3280-010-P1-K1-B3
ccggaccggcgagcggcggaggaaggcgttagatggcgttttcatcggccggagaggagacggtgcgggcgtcgcacatcctgatcaagtacgtgttgtcccgtcgcatggcgtcctgtaaggtctcttaggtacgattaatatcttcgacgactttggtagtctattaagcatgtaaaagttgactcttgaaat

SEQ ID NO: 618 - DNA, 177 bp, Triticum aestivum
  Clone ID: LIB3280-010-P1-K1-B4
tcgttgttgatttattcaggcctcaaaaaattgtccaatttcattccattcataaaaaagagggcaaacacgaggttttgctatgcccatttggcccgctagcttttcttatatttgaaaaaatgcctacatcataaaacagtacccttattgcattgttctgaattttgaaaaact

SEQ ID NO: 619 - DNA, 430 bp, Triticum aestivum
  Clone ID: LIB3280-010-P1-K1-B5
ctagtcttcacacaacaagtttctcctgatttacaaatgtgatctacagcaagttagcaggtgtgttatattgtcaatcagaatgttgggtaattttttgatgcacaaacgtagagaagatgatgaattagctatcatcgaagctttgtatgctaatgatagaagctcggccaaccacacacgtatacatacatccatccttacgggagatcgatacgtgcgagaagttctagaaggtcatgaattgagatgcaaacgagattttcggatggagcagtatatttttcgtaacttagtccagtgccttcgagaaagatgccatctaagagatacaaattttgtctcagtggaagaacaagtaggcatatttttatatgccgtttcaaagaatgcaaccaatcgtacactccaagggcaatttcagcatagt

SEQ ID NO: 620 - DNA, 434 bp, Triticum aestivum
  Clone ID: LIB3280-010-P1-K1-B6
cttcgccacggtggtgctggtgtcgctgctgtcgctgcacggcaaggcccgcaccgtcttctgcggcctcgccgccaccgtcttctccatctgcatgtacgcctcgccgctctccatcatgaggttggtgatcaagaccaagagcgtggagtacatgccgttcctgctgtccctgtccgtgttcctctgcggcacctcctggttcatctacggcctgctcggcctcgaccccttcatctacatccccaacgggtgcgggagcttcctgggcctgatgcagctcatcctctacgccatctaccggaagaacaagggccccgccgtcggcgccggcaagggggaggacgccgacgaggccgacgaggtggaggacgccaagaaggcggcagctgcagtggagatgggcgaggcaaagatcaaggtcgacgacgaca

SEQ ID NO: 621 - DNA, 123 bp, Triticum aestivum
  Clone ID: LIB3280-010-P1-K1-C1
gggaatttcagtttccgtgagcaactttggaggggctttaccgctcgctcaaacgcctttggatgaactctgttccttggtgaaatttcccaccaggcagttaaataactgcatcgttgtttc

SEQ ID NO: 622 - DNA, 406 bp, Triticum aestivum
  Clone ID: LIB3280-010-P1-K1-C11
gtcttgagcatctgccattcaacatgaaaacctattggctgacgtgcacagcagattgtctccctccccagagttgtaagttgtaacctgaaatgtgaagctggcatgtccagtctatacagctgttatgtgtaaacttatacagttggagtactagtctagttatgtggctctgtgacggtgtgcaaatgtagcaagccagagatttatttctgaccacatttctatggtgataaaaaaaaaaaaaaaaaaaaaaaaaaaaaaaaaaaatccatattataaaaaaaaaataaaaagtaattaaataaaaaaaatatattaaatattatcaatttatattaatacttcatttttaacttaattttttttttttattatattttatacatcctttctttatttattt

SEQ ID NO: 623 - DNA, 197 bp, Triticum aestivum
  Clone ID: LIB3280-010-P1-K1-C2
ctacctcatacctggagtctgcgtcgtcggatacgtgcggccacaagcgcgccatgaggcgccacctgaaaccactgggctgagtcgctgcagcgggcgaaatcatacatacacatcaaatgggcaagacggaaggagccggcctgagtaaccatctagatacgaaagaagggggatcagtctctacgctggggatc

SEQ ID NO: 624 - DNA, 390 bp, Triticum aestivum
  Clone ID: LIB3280-010-P1-K1-C4
aagaaataataactttcataatgatcagtgaggccacatacaaacgaacagacggcccttacactgaagaacacaacggatgggtgcagcacacgcactgcatctgcacatccaaattacacagacaaacaaaaatcacgatacctaatcaaacgatcgaggcagcattcgcgcgcgtgcatgcaggagctccgggcggccggccgatcgatcgatcctgcgcgcccaccgcacgagcaatgcatgcatgcaagcccggggtaaccggcggataaatatttaattagtactcgacgccgacggacggagggtcgtcgatcagaagtcgccggcggcgggtttcccccccttggcgccctcgccggtctcggcggtattcatgctgaagct

SEQ ID NO: 625 - DNA, 383 bp, Triticum aestivum
  Clone ID: LIB3280-010-P1-K1-C5
gtgcggcggcttagggttttaactcgcatccattctcaaggtaagcgccgcctcctccacgaacctcgattcagaccgtccttcacctcacacgggctcctgtttgattattccggtttgttcttgtgccatcgcgtccgtctcaggttagcaggaggcgggccatggcgccgtcgcagcccaagtcagggctcttcgtgggcatcaacaagggccacgtcgtcaccaagcgcgagctgccgccacgcccgtccgaccgcaaggggaaaggtaccaagagggtgctgtttgtcaggaacttgattagggaggttgctggatttgctccctatgagaagcgtatcactgagcttcttaaggttggaaaggacaagcgtgcactc

SEQ ID NO: 626 - DNA, 132 bp, Triticum aestivum
  Clone ID: LIB3280-010-P1-K1-C6
ctatctatttttagagagccgactttggatattaactgggatgcattcttacggaaagagccacctcctctacaatgaagaattcagaccgtgcttaaactaacaccatctcatgtttgattactacggaca

SEQ ID NO: 627 - DNA, 344 bp, Triticum aestivum
  Clone ID: LIB3280-010-P1-K1-C7
tcgcgaacctctcgccatttgccaacagacctcagatctcgctctcgcctccttgcgcagccgtcgtcgagagcagcaagaaaatggcggcgagcaacctcgagggtgtgctcctggggatgggaaacccccttctcgacatctccgccgtcgtcgacgaggccttcctcgctaagtatgatgtgaagccgaacaatgccattcttgccgaggacaagcacttgcccatgtacgatgagttgtccagcaaggacaatgttgaatatattgctggaggagccacgcagaactctatcagggttgcccaatggatgcttaaaactcctggtgcaacaagttacatg

SEQ ID NO: 628 - DNA, 413 bp, Triticum aestivum
  Clone ID: LIB3280-010-P1-K1-C8
ggctctgccaacgctggagcaggcctccgcctcctcgtagtcggcgtcggcggctacatccgcccacaaacgcccgctggggcgccaccgcgtaccactgccctgtgtcgctccaacggtcggcatcatacatacacatcaaatgggcaagtcggatggagcggcctgaggaaccacctgatccgaaaaaaggggatcgccccacgctgcggcctcgaccccaacctcgcgggcgtccggcatgacgtctccactccgtcaccacgccatgagcgcctccagcaagaagcttccggtggccatcgtgggcgtacacggcggcaaggagatggcctccggtctcgtgttccggcaggagatcctccatgtggtgctcgtcacgttgcagagatcgatccaaacgaggctgtagc

SEQ ID NO: 629 - DNA, 365 bp, Triticum aestivum
  Clone ID: LIB3280-010-P1-K1-C9
gcacacgtccaactggtagaccaacatgctgacgggccttttggtcccttacattttcttcaccatgcccggtctgctcttcggctttataaggggggagattggcagctgggtggcgttcgttttcgtcgtcctgcggctattctttccgcgccacttccctgattggctggagctgcctgggtctcttatcctcctcacggtggtcgcccccgtcatcttctcggacaccttccggggctcctggctcattatcggcgtcggcgtgtgcctggtcatcgggtgctacctgctccacgagcacatcaaggcgtctgggggcctcaaggaggcctttcagaatcccaatggttggtccaacacca

SEQ ID NO: 630 - DNA, 432 bp, Triticum aestivum
  Clone ID: LIB3280-010-P1-K1-D1
ggacaagaccaactggaagaccaacatgctgacgggcctcttggtcccttacattttcttcaccatgcccggtctgctcttcggcttcataaggggggagattggcagctgggttgcgttcgttttcgtcgtcctgcggctattctttccgcgccacttccctgattggctggagctgcctgggtctctgatcctcctcacggtggtcgcccccgccatcttcgcggacaccttccggggctcctggctcatcatcggcgtcggcgtgtgcctggtcatcgggtgctacctgctccacgagcacatcaaggcgtcggggggcctcaaggaggccttccagaagcccaatggctggtccaacaccatcggcatcctcctcctcttcatctacccggtctgggccgtcgtgatgtggttcctgtagaccgttcg

SEQ ID NO: 631 - DNA, 414 bp, Triticum aestivum
  Clone ID: LIB3280-010-P1-K1-D10
gtctttgacttgcatttgagcagcttgcggaatgctaatattaagactctttgggaggatgatgtgcatcctcactatgtaacaagaagatatgctgaatttacagcgtctcttgttcatctcaatgttgaatatggggatggtcagcttgatctaaatcttgagcgattacggatggctattgaagacttgcttgttaagttggccaagatgttccctaaaccaaagatgcaaactgttttcctgataaacaactatgatttaacaattgccatattgaaggaagctggcactgagggtggaaaaacacaacttcacttcgaggaggttcttaagagcaacattgcaatatatgtggaggaagtgcttctggagcatttcagtgatttgatcaagtttgttaaaacgcgtaca

SEQ ID NO: 632 - DNA, 250 bp, Triticum aestivum
  Clone ID: LIB3280-010-P1-K1-D11
ggcacgcgtggggaacaatagattaggggatgctattggcataccatgtccagtttctccgcatgcacttactatgtgcaagacagaagcagtagcttacggctatccatgtggagaccacaaggtcacgactgaagatgggtttattctgagcttcaaaaggattcctcacggtcatgatactggtaactcaaccgtggaggagaacacaagggatcctatactggcatttcacgggctttttgtggat

SEQ ID NO: 633 - DNA, 319 bp, Triticum aestivum
  Clone ID: LIB3280-010-P1-K1-D12
tcgggcactgtcatctattcatacatatgaccaaacgattttcataggacgcccatggggggtggtgttggaattcgagctcaacactcacagagttatgcatcttacatagcgcatgttacatgactaaaggttctgtcggcattttcttcagaagatgccacaggctcgctaaaagctgcaatctgggatcctgatcccgatgtttttctggaaaatgaattaccctatggagagtggtgccctgttgctgatgaagtgctagataatagttatgctatggcaattggctgagtttggattagatcgctagggtata

SEQ ID NO: 634 - DNA, 440 bp, Triticum aestivum
  Clone ID: LIB3280-010-P1-K1-D2
cccacgcgtccgattttggggctgttgttgctttgtgggatgaagaggaggacaaatggattgaaaagtcatatgtaatggatcattggacagaggagggctttgggccaaggatggattataatgtactcgatatgatattccataatgatgccttccaccttcttacggaagaggaggacatcatcagagtgcttccatatgctcaaggggtgcagaagttgcatgtgtggcgacgtatggacagagaagttgatgagatgtttgaagataaccttcatggcaccacaatcaagtaccttgtcgaatcgacaggaggttatcttgttatgtgcatcaagtacgtccgccgtggcagaacagagtcgattaacatgtacaggttatcagttcctgagaagaggtggcataactacagatcgcctgagggtgaagtgatc

SEQ ID NO: 635 - DNA, 427 bp, Triticum aestivum
  Clone ID: LIB3280-010-P1-K1-D3
ccaggtacaatgggaccaagctcatcctcctcgtccctagctactacacgactgccgtcctgcatactccctcctgttcatggagcatctggacctcttcatggaggtttgaagcatctgtcagtcaaattttgaagcaggccaattggaagcggcaccaattggcagcgagaggcagaagaggaattgtgacaccgtgttccatgctccttcagacatggagtccaggcgggcgcggttccgtcaccccgcggactccattggaggaggccccaccccgcgtgtggccgacttggagttggagggcttcctaccccacgccccttgtctgctctgacgatgggttcctcctggccgtgatgatgcctgagaccgtccgctacacccacatgaaggacgacggcatctgtaacaacgtctgcaacaa

SEQ ID NO: 636 - DNA, 409 bp, Triticum aestivum
  Clone ID: LIB3280-010-P1-K1-D4
gctctgccgcccctgcagccctcatcatcctcgcgcttctcccgaaccggcgtctcccgtccgcctcggcgccttccgtagcaggccagggccggagccgagaatgaagcgtccgcacgcgtccatctctcccttcgagccccttcgatgcgcccccgactgtcgccgccatcttcactggaagctctacgatggtcaagactggggaaggatgccgaagatgtagaggttgttgccccagtgacgctggagcccattcaaaggaacagaagatgcgcgtttttcctcctgaccatttgagtggtgttctgtgcaatttatgcttgttttgaaaatttggttatagacgtcgaatttatctccaatcatctggtgtactatatcttctacaatctttcatattttagca

SEQ ID NO: 637 - DNA, 435 bp, Triticum aestivum
  Clone ID: LIB3280-010-P1-K1-D5
gcgtgattcaaatggcgcaagcagaggttctggatttgttgcttttaaatccgctgatgatgcttcccgagctcttgctgaaatgaacaacaagatggttggcaataaaccactttatgttgcactcgcacagcgcaaggaagacaggaaagctaggctgcaggcacagttttcacaaatgcgtcccgttccaatggctccaaccgttggtcctcgtatgcaaatgttacctcctggtgttccagtcggtcagcaaatgttctatggccagccaccagcgtttattaacccacagcctggatttggcttccagcaacctttcatgcccggaatgaggccaggcggtgctccgatgccgaactttatgatgcctatggttcagcaaggacaacaaccacagcgcccagcttgtaggcgagctagtgctggtggaat

SEQ ID NO: 638 - DNA, 433 bp, Triticum aestivum
  Clone ID: LIB3280-010-P1-K1-D6
cccacgcgtccgtacatgtcagctggtcagataaatgtcccaattgttttcagaggaccaaatggtgctgctgctggagttggtgctcaacactcacagtgttatgcagcttggtttgcgcatgttccaggacttaaggttctggctccatattcttcagaagatgccagaggcttgctaaaagctgcaattagggatcctgatcccgttgtttttctggaaaatgaattactctatggagagtcgttccctgtttctgatgaagtgcttgattctagttttgctctgccgattggcaaagctaagatagaacgcgagggtaaagatgttacgattactgcattctccaagatggtcggctatgctcttcaggctgctgagatactgtccaaggaaggaatcagtgctgaggtgatcaaccttcgatcaatta

SEQ ID NO: 639 - DNA, 428 bp, Triticum aestivum
  Clone ID: LIB3280-010-P1-K1-D8
caggagcttgagaaggagcaggagacccagcagccaggactcaccggcagacccccgctcgccaacggcaggtctggaatgttgccaatgtcgagccctccagcaaatccgggacagcttaccattttttatggtgggtcagtatgtgtgtatgactcagtgccaccagagaaggctcaagcaatcatgctcattgcagcagcagcagctgcggcctcaaaaagcaatggcaccgctgctgttaagcctccagcgatgtctgcgaccaatgctatccaagccatgcttacgcggtcgctctcactccagagcacttctgtagcaaatggacaacctcaggctgtcgcggatcctggctcgatttgcaagcttcaggctgatcttcccatcgccaggagacactcccttcagcgcttcctggagaagcg

SEQ ID NO: 640 - DNA, 421 bp, Triticum aestivum
  Clone ID: LIB3280-010-P1-K1-E10
cgtgctctcacccttacatttccagatctctctcccgtgggcggcggcggctgtagatcaaagcagcaatggagcaacgacgtggtagaggacggatcaaggtcgtccactgatctactcgtgccctgcttctccttggcaaagcggcgcgtgccggccagaggaggtagcgccggcggagctgcctggcagatcaaggcgccggcgcggccggcgggcatagcgcgagcggccgcgactggtggagtagagctcgcaggagtggctgccgcatcagagtgcccttgcgcgttggcagagtgtggcatgcatgcgtggtgagcatgggcaagtgaggtgtacgtgcgtggttttccaatctcagatttttcttgttagttttctgcgacaggagcttcaagaaaaaagggactacacgagc

SEQ ID NO: 641 - DNA, 415 bp, Triticum aestivum
  Clone ID: LIB3280-010-P1-K1-E11
gatctcgccaggatgtaataaaaaatcacacattagagtggattgagaagttttatccaggcttatttgagcagatccattttgggaatcattttgctttggaaggccaatcaaggccaaagtcggagatttgcagatcttttggtgctcaggtcttaatagatgataacccgagatacgctttagaatgcgctgaggatggaatgagggttctgctctttgattatgataacacgtatccctggtgcaaaactggtgtggatcaatcacatccgctggtgaccaaggttcataactggcaggaggttgtgcaaaaacttctctcgtggggagcacctgagagctgacattcttatttgtccgatgtgagcagcagaattatgctcagcagacaatatctcactttctgaaggaa

SEQ ID NO: 642 - DNA, 169 bp, Triticum aestivum
  Clone ID: LIB3280-010-P1-K1-E12
cacgcgtcgcgcccacgccattcgtctggttatgaaccatatatgatactgatgaaactggggaatggcgtcactaggatcacattttaggttcgttgtgatggtacgatgctacatcggataactcgtattattttctagagttaatacatgccaacaaaccccgact

SEQ ID NO: 643 - DNA, 430 bp, Triticum aestivum
  Clone ID: LIB3280-010-P1-K1-E2
cccacgcgtccggccgccgccgacgttgctcgccgtccactcctcctacccgtcgacgagatgacgaatcgcaccaagaaggctggaattgttggcaaatatggtacacgttatggtgccagtttgcgtaagcagatcaagaagatggaggtgtctcagcactccaagtacttctgtgagttctgcgggaagtttgctgtgaagaggaaagcatttggaatttggcgatgcaaggactgtgggaaggtgaaggctgtcgactgcttacaccatgaacactgccagtgcagtcactgtcaggagcaccatccgtggcttgtggtagcagactgaagcataagttgctaccagcagtgttttgtcctaaggaattatcttgtgtttgcagttcagacgatactttggattcaggtctggtggctgtttagtc

SEQ ID NO: 644 - DNA, 359 bp, Triticum aestivum
  unsure (1)...(359): unsure at all n locations
  Clone ID: LIB3280-010-P1-K1-E3
cgcagctcttgttgcgttgtatgaggagaacgacaagccatcatctgcagtcgagtttgttcagcagaaattgggtggtccatcgatttccgactatgaaaagctcaaagctgagaagttggatttgcaactgaagtataatgagcttttagagactcacaaggaaacaagtagacagttggaggaacttaagaatttgaagatcgacgcaccttggaactaatggaactgacaggtgttgacatagtagcttgttaccaagcaaatatatatgcctcttcagtttggatcaccaagtcatgtaaaaaagaaacatccattggacccaggaaataaatcaatcgacatactgctgcnct

SEQ ID NO: 645 - DNA, 437 bp, Triticum aestivum
  Clone ID: LIB3280-010-P1-K1-E5
aagctctcagctccttcccagctccacggtttccagcaagcaaaccgaagcactagatcctcgatggctcgcgtggcactggtcgccgtgttcgccgtgctcgcggcactggcggtggcggagatggcgtccggggcggtgacctgcggcgacgtgacgtccgccgtcgcgccgtgcatgtcctacgcgagggggcaagcgtcggcaccctcgggggcgtgctgcagcggggtgaggaccctgaacgccaaggcgtccaccccggccgaccggaaggcggcgtgcaactgcctcaagaacctggcggggtcgggcatcagcatgggtaacgccgccaacatccccggcaaatgcggcgtctccgtctctttccccatcaacaccaaaaccaactgcaacaaccttcactaagttatctaccagcatcatcatcacac

SEQ ID NO: 646 - DNA, 437 bp, Triticum aestivum
  Clone ID: LIB3280-010-P1-K1-E6
ccctgttattgtgagaattcttaattcaagagttatagggagggacttatgtcaccacaaacagaaactaaagcaggtgttggatttcaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacaaccaatggatctgttatgtagcttatccattagacctatttgaagagggttccgttactaacatgtttacttccattgtaggtaacgtatttggtttcaaagccct

SEQ ID NO: 647 - DNA, 111 bp, Triticum aestivum
  Clone ID: LIB3280-010-P1-K1-E7
gtacattgatattgagcaaccaacctgaagcttgctcgactttggtattgggcaatttttagcaaggagttttcataagcgatccattaattgtgctgaacagtttgagtc

SEQ ID NO: 648 - DNA, 407 bp, Triticum aestivum
  Clone ID: LIB3280-010-P1-K1-E8
tttcgttttgttcgttgtatgagaactacaagccatcatcctctgttctgtgggttcagcataaatagtatggtcctccacctccccactataaaaagctcacagctaaatagattggtttgcttcccaagtataaagtgctgctagagactcacactgaaacaagactacctttcgaggaacttattaatttgtagatctactcaccctgtaactaacgtaactgacaggagttcgacatacatatcttgttaccacatccaatatatatgtcctttcatgttggatcaccccttcatgtattataagaaacattccattggactcctgaaaataatattaatgtccacttctctttggtcttcttctttgatatatatttaaattggtttttttaactatatata

SEQ ID NO: 649 - DNA, 283 bp, Triticum aestivum
  Clone ID: LIB3280-010-P1-K1-E9
ataaaactggtcatcctcctgcagggttgattatcatcaaatcagaagcgacgacagcatattattcccgtgtgcacgaaaactcagtgcgattctacaaaaaaatcatggaagcagagctagtagaatcctaggctcggtgcaaaatctggtcactcggatcagcatgttctatgtgacagcatgccactgtgggctcacaagaacctgtccactgtggcgggcaaagccgggtctgcaatgtcaccgataactgttgcctttcttttgcccgccttgaaga

SEQ ID NO: 650 - DNA, 418 bp, Triticum aestivum
  Clone ID: LIB3280-010-P1-K1-F10
cagagagatcgcgggggaggaggatgatgggagggcgcgcggtgctcctgctggtgatctcggcgctgttcgcgcagatcggcgcgtcggatccgctgttccacgagtccttcaacgagagcttcgacgggagctggatcgtgtccggcaaggaggagtataaaggtgtatggaagcacgcaaagagtgatggccatgaagactatggtctccttgttagtgagcctgccaggaaatatgccataatcaaagaacttgatcacccggttattttgaaggatgagacagttgtcctgcagtttgaagtgaggcttcagaatggccttgagtgtggaggtgcttatatcaagtacatccgtcctcaggctaccggatggaacgccaaggactttgataatgatactccgtacacaattat

SEQ ID NO: 651 - DNA, 269 bp, Triticum aestivum
  Clone ID: LIB3280-010-P1-K1-F12
gtgaccgatgccgcagctctgatgctcaggaagaagatccacagattaccgatagtgaaccaggacaatcaagtaataggtatagttacccgcgatgactttctttgcgcgttgtaggccatgctgaagttttagagatgcaggagtccatgcccggttcttgtggatctgtaaatatgtgtgtgcgcgtgtctttgtgtagcaggcatattctattgtgtgtaaaagtgtagtacagtttctatatctaaaaatatggcatggagcta

SEQ ID NO: 652 - DNA, 60 bp, Triticum aestivum
  Clone ID: LIB3280-010-P1-K1-F2
ctaggttggaataattcgagcctaggcaggctctgctcatcgcaaacgtgcacttgcttg

SEQ ID NO: 653 - DNA, 186 bp, Triticum aestivum
  Clone ID: LIB3280-010-P1-K1-F3
gggacggaatcattattatgtaagcatatatatagtagcaagctgtgtatattcaccacttcagcatacagggctcgggtctaaggccacaggtcgactggaaccaagtacctacaaccgatcttaattatacctgagagggtcccgggtggaatgggcgccgggaaccgattatacatgcggggc

SEQ ID NO: 654 - DNA, 203 bp, Triticum aestivum
  Clone ID: LIB3280-010-P1-K1-F5
ccgcagccgccgccggcatgtccaccaccgcgcgcccgctcgtctacgtcaaggccctggacggtgtcatggccaccgacgcggccggtgttccgatgccggacgttatgaatgcgcctattcgtcccgacataattaccttggtgcacagggtccgtttctgaaacatacgccagccctacgccgtcttccgagagggcggt

SEQ ID NO: 655 - DNA, 156 bp, Triticum aestivum
  Clone ID: LIB3280-010-P1-K1-F6
gccatgcttgtgcaggcatgtaccaatccgcactgtggaacggctaatggctgaccaaggaagttatggtatgtgcgagcgcacacgctactctaataaccgtatttatggtagagccaattcgtgcaacaatcccacactggtgggaggggcgca

SEQ ID NO: 656 - DNA, 338 bp, Triticum aestivum
  Clone ID: LIB3280-010-P1-K1-F7
gtgctccagcagaacgccctggagctggaagggagcaaccccggccacttgtggtggtccgaaggcctccgggcgccgccgcaccacgctgccccggcgccaacccagtcgcaaacgcccgccgtttccgctagcccgagggaaacaatctcagggaaccaggctctcgaaaccgagtcggactctgacagcgagtcattggtcgagattcagggcggccgatgcaagcggagcggcaaatcatcagataccaggcgaataagaaggatggtgtccaacagggagtcagctcgacggtccaggaggaggaagcatgcgcagctgactgaccttgagtt

SEQ ID NO: 657 - DNA, 254 bp, Triticum aestivum
  Clone ID: LIB3280-010-P1-K1-G1
aactgctctcctcccaatctcttcttcttccgccccaagtcgcctcaccggggatggagatcgacgcggcggtccgggcgagcagcgactcccggctgcgcaccaagtacgacaacgccgtctacgtggttcagcgtgcctttgcgctctacccgtttggggagattgccttcagctttaatggcgggaaggattcaaccgtactcttgcatttaatacgggcaggatactatctttacaaaacaagtggtggg

SEQ ID NO: 658 - DNA, 282 bp, Triticum aestivum
  Clone ID: LIB3280-010-P1-K1-G11
aattcgaaacatggcacaggagagtgtcgttcgttggcttaacgagttacacatacacggcatcctgctatcatttgtgtatagagttgcatacttaagtacaacggggacacatccgggaagcagcacagtacaaaattacgcaaaagttattcttgtgaggattcaaatctcgagaggattcaaatctccacaataatcacaaaccacctatagtgtccttcaggcctctatggatgtgtttgccctacttgcatatgatcattggccggtgccgtgttt

SEQ ID NO: 659 - DNA, 369 bp, Triticum aestivum
  Clone ID: LIB3280-010-P1-K1-G2
cgcatatctccttttggccccagatctctacggcgcacggtttctacgcgatggccgggccactccggggggtcttaccctccctcggacgggccctgctatcggctacgccggcgcggatgctctccgcggagggcttcgaagccctcttggagatctagcccggacagaacgtcatggtctccggaatcccagaggagcaccttcagcgcaaggtgctaatcgagacaccaggtaggactgcatctcagcaaggttaaagctaagccgggaggcggaaaatcaattacatggtaacccaaaagtgggtgaacccattgatggcatggacaacgactggtgatccggatgctaaatgtaggtgaatgc

SEQ ID NO: 660 - DNA, 406 bp, Triticum aestivum
  Clone ID: LIB3280-010-P1-K1-G3
aaagccatcacaatgtaggtggtcttcctaaagatatgaagttgaagctcattgaaccactgaagctcctttttaaggatgaggttcggaagttgggaagtatcttaaatgtcccagagtcattcttaaagcgacacccatttcctgggcctggtcttgctgtacgtgtcataggtgatgttacagcaggcaatgctttggaggttcttcgtcaggtggatgagatatttattcaatccattaaagatgcaggcatctatgatgaaatttggcaagcttttgctgtgtttttgcctgtccaaacagttggggtccagggtgaccagagaactcactcccatgtggttgctttaagggcaattaccagtgaggatggcatgactgcaaattggtatgattttgagcg

SEQ ID NO: 661 - DNA, 358 bp, Triticum aestivum
  Clone ID: LIB3280-010-P1-K1-G4
gttctcctccgcctccggtctcgagagctcgccagaatggtcgcccacaggttccaccagtaccaggtggtgggtcgcgcgctgccgacccccggcgatgagcagcccaagatctaccgcatgaagctctgggccaccaacgaggtccgcgccaagtccaagttctggtacttcctgaggaagctcaagaaggtgaagaaggccaacggccagatgctcgccatcaacgagatctttgagaagaaccccaccaccatcaagaactacggcatctggctgcgctaccagagcaggacctggtaccacaacatgtacaaggagtaccgtgacacgaccctgaacggcggcgtggagcata

SEQ ID NO: 662 - DNA, 172 bp, Triticum aestivum
  Clone ID: LIB3280-010-P1-K1-G5
attagtttcatttgttttttttttttcttttttctttttttttttttttttttaaatttatcttttttatttattattcttaactataaaaaaatcaagaacgaccaaaacacaaaaaaaaaaaaaaaaaagggtaatgaagaagtgcgaccaaaaacaagacaggagcagg

SEQ ID NO: 663 - DNA, 408 bp, Triticum aestivum
  Clone ID: LIB3280-010-P1-K1-G6
gaggctgcaagacattgacctggagggcgaccccttcacctctgctcgtgtagccgaatactgcgtgcctgcctgccatttgcttgctcaccgagagatccatcagtcccgattctctcacaatgccgaagaccagatcgtgaccttaggccaattgacctgcatcatcctggcaagcgtcctggaactcaagaggagcgccagtggcatctgagactgttgtcgcaacgggcagccatgggacatgggcacaggatgtgctcatatatatgacgagaggcagggcctccgtaacatggtcatactacttgacaccaactcgactgtcactagcacggccgtggcagacagcaatgtcagtgaactgtatgggtccaagtgaccgtcagtgcttgtcccgcctacgac

SEQ ID NO: 664 - DNA, 325 bp, Triticum aestivum
  Clone ID: LIB3280-010-P1-K1-G9
ggacggaccgacccgcgtctctctatgcggccaccaagaaggctggtgaggagatcgctcatgtctacaaccacatctatggcctctcgctcaccgccctccggttttttaccgtatatgggccgtgggggcgccccgacatggcatactttttcttcacccgggacatttcttgctggtcggccaatcacggtttacgagagttccggtggaggcacacaccagaccaccatttcccgggatttcacctacattgatgatattgggaaaggatgtattggggctttggatacagctgggcggagcacaggcagcggcggcaaaa

SEQ ID NO: 665 - DNA, 308 bp, Triticum aestivum
  Clone ID: LIB3280-010-P1-K1-H1
catggatcagcttcttttgaatcctgaatcttgctactctgctcagctttctcagatggagactgagacgcttctagcccagttagttgagacagatatgaacaaacgtgtgcagtaaggcacttacaaaggaaagaagtctaatgctattcgccatttttttggctaccaagcaagaggtgccctgccgtcaaactttgattgtgattacgcatatgttgtggggcatgtctgctttcacatcataggtagcggtctgaatggctacatggccactgtaactaatttaaaaaggcctgtgtaccagt

SEQ ID NO: 666 - DNA, 274 bp, Triticum aestivum
  unsure (1)...(274): unsure at all n locations
  Clone ID: LIB3280-010-P1-K1-H10
gaaancgngtggggactccacgcgtccgccgagacttcctatgtctcttcattgtagccccttgcagagaggccattttaagaacgggggcattgcgtggcactaagaatttgccttgggaggcctatttaccatatgcctctacagaggacgatgccagcttcatcatgggaacaaatgttgtcgatgcttttgatacagaagtagcttcagagattccaatccttcagagtgaccaggatgttttcggacgtgaggtattgaaccttctaag

SEQ ID NO: 667 - DNA, 154 bp, Triticum aestivum
  Clone ID: LIB3280-010-P1-K1-H3
gggatagcaaacaacggaccgttatatattattattagaagggctgaggataaatttctagcttttagatgaagccctgccgaggttacagcttccgtagccccccttgaacaggccgccatggcagattcgtgagagaaaattttcagtccag

SEQ ID NO: 668 - DNA, 317 bp, Triticum aestivum
  Clone ID: LIB3280-010-P1-K1-H4
acgagattgcctaagtctcttcattggagccccttgcagtcaggccattttaagaacggtgcattgcgtggcactaagaatttgccttgggaggcctctctaccatatgcctccacagaggacgatgccagcattatcatgggaacaaatgttgtcgaagctattgatacagaagaagctccagagattccaatccttcagagtgaccaggatgttgtggtcgtgaggaatgaaccttctaagcagccagcaactattaagctgccaatgtggctgttagggccttcagttctgttggttaccggtataggtccaac

SEQ ID NO: 669 - DNA, 232 bp, Triticum aestivum
  Clone ID: LIB3280-010-P1-K1-H6
gtgaattgttgctgatacgtgtccctatctaaattatactagcagcctaactaccgcggttcgttcattattagtgagtaaattaggttttgttcttgatttccgatgcggttgcgtactcatggtggtgaattctctcgaccgcccatcttatcacgtcgaatgggccaaaatgagcattaaggtttgtttgatttgcaaaaatataaaaattaaagggctggccgtttta

SEQ ID NO: 670 - DNA, 157 bp, Triticum aestivum
  unsure (1)...(157): unsure at all n locations
  Clone ID: LIB3280-023-P1-K1-A1
cgcgcgctcgccttccccactacaggcacagncagcgagcgcactggtggcgcaacgatggcgctggtcttctccttctccgccaccggcgtcgcggcgctccccagcaatgggctggccggcgcctggagctcctttctaggcgcagcctgcaagg

SEQ ID NO: 671 - DNA, 215 bp, Triticum aestivum
  Clone ID: LIB3280-023-P1-K1-A2
aaagcccaacccttcctactttatcacctttgcgacggtaccgtaaccgggtggggccatcgttatccccctcttactcggagtttgaattaccctgcactcgttgtgcttaggaacgatgaagccgtcatttcgtccgcaccatctacgtgggtaaaattcccgttgacattccgtagagggaaaatgaggtactttattttcatttacggtcc

SEQ ID NO: 672 - DNA, 403 bp, Triticum aestivum
  Clone ID: LIB3280-023-P1-K1-A3
cccacgcgtccgccatctcgtacgccaccgagaacgtcaactcgcacgagtgttgttctcgacaagtacatcgacgctctctacgagaagaggggttctacaagagaggcagcgttggcttcattggttgatgcttttgaaagttttatgcttggtggtcttgttgagaacaaatatgccactctactgagtctattcaatacttcgatcaagaagggatctaccaaggaggcttgcctggcatctcgcgccattgggctactgtctattacacttggtgctggcagtagctcacatgaaacaatggtagaatcacatccacagctttctaaggtccttcaaacctggtcggatgcttcaaagatgatctctgctcttgactgcttggcggtcgttacatttg

SEQ ID NO: 673 - DNA, 94 bp, Triticum aestivum
  Clone ID: LIB3280-023-P1-K1-A4
ctacatcttccagtgcgagccgcgctggcagctcgcctacctctcacacatgtgggtcgccggcgccgtcaccgtctacgcgctcatgtcgtcc

SEQ ID NO: 674 - DNA, 131 bp, Triticum aestivum
  Clone ID: LIB3280-023-P1-K1-A5
ttgatggttcatacggtgtgcctgctggtcttatctactccttcccagtagcgtggagtggtggtaaatgaacaatatttcaagggcttccgatcgatgagtttatcgggaagtagatggatgctaccgtc

SEQ ID NO: 675 - DNA, 215 bp, Triticum aestivum
  unsure (1)...(215): unsure at all n locations
  Clone ID: LIB3280-023-P1-K1-A7
cccacgcgtccgcccacgcgtccgcgcgcttccgtttccgtttccgtgtcgtggccgtcgactcccccctcgccncggcggctgagtcgcccgcactcgctgcgcttaggaacgatgagccttcgcaacggccgcaccatctactttnncntttttcctcggggcatcccctagagggaaattgaggatctttttttcaagttcttgacctattg

SEQ ID NO: 676 - DNA, 313 bp, Triticum aestivum
  Clone ID: LIB3280-023-P1-K1-A8
aaaaaaaaaaaacgcaaaaaaaaaaaaaaaagaagaaaagggggggaaaaaaagaggagaaaaaaaaaaaaaaaaaaaagaaaaaaaaagaaaaaaaaaaaaaaagaaaaaaaaaaagaaaaagaaaaacgaaaaaaaaaaaaaagaaaaaaagaagaaaaaaagggaaaaaaaaaaaaaaaaaaaaaaaaaaaaaagaaaaaaaaaaaaaaaaaaaaaagaaaagaggggaaaaaagaaaacagacaaagacgaaaaaccaaacaaaaaaagcaaaaagaaaaaaacaacagaaaaaaaaaaaaaaaaaaaa

SEQ ID NO: 677 - DNA, 339 bp, Triticum aestivum
  Clone ID: LIB3280-023-P1-K1-B11
gcggctggtgagtggtttacagctcgagtatcatcctgtggtcttttccatatagcctatccaagtgccaccgatccgttgaaaacagaactgaggactatttatggccagttatgccaagatgacatgcctatggtcagaagggcagctgcatcaaatcttgggaagtttgctgccactgttgaacagagccatttgaagacagaaatcatgtcgatctttgatgatcttacccaagatgatcaagattcagtacgtttattggcagttgaaggctgtgctgctcttggaaaattgttagaaccccaagattgtgtagcccatatcctttcagtcatt

SEQ ID NO: 678 - DNA, 372 bp, Triticum aestivum
  Clone ID: LIB3280-023-P1-K1-B12
tgagtgagttcatggagagacatacagtgtccaaactcatcggatcacctgcgggttatgttggctacactgaaggaggtcaactaacagaagcagtccgccgccgtccatacacagttgttctctttgatgagattgaaaaggcacatccagatgtcttcaacatgatgcttcagatcttagaagatgggaggctgacagatagcaagggacggacagttgatttcaagaacacactgttgatcatgacatcgaatgtcggaagcagtgtcatcgagaagggaggccggaagattgtgtttgaccttgactctgatgagaaagataccagttataacaggatcaagagcttggtgaccgaggagttgaagc

SEQ ID NO: 679 - DNA, 113 bp, Triticum aestivum
  Clone ID: LIB3280-023-P1-K1-B2
gccaaagcacaaatcaaacccagacccgagcccatccatccatccatccatggtgagaactctcgaggtctcggcgattcgggggagatggctccgtcgtacctcgtgattaa

SEQ ID NO: 680 - DNA, 422 bp, Triticum aestivum
  unsure (1)...(422): unsure at all n locations
  Clone ID: LIB3280-023-P1-K1-B5
aatttccttcaacaacccatgcttatgatctgagaacactctatttatgtactgatgtacattggatgccgggcttttaattttgagtgtgtgtaatgtgatgtctggcattcacttgaagtggcactcctatatttgcttataatataaatacttgtttgtgcatacgcaaatattttgtttatgcatacctgaactcctagctagcacttgacaacttattctctggtttcctattaattaaatggtacaccctccgttccaaattactcgtcgtggttttagttctggtttcctgcctcnttgatttgttcaagtattatcggcacattagttctttcattgagtagtgtgtattttctgctcatctaggtttgacaactagttccttgctctgctctgctcctgcttggtgctcgcag

SEQ ID NO: 681 - DNA, 430 bp, Triticum aestivum
  Clone ID: LIB3280-023-P1-K1-B6
ggataagtgggtggaattctctgcagcatggcataaatgcagcattccttgctgttgtttacagcgactacatgctgacatcacaaacagctgcagtggagtgcagtggaaaatattttagtccgacagatattcgcaatttcgctatatcacaggcaaattacgtgctgggtgacaacccaatgaagcttagctacctggtgggatacgggagcagctatccgcagcaggtgcaccacaggggggcatccatccccgcggatgcgaaaacgggctgcaagggattcgagtacctccattcgtccagcccgaacccgaatgtcgccacgggagccgttgtgggcgggccatttcagaatgactctttcgtggacttgcgcgacaatgcggtgcagacagagtccagcacttacaacagctgcacattcgt

SEQ ID NO: 682 - DNA, 429 bp, Triticum aestivum
  Clone ID: LIB3280-023-P1-K1-B8
cccaacccttcccactggattggcagatttcaacaagttgagtgctaagcttatcttcggtgctgacagtcctgctattcaggagaatagggtggctactgtgcagtgcttatcaggaactggttccctacgagtgggaggtgaatttcttgcaaggcactatcatgaacgcacaatctacattccccagccaacctgggggaatcacccaaaagtcttcactttagctggcctgactgctaggagttaccggtactatgatcctgcaacttgtggactggatttccaaggactcttggaagacctcagttcagctcccttaggcgcaattgtactgcttcatgcatgtgcccacaaccctactggtgtcgacccaaccttggaacagtgggaacagatcaggcagcttatgagatcaaagcaatgctg

SEQ ID NO: 683 - DNA, 361 bp, Triticum aestivum
  Clone ID: LIB3280-023-P1-K1-B9
ctcaagaaggagacgctccggattgagcccgatgaaggctgtcccggccgcgtcctcgtcgccttcaccttcgatgccaccgtcgctggaagcatgactgtctacttctttgcaaaggaagagctcaactgcaatctaacagcgatgaagccagacttgattaagcctgttactgttagcttcaaagagggtcttggccagaagtttaggcaaccttcagggacaggaattgacttctcagcgtttgaggactctgagttgttgaaacaggggggaatggaaatatatccacttgcagttaaagctgaaacaacattggctgctgatcaaccattggagggggaagacctgaaacccaaaa

SEQ ID NO: 684 - DNA, 83 bp, Triticum aestivum
  Clone ID: LIB3280-023-P1-K1-C1
caaataaatggggtgggtcattgtaagaacaagagagtaatgtcatgatcatcaacacaaataatgtcactccactcaacaac

SEQ ID NO: 685 - DNA, 72 bp, Triticum aestivum
  Clone ID: LIB3280-023-P1-K1-C10
gtgttcagatcgcggcgtctcctttattttttttattggttttattttattttttacatttttttttttatt

SEQ ID NO: 686 - DNA, 422 bp, Triticum aestivum
  Clone ID: LIB3280-023-P1-K1-C11
gatgtatgatgatctggatttacccttcgcaaaattgcgtctactgccaaaaggtggacatggcgggcataatgggatgagaagcattatcaaccatctcaaacaaaatcgtgattttccacgtctaagaattggcattggacgaccacctgggaagatggatcctgccaactttgttctcaggccattcaccaaaaaagaacaagaagagcttgatttcacattccataggagcttggaagcaataagaataatggcacttgaaggattcaacaagagcgctactttcgtgaacactgcccagtcatccgaaatgctgaatagatgacaggccaattcattgtttcttgtgccaaagcgattgagtttaagtgatgaactagggttaagggaactgataggggtgttcagatacttgcatt

SEQ ID NO: 687 - DNA, 364 bp, Triticum aestivum
  Clone ID: LIB3280-023-P1-K1-C12
ggagggaagcacatgggttcggagcttgtacagagagtagcaatcaatgaaatagctgagagtataatggcattcaatacaaactacaaggacactggcctgtttggtgtctatgctgtcgctaaggctgattgcttggatgatttggcttttgcaattatgcaagagatgagcaaattatcatacaaggttaccgaagaggatgttattcgtgcacgcaatcagctgaaatccttcatccaacttcaccttgatggcttcactgctgttgttgaggatattggacgccagcaactcatttatggcccgagaattcctattcctgagctttttgcgagaatagatgcagttgatccgagcacta

SEQ ID NO: 688 - DNA, 403 bp, Triticum aestivum
  Clone ID: LIB3280-023-P1-K1-C2
cccacgcgtccgccacaacgccccactcccctctccagctatggatgcagatggcatcgaggccaccaccgggcctcccgactcctctttcttccacgggctcagctcagcgctcgcccaatccctcgcgcacgccgcgacccacaccggctccagcgcctctccttctccttcttcatgtcttctcctcaccttcttagcttttttcccttgttcatgcagggagcacaaaaggagcctcgcctgtggaagtggatccgaccgtccccgacctcgtctactccttccgtcgccggattagacgcgcctcctgccggatccgtcctaatcgggctcgtctactcctccccggggccgggattgacgcgccgtcgccagatccggcttcattggaccggatccg

SEQ ID NO: 689 - DNA, 426 bp, Triticum aestivum
  unsure (1)...(426): unsure at all n locations
  Clone ID: LIB3280-023-P1-K1-C3
gcgcggaggcggcggcgacaggcagcgatggccggcggtggcgccgccgcgtcggcgctctcgagcccgtggagggcgctgctgcagcgagcgctggacgccaacgcgcacctnaagcactccaccttcttccagctcgccacggtgggcgccggcggcaggccggcgaatcgcaccgtcgtgttcagggggttccaagagcactgcgacaagattcagattaacacggatgcgcggagcaacaagattggggagatcaaggaatggcccctcggcgagatatgctggtatttcaccgattcctgggagcaatttaggatcagcggtatcatagatgtgatcgatggttccagtccggaccctgccaagctccagcaacgagagaaagcttggttcgccagttcagtgaagtcaagatcacaatac

SEQ ID NO: 690 - DNA, 430 bp, Triticum aestivum
  Clone ID: LIB3280-023-P1-K1-C4
ggagaatatttttaaacaatatatgtcctcgaagcctgttatgagtgcttctcgtgtgcggacagaactggacttatatttgtggaagaggaaattatccataggccagagggtcttgacatcatcaattggtggcagtttggaggtatcaagtatcctacattgcgaagaatggctcatgatatactagccattcctgtaacaaccgtggcatcggaatctgccttcagtactagtgggagaatactaagtgcacatagatgttcacctgcaccaaacatgaccgaagctcttatgtgcatgcaagcttggtcccgtgcagacatgttaggggattgcaattctactctctttgcggactttgaaactgttcttaaggatgacacagaaatgatggaggttgatgatcaatccatcttaaccgaagcct

SEQ ID NO: 691 - DNA, 235 bp, Triticum aestivum
  Clone ID: LIB3280-023-P1-K1-C5
gctagatatagatcgacagcgtatgcccttgaagcctgttatgagagctggtggggggcagacagaactggacttatatttttggaatgggaactcatccatagtgctgagggattagacaccatcaattggtggcagttacgatgttttaagtattgtacattgcgatgtatggcttatgatatacttgccattcttttaacaaccttgggatttgaatctgtcttgagttcta

SEQ ID NO: 692 - DNA, 98 bp, Triticum aestivum
  Clone ID: LIB3280-023-P1-K1-C7
aatctaggggtgtatgtgttatttttttgctaagttaattccttacaatctgtccccacttgtaagaaagtgattaaacctagtgaaattttaataat

SEQ ID NO: 693 - DNA, 78 bp, Triticum aestivum
  Clone ID: LIB3280-023-P1-K1-D11
cccacgcgttcgcccacgcgtccgccgagccggacgcagaggaccgcaagggcgatggctctcaacttgcattgaggc

SEQ ID NO: 694 - DNA, 436 bp, Triticum aestivum
  Clone ID: LIB3280-023-P1-K1-D12
cccacgcgtccgcgcacacgcgccaagctctctctctcgcaacgacaatggcggacgagaagctcgccaagctgcgcgaggccgtctccggctctcggccagatcagctacaaggagaagttcgggttcatcagccttgttttctgttacctcagcggtaacgaggagcaattttagtgggtcaagatccacactctcgccgacgtggtggttgtgtttttctttactctatttgttcctttataagatccttgtttctattaattttttttttcgtatagttttttcttcttatacttaatctttttttttgtttcctattttttgtgtctatttaataatatttttttatttaagtgttaaattctgttttaattttttatttatttttttatctttaatcttttttctttaactttttttattatttaatttt

SEQ ID NO: 695 - DNA, 434 bp, Triticum aestivum
  Clone ID: LIB3280-023-P1-K1-D4
ctttttcttgaaggatcagattttgagaagattcaacgggaggaaccattggatctacctccgatgccaccacagagaagaaattggaagggcgctcttgtagcaccttttgctagcaacaatatgttggctttataccaatgccctggcaaaaatgatggcaaaaaaacatctcaggaccaaaaaagctcatattttttgcaagttctacacaatgaagccccagtttcgatgccgggctgcagcaacaaggatttatgcccattcgaggagttcaaggaaaagatagtgaagccgcacctgaagcacgactacaatatgctatgcaagaagccgggggtggcagcagaggaggagccatcctctttcagctccaagctcaacttcttccttgatctgctctcgcggaaaggttaccgttttaaggggcaaga

SEQ ID NO: 696 - DNA, 415 bp, Triticum aestivum
  Clone ID: LIB3280-023-P1-K1-D8
tcagcttagatctttccactgcttccgccatggacgccgaggccgccgccgccaccgccgccacggctacgcctccggcgccctcctcccaacctctgggctccatcccgcagccccctcctccaccccctcctccctcctccgtagtacacacgcctctccctctccagactgcgccgccggtcgccagcttcccttctgcggcctatatccacgcgatgcgcgtcgagagtgcccacatcaacctcggcgtccgcctcgatatgaaaggggccaactactcgacttggcgtggcctcatgcttgaggtcatcgaccagtacgatgtggcggcttggatcgcgccggacttcaccaaccgtgccggcgacgtggcgtggaacatcgtcaacaaagccggcaagcgctggttcta

SEQ ID NO: 697 - DNA, 96 bp, Triticum aestivum
  Clone ID: LIB3280-023-P1-K1-E1
tcggttggccattttacctaaaactcgtgatctgtaagatttatgtttcgcactgaagagatatattattggcatgacactggaacttatcttaca

SEQ ID NO: 698 - DNA, 201 bp, Triticum aestivum
  Clone ID: LIB3280-023-P1-K1-E10
agaaacggaaaaggcacaagttgtgcggtgccacaaaatttgctgcgtcctcttcttctacctctagcacatgaatgttttcttgagagaatccttgggctaagagagttgcaaggtagagaagaaagcggtgctacgagaggctgctccaacaattggcatcagagccttgtcgatcctctgcttgtgtagcttttcttt

SEQ ID NO: 699 - DNA, 430 bp, Triticum aestivum
  Clone ID: LIB3280-023-P1-K1-F1
agccaacaacaattatactacgacccgacacgccccctccctcagtccctctgttcatcaatctttctcccgtcccccaaacctctcgatctcggagcagcgatgactcgcggcgaccagagggagcgggacaggcagagggcgcaggcgcggaagccggggaccaagggccgcgacgacgggctcacgccggagcagcgacgagagagggacgccaaggcgctgcaggagaagaccgcaaagaaggcggcgcaggccacgcagggggccgacgacgccaagaagaagaacgtcgccggcaagaaatagttcggatccgttctgtctgtctcatgaattgtcatgaagtggagagatgttctgatgtagaatttctgtgcgatgttggtgcgctcggcttgtagcacaattctttcggcgcctccagatc

SEQ ID NO: 700 - DNA, 374 bp, Triticum aestivum
  Clone ID: LIB3280-023-P1-K1-F10
cggacgcgtgggcgcgccgccgccgcagccgcctccgtctccgccgccacgatgccgtcgcacaagaccttccggatcaagcagaagctggccaagaagcagcgccagaaccgccccatcccctactggatccgcatgaggaccgacaacaccatcaggtacaacgccaagcgcaggcactggcgccgcaccaagctcggattctaagccggggatgacgatgatgacgcccgttgccgccgacgggagaagggtctagggtacctagggtttatggcgtctcgttgttttttgaagctaggatgggactccgggatgcctgttttaagattaagaattcgcctggggttgagagatattaattattactggtt

SEQ ID NO: 701 - DNA, 424 bp, Triticum aestivum
  Clone ID: LIB3280-023-P1-K1-F3
cttccccaaaacgcacactgcaccaccccacacagatctaaacccacccccatccccaccggcggcgagcggcggcgagccacccagccatcgaagatgcagtacaacaacctgggccggtcgggcctccgcgtcagccagctctcctacggcgcgtgggtgaccttcggcaaccaactcgacgtcaaggaggcgaaatccctcctccaggcctgccgggacgcgggggtcaacttcttcgacaacgccgaggtctacgccaacggccgcgcggaggagatcatggggcaggcgatccgggacctgggctggcgccgcgccgacgtcgtcatctccaccaagctcttctggggcggccaggggcccaacgacaagggcctctcccgcaagcacatcgtcgagggcctcaaggcctcgctcaagc

SEQ ID NO: 702 - DNA, 409 bp, Triticum aestivum
  Clone ID: LIB3280-023-P1-K1-F4
cggacgcgtggggcaccgctgctgttaagcctccagcgatgtctgcgaccaatgcgatccaagccatgcttacgcggtcgctctcactccagagcacttctgtagcaaatggacaacctcaggctgttgcggatccgggctcgatttgcaagcttcaggctgatcttcccatcgccaggagacactcccttcagcgcttcctggagaagcgccgtgacagggtggtgagcaaagctccttacggcgccgggaagccattcgaaggcatgggagcatcttctgggatggaagcggtcgcggagggcaaggcccagtaaccctgaaagaagaaagacggccctgcccctgatgtttggaaggaaaggggcgtgtgttagctgatgtgatgttacaccgtagaatcatcatc

SEQ ID NO: 703 - DNA, 232 bp, Triticum aestivum
  Clone ID: LIB3280-023-P1-K1-F6
aatccgagcaggattaaccaagttaaattaaaaacatccaggtcagatcagcattcaacacccctccaactcaactgtacaagtttccaaccctcagaacacacacccaaacctttatccttcttccattatacacctaatcttgtctgctcaaaaataaataattttaatttaatttatttaaattaaaataattataatttaataattattaattttattttttttttaa

SEQ ID NO: 704 - DNA, 425 bp, Triticum aestivum
  Clone ID: LIB3280-023-P1-K1-F7
cggacgcgtgggtgaaaggcagaaaaacgagaataaccgatcaagacaagccatccttatacaatctacaaggttgcacggtaatcacggaatggtacatacaaaagaaaagaactggactaatttaactcataacagcaaaggaacaccgaaggggcacacagaacatctcccttgcagaccaatcaaacttcaataatgacataagccgattgatgatcataaaacaataatacagaaaagaaccaagacgagggatgtgtacattacaaaggaaactaggttcttctactttaacatccgtgttcgtgggtgtttccatcttccaagattttcgttgccactaatttacacccatgaaaacttcccaacttttccagaaagcggtttgaagatcatatacattgctaaccaaactatcactc

SEQ ID NO: 705 - DNA, 352 bp, Triticum aestivum
  Clone ID: LIB3280-023-P1-K1-F8
cccacgcgtccgcatcaaacttagcttttttgttgatttctactggaactctatgtttctatgtcgagaggcagacgatatggtgcctggttatgttatttgcacaattgtcgtggacattaatccttcagttttgaatgttgaatcgtgtcgatgtcctgtgttagatgctgcatctcttgttcaatgtgctatttgtgatgagtctttttgttgttgtttcaatatgagatatttgctcaagttgttatgcatgtaatagatcatgacatggtcactcacatagtgtttgtctgttaatatttatgctgtgcaggtccagcaagaacataaaaatgcaactttcaatgtg

SEQ ID NO: 706 - DNA, 320 bp, Triticum aestivum
  Clone ID: LIB3280-023-P1-K1-G1
aaatttgacacaaaatacaaagcgggccagtaaaccaggacagaggtgtacaatcttaaaatatacataaccgaaaaggttcactagtgagcttgcagctcaagagcagtatgttgaccaagtagcaacatgctctaaattggggaactgaatccggacggccgaagacagcatccccacattgagcttgtgggtgagcgacaccttctccttcaatgtccacttctgaaccgtttgcttgcaattctgacacactagactcttataaagttttatgttcttcagactcaacgactgttatatggcaattgagtcaaagc

SEQ ID NO: 707 - DNA, 447 bp, Triticum aestivum
  Clone ID: LIB3280-023-P1-K1-G10
ttttgtagatgagttgaatcacggtggttgagaacaagaatgtgagtggtggtttataccctgattcaggctagctaaaattctaacggctatgcttagctcatttgaaaagggtcaccttttccatgtcggtgcgacttatctatgaatttccaacctaacttgtcaagaattctttgtattgcttagtttaggggggtgatttttaattaagtaaattttagttccattggcttctgtatattggtatttttttatatagtgtcctttattttatattttttttgcgttttttttatttaatatttgttattataatacctttatcttatcttatattttattttttttttgtctattttctatttttataatttttttttattttttattttgtcctatttgtttttttttttttttaaattttatgttccacttttttttttt

SEQ ID NO: 708 - DNA, 332 bp, Triticum aestivum
  Clone ID: LIB3280-023-P1-K1-G11
tctacttcgaatgatgcttcgagtccaacatactggccgtgatggacgcgtgagtgaatgacggcgtggacttactttcgttcttcctttttggcccttccataccatttgttaatgacctgtttgcaaactcttctacttagttttattatatattatcattgtagttttttaaattactattatttttatatactatttatttttattattattatttttttttatttttcattatttttatgttataatttttctttttctctttatactatttattttattttcttctattttcattttattttttatttctattttaattattaatt

SEQ ID NO: 709 - DNA, 404 bp, Triticum aestivum
  Clone ID: LIB3280-023-P1-K1-G2
gctcgacttgcgctgccattcgcccattggcaagtcagaacgtttgtcaggtgcctgagatgaaaggaagctcgcaattgcagttattgtgtttagcctgttgttttggggtcacttgtcccatagagaggtgatacctgtaattaatctggatcttaaccctcttgcttggaaaatatattcagtgctaccatacctcttgtatgagtgttatgtatggaattgcactggtctgtttcttgagtttctacctacaagtacttgtgtgatgcatttggcagtaccttgtttgtttatataaagttgaacatgtgagcacttgcataaataaaaattttaataatattaatttattttacattcttttacttttatttttattttttttctatcgtttttatttt

SEQ ID NO: 710 - DNA, 99 bp, Triticum aestivum
  Clone ID: LIB3280-023-P1-K1-G3
cacaacttcttcatcactactatttgattgtattatattgtatcattgatgattgacagtgcatgttacgcttgcatttaccacacaagcattgccacc

SEQ ID NO: 711 - DNA, 255 bp, Triticum aestivum
  Clone ID: LIB3280-023-P1-K1-G5
cccacgcgtccgggaagacgctgtgaaaatattacttggtcttcgtgagaatgtatggagcttatcataaatgcaaattcactctagaagccatcaatgcagcagtttatttgtcagcaagatatatcccagacagacagctttctgataaggctattgatcttattgacgaatcttgcagtagagctcgaattgaatcatttcaaatgaagaaggcaggacagtttttcgttctttttaaaggagccggatgaa

SEQ ID NO: 712 - DNA, 191 bp, Triticum aestivum
  Clone ID: LIB3280-023-P1-K1-G6
cggacgcgtgggctcagctcatttattgagttggaaaagaagcaattgtggaaatgagtattctcttttcttttcttttcagtccatcgttgtaagaagatactattgattcttgcttggtcattccgtagtaactggttccttgacttaaaactatgttttttgggttgagtttattatactttgtcttt

SEQ ID NO: 713 - DNA, 139 bp, Triticum aestivum
  Clone ID: LIB3280-023-P1-K1-G8
tctgtccaaggggcatcactacattttcaccgacgacaagtaggggttggagagcgttctattaaagcacattgaagacattcatgttctgataaccacttcattccacccagcctatgttactgcatataggttcaag

SEQ ID NO: 714 - DNA, 293 bp, Triticum aestivum
  Clone ID: LIB3280-023-P1-K1-G9
cggacgcgtggcggacgcgtgggggaaaacgtgagatcaatggcaccatcggaatcccatctcgtcttgctcctcgccgtcgtcctgatcgccgccacgccgcagccttcggcggccgtcagggacaaggcccctgccccctccagcagcaacgttgtagtagcaaaaccatcggcatggtgcattccctgcttttcgtttctaccctagatattctgtataccaccgttgttctgttcaccaacgcctagtgcgctgtcaccaccagtgatgccggtgccgaatgagtgtct

SEQ ID NO: 715 - DNA, 139 bp, Triticum aestivum
  Clone ID: LIB3280-023-P1-K1-H10
atacacgggaggtctactttgtcaagatcaaatgacatttcaattcctgatttatcttctatcctttactctagattgcatgtaatattctttcgttacaatatctaataataattttatatcttacatttaaattatt

SEQ ID NO: 716 - DNA, 186 bp, Triticum aestivum
  Clone ID: LIB3280-023-P1-K1-H11
gcgacggcgaaggatgcttcgagtccgacatactggccgggatggacgcggcagtgaaggacggcgtggacgtgctgtcgctctccctcggcggcccctccataccattggataaggacctgatcgcgatcggcgcgttcggggtgatgtccaagggcattcttgtggtgtgcgccggtggtaaca

SEQ ID NO: 717 - DNA, 360 bp, Triticum aestivum
  Clone ID: LIB3280-023-P1-K1-H2
gcacgatgttggtgttatgagacaggagttgcacttggccaagagctcgaggataagatgcctgtcaatgagtactatgaatacttcggtccagattacactcttcatgtagcaccaagtaacatggagaacaaaaatacacgctacgaactggataatataagaaccaaacttcttgacaatctttcaaaacttcgacatgcccctagcgttcagtttcaagagcgacctcctgatactgagttccctgagccggatgaagatgaagaggatcaggatgaaaggcatgatgaccctgtttctgatatggaattggagtatcacacaccttttgaagacttaacgaggagaatatctatt

SEQ ID NO: 718 - DNA, 208 bp, Triticum aestivum
  Clone ID: LIB3280-023-P1-K1-H4
aaaactggtcatcctcttgcaggttgggttgttatcaaatcagaagcgatgacagcaaattattcccgtgtgcacgaaaactcagtccgatttttacaaaaaaatcatggaagcagagcttgtagaatcctaggctcgttgcaaaaactgttcactcggatcagcatgttctatgttacagcatgccactgttggcttacaagaacct

SEQ ID NO: 719 - DNA, 89 bp, Triticum aestivum
  Clone ID: LIB3280-023-P1-K1-H6
caaaccctaaccctcgaatcgaagcaaccagccggcggcgatggggcagggttcttgcaggcggcatgggcaagcatggcggtttttcc

SEQ ID NO: 720 - DNA, 257 bp, Triticum aestivum
  Clone ID: LIB3280-023-P1-K1-H8
gtaatgttgaaataacactgcagttgcagggcaaggcaccgggatatgtgcagtcgttccaatgaacttgttgtgtggagcaccaacttgaatgattgtcttgcattttttgttataactactaatttgttcactaatgtggtgattattttaattgttttattattatttttatatttttattaatatacattttattatttttgtattttacttttcatatttttatctctctttattatatttcttttattatt

SEQ ID NO: 721 - DNA, 374 bp, Triticum aestivum
  Clone ID: LIB3280-023-P1-K1-H9
agaattcaggtaactgaatgaatgctggggcactggagcacgatggcggcaatcttgtaaaattcgtccgttcattctaaaaaaaaaaatatataaataataaaataaaaaaattaaatataataataaaaaaaatttattatatttttaaatattttatattttttattttataattaatattttaaattattaaaattatataatattattataatatttatatctttggtgtcctattttataatagaatataattattttaatttaatatttattttatttaaaaaatatatataatttttatttgatgttcttaacatatatattatataaattatgttattatttagtgttattttataaaattttaa

SEQ ID NO: 722 - DNA, 411 bp, Triticum aestivum
  Clone ID: LIB3280-024-P1-K1-A11
agggcacttcgtcgacggtgccactgctgatgtgactgcagatcagggtcagaagtacaaggaggatgtaaagcttttgagcgacatgggcgtcgacgcctacagattttcaattgcctggcctcgccttattcctgatggccgtggagctgtcaatccaaagggactggagtactacaacaatcttatcgatgaactcctggctcatggaatccagcctcacgtcacgatatatcatttcgacttccctcaggctcttcaagacgaatacgacggcatgcttagtcgcagattcatagatgactacacggcatatgcagaagtgtgcttcaagaactttggcgacagggtgaaatactggagcactgtgaatgagccaaacatcgagcccgtcggcggatatgatacggg

SEQ ID NO: 723 - DNA, 370 bp, Triticum aestivum
  Clone ID: LIB3280-024-P1-K1-A12
gcagatgagaactctcttttattaacagaagaggaaatgcgaatatctgtatattttaaaactgaaatgctagtagataaggggaataagaagctgaaaactactgtagttgcagatacccttggctgcaccagctcagatcagtacaaaattcaggtcatcaagagaaaactagaagagctttacataattacataacctcagctcagatttacagtaatgccgatacaccgacagatggtgccgtagagatgcaaaccctcaacatttgcactctttgagatagtagtcaaggaacttcgttttacacaagattttctcctgtaaccagagatgctgaatttcatgcagatttataagagttcccaat

SEQ ID NO: 724 - DNA, 58 bp, Triticum aestivum
  Clone ID: LIB3280-024-P1-K1-A2
cttgttatctttatttttttttgttttttcgttttatttaatttttttgcattttatt

SEQ ID NO: 725 - DNA, 313 bp, Triticum aestivum
  Clone ID: LIB3280-024-P1-K1-A3
cccaagtgttcataacagtttgcgaaaagtatggggtgaagtactcataggatgagatcttgatgaggtaccgtcaggcatatgcgcatccatggggcatatcgcggcttaaggatgttgatgatgggaggcccttttggcaacatatagttagttcttttacaggctgttcagatttagagtactttgaggaactttattattactatacaactgataaggcctggcagcttattgacctttacgcttaatatgtttttgaagcatttagattggctggtgtgagaacagctgttatatttaactttgacac

SEQ ID NO: 726 - DNA, 265 bp, Triticum aestivum
  Clone ID: LIB3280-024-P1-K1-A5
cagaaagcattagtatgactatcatgcggatgttcctagctctcttcgcccggggagagaggtatcaagagtagtagatagattcatcgtttttatgactttcaagttttttacctaatttaaattaattcattaatttcatctatgatattctggttcatttattaatcaattattccttattattcatccattatttatttttaataatcaatatttaattattattttttaataattttttttattatttatatttattatt

SEQ ID NO: 727 - DNA, 401 bp, Triticum aestivum
  unsure (1)...(401): unsure at all n locations
  Clone ID: LIB3280-024-P1-K1-A8
gtgaaagagagcggtacgaggcgcaaggcggtggtgctggcgcgcggaaggcgggggaggaggaggatgatgactgcctcctgnacataaacgaggcaactggcgagatcggcggcccgcatgggcccgagcccacccggtacggcgactgggagcgcggcggccgctgctctgacttctgagcaaccgctgccaactgggagggtaaaaacttgctcttggattctttctaagctgtaatcataaggatatggcatgggcatggcatggtggttttgttttactctgcttggggaataaattttgttgttatctctaaacaagattcttaagatttagtagttctgtaccacctttatccatgtcttaaatctttttaagttctcttttcgctttaattt

SEQ ID NO: 728 - DNA, 399 bp, Triticum aestivum
  Clone ID: LIB3280-024-P1-K1-A9
cccacgcgtccgaggccatcctcgtcgacgccgccggcaccctcctcgccgggaccgagcccatggcccaggtgtacagaacagtaggcgaaaagtatggggtgaagtactcagaggatgagatcttgatgaggtaccggcaggcatatgcgcagccatggggcagatcgcggcttaggtatgttgatgatgggaggcccttttggcaacatatagttagttcttctacaggctgctcagatttagagtactttgaggaactttatcattactatacaactgagaaggcctggcagctcattgaccctgacgctaaatatgttttcgaagcattgagaaaggctggtgtgagaacagctgttgtatccaactttgacacccgtcttcgtccacttttac

SEQ ID NO: 729 - DNA, 208 bp, Triticum aestivum
  Clone ID: LIB3280-024-P1-K1-B12
gctttcgtgggggtgaggactttctttgatgaacagaagaagaaatgcgattatttgtttatttcaaaactgaaacgctagtggatgaggggaataagaagctgaaaacttactgcagttgtagatacccttggctgcaccagctcatatcaggacaaagtttacgttaacaagagaaatctaggatagctttacctaaggacataac

SEQ ID NO: 730 - DNA, 267 bp, Triticum aestivum
  unsure (1)...(267): unsure at all n locations
  Clone ID: LIB3280-024-P1-K1-B4
tctagcgccctttttttttttttttttggaggggagaactttcttttattaacagaagacgaaatgcgaatatttgtatattttaaaactgaaatgctaggttttgngggggattagaagtgggaaacttgctgttgttgttgattcctttggctgcaccagctcagatcagtacaaaattcaggttatcaaaagaaaactagaagagctttacataattacataacctcagctcaaatttacagtaatgccgatacaccgacagat

SEQ ID NO: 731 - DNA, 238 bp, Triticum aestivum
  Clone ID: LIB3280-024-P1-K1-B7
aagtgtagggggacatgtatagattttgagctgtactttcttgacacacgaatctgtacaatttaacagccacatatgatacttctactcaaactttctagcgtaatttcagttcacctgaattactttacaaagttgaacaaaagcgcacgtgcatgttaaactgcataacatcacatcggccaaaatgctagcacatattgtaagaagccttgttcaaagaattcaaaccttcctt

SEQ ID NO: 732 - DNA, 423 bp, Triticum aestivum
  unsure (1)...(423): unsure at all n locations
  Clone ID: LIB3280-024-P1-K1-B9
cttttgtcgcatcgagagctctacccggaacggcggcgagaagggacgggcggaggagagatgccgcacctcgcgcggccgatgacggggctgctggtgttcatgggcgtcaacctcgtcctcctcagcaccatcacccccgtctacgacttcgtctgcttccacccctactgggaccgcaggagagaacgccgtcaaagggaacgtgaagcactgcaaggcaatggttctctagaaactgcaaaatagactctactaggtatctgcttacattattagcttatcacatcctggattgttcatttacgtgggatgaagaaaggttgatgaatttgcgaccaggctttttagtgtcggtgggtcattagatcttgttncgtgatgctcctgcaacgtgtcagtaatttttttgtaatggcaaac

SEQ ID NO: 733 - DNA, 416 bp, Triticum aestivum
  Clone ID: LIB3280-024-P1-K1-C10
cccacgcgtccgcccacgcgtccggcattgaacccggcagcacagtgactgtcaagtggcgtggaaagccagtcttcatcaggcgacggacagacgatgacatcaagctggccaacagcgtggatgttgcatccctgcgccacccagagcaagacgctgagcgtgtgaagaacccagagtggctggtggttattggtgtctgcactcatcttggttgcattccccttcccaactctggagactttggtggctggttctgcccgtgccatggctcccactatgacatctctggcagaatccgcaagggccctgccccgtacaaccttgaggtgcccacctacagtttcttggaagataacaagatgctcataggctaaaagcctaaaaccagtacctaccaacatatatttttcaca

SEQ ID NO: 734 - DNA, 462 bp, Triticum aestivum
  Clone ID: LIB3280-024-P1-K1-C11
cccacgcgtccgtgggttccgtctcctacgtccttgcggcggccgtcctggcggcgcttgtctccggcggcgcgtgcatccccaaggtgccgccgggccccaacatcaccaccaactacaacaaccagtggctctcagccaaggccacctggtacggcaggcccaccggctccggccccaaagacaacggcggcgcgtgcgggatcaaggacgtgaacctggctccctacaacggcatgatcgcctgcggcaacgtccccatcttcaaggacggcaagggatgcggctcctgctacgagatcaagtgccagaagccgtcgccgtgctccgacaagcccatcaccatcttcatcaccgacaagaactacgagcccatcgcgccgtaccacatcgacctctccggcacggtcttcggcgccatggccacgcccgggaaggagcagacgcttcggtcgttcgggg

SEQ ID NO: 735 - DNA, 450 bp, Triticum aestivum
  Clone ID: LIB3280-024-P1-K1-C12
cagagaaaaaaaaaagcagaggagaggaagcggaggcgacgatgtcggcgatgacggcggcggtgcccttctggcgcgcggcggggatgacctacatcggctactccaacgtctgcgcggcgctggtgcggagctgcctcaaggagcccttcaagaccgaggtctcctcccgcgagaaggtccacttctccctctccaagtgggccgacgagaagcagcagaagcccactgtgcgcacagatgatgaatgaagatcgggtgccatggtgatgttttgagaagttgttgatttatggtcagggcttaagaacttgagaataaattcttgcggtgacaatggatctattccgatactatgttgttatatttactaattgctcctgttctacttgatgaaccatgtgaaactctagtcttgtgctgctcgagtgagcgttgttttatgcatta

SEQ ID NO: 736 - DNA, 70 bp, Triticum aestivum
  Clone ID: LIB3280-024-P1-K1-C3
gtacaagtccagaattccaaatcaacccacgcatccatctagatcacagacaaccgcccttttttttttt

SEQ ID NO: 737 - DNA, 92 bp, Triticum aestivum
  Clone ID: LIB3280-024-P1-K1-C9
cccactcgttcgatcaaacctcagtttcgcgcacggagctgaccagtggagaagaattaggccggagggaaccaaggctcgctccgttttgt

SEQ ID NO: 738 - DNA, 329 bp, Triticum aestivum
  Clone ID: LIB3280-024-P1-K1-D10
tggacgcgtggggcgccaactgtttcccgcgagcgattacgcaaaccctaggtttcgctcgcgcacccggttccccagatctcgagtttgcccggcgatccggcgcgcgcatattgacgaagatgtcaccgatcatggcggcgcgcgggcaggggctgggccagggccagggccatcaggtgcagcaagatttcgacttcttcttggtggtggacttcgaggcgacatgcgagaaggacgcgcggatctacccgcaagagatcatttgattcccggccgtgctcgtcgactgctccactggccttatggtatctcgcgtcctgaagtac

SEQ ID NO: 739 - DNA, 220 bp, Triticum aestivum
  Clone ID: LIB3280-024-P1-K1-D12
ccactcttcgattctccgcttctcgccagcctcaccccgccatggcctccaccgtggcattcccccccgccatcgccgtcggcgccaatgtgcagcactctcggaggacctcttcgctgcggcccgtcccgagagccaggcccgtggccgcgagggccagcgccgagcgggacggcgccgcggcggccgtccaggcgcggtcggagaggaccatctagga

SEQ ID NO: 740 - DNA, 86 bp, Triticum aestivum
  unsure (1)...(86): unsure at all n locations
  Clone ID: LIB3280-024-P1-K1-D2
nctcctccagggaaagattaggatcgatattatctactttaaccatttttttatgtcgctcggtttttccagaatatacaaatatg

SEQ ID NO: 741 - DNA, 143 bp, Triticum aestivum
  Clone ID: LIB3280-024-P1-K1-D3
cactggagcttgagagaggatgcgctggagcttagaggaggatgcgcgggagcgtcgaggtggactcccgcgagctcgaggaggacgtggccagaggtcctgacgatgcctgcatgttattctaggcggttaggggtatcgtt

SEQ ID NO: 742 - DNA, 422 bp, Triticum aestivum
  Clone ID: LIB3280-024-P1-K1-D9
cccacgcgtccgtgactcgattatagacacaggtaacaacaactatatcaggactatcgtcagggccaacttcccgccctacggcagggacttccccgggcacaaggccaccggccggttcacggacggtaggatcagtgttgacttcctagcggcggcacttggtgtgaaggagaatgtcccgccgtacctgaagaaggacctcaccctcgacgacctcaagaccggtgtcagcttcgcatcggccgggagcggctacgacaacgccacctgcaagaccatgtcggcgctgtcgatggagcagcagctgaagatgttcctggagtacaaggccaaggtggggactatcccggacaaggccctctacctcctcgtgtggggcagcaacgacatcgtggagcacttaccttcggtgaccccat

SEQ ID NO: 743 - DNA, 163 bp, Triticum aestivum
  Clone ID: LIB3280-024-P1-K1-E12
tcgtctctctgctcagcgcagcgcagatggtagcccgtccacgccgggggcggcgagggcgatcacggcgagggcgcccgcgcgctccttgcgctgttgcagcgcgtgcagtctgaggcgctgcgcgtgctggggcctcgcgacttcgtccataatctctatc

SEQ ID NO: 744 - DNA, 452 bp, Triticum aestivum
  Clone ID: LIB3280-024-P1-K1-E4
gatatggatgaggagtatgaagacaatttgttcttacaatgtgacaagtgccgtatgatggttcatgctcggtgctatggcgaactagaaccattgaatggagtactttggttatgcaacctgtgccgacctggggcacctcgcgtgtccccacgatgctgcctatgttctgtcacagggggtgcaatgaaacctacaacagatggccgttgggctcatctagcatgtgcaatatggattcctgaaacatgcttaaaagatgtaaagagaatggaacccattgatggattgagcaaaatcaacaaggaccggtggaaacttctatgcagcatttgtacagttgcttatggagcttgcatacagtgctcacattctacttgtcgagttgcatatcacccgctttgtgcacgtgctgcttgtctatgtgttgagcttgaaattgttgacaaaat

SEQ ID NO: 745 - DNA, 230 bp, Triticum aestivum
  Clone ID: LIB3280-024-P1-K1-E6
caacactgagtacaagctggagactcttctctgcagtctaccgcagagctttgggggaaagacgttgtctttgagtaccctgtgactgaaactgcctgaagatccatgccttgaatgtcctccattttcatatctttctgatccaaatgttttggtcgaggtctcagtttgttgtgctatcaatgtttttcagaaacatagttttggttacgttctggggttaggaagtt

SEQ ID NO: 746 - DNA, 284 bp, Triticum aestivum
  Clone ID: LIB3280-024-P1-K1-F1
cagaatgctatatcaatgtacataaatggtaaaatttaggctataataagcctcctataaaaaagacttgctgtttgggatttctattgatctagcacctcccctgttttccagtctacttatgaaatcacagaggggagccacttatttcggtttggttttctttttgtcttttgaccactgaggttgctattacagaaacaaatcaacaaatggtataggatgttgccaagggctgctggtgctcatgaaccgaaaaggaagctggtgcctggttttctttc

SEQ ID NO: 747 - DNA, 136 bp, Triticum aestivum
  Clone ID: LIB3280-024-P1-K1-F10
aaaaaattgtcccgagcacgtcatccccaacctctcgaccttatcctggcaccgcgccgagacgcctgtccgaccttgcacggcgccgcccccatcttgcctgaccttacacggtgctaacccactcagtcttcta

SEQ ID NO: 748 - DNA, 367 bp, Triticum aestivum
  Clone ID: LIB3280-024-P1-K1-F11
aagagatgtttgaacatttttagtgtgttcactcatttcagatggagtgacattttctgctcaaatcaagtttaacataattgctgtaaaacagcaggaattgtctcacaaaaccccttacacttgggtcacacattactactactgctactagtacatccgagcaagcagatggcagaaacaacacatccacttcttttgcttcctctcaacttcacttttgcttcttgggcattctgtaaccaccgacaacgcaggcgtggtcgcgctcaaagggcttcagggtcacctgctccgagggcttgaactggtcggccttcagcttttccactttgttcgcaaacaccgtctcggtagcctgggtcga

SEQ ID NO: 749 - DNA, 381 bp, Triticum aestivum
  Clone ID: LIB3280-024-P1-K1-F12
atatagaagaacactgaataatgacgagtagcacatcgaactagtatatactggtactggggtcatttacttcagtttagcctctcatgacagtaagcattagccaaaggcatcaagagaccttcgtagacatcatccagcccagtatatgtgtctgggagcacttattattaagattatgaacaagtaaaagaaattctcatgctttcgctacgatttcttatttgatcctcaagaagaagaaaaactccttcccgtgcgccggcggtggcggtccagtctagagtttggatgactgctcgaccccgggatattctttacgccatgtcttgtggatgtgtgttaccacaaaacccccaggggtttcaggctttacattca

SEQ ID NO: 750 - DNA, 174 bp, Triticum aestivum
  Clone ID: LIB3280-024-P1-K1-F3
agcagataccgagacccagtccgcctgctgtgccgccttcaccttcgcgatgagggccagtggaagaagaagaggatgaggaggctcaagaggaagctccttaagatgaggcatctatccaagtatgcgaacaacgaggagaaagcttaaccttggattactacaccattcttt

SEQ ID NO: 751 - DNA, 340 bp, Triticum aestivum
  Clone ID: LIB3280-024-P1-K1-F4
gaaagttaaacaatcccaatccaattcaaggggattcttcttcccctgatccagtgaccatattcctaataaaccccaacttttgttgcctcttttcatgccacccaaaattagctgaaacaagaaacagttggtaaatagggaatgcattcctagcgcttctgctcgccggctcggtagtagtcgagcgtaacgtggagcagcagatcggagatctggcgcgccgtcggcctctcccctggcgcaagcctggtgcatcggaacgccacctcgaggaccttcgtcatggacgactcctcgcgcggcaccagcggcttgagcgcagggtcgaacacctggt

SEQ ID NO: 752 - DNA, 247 bp, Triticum aestivum
  Clone ID: LIB3280-024-P1-K1-G10
ccacgcctcactctcctatcctcctcctctgttttcagttccacttggcgggtcccttcctctgagtcggctgctgtgggagcgctggtagggtgcatggaggaggaggaggccgccggcgtgaggaagcggaagcggggcggggaggccgcggtcgtcgtggtgtccggcgaggcggtgctcgtcgagggaggcggttgcttctcgtggaaggaggcggatattgaggagggggaggagttccagg

SEQ ID NO: 753 - DNA, 450 bp, Triticum aestivum
  Clone ID: LIB3280-024-P1-K1-G11
caaccaacccttcctccttcctcaagcgcgtcagctcctccgccccggcgacccgagcgagatggtttccgccgacgcagctcgcaacgtcgtcggtatcatcgggaatgtcatctccttcggcctcttcctctcccctacgccggttttctggcggatcatcaaggccaaggacgtggaggagttcaagccggacccctacctggcgacgctgctcaactgcatgctctgggtcttctatggcctccccatcgtccaccccaacagcatcctcgtcgtcaccatcaacgggatcgggctcgtcatcgagggctcctacctcatcatcttcttcctctactccaccaacaacaagcggctgaagatgataggcgtgctcgccgccgaggcggcgttcatggtggccgtcgtgctcggcgtgcttctcggtgcccacacccacgagaagcg

SEQ ID NO: 754 - DNA, 382 bp, Triticum aestivum
  Clone ID: LIB3280-024-P1-K1-G12
gcgggcagaggcggaggatatgcggcggcgcacgttcctgccgtaccggcaggcgctgcttctcggctgcctcgggtttggttccggcggttacagcgccatgcacggcttcgccgccgccaccaccggcaagtccaagtcttgacgccagaccgccgacgcctccatggaccactagctcacgagtgtcaaacaagcaatactagtaacttcccttgtaaagtactgcggtggcaagaaggaatgcagtggaaaaagaaggttgacttgtgtatagaaaagggattattgttcccttttgtagtaattttattgtgatgtaagtgtggaattctgaagaacaaaattggtgttttatatgccccgaaaaaaaaaattatta

SEQ ID NO: 755 - DNA, 58 bp, Triticum aestivum
  Clone ID: LIB3280-024-P1-K1-G2
tttaatatttccactcttaacgttccttcctctggttcatctccttctgaatgagccg

SEQ ID NO: 756 - DNA, 436 bp, Triticum aestivum
  Clone ID: LIB3280-024-P1-K1-G3
cccacgcgtccgggaacaattactttgactcgccttcttgcacctttcatgttggatagagggatgggtcattttgttgtgatgagtagtgcagctggaaaggtgcccacacctggccaggctctttactctgcttccaaacatgctctcaatggctactttgcttctctgcgctctgagttatgtacgaaaggcattaaggtcactgttgtctgtcctggacctattgaaacaccagtatcttctggtgcaacttctttatcacaaaggcattcatccgagaaacgtgtttcagtggaaagatgtgctgaactgacaataattgccgcaactcatggactaaaagaagcatggatatcatatcagcctgggctggctgttttgtacgtagtgcaatacatgccaacaattgggtgctggcttatggacaagggtg

SEQ ID NO: 757 - DNA, 272 bp, Triticum aestivum
  Clone ID: LIB3280-024-P1-K1-G7
gtaggaaaggcatggctatggagatgtcccgtgatcacaggccaacatatgaagcagagcgtcaaagggtcactgagtgtgggggatacattgaggatggctaccttaatggagtactgtccgttactcgggctctaggggattgggacatgaaaatgtcttaaggcttgcattcacttctcattgcctagccagagtttcagcagaccattcttacggaggacgattagttcctcattatatgctgcgacggtatatggtacgttatgacc

SEQ ID NO: 758 - DNA, 398 bp, Triticum aestivum
  Clone ID: LIB3280-024-P1-K1-H1
aagaagcagcagccgcagcgcgaccccgcgagaaaccctaccgccgccgccgcagaagcagccatgggtatcgacctcgttgccggcgggaggaacaagaggaccaagcgcgtcgcgcccaagtccgacgatgtctacctcaagctcctcgtcaagctctaccgtttcctggtgaggaggaccaagagcaagttcaacgccgtcatcctcaagaggctcttcatgagcaagaccaaccgcccgccgctctccatgcgccgcctcttcaacttcatgaagggaaaggaggagaagaacattgctgtggttgttggtacaatcacagatgacatgcggatccaagaggtcccagcaatgaaggttaccgctttgaggttcacagagacagcgagggcaaa

SEQ ID NO: 759 - DNA, 93 bp, Triticum aestivum
  Clone ID: LIB3280-024-P1-K1-H10
cttagatactctagatagttcatgatcctttatagtttatgtttcagtgtgtttgtaagggtcaacttctttgtactgattcatgatatgaat

SEQ ID NO: 760 - DNA, 313 bp, Triticum aestivum
  Clone ID: LIB3280-024-P1-K1-H11
gccaccgattatctatggtgacgtgagccgccccaaccccatgactgtgttctggtccaagatggcacagagcatgactgctcgcccaatgaagggaatgttgacaggccctgtcacaatccttaactggtcttttgtcagaaatgaccaaccgaggtttgagacttgctaccagattgctcttgcaatcaagaaggaggttgaggatcttgaggcaggcggtattcaggtcatccaaattgacgaggctgctttgagagagggtctgccactcctcaagtctgagcacgctttttacttggactgggccgtg

SEQ ID NO: 761 - DNA, 459 bp, Triticum aestivum
  Clone ID: LIB3280-024-P1-K1-H12
cgaaagcaaaagtggacttcagaggaagaggctgctcttagagctggcatagcaaggtatggagtgggaagttggcgcctgatattgaaagatgatgacttcaggtccatcttgagctgccggtcaaatgttgatctaaaggacaagtggcgcaacatcaacgtatttttcaccgaatcaggctctatggataagggaaggactgccatgaagaagaaccgagctactccaaggaggaatgatcacccaatggcaaagagcacagttgcttctgatgttgatgacgaaattgttgatgaacagcctatagcatcagtgtcaagtgaactgtggaatgtttcaattccaaagaaatcgcggtcaaggctaaacaatatcatattggaatctggcaagaacttgaatgagcctacaaggtcacacagcactacgattgctaagtacatagaggaggaattt

SEQ ID NO: 762 - DNA, 172 bp, Triticum aestivum
  Clone ID: LIB3280-024-P1-K1-H2
tccactccatcttgtccacgcgctctcactcgaaatcttgcctccttcaagaaggagggagtcatggtggtgactcttttcactgctttagttaactagaaaatgactcacacctagtccaggtccgaacgtcttttccaaacacgcttttaatagcttttctacattcctg

SEQ ID NO: 763 - DNA, 451 bp, Triticum aestivum
  unsure (1)...(451): unsure at all n locations
  Clone ID: LIB3280-024-P1-K1-H4
agcacggatagcataaggatgacggggagcgtaaggttccaggtgtttgataagaacgatctcttgctcaccggggacctggagttatgcaatgccaatggtgtggtcggggaaccgaagagcagcagcaagaaatggaatatcaagtgccaatcctcggcatcgtctagtggtttcttgaaggggaagatgtccacgggcccagactctgcgcatcctgttgtcgaggtttacattgctggcactttctctggcacgccaattatattaaccaagacggtccagtatatatcacggaggaagtcccagatgaaactgaagctggactctatccctgagaatgaagcaactgaactacatacagagaactcacacggngactctgtgaaggtatcagaattctatgatcccaagtctgagacagacgtggacatggactataacagcttgt

SEQ ID NO: 764 - DNA, 461 bp, Triticum aestivum
  Clone ID: LIB3280-024-P1-K1-H5
aggggaggtcgagatggagatgtcgacgagcttcccgctgccttgtctcgccatggtgcacggcgtaagcgccgaacaccaacaacccacggcgacgacgctgttcagtctcgccggcgcgaggcccctcaccggagtcgcccttgaggaggagctgaagaacaaatcagtctgccccacgccgcaggggtgggtgctagtccagcaccgagacgccgtcgtcgtcgccgtcacctacctgctggatccgcgcagcagccaaaggatcgacctgccgcatctcgcaatccagcagggcctgatcccctactgcagctgcctgctcgccggcgaccccacggccccggggtgcccagtgctagtggtggagcccatggccaccttgctatggtgctgccgcgtcggcgacggcgagtggaccaggcacgactacgacatcgggaccctgggagacgagcact

SEQ ID NO: 765 - DNA, 351 bp, Triticum aestivum
  Clone ID: LIB3280-024-P1-K1-H6
ggacaaatgtagaagacgcttttcagtgcattgtaaaggatgctctgaagaatgaaccagaagaagaattgtacattcctgacactgtcgatgtggtgggtggcaaccgcacccaaagatcatcaggctgctgctaagccatgccacgccatggccgtagcaaccattgaacatgctgtctttcctgcctgtataatatcatgttattctgtattccatttgtgacttgaccaatcaccccttcggtacgaaatcaaggatcgatgatctgtcctgttctgtctgtcatcttgtatgttgggtagtttgttgtgaatgcggcgggatgaaaatcataaatttcttattttt

SEQ ID NO: 766 - DNA, 249 bp, Triticum aestivum
  Clone ID: LIB3280-024-P1-K1-H7
caaaagacgaagcagtttcttgttcgtactcgtaggatttagtggcggggttttcaagagaggcccggatggctttttattagaaaaatctctagtttggtggtcgtactagctgctttcatcccatgtctgtgaatatcgcaaacatgatgttcggttgcttacactaatatgccagtccattttctcttgtcctgttattatggcggagtgggggggccggttcccttcttttcatcttctgcttat

SEQ ID NO: 767 - DNA, 315 bp, Triticum aestivum
  Clone ID: LIB3280-024-P1-K1-H8
tgttttttttttttttgggacaaaatgagtcctcccatatcttaaatcacaagtttcagattaagagtccagtttttggaaaatacattcagggcgaaagagatctagtaacaaaaaaaaaatccaatgcaggaaatccgtgcaaaaatctgatcttaatagacttgggggaacaggaagaaacaaaaattggaacaggggtgttggcgcgcactattttcatcatagactgaaatttttcttaactctttcaagatttaaattagctacatggatcattttatttacaaaatttacagtttcagcttccatgtt

SEQ ID NO: 768 - DNA, 150 bp, Triticum aestivum
  Clone ID: LIB3280-024-P1-K1-H9
agggggttgtttcgttttttttgtgtattaatttatttctttattctgtaatgcgtagatcttgttattcgcgccttggggaaattgaggagccttcctaccaaaaatgcagaattccgccatcgctactcgggaaaaaaaccctcgcta

SEQ ID NO: 769 - DNA, 70 bp, Triticum aestivum
  Clone ID: LIB3280-025-P1-K1-A10
gtgcgcagtggttgctattgagaatgaacgacccttctacaggcgatgggcagtatagagatctttctgt

SEQ ID NO: 770 - DNA, 251 bp, Triticum aestivum
  Clone ID: LIB3280-025-P1-K1-A11
ttcgacaaaaaaaaacccccttttttagtaggtccatattgggtccaaaatgtgagccttttaaataaagtgttaccgtgggtttcgccagaacggttaaactggttccatgaaactgaacttttgccagagtggtccactttttagcatgatcaaactggctttttactttttttttatgagcaaactttttcttaagaccattcacaagcctttttccccgccaagtaattttgggttaaagttttggt

SEQ ID NO: 771 - DNA, 321 bp, Triticum aestivum
  Clone ID: LIB3280-025-P1-K1-A12
gattcctcaagcactggcagggctgcggtaatggggagtgtcagcaactaaaattaattcatttatccttggaagtgggataacaagaagggaaaatggcatgcatgatcactcttttttaatgtaaaaaatattaactggaatttaagaatgttgacaccgcatctctggttcattaatgaaattttctgctcttcagtttaacttctgtggctcgttgtgatagtgaaagtcgatattttgatatctaatggaatgtacatattcttgccattttatagttgacttcctgccatgatttgcttcctaaaagaagtagta

SEQ ID NO: 772 - DNA, 162 bp, Triticum aestivum
  Clone ID: LIB3280-025-P1-K1-A2
accactcgtccgtccacgcgtcccgggatattcaacaacatatcctctttgagagctgcagacattcagctgcaggaagctcacaccccttacgacccggacaagatccaaactgctgataagcttgtcatagatgagctcacgaggcttttagaactcaag

SEQ ID NO: 773 - DNA, 190 bp, Triticum aestivum
  Clone ID: LIB3280-025-P1-K1-A3
cgtgcgcatgggttccagtggaggctcctcctcccgactgagggtgcatgtggcttagtttggcccgatacaaaaaatgcgaccctttcttgttcttgcgcggcaagagcatatcctcggagagatttttcgagcccatacttcaagcttccagctccttcctcgtgtatagattgaacttgctggttgc

SEQ ID NO: 774 - DNA, 344 bp, Triticum aestivum
  Clone ID: LIB3280-025-P1-K1-A6
cccacgcgtcctagtctaaagttaattttgttacgttctttgtattgaacgcgagaatgcgtgagttcatgacacttcaggttgaaaccagttattacaatgaggagttcttggtagaacaacgtaggaaacttcagctgcaggacagagtttcaagaggtgcccagtttcattttacaactggtttatgtatccgcactaactgggacatcaagcatgtgcgtgatttggatgtagaatttccatttgttctttggggcttattaaacgtgttttggttttttgttatattttactttttaatctatatatttcattatttattaaagtattttttattattt

SEQ ID NO: 775 - DNA, 228 bp, Triticum aestivum
  Clone ID: LIB3280-025-P1-K1-A7
gctgatctcatgaacaagtacatgtacctcaccgggtgggttgatgttagggagattgagaagaccatacagtatatccttggcgctggaatggatacaaaaaccgagggcaacccatatcagggttacatttacacatctttccaagagagggcaaccttcatattcgaaagaaacactgcaaggcacgccaggaagtacggggacctgaaactggcttaaatatat

SEQ ID NO: 776 - DNA, 375 bp, Triticum aestivum
  unsure (1)...(375): unsure at all n locations
  Clone ID: LIB3280-025-P1-K1-A8
cggacgcgtgggcgccaggggagccacctgcgccgcaccgaggatcgtgtctgctggtcttgccccgatccagcaaattcgcccctttcttgctcttgccgcggcagagcagtccgaggagagattttcggagccgagactcaaagcttccgtcttcttcctcgatctcggattgttcttggttgttgcccagggtagtgcaggctgctagggttggccggatgattctttgcgcgtgcgggcggcgtatatacgtgtcatgagaagatgatgcgcgccaagggcaaagctacattcttggacgccatgaaagagaccacctcccccgtctnttccgcgggggtcaaagaggcgctcaaggaggacaagtgggag

SEQ ID NO: 777 - DNA, 407 bp, Triticum aestivum
  Clone ID: LIB3280-025-P1-K1-A9
tgtgtgcaggtcttgctctcgaggctgggcgtcccgtctccccgtgcatgtggtctagtggtgtgcgtcgtgtgtactgggaccggggccgtgggggtggggcattgcgttgggcgctttgatcggctcgtgggcatgggccacgcgcccagtacccacgtactgtatccatcgaacgggctgcttgcctgccactgccactgtgtcactgtgtgtgcgtccgcgatggcgtacaagcccatagcagcgacgcatgcatacctataaatttgattttgcatcgattcaaggtatggcggccgccaccccttgcccactggggtctttcgccagtggcttcgggaacaggagcaaaaggggaggaacgagcaggcgaatctggcccaggcaggcgatgatcatgatca

SEQ ID NO: 778 - DNA, 412 bp, Triticum aestivum
  Clone ID: LIB3280-025-P1-K1-B1
gtgtgcaggtcttgctctcgaggctgggcgtcccgtctccccgtgcttgtggtctagtggtgtgcgtcgtgtgtactgggaccggggccgtgggggtggggcattgcgttgggcgctttgatcggctcgagggcatgggccacgcgcccagtacccacgtactgtatccattgaacgggctgcttgcctgccactgccactgtgtcactgtgtgtgcgtccgcgatggcgtacaagcccatagcagcgacgcatgcatacctataaatttgattttgcatcgattcaaggtatggcggccgccaccccttgcccactggggtctttccgcagtggcttcgggaacaggagcaaaaggggaggaacgagctagctaatcttgcccaggccggccatgattatgatcagggcct

SEQ ID NO: 779 - DNA, 364 bp, Triticum aestivum
  Clone ID: LIB3280-025-P1-K1-B10
cggacgcgtgggcgagggtgctcacggtgatctcgcagaagcagaagtcggcgctgagggaggcgtacaagaacaagcgtctcccgctcgacctccgccccaagaagacccgcgccattcgcaggcgtctcaccaagcaccagctctctttgaagacggagagggagaagaagcgcgagaagtacttccccatgaggaagtatgctatcaaggcctaggttaggagcacatgttttaccggccgagttttgctcagaagttgcatgaattttatgttctgggtggacaccgctgctatctaagtactatgtattcgatatcctgcatgaaattcgaacttatgcttattgacactatgatctac

SEQ ID NO: 780 - DNA, 365 bp, Triticum aestivum
  Clone ID: LIB3280-025-P1-K1-B11
cggacgcgtgggcgagggtgctcacggtgatctcgcagaagcagaagtcggcgctgagggaggcgtacaagaacaagcgtctcccgctcgacctccgccccaagaagacccgcgccattcgcaggcgttttaccaagcaccagctctctttgaagacggagagggagaagaagcgcgagaagtacttccccatgaggaagtatgcttatcaaggcctaggttaggagcacatgttttaccggccgagttttgctcagaagttgcatgaattttatgttctgtgtggacaccgctgctatttaagtactatgtatttcatatcctgcatgaaattcgaacttatgcttattgacactatgatctac

SEQ ID NO: 781 - DNA, 410 bp, Triticum aestivum
  unsure (1)...(410): unsure at all n locations
  Clone ID: LIB3280-025-P1-K1-B12
gttcagaacagtcagtcggaaccgcaggagccatcttcaccttaatctaaaaacagaaggttttccttttgctagatctctgaaaaatccgcagtggagtaagcgctggcattacctacctagattcagcatatgtattggttcggtcggttagcgtcgtggggccgctctctggtttttgaagtttattgcagctggcaaagccccgcactgatgttttgagttccatcgttctctgtgtggaaaatacagaattctatagttctgtggaacacctggtctgttcatcttgtaattttcgttttggaacttaactattgtagggtngacagactatacatactgaagaaatgtgcccttccatcatcatcattccatgggtcaaaaataccggtcggtcgtttcatatt

SEQ ID NO: 782 - DNA, 138 bp, Triticum aestivum
  Clone ID: LIB3280-025-P1-K1-B2
cgggtacgacaccacgcgtaccgatatccaccgtgccatgccgggcggtaccagcggggttcaagagcgtttttaactacgctccggtgctcaaggctcatattgactcgaggagcaaggggtttattggacgttctt

SEQ ID NO: 783 - DNA, 246 bp, Triticum aestivum
  Clone ID: LIB3280-025-P1-K1-B3
accagggtttaacaaattttgcaaagagaagtttaagaaagtatctctcctgaggcctaaggcgacgaggtctagttcgagggagatctacatgatctgcgaagggttgctgtagaagattttccaccacttaccttccatgtgatcatttatgtctgttctgagcattttgtttttatcaagaactctacaaatttgtctttatagtttatagttttttatatcttgttttgatttctttttttt

SEQ ID NO: 784 - DNA, 184 bp, Triticum aestivum
  Clone ID: LIB3280-025-P1-K1-B7
agatccaccgcgccatgccgggcggcaccggcggggtcaagagcatcttcaactacgcgccggtgctcaaggcgcagatggacgcgaggagcaaggggttcgcggacgtgctgtacctggactcggtgcacaagaggtacgtggaggaggcctcctactgcaacctttttgtagtgaagggcgg

SEQ ID NO: 785 - DNA, 261 bp, Triticum aestivum
  Clone ID: LIB3280-025-P1-K1-B9
ttttccacctcatgattttgcgaacagaagcgattatggaggccaaatcactagcttcaataagaagccagccagcagcagttaaactgaattgcagaagaaaaaaaaaggaaaacaaaacaaataaggaacgaattcccctgacatcacatttctatacaggttcgttttgcaacaaaaactgccagcaacacccaagggtttgttcactgatgcttatttctcctcgatatctcaacgtgttagaagagtactaatctt

SEQ ID NO: 786 - DNA, 196 bp, Triticum aestivum
  Clone ID: LIB3280-025-P1-K1-C10
agcacacgtgctcgcgcgtaatgcttagtttatatccaaaatgtggtgtatggtcaagaaccaacaaacccggaacgcctactacaggctcatgacaagaaaagccgcaatggtctctcgctaaatgataatcagatcgtgaccggcatagaatatattcaagctgttttggattcaaatgctgctggttggggcg

SEQ ID NO: 787 - DNA, 371 bp, Triticum aestivum
  unsure (1)...(371): unsure at all n locations
  Clone ID: LIB3280-025-P1-K1-C11
gacactagctacgtcgtgcttatgtgcaacgaccctacaaggtcgtcgtacgagtcgctgatctacaggccgaccttcgccggcttcgtcaacgtcgacataaccaagaccaagaagatcgccctcaggacattgatcgaccactctgtcgtggaaagttttggcgccggcggcaagacgtgcatcctgacgagggtctacccgaggaaggccgtcggggacaacgcacacctatttgtcttcaacaatggcgagtcagacatcaagctcaccaacctgcgtgcatgggagatgaagacccncacgatgaacaagcgtctggggcagtagtagcaacagagcccggcctagtagatcgaagattcagagta

SEQ ID NO: 788 - DNA, 250 bp, Triticum aestivum
  Clone ID: LIB3280-025-P1-K1-C12
gtcggtcggtggggagcagcagtgatggccgcagcccagaagacgaaatggctcctcctcctcctactcctcctgtagatccacaacaacccatggaagcggggccggcggccaagcggagcatgtcggagcaccaccacggcgccggcgacgcgccgtccttcaagatggaggacctgcccgtggatgttcaagctgttataatgtcgcttctgccactgaaaatggctgtgaggacaagcattgtttc

SEQ ID NO: 789 - DNA, 227 bp, Triticum aestivum
  Clone ID: LIB3280-025-P1-K1-C6
atctaaatttaattattaatatttaatattaaaaaaaatattactttattaataatctataaattttttaattttgtatatattttttttttaaatttgatttataaataaataaaattttaattataaaaaaaatattttaatttataataataaaaattttttttatatttattttaaaaaattatatataaattaataatatttttaaaaatatattattatat

SEQ ID NO: 790 - DNA, 380 bp, Triticum aestivum
  Clone ID: LIB3280-025-P1-K1-C7
gacgctgcgaagtgttgctccctttggcatggtagaagacccatgtgattctgtcgtgtattgcactagcaggtctgcctccaatacttgagttatctggtggaactggagaccatgggctatctaccgcaggaataaattcagcatgaagatgtttttcttattaagaaagcatgcaccggtgctgtgggcagttctctctgggtcttgctttacatattcatttagttactattttagatggaaagacatgatctcctgcgtttgtgatttgtgggcaacttgcttaatatgtttgagcaacatatatttctcggtggattttattgtgttggacatgatggcctgtgtcttcggtcaagttgtttattagtactcaa

SEQ ID NO: 791 - DNA, 423 bp, Triticum aestivum
  Clone ID: LIB3280-025-P1-K1-C9
agctcatgggcttcgttgcaatcctcagttgatatccaaattgtcggggatgatttgcttgtcacaaacccaaaacgtatagtagaggctattgacaagaaggcctgcaatgctctgttgcttaaggttaatcagatcggtaccgtcacagaatctattcaagctgctctggattcaaaggctgctggttggggcgtgatggtcagccacaggagtggtgaaacagaagacaatttcatcgcggatctagctgttggtttagcgagcgggcagatcaaaaccggagctccctgcagaagcgagagactggccaaatacaaccagcttgtgcggattgaagaggagctaggcaacgtgcggtacgccggcgaagcgttcaggtcttcatgagaaaccagaatcacagacgactttgactggagc

SEQ ID NO: 792 - DNA, 83 bp, Triticum aestivum
  Clone ID: LIB3280-025-P1-K1-D1
tcccactcgaactaacccacggcgcctgtgccacgcggacacctacagaggaggcgtttgtggcgtttcttacctatagatac

SEQ ID NO: 793 - DNA, 385 bp, Triticum aestivum
  Clone ID: LIB3280-025-P1-K1-D10
cggacgcgtgggcggcgtacaaggagctgcgcttgcacctcagcatcatggcgggttgcatcgccgtcatccgcgccgccccctacatcctccactacctcacccgcgagcccggcatgacggagctcaagctcgagctctagggcgcttcccccgcccccgccccctgaggtgcgactgggatggtgaagttactctcaagatcaggctttgaagtaccttatgaaacatgaacttagttttccttgatagtgtttcttccttctgtagcgtgagaattcaatgacggtgtttgcattaactctgttggttacaaataccactggcctggcaactttgcgggggtttaacagtcagcgaattggtgctttacatatggatttat

SEQ ID NO: 794 - DNA, 262 bp, Triticum aestivum
  Clone ID: LIB3280-025-P1-K1-D11
tcactcttttcggactccaaggagctccccttgcacctcacgatcattgcggattgaatcctcgtcatgcacccccactcctacatcctacactacctaacccattagcccatcatgaccgatctcaaacttgagctctaaggctctttctctctccccaccccttgaagttctactgggattgtaaatttactcttaacatcaggctttcaagtaccttatcaaacatgaacttagttttccttgttaaggttttttcctt

SEQ ID NO: 795 - DNA, 420 bp, Triticum aestivum
  unsure (1)...(420): unsure at all n locations
  Clone ID: LIB3280-025-P1-K1-D12
gtgccctgatctacttttccattacctttgcagacactatgatgaaatttgcatgctttgagaccattgttgagatggtgtacaagcatgctgtgccaaaaccaaaagatcaatgcagtaaaccattgcagctagcagtgagttttgcaggggggtacattgctggagtcttgtgtgctgctgtctctcatcctgcagacaacctggtgtcttttctcaacaatgcaaagggagccactgtggcagatgctataacaaccattgggctgtggggccttttcactcgtggccttccactccgtattatcatggtcggtactcttaccggagcgcaatgggcaacatacgacgcgtttaaagtatttgttgggctaccaaccaccggnggagtcagctctagttgtcatgctgncactactt

SEQ ID NO: 796 - DNA, 162 bp, Triticum aestivum
  Clone ID: LIB3280-025-P1-K1-D2
cgtggttttagtctgtgaactcgagagaccgagcgaggaaagttgccgtgtgagacctgagagttaggagatatggctgggattggtcctatcaggcaggactgggagccgatagtggtgcggaagaaggcgcataacgccgtcgacaagaaggacgaaaag

SEQ ID NO: 797 - DNA, 157 bp, Triticum aestivum
  Clone ID: LIB3280-025-P1-K1-D3
aaggggacagatgagctacaaaaattgtgcacaatcagtgcacgaccaggaatagagtaagacttattccccttataaactcaagggatacatctattagagaatcttaacctgctctctacagttactaaaaaagaacacttttaagctgcaaaca

SEQ ID NO: 798 - DNA, 316 bp, Triticum aestivum
  Clone ID: LIB3280-025-P1-K1-D5
gtcaaaaccaaaaaaacatctagcgtggataaacgaaggaaaaaaagaaagaactactcttctgattcatatagctcagaaacttctgactcacagtcctattcctcagatagtggttcggagtcagaatcatactcttcagcatcattggatactagctcatctagtgaccataggcacaagagaagaaaaggttctaagaaagtgaaacgaaagcctgcaaagaggaagagcagccataagaagagttagagcaagagttgtgggacaaaaagatccaagcggtgctatgggagcttaagtgatgcttcaaaaa

SEQ ID NO: 799 - DNA, 258 bp, Triticum aestivum
  Clone ID: LIB3280-025-P1-K1-D6
ccatgttgtgtgctggcatttattgctcatacaccaacgtaacaagtcaggaccaataggatccgttgagaccttagggctcttggcagcggttcctgcctcaaagaaggctgatcagaaaccacgttgtgattgatcgaatattctccatggtctgagctgtttttatcaaaacaacctggttttttaacaatcaaaggccctgggcaagcttacaccatggctgggggcttttactgggcttcactcgatatatgg

SEQ ID NO: 800 - DNA, 122 bp, Triticum aestivum
  Clone ID: LIB3280-025-P1-K1-D8
ggcagctttgatgtttgcggcatgaactgtaacgtgatgctatatggtacggtcttgagtacgctcctgatatggaggtgaaccaacttaatgcaacatatgtatatagattttgcaacttg

SEQ ID NO: 801 - DNA, 290 bp, Triticum aestivum
  Clone ID: LIB3280-025-P1-K1-E1
acccaacaatcacagcgaatcccgctcgctgcacaacactgctagaaagaagagcctgcaagccatggccggcgtcctgctctcggccgccgttgcctgcgtccttctcgccggcgccgcgttcgcgtcgtcgtcgtcgccgcgggtgttcaccgtctgcggcgtagagaggggttggtggctgccttttcccggattggtgtcctatcttctctgttttactttattctcgttatcatcttcttgttttgtctttcattttatgtttctcccaaggaacttcttttctt

SEQ ID NO: 802 - DNA, 97 bp, Triticum aestivum
  Clone ID: LIB3280-025-P1-K1-E2
gtccaaataagcggccagagccctaagtcgagcaaattcaatggtgattgcatggcttgagcctgtctctgttgtacctgggaatcaataccattac

SEQ ID NO: 803 - DNA, 413 bp, Triticum aestivum
  Clone ID: LIB3280-025-P1-K1-E8
cggacgcgtgggttgttggctggctcctgaaactgagcacatgttggtatttcattgttgtactggtgtatgcaagggttattttcgtgcagaggttttgaactgtgatttccttctctttcaagcctaaagcattcaactgataatttcaggcaggcatttcaattttctatcatgcttctagatatcaaacgtggttgagaaagttccatttttaaggggctggagctccatggcttacagatctaacgacccctgatgctctttgcatatttccaatgataacatcactgttcgccatgcttccctttgaggagcggcaggtgcagatgcgtgtgcgaggagcgccttcggtcgaacggcgttctttcttcgtcaggaagggtgcaacctgctactcaagccccttttct

SEQ ID NO: 804 - DNA, 244 bp, Triticum aestivum
  Clone ID: LIB3280-025-P1-K1-E9
gctccccaggattaatcttggtctgatttggaagcaaaccatatgtggatggcaagggtttgctaccgtgcgcagtggatatagttagcttcctcttcaaaggtgcctcgcttgtgtattttaataagccaaacttctgcttagagaccaaacttttggtgtataattgcattccaaacccacggagatctgagcttttgcgaactacactacatgcgcaaggcttatgttgtactatcaaacc

SEQ ID NO: 805 - DNA, 95 bp, Triticum aestivum
  Clone ID: LIB3280-025-P1-K1-F1
cccccctacccttacccccagatcgtaccaaccgtcgccgatggccgccgacggcttgtggctcgccgcggagcttctggccaaactaataacac

SEQ ID NO: 806 - DNA, 255 bp, Triticum aestivum
  Clone ID: LIB3280-025-P1-K1-F10
tcgccacgcgtcggcttgtggggaacagtgaatctggaatgagacaaaggatctgtctcttctcatacacggaccaacttgttagccgtgataagtatctgaacaccatggagttcattgatgcggttgctgaggagttgaggacaagaatgtgcgcaaaatctaagttatgtaggtactacatgtctacactagtgaataggacatgggtcttgttaggatcctataatacaagggtttcatttgttctttgaa

SEQ ID NO: 807 - DNA, 391 bp, Triticum aestivum
  unsure (1)...(391): unsure at all n locations
  Clone ID: LIB3280-025-P1-K1-F12
gacaaggaagcagtgaagagtagctagcatccatggcgtgcatcaataccttgcagagctgctccatgttcaaaggggccaagagtaaggccagaagaggtagagccagtggcgggacctttgagtgccgggcgtccacgttcatggacgggagcgggctccggctcgggctcgacgagaaccccgatgccatcatctccggggagtggcccgagaacttctccctcctcagctacgacgacctccgcgcatacctncagtcacagcagcagcagcaacaacgacaaccatcccatgccggcgatcagcagcgggggcctctcctgcgtgaggccatgtcgacgcccgtgctgatggtcacagcggagcacgcgctggtggaggttgaagc

SEQ ID NO: 808 - DNA, 61 bp, Triticum aestivum
  Clone ID: LIB3280-025-P1-K1-F2
caaaccccagtttcgcgcacggagctgaccatcgagatcgatcaggccggagggaactaat

SEQ ID NO: 809 - DNA, 60 bp, Triticum aestivum
  unsure (1)...(60): unsure at all n locations
  Clone ID: LIB3280-025-P1-K1-F5
caggnnaccggnnccggaatttcccccgggtcgaccccaaacgcgtccgctttcaaaagt

SEQ ID NO: 810 - DNA, 328 bp, Triticum aestivum
  Clone ID: LIB3280-025-P1-K1-F7
cccacgcgtccggaaaagccaaatccttgccggtggccgtggattgggaactttcaaaagtggactgaagggtggtgtccatattgttaaggctgaggaggctgaaagccttgcagctaaaatgcttaaccaggtcctagtaacaaaacaaactggtccacaggggaaggttgtgggcaaggtctacttatgtgagaaaatgtcacttgttaatgagatgtactttgcgatcacccttgataggaagactgctggtccactcattatagcttgcgccgagggaggaacgagcattgaagatcttgcaaagaagttccctgataagatt

SEQ ID NO: 811 - DNA, 253 bp, Triticum aestivum
  Clone ID: LIB3280-025-P1-K1-F8
gcgcgctgtccggtgtgcttcttcgtgcgtaggtgttcgagcaggggttcaaaaggacggacaggcgcatcgttacctgcctcgccgtgcttcgtgcggtgccgcggcccgtgcctcccccggcgccttcgttttcccggtcctgtggcggacaccccgagcgtctcgtggcaccagtttcggcacccgacccgagtccagagcgtacagtagcgtaatctttgagaagaaggtcgtcaagttcaccggcgag

SEQ ID NO: 812 - DNA, 320 bp, Triticum aestivum
  Clone ID: LIB3280-025-P1-K1-F9
cccacgcgtccgcccacgcgtccgcgccttgcagccgacattggccaaacagacgcccgccagttcaagggcatccggcacttcatccaaaccatctacaagaagaacggcatccgcggcatctacagagggctaccagcgtcgctccacgggatggtcgtccaccggggcctatacttcggaggcttcgacaccgcaaaggacacgctggtgccgctggactccccactgtggcagcgctgggtgacggcgcaggcggtcaccttcacggcagggctcatctcgtacccgctggacacggtgcgggcgaggatgatgat

SEQ ID NO: 813 - DNA, 85 bp, Triticum aestivum
  Clone ID: LIB3280-025-P1-K1-G10
ggggtatttttttgtcggggcacaaagtacatttttattaatatttttagaaaatagatggacagatattgtttttatttatttg

SEQ ID NO: 814 - DNA, 351 bp, Triticum aestivum
  Clone ID: LIB3280-025-P1-K1-G11
agcaggtaaaaacaaatagataagagatatccaggcatttcatggatctgccagaaaattcacaaggcattatctatcatgaacaatgctacaaaacaggttgaggaaagcaatcacattcttattccagccgaacagtagttgaatgccgtatgctcagattagaaatattggcttcaactcagcagtctctaactagtaggagaaagacctgtaacaagtccagaacaaaatccagatgcgcagatcgaagatgataagccatctaaaactcagaccactggaagctccccgcactcactaatgaccaccttctttttcggacggtcacctctgtcagtcttcgacgac

SEQ ID NO: 815 - DNA, 146 bp, Triticum aestivum
  Clone ID: LIB3280-025-P1-K1-G12
gatcgtgagcgagcgctcttatattttttgttttcagccggtaaagacaaagggataagagatatccaggcatttcatggatctctcagaaaattcacaaggcatttattttttatgtacaatgcttcttaaaactagtttgagga

SEQ ID NO: 816 - DNA, 197 bp, Triticum aestivum
  Clone ID: LIB3280-025-P1-K1-G4
gacaggaagcagtgaagagtagctagcatccatggcgccatcaaacctggagagctgctcatggcaaagggccaagagtaaggccagaagaggtagagccagtggcggcacctttgagtgccgggcgttccgttcatggacgggagcgggctttggctcgggctttacgagaaccccgatgacatcatttccgggga

SEQ ID NO: 817 - DNA, 141 bp, Triticum aestivum
  Clone ID: LIB3280-025-P1-K1-G5
agcacgtaaaaacaaagggataagagatttcctggcattatatggatctgccagataattcacaaggcattatctatcatgaacaatgcttcaaaacaggtattggaaagcaatcacattcttattccagccgtacagtaa

SEQ ID NO: 818 - DNA, 379 bp, Triticum aestivum
  Clone ID: LIB3280-025-P1-K1-H10
ggaaattggagtagaaagagcaatgatcaatgaggggcaaggtggtgccattgttgaggaatgggtggagctagcaaatggatgcgtttgttgcactgtaaaacacagcctggttcaagcacttgagcaacttgtgcagactaaggagagaatggatcatatattattggagacaactggtttggctgatcctgcaccacttttatccattctctggctggacgatcaattgggggcatcaatcagactagactctattatttcgggttttgatgcaaaaaactctaggcggcaaatttttgaacacaccaactctttttcattttctgaagcatttcaccaaatcgcattttcggatgttgtgatatttaacaaaaat

SEQ ID NO: 819 - DNA, 182 bp, Triticum aestivum
  Clone ID: LIB3280-025-P1-K1-H2
tccacgcgttcgcccacgcgttcgagaagatcggattcgatttggatttctagggtttgctcatcctcatccctattcccttcttcgactccgttctttcttttttcccaccttctatcaaatttgtgatttttcatcaattttcataatatttgaatccccaactccttttacactctttc

SEQ ID NO: 820 - DNA, 466 bp, Triticum aestivum
  Clone ID: LIB3280-025-P1-K1-H4
cggcaggcccgggatgaccgacgcgtcccacgcctcctgcaaatttgtgtacaaagagcactgctcaatgagtggcaagggggagccatgggtaaggaatacgtgcgggcagcaaaacgagtccattgtcgaacttgaaaaacacagcctggttgaagcacttgagcaacttgtgcaaactaaggagagaatggattatattttattggagacaactggttttggctgatcctgcaccacttgaattcattctttggctggacgatcaattggagttattaatcagactagactttatcattacggatattgatgcaaaaaactttatgcggtatattgatgaacacacaaactttttagctatttcctgaagcattttaccaaaatttcattttctggtggtttcgatattaaacaaaattgatattattaaagacaattctttggtttagtataggcaaattat

SEQ ID NO: 821 - DNA, 351 bp, Triticum aestivum
  Clone ID: LIB3280-025-P1-K1-H6
tggtttaatttttaattattataattgggtataattggttttttttattttttatattatttattatttttttaaatttttataaatttaaatatttatatttataaatattttattattttttattattttttttttattttttaatttatttattttatattttttatttttttttttttttttataatattttattttttttaattattttattttttattttatattttttatattatttatttatataaatttttttttttttaaataataaatataattatatttttttatatttattaattttatatattttatttaaatttttaattttaataattatatatt

SEQ ID NO: 822 - DNA, 263 bp, Triticum aestivum
  Clone ID: LIB3280-025-P1-K1-H7
tcgcagggcccaaattggtccctcaagccagtcccacatctcccccgcgccgtcgaccgccgttcgtcgtcgccgtgcgccgggtgcccaagatggacggtgaggttgtgttccttttgctttttttttcatatttagtttcttttttcatcgctttttgttcatttttgttttttttttctatttttattttattatttattataattattttttttgtgatttttttttataataatatattttttttttttcttttataa

SEQ ID NO: 823 - DNA, 156 bp, Triticum aestivum
  Clone ID: LIB3280-025-P1-K1-H8
cgccaccttaagcacgcaaaggccgaggaggacaagctaggaggagcgagcagccatggcttcgtcggtggccgccgcggcgagcgcgttcctcgggacccggctggcggacccggcgccgcagaacgggcgcattgtggcgcggttctgcttttg

SEQ ID NO: 824 - DNA, 256 bp, Triticum aestivum
  Clone ID: LIB3280-025-P1-K1-H9
gcaccaacgcccgcggcgcgcacaataaggaaagcccccgctggcggcgatggggcagacccacagccaggccaagcccaaaccggacaggcacgcgtctccacagccgcgcggcgacgaccagcacccgaaccagccacaagccggcaccgggaggcgcccgccggccgcgcccgccatggacaccttcttcctgtcgcacggctcgcccacgctcttcatcgacgaggcgatcccggcgcggagcttttttcag

SEQ ID NO: 825 - DNA, 62 bp, Triticum aestivum
  Clone ID: LIB3280-026-P1-K1-A1
ctctctgttgtccgagccgagatcctgctggatgaggctggtgacggtgaagtggcggaaat

SEQ ID NO: 826 - DNA, 161 bp, Triticum aestivum
  Clone ID: LIB3280-026-P1-K1-A10
tcttcctcatctagaaccgccaacttggtgagattcgaaaccacttcctctcaaatagtaactactaactcatctttcaagttcagtcaaatataatatttttttgctattcaattatttacgcacctaatttgtatattaaatcgtcgtcatctcacatt

SEQ ID NO: 827 - DNA, 358 bp, Triticum aestivum
  unsure (1)...(358): unsure at all n locations
  Clone ID: LIB3280-026-P1-K1-A11
gggagnnccggggcgacccacgcctcccaaaccggcattaataattccccggcaccccgctccatcttcaccgtaccaccgggggttctaaatggagattaacaatattgtctttgccggccttctcgcgggcggcttagtcaccggcgtcatgggctccgaggattcccctgccaccaaaaacacctttcaggtggcaaattccccaggcgccctcattgtctccctcgggatatattttctctactcaaacaccggacacgtaagggaggagtgcattactagcattcattgggcggttgtgtgtttacatacgaatgatgcggggtgatttttattgttttcttcttgattagca

SEQ ID NO: 828 - DNA, 257 bp, Triticum aestivum
  Clone ID: LIB3280-026-P1-K1-A2
gttttatattacacagcaaacccctttttttttttttatattgttcgaggagaggcactcatcaaacactatcagtgtcgtctcatttattcttatcgagccatgctttctatctgctctacagttatgtctctgaatatgtattcacctcaactgagctaaaaatgcgtctccagatcagttgaatttatcttatttactaaaaaataatctattaagagcaatattatgtttatttagctttatgaaacaaacat

SEQ ID NO: 829 - DNA, 256 bp, Triticum aestivum
  Clone ID: LIB3280-026-P1-K1-A3
agtaccgtcaactgggggggatttgaaaccactttctctcaaatttcacgactaacttatatttcaagtttagtcaaatagaaaattcaattgcattcaattatttactcatctaatatatatattaatactgtcccatttcacattttgaagtaaagcgggacaaaatttgcctacaacatgaaacacatgttttttgctgctcatttttaattcatatgatgctgagctgcgacaagcaattaataacttactg

SEQ ID NO: 830 - DNA, 359 bp, Triticum aestivum
  Clone ID: LIB3280-026-P1-K1-A4
ataggtcgggagctatcacaaggaaacccacattatgaacaaatacgagtatgtgctgaggatgcgattgagtgcacaaactttgtccaacatagagacccgttagtatagcacatataaaggataggcttgctcgaacagaaagaatggaggttttcccaaaaaataaaaagagaagaacagatgtagtcccagctcagtacttctgcggtgtactgcaagtccatccactagagcttcggttttcattcaaacctaacaagtctagcgtctgctcgtttcgtctaacaaacaatacagatgaacatgtgttatttagactcaagaaaaaagggagggagttggggaggattacttta

SEQ ID NO: 831 - DNA, 373 bp, Triticum aestivum
  Clone ID: LIB3280-026-P1-K1-A5
gggaatgacaggatgtgaagagtacactttgatcacgaacctgcagacacatttcaagatcaaccatcctgaattgccgctgtcatactacacaagagtacttggcatgcctggtcttactgcctatgctggattttttgacgtggccaagccaaagaagggcgactatgtcttcgtgtcagcagcgtcaggtgctgtcgggcagcttgtcgggcagcttgccaaaatctctggctgctatgtggttggtagtgccggttctgatgagaaagtcaaccttctaaaaacacagtttgggtttgacgatgcctttaactacaagaaggaacaggacctgaacgccacactgaaaaagtgctttccggagggcatt

SEQ ID NO: 832 - DNA, 442 bp, Triticum aestivum
  Clone ID: LIB3280-026-P1-K1-A6
cccacgcgtccggggatccaagagcggggcaacggctacttgcagtggttgtcgtggtgcaagaatgaggatgataacaagacagattggacctggcatgatccaacagatgaatactgtttgccctgaatgcagaggatcaggcgagatgataaatgacaaggatagatgcccaagctgcagagggaacaaagtattccaagagaagaaggtcttggaggttcatgtggagaagggaatgcaacatggccaaaagattgtattccagggtgaagctgacgaagctcctgatacagtgacaggagacattgtttttgtcttgcaacttaaagagcacccaaaattcaagaggaagtcggatgacctatttgttgagcacacgatctctctgactgaagctctctgtggctttcaatttgttctgacccatcttgatggtcgg

SEQ ID NO: 833 - DNA, 263 bp, Triticum aestivum
  Clone ID: LIB3280-026-P1-K1-A7
cagatgtgttagacaaaaaatcattgttaaatgaataatagtgccaaatgagattcactaatcaaacaccatcgatgaagtcacatttatgcgtagcgagccatgcttcctatctgttctatgttatgtttctgaatatgtatccacgtcaactggtctaaagttgcgtatctagatgagttgcattttgtttatttactaaaatatagctattatgggattatttgggtatcagctttatgaacaagcattcaagttttgct

SEQ ID NO: 834 - DNA, 292 bp, Triticum aestivum
  Clone ID: LIB3280-026-P1-K1-A8
attgtccagtccacacacgccaaaatgcatgaaagttttccatcatatcgcgtacatatgcgtgcctctttgacgcactaccactcgacccgacttgtatcactccctattttactactgctaactcgaccagcaactctgatgaattaacctggacaactcgacccatcacacgaacacacgattatttgttgcactcgtcgccgcgtttcacggtccaaaccatgaaaagcattcatacacccgtccgtgcaacacctgcatagtataccaccactagtgttcgacgacg

SEQ ID NO: 835 - DNA, 307 bp, Triticum aestivum
  Clone ID: LIB3280-026-P1-K1-A9
cgccaacttggtcagatttgaaaccacttcctctcaaaagtaacgacgaacttatttttcaagtttagtcaaatagaaaattcaattgcattcaattatttactcatctaatatgtatattaatttgtcgtcatttcacatttgaaggttgagcctcagtaagttgaagacaacatgtttcgtaggaagcacgcttctcatttcaattcagatgatgctgagcagcgacaagcaaagatcaacgaactgagagctgcacttgggcctatgtctggccgtggcgaaaaagtctgcagtggaacatgct

SEQ ID NO: 836 - DNA, 424 bp, Triticum aestivum
  Clone ID: LIB3280-026-P1-K1-B1
attaccttcaaggggtgggggattttaaatcatttcttcttataatttactactatcttttaaacaaagaataggggaattgaacaataattgtattcaagaatatactcatctaatacgtatattgattaaataaggttttacatttaacccacacgcggtggcatttttaagacatcattttttgtgggaaacacgcttctttttttaattcatatgatgctgagctccgtcaagtaaatatcaaccaactgagagcttctcttgggtctatttttgcccgtggcgaaaagtattttagagaagcatgcttggcaaggtttctttaattcgccactggcttgtcatgagtttttcccaatatttgaagatatctttcttttgggactttatttgcctgtgcattttctagcctgattttttt

SEQ ID NO: 837 - DNA, 209 bp, Triticum aestivum
  Clone ID: LIB3280-026-P1-K1-B10
aactttattgtaaagaagtttgcccgatcagtggccagagaaaagccatggcgatgaagtctgattgatgacccgcgagcgctcggcggtgcttgatgtggtggatgcagaatagtatagctccgggttgagtagtaggccagatatggaaaaaaatatgtactttcatgtttttggtgtggattcttttcctttttgtgataaatgaa

SEQ ID NO: 838 - DNA, 347 bp, Triticum aestivum
  Clone ID: LIB3280-026-P1-K1-B12
gcctcccacagctccgtcgcggctcatcccgaccgatctcccttgcgagattgcgtttcttgcggcgcgtgcgcgcacagcacatccatggctgtcgccggaggaggaggaggaatggcgctgagcctgcgggcgccgtcggcctcggcgtcgccggcggtggggcggctgcgtagggcgtcgtcgtcgccggcagtgaggtgcggcgcgacgcgggaaaggtggccgacatcggccccgtacggggtgctggaggaggaccactaccggactttgaggctgcagccgggcgcctccaggggcgaggtcaagaaggccttccaccgcctcgcgcttcagtaccaccc

SEQ ID NO: 839 - DNA, 217 bp, Triticum aestivum
  Clone ID: LIB3280-026-P1-K1-B6
gcaccagcgaaacgcatagcgagaggccgaggaagcgatagctctagcgataaggcactgacagatcaatggctgccacggcgtactccgtggccctcctcggaggggcacgccttcccgccgtcaccggcaacgcccgcccccgcttcttcgcccttcttccggggggcaactttcacccttttccgctccaagatgcgcccaagccgttccttgc

SEQ ID NO: 840 - DNA, 284 bp, Triticum aestivum
  Clone ID: LIB3280-026-P1-K1-B8
ggtgctcgatgtcagccacaaccagctcgccggcccgctcacgcaggaggtggcggggctgaggaagctggagcatctcaacgtcgcgcacaacctgctctccggcccgataccgcaagccgtgtgcgcgctgccgcggctcaagaattttaccttctcatacaacttcttcaccggggagccgcctgcgtgcgcgcgcgttgtgccccggggcaacgaccgggacaaccgcctgccgaatcggcccttttaacgggcgcggcagcagtgcgccttcttttacg

SEQ ID NO: 841 - DNA, 273 bp, Triticum aestivum
  Clone ID: LIB3280-026-P1-K1-C1
cggacgcgtgggcggacgcgtgggttgtcaagggcattgttgattcaaaggagctttccctgaacattttccgagagactctccaacagaacaagatcctcaaggtcattaagaagaaccttgtcaagaagtgcattgagctcttttttgagattgctgaaaacaaggaggactacaacaagttctacgaggcctttttcaaaaaccttaagcttggcattcacgaggacttctataacaggaccaagattgctgagcttttgaggtaccact

SEQ ID NO: 842 - DNA, 440 bp, Triticum aestivum
  Clone ID: LIB3280-026-P1-K1-C10
atgctcttcctctacacgcagccacctgagatgaggaacaccaagttctggcctgaccagcctgctaccttcagatcggcgctggatagatattctggtgcggtgaaggatgtatcagactcccttttagctacgatggccaagaacttgggactgaaacgagaggcgatcgctgacaaatgcatccgtggaatgcagaaagtcagaataaactactacccaccatgcgcccaagcagagaaagtcgttggcttgtccccgcactccgatgctaacctcctaacacttgtcctccaagtgaatcatgtccagggcctgcagatcaagaggaacggcagctggcttcctgtcaagcccgtctcgggcgctttcgtcgtcaacatcggagatatgtttgaggtcttgacgaacgggaagtacaggagcatcgagcaccgggc

SEQ ID NO: 843 - DNA, 122 bp, Triticum aestivum
  Clone ID: LIB3280-026-P1-K1-C11
cttcttgttaaaccaagactaatgccattatttctgagcaaaaataaacgcctcttcttccaaccctaacacggttcaaaacattaccataataacaaatgcttcgcctaagagacagcatg

SEQ ID NO: 844 - DNA, 231 bp, Triticum aestivum
  Clone ID: LIB3280-026-P1-K1-C12
gcaaatcactcctgccaggaggacgcacctgccatttccagtagttcgtcttgtctctctgactcggaggggcatcagccatgggagatcaggaggagcaggggaagaagattggcggcgatggcggtgggaggacgaacaagtacgcagtcgcctgcttcgtcatcggctccatcatctccatccttcatggggctacgacaccggccgtggatggagcgggcggcgatg

SEQ ID NO: 845 - DNA, 178 bp, Triticum aestivum
  Clone ID: LIB3280-026-P1-K1-C3
ccgatccgtcatctcctccgcgaccgcgctccgttctccggcagcccgtcgtgcgtcgacattctccaggggtccgcccggccatggcgtcgtcggcgctcatctccgacaccgaccagtggaaggcccttcaggcgcacgttagcgcaatccacaagacgcacctgcgcgatcttat

SEQ ID NO: 846 - DNA, 124 bp, Triticum aestivum
  Clone ID: LIB3280-026-P1-K1-C4
agattttaatcctttaggatacggaatttatgtgagagtgttatgattcacaatgcctaccctgttggctctggcctgtgtaaaatctaagtgattattcaatttttcaaccttgtcgctctat

SEQ ID NO: 847 - DNA, 304 bp, Triticum aestivum
  Clone ID: LIB3280-026-P1-K1-C5
actacaataatacgttaggtattttatcattgcataccacggtacaagctgacacgtacatttagcattattcatatgcctcaagaacatgcaccactactacagataaccaagaacttaacacgaccgaccgacagagatggacctaacgacgtaattaagcgacaaacacaacaaacaaatcgagttcttcaaacgtacgtacgcgcggggtatagcgcccacagaaccagcatgcatgcacgctacgagtagcactaccgaaccatcaaccatgcgccccgtcagtgcttgccacacacca

SEQ ID NO: 848 - DNA, 302 bp, Triticum aestivum
  unsure (1)...(302): unsure at all n locations
  Clone ID: LIB3280-026-P1-K1-C6
cggacacgtgggccgggccgcataaaacaatccgggtcatcaacacctatattacgagcgtgtgagcgcgcgacatctccagaagctntacgtcgcgatcgcgcgaattttaatgggaaaagagggggcgcaaatatgccagtcggactgagctacgcaagtgatttcttccggaggaggagcgccaaaagcatccctatagtatatatacctatcgtgtttcttggaagacttgaacgatacaagttggctggccaggatcgccaaagaaagattggccttttccttttattgggactctg

SEQ ID NO: 849 - DNA, 343 bp, Triticum aestivum
  Clone ID: LIB3280-026-P1-K1-C7
gctctcgacttcatgcccgccgagaaggctccccaagccggcacagtcgctctcggcgccaccaccaacaatgccgtcgccgtgcaggtgcagcagcagcagcacaagaggctggaggggaaggtggccatcgtcaccggcggggcgcgcgggatcggggaggcgaccgtccgcgcgttcgtcaggcacggcgcgcgcgtggtgatcgccgacatcgacgacgcggtcggggaggcgctggcggccgcgctgggcggggcctgctgcacctacgtgcactgcgacgtgtctggtgaggccgacgtggagcgcgccgtcgggtactgggtggcgcggcacgggc

SEQ ID NO: 850 - DNA, 94 bp, Triticum aestivum
  Clone ID: LIB3280-026-P1-K1-C9
caagaaatgaaagtggcgaaggggaaggatgcctttagcttttcttcaggaaatcatggacagtaatacaacttgaaagcttaagctgtggctg

SEQ ID NO: 851 - DNA, 83 bp, Triticum aestivum
  Clone ID: LIB3280-026-P1-K1-D1
tccggagctcctgcatgcgcgcgcgcgcgcgtatgctgctgcgtttgattaagtatcgcgatttttgtttgtgtatataattt

SEQ ID NO: 852 - DNA, 141 bp, Triticum aestivum
  Clone ID: LIB3280-026-P1-K1-D10
tcgcccacgcgtccgcggacgcgtgggctaaattaagctgctcctggtcatagtttctttaattaaaaactttgctggggatcatctgtggcaaacttgttaaacttgtgtagccgtttgcagtttggtatgttgtgttgc

SEQ ID NO: 853 - DNA, 311 bp, Triticum aestivum
  Clone ID: LIB3280-026-P1-K1-D3
ctagttctagagcggtcgttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtattttcaatgatggccagacccctttagcaccctctcctttgtttttacttttgggagagtaagtataattttc

SEQ ID NO: 854 - DNA, 369 bp, Triticum aestivum
  Clone ID: LIB3280-026-P1-K1-D5
cgggtggttctgcatcggcgagatcgccggccggggtttcaccttcacgggctacagcgtctgagcgccttccttccatgagtacctccacgcgatcggcgtcgattaagagctgaagactctgttagccaatcagtttctcgtgatgcgcggagcgaagttttgagtttctgaaatactattcttgatgctggtgaaaaaagtacacccggctcggtgaattcgactcgtcgatgaggtctaataatttgtcgcacgcttagttgagtgattgaagcctggacagatgagatatctgtgactgtgatgtttgtcttgcttgcttgctggaattaggggtaattacggctcttccaggctatatgtttt

SEQ ID NO: 855 - DNA, 139 bp, Triticum aestivum
  Clone ID: LIB3280-026-P1-K1-E1
tttacacatattctagtttatcaaattttttcgtctgttctgcaaactcatgtcaacgagggtgatctctgtggcagccatttcttcttctccctttagaatggctcaaactcctacatttcggcttctcctgctatct

SEQ ID NO: 856 - DNA, 129 bp, Triticum aestivum
  Clone ID: LIB3280-026-P1-K1-E12
cgcatacagaacgggcctcgtctcccccttcgtttctccccccgccgtatcctttcctgaccggagcgagcgagcgccctaccgctcctagctcccccctcttcccgatggctttcctcaccactatca

SEQ ID NO: 857 - DNA, 255 bp, Triticum aestivum
  Clone ID: LIB3280-026-P1-K1-E3
cggacgcgtgggcggcgccgtctcgttacagacagcgggagcgaaagagcgagcggtgagagaactccgggagagggcggcgagatggtgcatcggctgacataccgaaagcgccacatctacgccacgaagtcgaaccagactcgcgtcgtcaagacctcaggtgggaggcttgtgtaccagtacaccaagaagtcggcgagtgggccaaaatgcccggttaccggcaagaagatccaatgaattccacacctg

SEQ ID NO: 858 - DNA, 137 bp, Triticum aestivum
  unsure (1)...(137): unsure at all n locations
  Clone ID: LIB3280-026-P1-K1-E5
tgctacttgtacatctgtaattcctattcagtcgtaacaataatatttagtgatctcaattttcatgccatgctgaattaaattcagctaacatcagcaatttagttgaaagtgcaggnagcgttctactttaattg

SEQ ID NO: 859 - DNA, 428 bp, Triticum aestivum
  Clone ID: LIB3280-026-P1-K1-E9
cctctcgacctctcacctagcgcacatccatggcgcgcttcctcgtcgccctgctcgctgccaccctggtcgcggttcaagctggagggcagctgggccacgcggcgccggcgacgggggaggtgttctggcgcgccgtgctgccgcactcgccattgcctgacgccgttctccgcctcctcaaacaacctgcagcagaatccaccagcttcgtgagagaccccgaggacaggccccccttcgactaccgtgattacagccgctcgtcgtgcgatgatgaaccgagcaagagcaccgtcgccgcctccggagcggggggctttgactacgacaactacagcggggccgacgaacgtcgtggtgccaccgatgaatacaaggcgccgagcagcagcctcgctggaagcggggcgtacatggctaggggc

SEQ ID NO: 860 - DNA, 457 bp, Triticum aestivum
  Clone ID: LIB3280-026-P1-K1-F1
cttccccaaggcagaagttcttatcctcaacttcgcctcaagtgtatactacctcccgtcgttcattgcaacaatgcagaacctgaaggccctggtgctgatcaactatggtactaccagtgcaacccttgacaatttatctgccttcaccacactgagtgacctgaggagtctttggctggaaaagattacgctcccgccactgccgaaaagcacgatcccactgaagaacctgcgcaagatatccctcgtcctttgtgagctgaacaacagtctaagaggatcaacaatggatctctccatgacgtttccgcgcttatccaacctcaccatcgaccattgcgtagatctgaaagagctgccacctagtgtatgtgaaatcagctctctggaaagcatcttcttgtcaaactgccatgaccttacagagctgccatatgagctgggcaagctgcac

SEQ ID NO: 861 - DNA, 331 bp, Triticum aestivum
  Clone ID: LIB3280-026-P1-K1-F10
gagctcactcttggtgctctccgctccctggtcgttcggtcgttggaagttggaacctcctgctcctcctccgcagccgcgggcggcgtcaggaggtttccgggctgcgcgttggtgcatgcaacagaggggcctctccaacaaccgccgctcccgcggcttcttccgatcccgcctcgccgtcgagggcgcctaaacagaaccccaccgtcacccccggcccagccaacacacacaccacaccttcttaacaacaaacacacaccagagctcacacccaacgacgacactcccctgctcccttcctttcgcctctgaaaaactttttaac

SEQ ID NO: 862 - DNA, 367 bp, Triticum aestivum
  Clone ID: LIB3280-026-P1-K1-F11
cccacgcgtccgcccacgcgtccgatgaagcttcagatccgtgtcgacgaaggcaccgggaagatcgtcgacgcctgcttcaagaccttcggctgcggctctgcaatcgcctcgtcctccgtcgctactgaatgggtgaagggaaagcaaatggaggaagtagtgagtatcaagaacactgagattgcaaagcacttgtcactttcaccagtaaagctccattgcagtatgcttgctgaagatgcaattaaagctgccgtgaaagattatgaatcaaagaaagcgaagctgggagacagccctgcaaagaaggctgccgaagcatgagcatgatatatgcttctgttctatgagggtggggaatggg

SEQ ID NO: 863 - DNA, 109 bp, Triticum aestivum
  Clone ID: LIB3280-026-P1-K1-F12
agctgaaaaaggaacggggccaactatatatatgacccttactttagatttattacggtttacatggccttattttgacttatcatggggattgtatattattaattca

SEQ ID NO: 864 - DNA, 265 bp, Triticum aestivum
  Clone ID: LIB3280-026-P1-K1-F3
tcgctgatggacgctctcaggattgatgtgttatagtcttagcagttcctttgttcaattgatgtgcagcttaatatccaatttgtttggccaacaaaatcatgccaaacctgttgaacgcgtgcctgtggttggtgttactgtgttgcttagggctactatagtagaatttctggagtgatggttattgtaagaattgcattatctttctgttgctcagatgtgtcgagggataattggaagaatagcattatccttggggttg

SEQ ID NO: 865 - DNA, 276 bp, Triticum aestivum
  Clone ID: LIB3280-026-P1-K1-F4
gggggggaagtgcaataaggttgaaaaattggataatcccctagattttacacaggccagaacccacagggcaggctttttgaatcataacaatttcacataaaatttgtgtaggaaataattaaaatctaagaaaaaaattcgagttccgaaggagtgcaagctaatcaagaccaaaatttatcgaggctttgcgatggatctcatctaatttgggaacctacaagtgcgccagcacgcacgctttttccagggccacgccggtgggggaccacc

SEQ ID NO: 866 - DNA, 446 bp, Triticum aestivum
  Clone ID: LIB3280-026-P1-K1-F5
gtgccagcgctactacttgattgagtgccagcacgtatctgtgctttcagcaagaatttcaccattgggagccggtgcctttcgaagcactttcacgtgtgaaccgaagtcgtcttgcccaaaacccacggagacctacctatagtgacgttaaagtaccaatgagcatggaggtttggttggaattggatactacatctttcaaataaaaaaaaaaaaaaagggcgtcccgtttagagtgtttaacattaaatacacgctggagctgacacctaacttcgacactgcggtgctcccttgctttcgcctctgaaaaactttgaaacgagagaagaagatggacaccatcaccgtcgttgagaatgtgttctgagaggtggagcgcaaggtgcataagagctactgttaggagcactccaaggacctcaccggggagtccatgatgc

SEQ ID NO: 867 - DNA, 180 bp, Triticum aestivum
  Clone ID: LIB3280-026-P1-K1-F6
gcaaacccagcacgaaatccctcgatcgcccgaatccgatcgaagcttttcttcctccgcaatccaaatctcgcgcgcgctgcgatggcggccgccgccatctcccacctccgccggggcgcgcagcgccacgcgctcctatacctctcgcgccgccacttctcctttccgtcctccctc

SEQ ID NO: 868 - DNA, 214 bp, Triticum aestivum
  Clone ID: LIB3280-026-P1-K1-G10
agtgtattgtaacaaaaataaactggagtcgcatggaattaagctacagttcaaatcacaaaaggccgccaaagtagattgtcaaatataaactagaagtggcaaccaatttaaccgtgtgatattaaaaaaaacagttaaattcacataggcagattagttcaaagtccacttattcatacttgaccgtgctgctatttcaaaactgtttaaa

SEQ ID NO: 869 - DNA, 454 bp, Triticum aestivum
  Clone ID: LIB3280-026-P1-K1-G11
cccacgcgtccgcccacgcgtccgcccacgcgtccgcccacgcgtgcggactagttctagatcccccagaactggatccatcgctcgcacgccggagacgggcgccatggccgcctccctcgaagacctccggaacgagagcatcgatctcgagtcgatcccgatcgcggaggtgttccaggtgctcaagtgcaagccgcacgggctcacctccgatgaggccgccagccgccttcaggccttcggccccaacaaactcgaggagaagaaggagagcaagttcctcaagttcctggggttcatgtggaaccctctgtcgtgggtcatggaggcggcggccatcatggccatcgtcctcgccaacggcggcggcaagccccccgactggcaggacttcgtgggcatcgtcaccctgctcatcatcaactccaccatcagcttcatcgaggagaac

SEQ ID NO: 870 - DNA, 479 bp, Triticum aestivum
  Clone ID: LIB3280-026-P1-K1-G12
ctctgctccatttgttttatatatcatgtatgctttatatatcctatgtgctgccatgatccttgcttcactgatcatgttgattttctagatttggctgggtgccgtgttcttttttggcccttgtccgctttgatcaatgtgctctgggatctggctctgtgactgtgatgatgcacccgcagggaggaggcaacatcgacgcgatggcacagcagaggagactgggcttgttgtggaacttctggaggcagtaggacatgatgccgcacatcacagagatcaagatggccatgcgcatgccgatgccgcccgccgacatcggcgagagcgtcaccgccggcaacggctctagtgacctttccaggatcttctccatgagctactggaaggacaccaactccagcatcatgttcttcacgcctggccgcaagaaggccaagttgttcggcgacagcgatgacggcatggtcaccagc

SEQ ID NO: 871 - DNA, 255 bp, Triticum aestivum
  Clone ID: LIB3280-026-P1-K1-G2
cccacgcgtccgctatgcgcacatatttgaaacagagcttgtcatatatatagcacaaagccattatgagtatatatagattattgtataaggttactctatagatgaagaactaattcatcagctctagctaagctgggtacagagctaattcatcagctcaccagtgatcatgcgtgttgctgaatatctcatctatgtgcgtgttgtgtaatgagattaaagtgggaatacatcatgggcggagtcaggatt

SEQ ID NO: 872 - DNA, 199 bp, Triticum aestivum
  Clone ID: LIB3280-026-P1-K1-G3
cccactcgtacactatgcacacatatttgaaacagagcttgtcatatatatagaacagggccaatatgaatacatatattttattgcctaagagatactctatagatgaagaacttattcattagctctagctgagctgggtacagagctaatttattagctcaccagggatcatgcgtgttgcttaatatcccatctt

SEQ ID NO: 873 - DNA, 423 bp, Triticum aestivum
  Clone ID: LIB3280-026-P1-K1-G7
gggacatgaaaaaagctgacttggaaagacaacgtaagcatgctgaggaggtttctgctgcttctgctgttctaaagcctggtgatgtgatcactatccactcatctaatcaactggaagaaatatttacagccgcgtcaaaactgtcaaagcttgtgattctgtattttactgcaacatggtgtggaccatgtcgttttatgggccctgtttacaaaagcttatctgaacagcaccggaatgtcgtattccttaagctggacattgatcaacaaggcaatattgcccatcgctggaatgtctcaagtgttccaacattctcctgtgtgataaacggcaaagagattgataaggttgtcggggctgacaagaccggccttgagagaaaaattgcgcagcatggctctcttaaacactgagcta

SEQ ID NO: 874 - DNA, 293 bp, Triticum aestivum
  Clone ID: LIB3280-026-P1-K1-G8
gaaatacccaaatagtctcgcggatcagccgaggccgtcatccacaagcgcgaggcggacatgttctacctgttaacacatctgcactcagcatgggcgacggaccaaaccatcctctccgaagaggaacagctagttatcatccgcttcagccactattgggacgagacacgcatgcatatggatgacgtgctatcaggaggggctgagaccataaagaactatgcggtgatctaccttgtttacattaccgaaggttctgaattcaacaccatgtgcgagttgtatgaccc

SEQ ID NO: 875 - DNA, 81 bp, Triticum aestivum
  Clone ID: LIB3280-026-P1-K1-G9
agcacattttcaaagccaatatactgcagcgtagagtgtattggaacaaccttgttcagtttcacactattgtttgtgtgc

SEQ ID NO: 876 - DNA, 67 bp, Triticum aestivum
  Clone ID: LIB3280-026-P1-K1-H10
gcgtacaagggattcccgtgcaaggcgtcttctatagaactctaaaggcgggtggtgttcgtgggca

SEQ ID NO: 877 - DNA, 126 bp, Triticum aestivum
  unsure (1)...(126): unsure at all n locations
  Clone ID: LIB3280-026-P1-K1-H11
gtcattactcattaggattcgagttcatatgatgttccttttctagaaacatgctgagtggcaaatgttgagcacatggtagctttgtacgtccgcnnnananaaaaaaaaataaattattaaatt

SEQ ID NO: 878 - DNA, 202 bp, Triticum aestivum
  Clone ID: LIB3280-026-P1-K1-H12
ctcgaaacaaaccaacaaggacaaacattctctcctgattcggatccgacgggcgatcgacctttccatggggcgccgctctggaggaggaggaggcgactgcagctttctcaacgcgccacggtccgcagcccctgcacccaagcccgcggccaagcagtcgttcgccctggcgccgtacaaaaccgacagtagcagcgcc

SEQ ID NO: 879 - DNA, 197 bp, Triticum aestivum
  Clone ID: LIB3280-026-P1-K1-H2
cccactcgttcgctatgcgcacatattttaaacagagcttgtcatatatatagcacaagagccactatgagtatatatagattattgtttaatgttaccctatagatgaagaactaatttatcatttctagcttagccgccgtcaaagctaattcattagcttaccagagatcatgcgtgttgcttaatatctcatc

SEQ ID NO: 880 - DNA, 369 bp, Triticum aestivum
  unsure (1)...(369): unsure at all n locations
  Clone ID: LIB3280-026-P1-K1-H4
attagtttaaaatgtttacgtatgaagtttctatgctatataagaaagtaggtctgaactatttgaggtcatgnttctatttacaggttactcgtatagttgcatagctgattcagttacattagttcaaaacaagtgtttgtatctatcttaactntcaggttacttgtattgcatattgattgatttcgtgcaggctcctccgctagattttttttgaagtgtatgtgttttttttttgaacaaggaggttcatattctggacatatnctcgtgacagcaagtttataataaattccgaaactcctnaggtgaagtcagcaaagatagcatattcaactatattcaaataattgtacataactgccc

SEQ ID NO: 881 - DNA, 400 bp, Triticum aestivum
  Clone ID: LIB3280-026-P1-K1-H7
cccacgcgtccgtattgcgaaagaaactgcgatgatgacgattctcatagccctgttcgtccttgggttcgttgcaggagcgcaacaaactgatgccgcgtacgatgtcacgtggtcaccgcgcggcccttcgtcgacaatcccacctcttcatccgtcggacggcgtgttcccgacacagtggtgcaacccccgcccacagcacctcaaggccgacaaagggatcctctttctcaggcgcaacctgttcgacggcgcggtgctgcccgcaggcaccaagctcgggcacgccaggagggcaggcaccgtcagcacggtcaccggcaccaacctcgcgccgccgccgttcgactacggcagccttcgaaacatactgacctactacaatattgcgccgggc

SEQ ID NO: 882 - DNA, 123 bp, Triticum aestivum
  Clone ID: LIB3280-026-P1-K1-H8
cgttttgtaaaaaattaaaaaagaaaactagtgatgatgactattcttagagcccgggtcgtcctcgagtgctgtgcaggagcgcttcatactgatgccgcgtccgaagttacgttgttaccg

SEQ ID NO: 883 - DNA, 417 bp, Triticum aestivum
  Clone ID: LIB3280-026-P1-K1-H9
ggcaattcaatggcctggttgatgtctaccgcaagactctcaagtcagatgggattgctgggctttaccgtggattcaacatctcctgtgttggaatcattgtctaccgtggtctgtactttggactctatgattctctgaagccagttctcctcactggcactctccaggacaacttctttgccagctttgctcttggttggttgatcaccaatggtgcaggtcttgcatcttaccccattgacactgtccgcagaaggatgatgatgaccttcggagaggccgtcaagtacaagagctccttggatgctttccagcagatcctgaaaaaggagggtgccaagtccctctttaagggggctggggccaacatccttcgtgccattgctggtgctggtgggctcttcggctatgatc

SEQ ID NO: 884 - DNA, 106 bp, Triticum aestivum
  Clone ID: LIB3280-027-P1-K1-A1
cggacgcgtgggcggttttgcaaaagaatttgcagaacaactgtttcacggattgttttgcagaagaatcgagattcaatcagcaatgtcacttgttcctcaaaaa

SEQ ID NO: 885 - DNA, 122 bp, Triticum aestivum
  Clone ID: LIB3280-027-P1-K1-A10
atgaacaattaatgtacagttagcttcatctggcaaaaaaaaacgccgcatttctcatatagacatttaatgttacatatgggcgctataagtaaacatatttgacagtgtacaaaatccac

SEQ ID NO: 886 - DNA, 337 bp, Triticum aestivum
  Clone ID: LIB3280-027-P1-K1-A11
ctgttccaatgaaggccacttctaatctaaaaacagccttttgcattctcctgtgagtggatctgagcatcaataattagcctgaatacgggacggatatgccttgtggcgctatcaaccttgctttgttttgttcaaagttcagcagatgtccacttataatttgaagcagacttctgttttttcccgtgagcggatctttgttctaagttgcaataattagcctgactaaaggagatgctttaagaatatgtcttggtcttgttttgtccaaagtggcatcatgagaccgcttgtactctgaaatgaagcaataacacccgtgcacttttgatcc

SEQ ID NO: 887 - DNA, 390 bp, Triticum aestivum
  unsure (1)...(390): unsure at all n locations
  Clone ID: LIB3280-027-P1-K1-A2
gtgtaccaacacacgcggaggctcccatggccgctcggccgcatcaacgcggaaaggggctcccgccgtgctcttcctcgtcggaggagccgccggggaggcgggtgctaagcacagcgccattggggaggccaagggaggcgggctcccatgtgcctgcgcggaaaccgtgctagtgggaggccattgccgccgcggcgcaagatgcggcgagcttcgggtggcggcgtcagtggccgcgctggtgacgggaggtctccgtcggctgccgccgggtggttccggacggcgcgcgtcgcccaaccgctggtcgtgaagaccaagcgcgccaggagcaccaccgtgccaggaggccgnagtcgcgtacacggcggactggaaggatgcaag

SEQ ID NO: 888 - DNA, 195 bp, Triticum aestivum
  Clone ID: LIB3280-027-P1-K1-A3
ggcgcatcctgatgaggtccaataggcacggatacctattccggttcttggacaggataggggtccaacacgcactttttattgaccacaagttatggctcgtttgctgatgctatgcacagctgcattggggaggtcaaaggaggcccgatctcatgtgcctgcgcaggaaccgtgcttgttgttgtacattgt

SEQ ID NO: 889 - DNA, 377 bp, Triticum aestivum
  Clone ID: LIB3280-027-P1-K1-A4
ctccatctccttgtttctctccaccttctccttggtgtgactccggccgcccattggcgaagggaagctccgtgccgccggaagagaagccaggcgccatggggacgcaggcctcgccggacaactacacgccgcccaaggatgagaggactgcacgggagaaggcgatcgatgactggcttcctatcacgtcgtcgaggaaagcaaagtggtggtactcggccttccacaatgtcaccgccatggttggcgctggggtgctcagcctcccctacgccatgtctgaactcgggtggggtcctggcatcgcggtgatgaccttgtcgtggatcatcacggtgtacacgcttggggagatggtggagatgcatgagata

SEQ ID NO: 890 - DNA, 380 bp, Triticum aestivum
  Clone ID: LIB3280-027-P1-K1-A5
cagaaactgcctccgcaggagggaagggaggagagggtgttgtgccgtggtcgatactctgaagattgattccggtccgcagcagcgacgccggcaacatgaggttcaggatccggaagaagcctgcgtccgcgccgccggacgcttcttccacggccgccgtgccggacactgcggccggcggcggcggccgggcgacgatcgtcgctagcccagatcgctacggcacagagaatggaggaagcagagatgagtcgttcttcgaggcaaggccgtggttagactcggacagtgaagatgatttccaaagcgtgagaggagacttcactccttcaagaggtagcacaccagatcaccagatgcaaacatcattcgcagcg

SEQ ID NO: 891 - DNA, 274 bp, Triticum aestivum
  Clone ID: LIB3280-027-P1-K1-A6
ttttgtttttttttttttttttggggaaaaacactctctaatttttttggaggaacttgacgagtttttagcttacaagcagaccagttgtgatctgtgaatggacgacggaacattttatacaaccagatggatttttttgatgggggcagcatatgggcaaaatgcttcgtgttatgcttatttagaggaacaaaataattccctcagcccaaatgaagaaaggaacatgttttgcgcaaaattaagcacaatttgcctacaaaattaaaaa

SEQ ID NO: 892 - DNA, 345 bp, Triticum aestivum
  Clone ID: LIB3280-027-P1-K1-A7
atatatacatatatattgcatgaatagtataagtacaatcaccgtgggtcatacatgacattgtttctactgtaataacataaatctaaatatattttttgaggggcgtaaatctagatatataagtgttgaaatccagctataagttatggatcgagcactatctatatatccgggtacctccatgatatatgtggcttcttctttagttaattcgcataccatattactggcatcatgcatgcatggcaattgtcggcgtacgtctagggggaggtctcggtgttttgacgggcgtatggcggcgggccgggtgcaggcttgtggggtgccggcttgggcgcg

SEQ ID NO: 893 - DNA, 400 bp, Triticum aestivum
  Clone ID: LIB3280-027-P1-K1-A8
cccacgcgtccggggatgcaaggggggcaggtccagatgaggcgagatcccagcagggcgaacgggggcggccagccgcggtcgcgttcgttcacctaccagagctccacggtgacttatggtgggattaatggagcctactacacagcttccaagacccggaggagcggcagcgatgggatcactgtcgaagaaagcaaggaggcagatactacgactaaagaggccactcacaggatctccaggggaattcatgataagggacactcagtaacaaggaagctgaaatcagatgggaaggtggacagtacacagatactgcacaatctcaatgaagatgagttacctggatttgaagaatcatggaagggcagtgctggacaacacttaccaggctggg

SEQ ID NO: 894 - DNA, 349 bp, Triticum aestivum
  Clone ID: LIB3280-027-P1-K1-A9
aacaattaatgtccactcgtattcatatggaaaatgaaaaccatgcatttctcatatagacatttcatgttccagatgggcgctatttgtaaacatctttgatagtgtacaacatcaacgatcagatattaatcatacatccagagcacacatatactcctgagaagtcgattctcatgtgtttacttgccgggcacaaagttggtggcgaaggcccacgcgttgttgttgacggggtcggcgaggtggtcagcgaggttctcaagcggacccttaccggtgacgatggcctgcacaaagtatccaaacatggagaacattgcaaggcggccgttcttgatctccttca

SEQ ID NO: 895 - DNA, 371 bp, Triticum aestivum
  unsure (1)...(371): unsure at all n locations
  Clone ID: LIB3280-027-P1-K1-B1
gccatctgcgtcgacggcaccaagcgcctctgccacatccggggcaagatgcacaagaaggtctggatcgccgccggggacatcgtcctcgtcggcctccgcgactaccaggacgacaaggccgacgtcatcctcaagtacatgaacgacgaggcccgcctactcaaggcctacggggagctccccgacacgctccgcctcaacgagggcgttgacgtcgacggccccgaggagggcgagggcgacagcgactacatccagttcgaggacgaggacatcgacaagatctaagccttttttcctcctccctcgcctatancttgtgttctattctggtctaatagcgtctgtgtcgggtcggggggctgttg

SEQ ID NO: 896 - DNA, 198 bp, Triticum aestivum
  Clone ID: LIB3280-027-P1-K1-B10
cggacgcgcgggaaaaaatactgtcgatctagctttgcggcgcggcaggaaaccagccagcactcacggcggaggagggaataacccactgcttcaggggcgtgaaggggctggacgaaaggggggcaaaagaaaaacgaaggcccattcgagctcccagcgatgaacatacagctgggtctgtgatctgagcacaag

SEQ ID NO: 897 - DNA, 348 bp, Triticum aestivum
  Clone ID: LIB3280-027-P1-K1-B11
cacccaaaatccgccccttttcccgccgcacgggccctaaaccctaacccagtcgccggcgcggcgccggagatgatgcagcaacagcagcagcagcagcctctgccgccccctccgccgcagcacccgccggcgcagcccggcggcggcggcggggacttctaccgcggcccgctgcagccggcgatgcggcagctctctgcggcgtcatccaccaacctcgcgcccgactacgccggccacccgggaccccagcagcaccatcagcagcagcaacatcaacagcaacagcagcagcagccgttcgacgcctatggggacaattttggcgctaagaggatgcggaag

SEQ ID NO: 898 - DNA, 381 bp, Triticum aestivum
  Clone ID: LIB3280-027-P1-K1-B12
caattatcaatatcatcaggaacactcatcaagtggacaaagggcttttcaatcaacggcgcggtaaaattcaaaacactacacagcatttgttgagcagttcctagcacattagttagcataagttccactggatattcttataaatccattgattcccttggcaagtttctggtggtaaaccttgatttcgtatgccaatcagaacttaagtgctgaagttatagtggttttgttcttcgtttttgtcaatcagaacttaagtgttgaagtacaaatagtatatggtatcgaagccaattgttggtcttaagtggtatcgtaagtttcatatgccaatcagaatttaagtgttgaagtacaaatagtatatggtatctg

SEQ ID NO: 899 - DNA, 353 bp, Triticum aestivum
  Clone ID: LIB3280-027-P1-K1-B2
gtgctggcgacttgaggattttgggtagtgatatttgatacagtaaagatacaaggttatctcagtgacctcatttgataagtgccctatttttgtgattgcatgtttgcaatcgggacctcaaggagcagtgctagttcggaagaacgataatgtctccattttgtgaactatatatgaatacttgtgcttatgctaaccaggctggctgagtacaacgaacgcttgttattagctgatgaaggaaccgttatgcggattcaagcctttgatgcggcttgcgagagaagcatgtccagggagcgcctgacagaatcatgtcgggacaaccctggcgtctgcgatgatcgggc

SEQ ID NO: 900 - DNA, 284 bp, Triticum aestivum
  Clone ID: LIB3280-027-P1-K1-B3
tcgcgactatttggaaaaccagaataaagaaacaagtgtatcagctgggccctatttagatccagatccaacatcagatacacttgtttctttattctggctttggatctggatccaagaagggcccagcggaccttaaggagcgtacgcaggtctggaccacgagcttgccttcatcttgggtcctatttataaatacttgcgcttgtgctaagactgctagctttgtcatccatcgctgtccattacctggtgtaggaacaattttgcttattcattcctcg

SEQ ID NO: 901 - DNA, 383 bp, Triticum aestivum
  Clone ID: LIB3280-027-P1-K1-B4
gctctactcgtctcgcaaacgaaagagcagatcatatcagaccagagtgagtttgcatctgcgagctgcgccaatggaggggagaactgctctctgtttcctcgtcgtgctcgcgcttctcgcaagccctgctctcgcagaacgcaagtgctacaaggagcgcttctactccatgatatgcatgaagtggcactgcgccatggagtgcgtcaaccagagcccggacctggtgctcaagtcggcccactgcaccaccaagcacgtcatcatgcgctactgcaactgcgagatgtgtaccaaggagtagactgctctgtctactctggtcgtctagttattagctagggaggcgtaccaccaataaactaaatccatatggagct

SEQ ID NO: 902 - DNA, 301 bp, Triticum aestivum
  Clone ID: LIB3280-027-P1-K1-B5
gctctactagtttggcagacgaaagaccagatcatttcaaaccacagagagtttgcatctgcgagctgcgccaatggaggcgagaactgctctctgtttcctcgtcgtgctcgcgcttctcgcaagccctgctcttgcagaacgcatgtgctacaaggagcgcttgtactccatgatatgcatgaagtggcactgccccatgttttgcgtcataccagagccctgccctggtgcttaagtatgtccactgctccaccaatcatcgtattatgcgctactgcaacagtttgatgtgtaccaa

SEQ ID NO: 903 - DNA, 325 bp, Triticum aestivum
  Clone ID: LIB3280-027-P1-K1-B6
gctctacttgattggcaaacgaaagtgcagatcatatcaaaccatcattgagtaggagtatgcgagctacgccaatggatgcaagaactgctctctgtttcctaattgtgctcacgcttatagcaagccctgctctcggagaacgcatgtgctacaaggagcgcttctactccatgatatgcatgaagtgacactgcgccatggagcgcgtcaaccagagcccggacctggtgcttaaagtggcccactgtaccaccaagcacgtcatcatgctgctactgcaactgcgatatgtgtaccaaggaaaaaactgcgctgtctactc

SEQ ID NO: 904 - DNA, 370 bp, Triticum aestivum
  Clone ID: LIB3280-027-P1-K1-B7
ggagttgaaaaggtcacaagctcgttttgagagacttggtgatatgcttgcttcagaaattttaaagcgtggtgctaatgaagaagcttccagcgtccatgttgatgaagatctaaatggaccttatgaaaggagtccaaatgctactccagctaaaaagagatcaatcccatactcaactagtgatgaggcaaaagctgctaagaaaagaagagagcgagagactgatgcattcactagatcagataaatataggtcagaaggcgacattacagactatgataaaacaattaagggtagtgatggaacaaaatctatatatttgaagaagagactgtgggaagatgaaaagaataagcttggaaatgct

SEQ ID NO: 905 - DNA, 360 bp, Triticum aestivum
  Clone ID: LIB3280-027-P1-K1-B9
gctatatccttattaatccgtttgttaattatggatggatgctgtagctgccttcgacaggcactggaacaataatgtctatggcttgtcctatttcgaaaaaaaaaaaaaaagaagtaaaaatagagctcccagcgaagaacatacagatgggtctctcatctgatcagcaaggaatggcttcaaccaggggagacgtaggatgggagttcggccaaggcgaactgatagggaggatagtgtacggcgaactgtctatgtctcagacattgatcaacatgtcactgaacagaagcttgctgaggttttctcaaactgtggtcaagtggtagattgccgtatctggggtgatccaaactc

SEQ ID NO: 906 - DNA, 253 bp, Triticum aestivum
  Clone ID: LIB3280-027-P1-K1-C1
ctaaaagacccatttattctcaatggcttgccgatcatcgggcaagtcaaccaaagcccatactttgttctcatacatggaacaaccaggcaatctcatacataactagggaagacagcgaactcatttccaccgtatctaccactctaatgttaacaagaacacctttttaaaaaaaaaaacaagaaccccggactccacgaactacatatgcctgatcccccctgaaagtgcctggccgtgcccaagggct

SEQ ID NO: 907 - DNA, 154 bp, Triticum aestivum
  Clone ID: LIB3280-027-P1-K1-C10
cccacgcgtccggctgagcccgtgcctggccttcttcagggacgcgggcacgtccaaggcgccggcggggtgctgcaagggcctgggcaccatcgtccgagaccagccggcgtgcctgtgccacatctttaaccacaccctggagcgggccatc

SEQ ID NO: 908 - DNA, 282 bp, Triticum aestivum
  Clone ID: LIB3280-027-P1-K1-C11
cagagtttagcaatggcggccgggcgagcgtgtgctcttagcgcggtgcttgtggtggtggtggcgccgctcctcctggccggcgtggcggacgccgactgcttcgactactgcttcaaggactgcatcgccaaggacaagaacatgatcgactactgcaactacgcctgcgacaagacctgctacacgggcgcgccccagcggcccttggcggcggctgccgcccccggcgacatgggatgccagctctcctgcgccaggacttcctgccaccgtcttgat

SEQ ID NO: 909 - DNA, 336 bp, Triticum aestivum
  Clone ID: LIB3280-027-P1-K1-C12
tgaagatcatccttcaccagctgaatttggtgaattccgtgtgaagcttgctggtctgacaagtataactcggaattactttgagaaccttgttcgagcattggaagatgggttggaggatgtccagtgtgccggagaggctgcaacctcaagcaaggcctccaactcgaagaaaggaggagctaaaggcaaagcggcgaagaagcagccgtccagatcatcttcggaccattctgatgatacttggccatgcgagcgctgcacatttctgaatccctcttcagcggatgcgtgtactgcctgtgataagcagcggtactagtagattaataaacg

SEQ ID NO: 910 - DNA, 399 bp, Triticum aestivum
  Clone ID: LIB3280-027-P1-K1-C2
cccacgcgtccggatgacaggctgcagtgaggcgagacagtcagcagggagggagatcagaagtcgggacacccagaggtgtctgtatgattgggcctggctgcgcaattttcagcctgggccttaagtttggtcaagcagagggcccattgattgccgtgtagcgagtgagtgagtgagtgaattctaagacaagtagaagtgtattgcagtgagtgagttgcctgcctccccggttcctgtttaatccctttcttggtctcttttatttttccgaatagtgagttgaccgccggatcagttggtgttggaagcttacatttgtcctaccgaaatttctctcccttgtccttccattttctggagcaagagtgtgtaattaatatgagtacttcatat

SEQ ID NO: 911 - DNA, 239 bp, Triticum aestivum
  Clone ID: LIB3280-027-P1-K1-C3
aaaccaaggaccaggttaatattttcggcctgggaaataaattttatcaaactggaagcacaattctttgccgcaaaaccagtgaaagctataatgtatgattacacatacataccagcattgtaaatagagaataaccccacggcccaattccagagcaaacccgaaaaccctcatggctattgaagcgaataatacgcatgcagccatgctatgaccatttaaaaagattacacact

SEQ ID NO: 912 - DNA, 383 bp, Triticum aestivum
  Clone ID: LIB3280-027-P1-K1-C4
gcgctgggtatggcgggaggaagactgaggaggagggctatggtggttctgggtatggatctggcaggaaggtgcaaggcgaggatgaaggtgcctatgggtctggtgggtaccagaagcccaagccgtatggagaggagacccagggttcatatggtggtgggtatggccaggggaactatggccgcaagaagcaggatgacgactctgatgatgagaagaagaaccgttacgcgaagcgcgatgactctgatgatgagaagaaagaacgtttcgagaagcaccaccaccatcgtcgccacaacttcgatgactaagcatccagcatggtcttgacctgctgccatcggccccacatcttgctactacacgaataaagattg

SEQ ID NO: 913 - DNA, 341 bp, Triticum aestivum
  Clone ID: LIB3280-027-P1-K1-C5
cccacgcgtacggttagaggaagactgagagcgggggctattgtggttctgggtgtggatctggcaggaaggcgcaaggcgaggataaaggtgcctatgggtctggtgggtaccacctagcccaatccgtatggagaggagacccacggttcatatggtggggggtatgtccaggggaactatggtcgcaagacgcaggatgacgactttgatgatgagaagaagaaccgttacgcgaagcgcgatgactctgatgatgagaaaaatgaacgtttcgagaagctccaccaccatcgtcgccacaactactatgactaatcattcagtatgggcttgacctg

SEQ ID NO: 914 - DNA, 389 bp, Triticum aestivum
  Clone ID: LIB3280-027-P1-K1-C6
cccacgcgtccgcggccgtcccgcgtcacaaagtcgcggatcatggcgcaaaacagtacccaactaaagcgaaaagctcgccaagaaaccggccaaagcgctaaagcgaccgcacactgcctgccaccagcggcagcagaagaatagtaccccaactcggagcgaaagcaaagcttgccggcttgatcctcatcctcgaccggatgccatggttttcaccggcacgaaacttctgaatctttcatggagttttcggttctctcgccgagtggagctgcgctgagctcacgtgtgacataacatcacactcacactcacacccaccaagagcggccaggacgaatcccagtgatgtctccctctcggtagccggcctatatatacaggcg

SEQ ID NO: 915 - DNA, 392 bp, Triticum aestivum
  Clone ID: LIB3280-027-P1-K1-C7
agcagctttcctctctagctcgatcgatcgatcgaatccttccgtcgcgttcgcgtttccgtttcgtgtgtttagaccaagtttccaatggctcctcttggtgacgctgttgcccccgcgtccgccgccgccccaggcctcgtcgtctctttcggcgagatgttgatcgacttcgtgcctgacgttgccggggtctccctcgccgagtccggcggcttcgtcaaggcgcctggaggcgcgcccgccaacgttgcttgcgccatctccaagctcggcggctcctctgccttcatcggaaagtttggcgatgacgagttcggccacatgctggtggagatcctgaagcagaacggcgtgaacgccgagggctgcctgttcgaccagcacgcgcg

SEQ ID NO: 916 - DNA, 219 bp, Triticum aestivum
  Clone ID: LIB3280-027-P1-K1-C8
agcaagattgcgatctagctcgatcgatcgatcaaatcctttggtcgggttctcattttggtctcctgtgtctagacctagattataatggctcctgttgttgaccctgcagaccccgcatccgataccaccccaggcctcacattttgtatcggtgtgaggatgatcgactttttgcctgacgtcgccggtgtatccctaacgtagacagatttattc

SEQ ID NO: 917 - DNA, 337 bp, Triticum aestivum
  Clone ID: LIB3280-027-P1-K1-C9
actatgttacaacggaatattctagaggatataacctaagccataacgccatgaatagcaccaggcatagcacaagtggctgctcaaatcacgctgagggacaggcaaaacgaaatttacaagcgacatctcatgactgatcttgcacctgtgatcgctcttttggcagggtactttggatggtacatttaccgttacagtgaccgcaactgagctatcaaatccattcacatatgcccactcatcaggccactgaacagaacatcgttctgagcatcacatcggggggaacaacgattggggagccgatgggtgtgcctatgtgttaaaaagggcg

SEQ ID NO: 918 - DNA, 225 bp, Triticum aestivum
  Clone ID: LIB3280-027-P1-K1-D1
attactattataatttttttttctctaaaaatcttttccttttattttttttttcttttattttaacatatatctttttttccttcttcttttttttttttattttatacttttttttcaaattttttcttgtttttattcttcattctttacttttttttttctctctttctttttatttttttatatacttttttcttctctatttttgtccgctattttttt

SEQ ID NO: 919 - DNA, 378 bp, Triticum aestivum
  Clone ID: LIB3280-027-P1-K1-D10
cccacgcgtccgcccacgcgtccggataaacccctccatccgaaccaaacccaaacccgagggagccgccgcccgcggaatccaaacctttttccctccatccccttccttcccttcccttccccgcgcgatcgatcaatcgcttgatcgagcgatcggagccgatcggggagcagcggcgatcaggaatcgatccgtcctacgcatacaagatgtcgccggcggagatggagtccgacaaggtcgttgaggcctccggtggcgctggcgaccccaaggcctgcgacgactgcaacaccaccaagacgccgctctggcgcggcggacccaacggaccaaagtcgctgtgcaacgcgtgcgggatcccgtacaggaaga

SEQ ID NO: 920 - DNA, 218 bp, Triticum aestivum
  Clone ID: LIB3280-027-P1-K1-D11
cggacgcgtgggcgcacgcccccacgtactctcgccccgcccggacgacctcaacctctacctgctcctcctcccccgccgttcgccctcttccgttcctcgccgttccttccgagccttccgccgctccttcattccttctgagccgcccgccacgcccttcgacggaggagccccttcgtcgagggaaccgtcgtttagaccgttcctagagcccg

SEQ ID NO: 921 - DNA, 77 bp, Triticum aestivum
  Clone ID: LIB3280-027-P1-K1-D12
agcacgcgtaagctcatgcctcacaatagtctggtccctgctgggggtggccagaatataccaactatgcactcacc

SEQ ID NO: 922 - DNA, 327 bp, Triticum aestivum
  Clone ID: LIB3280-027-P1-K1-D2
caggcaagacaaacaatattatggattgaattcagggctcacttaatattaagttcatcaaagctgctgcacaccagcagaagtttgcagatacaaacgataacactgcatcatagtacggtatagaaacgaagacagttcaggcaacgacagacatataccagactcctttggaggacaccgaagacgagacttgtgaacccagagacaaaagcagctccatggccaggagcttactggccaccacggagacggagcaccaagtgaagggttgactccttctgaatgttgtagtccgccaaggtgcggccatcctcaagctgctta

SEQ ID NO: 923 - DNA, 377 bp, Triticum aestivum
  Clone ID: LIB3280-027-P1-K1-D3
atgtagcaaacaggttccttgataaacagagttctcccaagatttgcatggtgacaggtaaacagacttcgaccaaaaccaaacatcagatcaatggagccgcgacggcgattgcctagctgttggtgtacgcgtcttcataatactggcgccgacgtccagctggtcctcttgcttgtgcttgcggcttcttctcttggtagccgttgcgccggtgctggtacggccggtgctcacgccctgcttgcttgtccccgtcgacttcaccggcatcacgcgcgtactgatggtaaggccgcttggctgcaggaaagtgtgcgccaggcggctcccggtgctgacgatacccgccgccctgaacttgttgcgccggaatc

SEQ ID NO: 924 - DNA, 385 bp, Triticum aestivum
  Clone ID: LIB3280-027-P1-K1-D4
acttggcacaaatagctgcttctcacttgcaagaaaaggaccttgtctatgtgtctgggcaattaactggagatgttccgccattcaaacatactgatggccaagcaaatattcaggttgtagcacatttgctgtcatttgttgatagtaaagctgtggaaacggatctcatggtggatgaagaggaagggtttatggagattgctgaggctgaaaagaaagttgaacaaaccaaacctgtctctaaatatccagcacgcacattttcagattataaagccaaacaggacaagtacagaacgctctggaatgatgttcttgccaatccacttaattggactgataaccgagctgagaaggcgaatggatctaaaaatccaaagta

SEQ ID NO: 925 - DNA, 374 bp, Triticum aestivum
  Clone ID: LIB3280-027-P1-K1-D5
cccacgcgtccgccatccacatccacgagacacacacagcacagcatcggcgtaaagggaacaccagcaagatgtctcagctcgcccgcgccagcctgactgcgatggcgatgctccttctccttgccgctgctgcggcggcggcggggccggcggccggcggcgcggctgtggcggacccagcaggctggcaggacgacgttgtggcgctcaacgaggcctgctacaagtacgtgcagaagggcgcgccgacggtgccgccgtcgcaggagtgctgcgacgccgtgaagagcgtggacgtgccctgcgtctgcagctacctgggcagccccggcgtgagggacaacatcagcatggagaatgtgttctacgtc

SEQ ID NO: 926 - DNA, 365 bp, Triticum aestivum
  Clone ID: LIB3280-027-P1-K1-D6
gacccctcccccccaacccacaaccaccggcggcggcgcagcgcagctcgaggaaggaggcgaagatggtgaagttcctgaagcccggcaaggcggtgatcctgctgcagggcaggtacgccgggaagaaggcggtgatcgtgcgcgtgttcgaggagggcacccgcgaccgcccctacgggcactgcctcgtcgccggcctggccaagtacccgaagaaggtgatccgcaaggactcggccaagaagacggccaagaagtcgcgcgtcaaggtgttcctcaagctcgtcaacttcacccacctcatgcccacccgctacaccctcgacgtcgacctcaaggaggtggccttcgtggcgcccgac

SEQ ID NO: 927 - DNA, 242 bp, Triticum aestivum
  Clone ID: LIB3280-027-P1-K1-D7
aaaaaaaaagcccttgaaaaaaaagaaaaaaaccccaaaaaaaaaaagaaaatgggtgttaccaaaaaaaaaaaaagggggggtttttttttaggaaaaaaatttccaaaaaaatcaaaatcactttggggcccctttttttaaaaaaaaaaccccaaaaaataggttaaaaaagtacctgtttatttataaaaagggtgggggaatttggtctttttttataacagaaaaaatttccaaaa

SEQ ID NO: 928 - DNA, 394 bp, Triticum aestivum
  Clone ID: LIB3280-027-P1-K1-D8
ggctagttgaagaagcaatagatggaaagatagtgttgtccatgagggctttatatcagtcaaaagtagggctcacccttattgattcaggtgtcaaagatatcttgaagaacctatctgagaagcaaggaaagaagatgaattcgccagaatctgccaaagatattccaaagttcctcgagttatttgcgggtcaaattaatatggatgagactaaggaccctattgaaagttttaagacgtttaatgaatttttcatcagacaattgaaacccagtgccaggcccattgcacaaattgatgatggtagtattgctacctgtgctgctgattgccgtttgatggcctatagttctgtcgatgagagcacaagattttggattaagggtcgcaa

SEQ ID NO: 929 - DNA, 297 bp, Triticum aestivum
  Clone ID: LIB3280-027-P1-K1-D9
ggctagctgaagaagcaatagatggaaagatagtgttgtccatgagggctttatatcagtcaaaagtagggctcacccttattgattcaggtgtcaaagatatcttgaagaacctatctgagatgcaaggaaagaagatgaattcgccagaatctgccaaagatattccaaagttcctcgagttatttgcgggccaaattaatatggatgagactaaggaccctattgaaagttttaagacgtttaatgaatttttcatcagacaattgaaacccattgccaggcccattgcacaaa

SEQ ID NO: 930 - DNA, 224 bp, Triticum aestivum
  Clone ID: LIB3280-027-P1-K1-E10
cccacgcgtacgggagagtcaagctctccatctcccgcgccggggttggggcgctcctccaccgatgctgcgccgccgcggctgactgcgtctgtctcctcttcgggcgcgaccaccatgctctttcggcggctaacaccctctgcgactacgacgaccaaaccccaggcgagccgggcctttgcatctaaatatgcggtcactccttgactccaccaacgctg

SEQ ID NO: 931 - DNA, 275 bp, Triticum aestivum
  Clone ID: LIB3280-027-P1-K1-E11
cccacgcgtacgggaggtcaagctctccatctaccgcgccggggggggggcgctcctccaccgctgctgggccgccgcggttgactccgaccgcctcctgttcgggcgagcggaccaggcccctatcccagcttccaccctctgctgctacgacggccaatccctcgccgccccgggcctcctgatttgaataggcgaccattccttgctctaccaccagtactacattttagattcccttacaccgcctcaaccgagtctacaccctgccccca

SEQ ID NO: 932 - DNA, 375 bp, Triticum aestivum
  Clone ID: LIB3280-027-P1-K1-E12
caatagtcattaccttaaaaatagatgagaggatacagtcccgaggctttggctttgtaaaattcgaaagagagaaggatatgattagtgcaaaggaagctcatcatgtctatgtgcttgggaagagagtggagataaaggatgctgttgctagaccgtccctgcctgaactcgaaagagcaacttccttcaggcaccatgtacgtgagtccccaagagtgactcatagtgagctggaggatgaacaacctgagcaatataactttgggaaacggcggccaatgccagagaagcacctcccatcttggttctttatattcaggaggtggttgccaagatttctcatgaaagcaaccgaacgatatggtgagaagt

SEQ ID NO: 933 - DNA, 392 bp, Triticum aestivum
  Clone ID: LIB3280-027-P1-K1-E2
gtggccctggatgcgcacgttgagggtggtcttgatgccgacgttgcagacgcggaagcggtacgtcttgccttcctccacgttgaacatgggcgggttggaggcgtccttctcgttcttgccgttgatgaggagccccgcggggcggccgatgcccttgccggtgtcgaggttcttggccagcacggtgtggtccttggtgtaccagtcgccgacgaggacgccgaagtcgtcggccggcgggtcgaagggcaccgggatgagcgggcggctgtggatgctgatgagcccgtaggccccggcggcgcgctgcatgccgatgctggggtagtagaagaaggtgccgatctggtccttgaactgcatcttgtaagtgaagttggtgcccggca

SEQ ID NO: 934 - DNA, 394 bp, Triticum aestivum
  Clone ID: LIB3280-027-P1-K1-E3
gagaaggaaaccctagccgccgtcgtccagatctgcttgggttggtggaggtatggctacggcgctgcgcaccatggccgcgaagctgatgcagaagatccccgccgctgtccagcgggttcgcgtctcttctcgtgctccggcaccggcttttgccgacctcgaccccttcggcccagagtttcgccgggcactggagaagattgtagagaaacacaggaagaggcgcaggaacgaggccttggcctgtggtgctggcttcagtcttggagcactcacctttttgcttggggtccatcggcttcgttgaagggagatggctcaatggtgaatgactggaatatctatcctgcaccgcatgttctactatctactactgtgcccgcaagttcta

SEQ ID NO: 935 - DNA, 389 bp, Triticum aestivum
  Clone ID: LIB3280-027-P1-K1-E4
aatgctcagcaagggcagcttcatgcctcacaatccttggggcctggttcttttggccagaatataccaactatgcaattacctggccagctccctgtgtcacaaccgttgacgcagcaaaatgcttctgcaggcgctctacaggcgccttcagctgtacattccaatcccatgcaagctgttcctggacaacagcaacttccttccaatgtaacaccgcaaatgctgcagcagcctgtccagcagatgctgtcacaagcaccacagttgctacttcaacagcagcaggcagctatacagtccagttatcaatcttcacagcagacgatttttcagcttcagcaacagctgcagctactacagcagcagcagcagcagcaccagcagca

SEQ ID NO: 936 - DNA, 359 bp, Triticum aestivum
  Clone ID: LIB3280-027-P1-K1-E5
acgatcgacatagcactcagcatcgcccgccccctctcttcccatctggcgggcagcagaggagaccggcctcctccagatcggcctcgaggtcaacgacgcggacaaccgacggactcgacgctgccacccggagctacatcgcccacgatgtcgagtagggcatgtgcaagagctcttggccttccggggctgccgccgcaggacttgtatcgtcaggccgtcgtggtgtcgatccagccgccggccacatatgggtcttcaggtcgggtgcggcaacttgggacatggatagtagcttttgtggtagggcatacccaggaggcgtgacctgctggtagcttgccagggtcttctat

SEQ ID NO: 937 - DNA, 304 bp, Triticum aestivum
  Clone ID: LIB3280-027-P1-K1-E6
acgatcgacatggcactcagcagcgcgggccccctctcttcccatctggcgggcagcagaggagaccgggctcctccagatcggcctcgaggtcaacgacgcggacaaccgacggactcgacgctggcacccggagctacatcgaccacgatgtcgagtagggcatgtgcaagagctcttggccttacagggctgacgccgcaggacttgtatcatcaggccgtggtggtggcaatacagccggcggtcacatatgggtctgcaggtcggcagcggaaacttgaaacatggatagtacctttgt

SEQ ID NO: 938 - DNA, 393 bp, Triticum aestivum
  Clone ID: LIB3280-027-P1-K1-E7
gcttcctcaaggtcgtgtgggttactgggtttaactagcttggctcggccccttcctccgcgcaactccgacgatggcgcgcctcctcgttctcgccgtcacggccacggttctcatggctcaatccgggcagccggcgtctgctgcgcggacgtcgccggcggaggccttctggcgcgccgccctgcccgacgccaccatgccggacgccatcctcgagctcctgccccagggtgatcaccacgcatcaacggaacagggcgcgtacatgaatgcagagaccgacacaccggaaggcgcggtcgaggccgtggaggacaaggacccgccgccgcccatgaacttcaactacgactacgacgacgccttgccccggagcgaagccaccagcgc

SEQ ID NO: 939 - DNA, 336 bp, Triticum aestivum
  Clone ID: LIB3280-027-P1-K1-E8
gcttctcctccccttccggttcgggttctggttcggttcgggttcggttcgagagagaggccgagtagctagcctagtctagggtttcggtagagaggaagggagatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgtgggttcggcttcgtcacgttcggcagcgaggagtcgatgcgccaagccatcgaggagatgaacggcaaggagctcgacgggcgcaa

SEQ ID NO: 940 - DNA, 367 bp, Triticum aestivum
  unsure (1)...(367): unsure at all n locations
  Clone ID: LIB3280-027-P1-K1-E9
cccacgcgtccgggaggtcaagctctccatctccggcgccgccctcgcggcgctcctccaccgctgcggggccgccgcgggtgactgcgacggcctcctcttcggccgcgcccaccgcccccctccgccggctcccaccctctccgactacgacgaccaagcccccgccgccccgtgccttttcatctcaatctccggccactcctccctctcccacccctgctccctctcagatcccctcggccgccccaacccgccgccacccttctncccttgccccctcggcttcttctcgtcccgccggcgcacccctctccgcgccttcatgcgcgagcacgccctcgcgtgctcccctgccaaaacccta

SEQ ID NO: 941 - DNA, 334 bp, Triticum aestivum
  Clone ID: LIB3280-027-P1-K1-F1
gcaaagaggaataggatgttgacaccaatagcataaacttgaccataatatcagtcggattggaggacaatgtatttaaggaaaattgcccggtaacgattcagggcacatactcgaactcaaactcaaccctatgatagtaaatgttttgagaacgctgccgccaacctacgacaacctctggagttcgatgcctccaccaaaaacgaatgttgggaaaatccaccctctacaataattattgccttccaacgttaaaaagataaaagttcaccagatcctcgaagggtaggactgggaacaaacttctcttgttcgtcatcatttcgtcccc

SEQ ID NO: 942 - DNA, 194 bp, Triticum aestivum
  Clone ID: LIB3280-027-P1-K1-F11
ctagggaagcaaatatttagggacaaggggggttttttcaccactttaaaaaacaggctcgtgtttagtcccacagggggacagaaaaaaaattcttacaaccggttttttttataccttaaagggccccggggggaatgtgcccggagaacagattataaatgcgggggggggggggggagcccccaaatggg

SEQ ID NO: 943 - DNA, 341 bp, Triticum aestivum
  Clone ID: LIB3280-027-P1-K1-F12
aaattactgaactgtcttaattatcatgcatgctacatatgaatagtatatctcacataacatactatacacacatatatagcttccgatcaagcaaatgaagacgattctggatatctaacactatacggacatcagagaattttcactccataatccaagacggaccttcactcatgctcctgtagttttcaggagcggttcaggtactcaatggcaaccgcggtgtgaaacgcagctccaataggaagaacaccctcatcgaggacgaaatgcggggagtgcaccggatgcaccctgtccatggcggtctcgttacctacgccgatgaagaaagatgc

SEQ ID NO: 944 - DNA, 384 bp, Triticum aestivum
  Clone ID: LIB3280-027-P1-K1-F2
cccaaccaagggcggctgcagggaggaggagaaaaaaccagcagacccccacgggattcgcctggatcaaacccagacccaaaccagagggatttctccagaggtcgatccgatccgcggcgcgtccggcggcggggtctctccttcgggatcgatcgtcgcggcccgcggcgggcgggttggtgagggcagaatttgggttcgaattgggcctgttgcgccccgattttgggggcggaggcggctgcggcgggattcgcgtcgcggaggtcgttgcgctgcaccgcgccgcgcggaggtgcggttttgtggagggcctcgcgccattgcatcgagggctcgcgtgcggcgtggacgagcccctggacgccgtcgccggagcca

SEQ ID NO: 945 - DNA, 365 bp, Triticum aestivum
  Clone ID: LIB3280-027-P1-K1-F3
gatcgatcatgaagccatacatgcccacggtactgagaccccctagggtggtggccatcctggccgtggtcctggcggcggcgctcgccacagccgtgaacgctcagcagtgcggctcccaggctggtggcgcgacgtgcgcaaactgtctctgctgcagcaaattcgggtactgcggcagcggcgacgcctactgcggtgccggctgtcagagccagtgcagcggctgcggccccacccctcccggccccagccccggcgggggcgtgtcgtccatcatctccagggacctcttcgagcggctccttcttcaccgcaatgactgccaagaggcccgcgggttctacacgtacgacgccttcctc

SEQ ID NO: 946 - DNA, 248 bp, Triticum aestivum
  Clone ID: LIB3280-027-P1-K1-F4
cccacgcgttcgcccacgcgtccggcaaaacatgcttgaaaaccttgttgtccttagtcgttcattggttttactatgatattgcagttgtaggtgcagagatcgactatgatatagcttggtacatggcttcctcatgaggaaaacaaggcaacattgtgttgaaacatattgcacgggaaaacagtaggatttctaggatgccacattatataaacaatgtaatgtgcttctatttattctagatc

SEQ ID NO: 947 - DNA, 389 bp, Triticum aestivum
  Clone ID: LIB3280-027-P1-K1-F5
cctgccaggaaaaaaaaacacaagccctgttcctacgatacgatctccccagatcccctccccgtccccgtccccgattcgattccccgcatcggccgctttgccgccggtaggatcggggccggtggagcgcgatggccgcgccgccggctagggcccgcgccgactacgactacctcatcaagctcctcctcatcggcgacagcggtgttggcaagagttgcctcctcctacggttctctgatggctccttcactactagttttattactacaataggtattgacttcaagataagaacaattgaactggatggcaagcgcattaagttgcaaatttgggatacagccggtcaagagcgattcatgactatcacgacagcttactac

SEQ ID NO: 948 - DNA, 389 bp, Triticum aestivum
  Clone ID: LIB3280-027-P1-K1-F6
cccacgcgtccgattctagaaggcgaagtcggagtcggagtggagatagatatggacgtgacaggtacagagagagggatcatcatcgtcgtagcaggagtcgtagcactagccctgatgattacaagaggcgtggcagagacagaagtcctagtcgtagcaggagccgcagctacagccctgatgatgacaggaagggtggcagagacagtttgtcgcctgcacgcagaatcactagtcgctcccctcgcaagacaccacctcctcgcgaggggtctcctgctaagcgcaatgatgatcgatctcctgctaagcgcaatgatgaccgttctcctgttaggcgcaatgatgaccgttctcctgttaggcgcaatgatgaccgttctcct

SEQ ID NO: 949 - DNA, 350 bp, Triticum aestivum
  Clone ID: LIB3280-027-P1-K1-F7
gcgataacgaaactcgcagagaggacggacatggcggcgaggagcgacaacgagtcggacggcgacgtgggcaccaaccccgccgaggggggctcgtccctgtccctgccgcctctagctgccggtccggccgtatgcgtcctccggtccgccggggacttcgccggcggcgccttcgtcggatctatctttggatatggacaaggtttgctatctaagaagggcttgaagggctcactcgggaatgcagggtcttctgccaaaagttttgcagttctttctggcgtccagagtttggttttgtgcttgttgaggaagctacgtgggaaagatgatatcatcaattccgg

SEQ ID NO: 950 - DNA, 317 bp, Triticum aestivum
  Clone ID: LIB3280-027-P1-K1-F8
cccacgcgtccgcggacgcgtgggtggaagtttgagaccaccaagtactactgcaccgtcattgatgcccctggtcaccgtgacttcatcaagaacatgatcaccggtacctcccaggctgactgtgctgtgctcatcatcgactccaccactggtggttttgaggctggtatctcgaaggacggccagacccgtgagcacgccctccttgctttcactcttggagtgaagcagatgatctgctgctgcaacaagatggatgccaccactcccaagtactcgaaggcccgttatgaggaaatcgtcaaggaagtctc

SEQ ID NO: 951 - DNA, 372 bp, Triticum aestivum
  Clone ID: LIB3280-027-P1-K1-F9
gcccaacctacccccgcccccgcggcgcgcggccgaggcctccattcctcatggaagccgctgccgctgccgctgcgagccccgatagctcgtcgctggaagccgtggccaccgtcttccggtcccgcgtcaaccagcttcaagacctcgcccttgcccgcaacatgttcccggcaacgggggtgacccaccttaccggcggggacaccttggtgaccggcctggaagcgcaagtgcaagccattcgccgccgcctgtgagaggagctcgacgccatcccgaaggccaagaaactagtggagaagtccttgaagcaacagcagaagttgcagcatatgcttgcaaacatgccacctgggatgcgtgaagata

SEQ ID NO: 952 - DNA, 334 bp, Triticum aestivum
  Clone ID: LIB3280-027-P1-K1-G1
cctgtgccgttagagagctccgttatccagcttgacgagaagctggacgcaggggtctccaagtgaagtgcttgtaatcatggtagctaccaattgtttttttttgtcttgatctatctgggcctaagattctaaaatacattcgcccatacatcagtactagataggggtgcggcttgccacacattgcccagccaacggtaagccatcggatatgatagtcggttcaatatatagctgaattagatattttattattgtgttgggagctgtcttaagcacatagttagaaatcatgtttgtagttgctgaaagaaaaatagagcttgcacat

SEQ ID NO: 953 - DNA, 272 bp, Triticum aestivum
  Clone ID: LIB3280-027-P1-K1-G10
cgaatttcatgcaggatatcgaatacatagtacttagatagcagcggtgtgcacacagaacataaaattcatgcaacttctgagcaaaactcggccggtaaaacatgtgctcctaacctaggccttgatagcatacttcctcatggggaagtacttatcgcgcttcttctccctctccgtcttcaaagagagctggtgcttggtgagacgcctgcggatggcgcggctcttcttggggcgcacgtcgagcgggagacgcttgttcttgtacg

SEQ ID NO: 954 - DNA, 380 bp, Triticum aestivum
  Clone ID: LIB3280-027-P1-K1-G11
cccacgcgtccgatgacggctacaacccaagctacggtgccaggccactgcggcgcgctatcatgaggctgttggaagacagcctggcagaaaagatgctggctggcgaggtcaaagaaggtgattccgctatcgtagatgttgattcagaaggcaaagttatagttctcaatggtggcaacggtgtcctggagccgctgacacctattttgagcacctaatcatacggagcacatgattacggaacccattgtttcagcacaagctgtggcgtggagctgacaccaattctctttcattaggtggtgttgtgtcgttagatattgcttgcaagcgaggcactagaagattccgtatagctcaccggcacgcctagtttt

SEQ ID NO: 955 - DNA, 301 bp, Triticum aestivum
  Clone ID: LIB3280-027-P1-K1-G12
cccacgcgtccgatgacggctacaacccaagctacagtgccaggccactgcggcgcgctatcatgaggctgttggaagacagcctggcagaaaagatgctggctggcgaggtcaaagaaggtgattccgctatcgtagatgttgattcagaaagcaaagttatagttttcaatggtggcaacggtgtcctggagccgttgacacctattttgagcacctaatcattcggagcacatgattacggaacccattgtttcagcacatgctggggcgtggagctgacaccaattctcttttcatt

SEQ ID NO: 956 - DNA, 337 bp, Triticum aestivum
  Clone ID: LIB3280-027-P1-K1-G2
cctgtgccgttagagagctccgttatccagcttgacgagaagctggacgcaggggtctccaagtgaagtgcttgtaatcatggtagctaccaattgtttttttttgtcttgatctatctgggcctaagattctaaaatacattcgcccatacatcagtactagataggggtgcggcttgccacacattgcccagccaacggtaagccatcggatatgatagtcggttcaatatatagctgaattagatattttattattgtgttgggagctgtcttaagcacatagttagaaatcatgtttgtagttgctgaaagaaaaatagagcttgcacataat

SEQ ID NO: 957 - DNA, 385 bp, Triticum aestivum
  unsure (1)...(385): unsure at all n locations
  Clone ID: LIB3280-027-P1-K1-G3
aataacttctacagcagccactggtgatcaagctgcttttatattgagcattcccaaaagaaaattgtcggacgagacacaagaaactcttagaacatccactttcccaagcaaccatgtgaaggagaaatgggccaagaatctttacattgcctctatatgctatggacggacagtgtcgtgagacttgcagtcacaccaactcagtcagggctgagcatattaaaatgagttgacatcgaaaaccacagcaaatttagttgctgctgtgttactctgtatgtgtaggtaaattgcgtagatgaaccttacatcatggccagagcaggggcgctccagaaagaactgngatgaaggtggaccacagctagccaataagaagatg

SEQ ID NO: 958 - DNA, 379 bp, Triticum aestivum
  Clone ID: LIB3280-027-P1-K1-G4
tgcatcatgctttatttgagtgtctcaatgagtattatgttggatggcctacccaaggtagtcagtgggtgaccaagtatccggttgttgcggaagaatcatttaccagagacgaaaccgggggttgcgtgcttcatgccatcaggcactatgatggctctaagttgaagattccgctcacgaagtacaatgccgacaaaaccaaaaggcaagcactgcatgagtgcctcaaactacgggggaactcgtcgaagttggtgcatgatgcattttggacggcagtcttcgctaccgcgtcatacgtcaaccaaaacgtcatgctaccctactgtcggaacagtcgtaggagcacaacacgagtaccaaaaggtcttgcaca

SEQ ID NO: 959 - DNA, 389 bp, Triticum aestivum
  Clone ID: LIB3280-027-P1-K1-G5
attgcaaagatgaagaaaggtgtaatcttttctttgttgaacatgccagcagtcatggatacccaagctgttgctgatgcttgctccagcggccacattgctggatatggaggtgatgtctggttcccccaacccgcacccaaggatcacccatggcgctacatgcctaatcacgcaatgacccctcacatctctggaactacaattgatgcacaggtttgcttctgtgtttttatctcagcataggccctacccagccatatgcttttaacaaaactatggacgaattctaagtagtcactaatcagttattccgaatggattctgcatatggtaaccttgtgttttcctttccttcataggggagaagcaaggaataatctatatta

SEQ ID NO: 960 - DNA, 390 bp, Triticum aestivum
  unsure (1)...(390): unsure at all n locations
  Clone ID: LIB3280-027-P1-K1-G6
cccacgcgtccgcggacgcgtggggggctgcctcaatcccctccggcggcgtgcctccatccatcccctccggcctctcaccccgacagaacaccggcggccttcaagttccggccggtgtcggagacgaaacggcctatatttagatggaggagagggcggaggagatctgagcaagccgaggttgcgcgcgcgcgatggggaaaaagctacccccttctactccggcctcgtcatggacggagacggcgggaaggcggcgcaaaggcccctccttggccccgctctctgcctgcaagcgccggcggacccctgaggcaagcggctgggcttccctccccaccgatgtagttcacctcgtcaccagccgnctgctggccgacgacgtgg

SEQ ID NO: 961 - DNA, 189 bp, Triticum aestivum
  Clone ID: LIB3280-027-P1-K1-G7
gaatgatcctagtttgctccgttgattattcacctactgggaaaagacaggtccttttcggggagcgttccttctggagacaatgcgtgtcaaaggggtgaaccaagaaaccgctgcaagcaaatcttactttgcttgaagatgcgaggcgatgaaatcaactgctgatttgatggaatcgatcttctc

SEQ ID NO: 962 - DNA, 125 bp, Triticum aestivum
  Clone ID: LIB3280-027-P1-K1-G8
ttagctgtagcgcgggatgacccgtttttttttgcccgttcccactggggctgtcatacttgctgatatctcttctataacgcaaatagcttattatatgatgacatcaataacgctatcaaggc

SEQ ID NO: 963 - DNA, 320 bp, Triticum aestivum
  Clone ID: LIB3280-027-P1-K1-H1
ccgaacccgaaccacaccgtccggtccaccccgagaggagagcgcagccacaggccacagcgacatgccggcgacgccgaccatcatcggtgccctgctggggctgggcacccagatgtactccaacgccctccggaagctcccctacatgcgccatccctgggagcatgtgctgggaatgggtctgggtgtagtgtttgtaaaccaactggtgaagtttgatgagaaggtcaaggtggaccttgataagatgcttgagcgtgcgaaacacgccaatgagcagcgctactttgaccaagacgacgattagctgttcaaat

SEQ ID NO: 964 - DNA, 306 bp, Triticum aestivum
  Clone ID: LIB3280-027-P1-K1-H10
cccacgcgtccgcccacgcgtccgctcggattcaccaccatctccggcggcggcggcggccgcgacaaccgactccaccaccttccttccacccgcccgagtagccaaaacagaagcccccccgagcaagcgagcaccttcgagcggctcgccggaggaagcggcccgccgccgcaggcaggccagaggagatgtactgccagtcgtgcaagaacgtgtacgacgaggaggacgccgggacctgcaaggagtgctacgaggaggccagcgagacggaggaggagctcaagcgcgagatcgacgacc

SEQ ID NO: 965 - DNA, 364 bp, Triticum aestivum
  Clone ID: LIB3280-027-P1-K1-H11
accatctattaactctgctatcccatgtgatgattggtgtcctggccatcttgttcgtgtggtcgaaagctatgaccttcatcaagaagagtccgccagatattcctgtagtcgagatacctgaagacctcgctgtgaatgtatcacgggcactacgcagcgatgtcaacagatcacttcacttgttgcgcgagattgcaatggggcatgatctgaagaaattccttggtgtgattgctggtctctgggttctgtcagaagttggaagctgctgtgatttcctcaccttgatatatattgctgtcctgatgatccacacggtgccgatcttgtacgacaagtgcaggacaaggtggatcacttc

SEQ ID NO: 966 - DNA, 324 bp, Triticum aestivum
  Clone ID: LIB3280-027-P1-K1-H12
agcgcgaacccggataagttgctgctccaaaccagacaatttggaggatgaacgcgagtctcccagcgatgccatggttagcactgttctttcagttgactctgcttcaaaccatacaattcatttaggcaaaatactggagccactatcattcatactgtatttggcatggtagtggacagtcagaaccttacggtcttgcaacatcctcagaataaatattctgctccaatcaagttctatgtatattctgttatccacggtttatctcaaaaacgaggatttcatattacacaagtgaagaatccttgagaaatgtttatg

SEQ ID NO: 967 - DNA, 231 bp, Triticum aestivum
  Clone ID: LIB3280-027-P1-K1-H2
cccacgcgtccgcccacgcgtacggacttgttctagatcgcccgaaccggaaccacactgttctgtccaccccgcgaggagagcgaacgcacgtgccatacggacatgcctgtgacgccgaccatcatcggtgccctgctgctgctggacacccagatgtgctccaacgccctccgtaagctcccctacattctcgatgcccgggagcctgtgctgggaatgggtctgggt

SEQ ID NO: 968 - DNA, 385 bp, Triticum aestivum
  Clone ID: LIB3280-027-P1-K1-H3
cccacgcgtccgggggtatgataatgttccaatgaagattaaccggctcagatgcagagttaattatcacgccttaaagtttctacctggcattgaagaaatggctgacaaactggcaacaaggatgcggaatcgaactgggagtgtaaatccatacatggctcttcatcttagattcgagaaaggaatggtgggtttatccttttgtgattttgctggaaccagagaggagaaagcaatgatggctgaatatagacagaaacaatggccaagacgcttcaagaatggatctcacctttggtctttagcactggaaaagagaaaagaaggccgctgcccgcttgagcctgggaaaataggtttcattctgcgtgcaatgggatat

SEQ ID NO: 969 - DNA, 269 bp, Triticum aestivum
  Clone ID: LIB3280-027-P1-K1-H4
tcgcccacgcgtccgtgggtatgatattgtttcaatgaatattaaccggctgggatgcggaggtaattatcacgccttaatgtttctacctggcattgaagtaacggctgacttacgggcaacaaggatgcggaatcgaactgggagtgttaatccatacatggctattaatcctatattcgagaaaggaatggcgggtttatccgttatgaaattttgctgaaaccttagaggttaaagcattgattgcttcttgtggacagttacaa

SEQ ID NO: 970 - DNA, 335 bp, Triticum aestivum
  Clone ID: LIB3280-027-P1-K1-H6
aaccctttttagttgctgtttcaaaccagccccttacgtatcattactcaacaccaacaaatattcactaaaggggtctttacccaatcatcatcacccctgacatctcccacagcgaacccatatcccccgtgcatggagatggaccaaaaacagggttgcacagcaggatcaaaccaacggagaaaatggactcttgttaagtagcaccgcaaggccacacaggttacatgcgagagctaccaactaagttaaccgagggaaagcaaccaacaccatgccaggatatgacaccgccgagagtcccgaaccaaaaggagagttttaggatcgat

SEQ ID NO: 971 - DNA, 323 bp, Triticum aestivum
  Clone ID: LIB3280-027-P1-K1-H7
gtagttggtgaagttgcagagttccgttggcaggcacaccatgtccatctccaccgcttcccgccgcgccctcagccggatcggcggcgccctccggcggtccttgtcgtcgtcgtcgtcgtcggtgccggacgcctcggggtaccacgtgtcgggcgggccgagcttcatgcgcgcggccgtgttctgggagcccggccgcccgctcaccatggaggagttccgcatgccgcgccccaaggccggcgaggtcctcgtcaagaccaaagcttgtggagtttgccactctgatctccatgtcatgaaaggcgaactccctttcg

SEQ ID NO: 972 - DNA, 291 bp, Triticum aestivum
  unsure (1)...(291): unsure at all n locations
  Clone ID: LIB3280-027-P1-K1-H8
gtgttttggttnggcaaatgacgcattagctgttcaaactagaatggtggatttgatctgatctaccagctactggcactgtatatgtacgaaaagaacccaagaaatcctacccgccctgttctgattagggatcacaatctggaagaaagaaagaagaaaaaaaatgcaggggaaccacccgatcggggtgaaaatggatcgacccttacggctgacgttggttggttggttagaaggggtggtagctcccgcggaaggcgccggcgtttgcaaatagcccgaggagat

SEQ ID NO: 973 - DNA, 310 bp, Triticum aestivum
  Clone ID: LIB3280-027-P1-K1-H9
agaggctcccattccgcttcccgccggcgactcccgccgcgctcggtttcctgccgcgccaggtcgccgactccgtcccgttcacgacggccgcgctgcctggcgtcctcgcgacgttcggcgtcgcgtccgactccgccacggtggccagcatggaggcgacgctgcgcgcctgcgagtcgccgaccatcgccggggagtccaagttctgcgcgacctcgctggaggccctggtggagcgcgccatggaagtgctggggacccgcgacatcaggccggtgacgttgacgctgtcccgcgccggcgcccc

SEQ ID NO: 974 - DNA, 346 bp, Triticum aestivum
  unsure (1)...(346): unsure at all n locations
  Clone ID: LIB3280-028-P1-K1-A1
aagcgagaggaaagctctccaatcgagaggcatcaacggggtccacgacgcaggcttgtggtgctcccatcccatggcgccgtggctgctgctcccctccttcccgtggcctcccccgccccctcccggctcctcctctggccgcggcggcggaggcggtggaggcnacnncngagattggaagcccaacgtcgtcacggccatcgccggcgtccaccttggtcgctccctccgccgacgactatcgagtcttctctgcttgcctgaggtgcggtctcttgatgtcttgctcagaatttgcctctatttgtttttaggatcacagcctctagacacacaccacatt

SEQ ID NO: 975 - DNA, 382 bp, Triticum aestivum
  Clone ID: LIB3280-028-P1-K1-A10
gacgcactaccgggagccgaggttctacaccaaggtgtttaaggaatgccactcctatgaccaagaggggaattcctttgagctttctctggtaacttccaagtgcattggagcttatgtgaaaagcaagaagaaccagaaccagatatgttggctgtgggagaaggtcaagtgcacagaagacaaaggctttcagagattcctggacaatgtgcagtacaaatccactggaatcttgcgttatgagcgcgtgtttggggagggttatgttagcaccggtggattcgagaccacaaaggagtttgtggacaagctggacctgaaagctggccagaaggtgctcgatgtaaggtgtggtatcggaggaggcgacttctacatg

SEQ ID NO: 976 - DNA, 422 bp, Triticum aestivum
  Clone ID: LIB3280-028-P1-K1-A11
caacttcttctgcgcgctcgggtacaacgtgacggcaatgggcaggttcaacgagacgcgctacgcgtgcccggccgtccccgtcgccgtgcgggacctcaactacccgtccatcacgctgccggacctcgccggcctgacgacggtgcggcgcagggtcaggaacgtgggcgcgccgaggagcacgtacacggccgccgtcgtcagagagccggaaggggtgcaggtgacggtgacgccgaccacgctggcattcggcgccgtcggcgaggagaaggagttccaggtgagcttcgtggcgagggtccccttcgtgccggcgcccaagggcgccggagggtacgggttcggcgccattgtctggtccgacgggccagggaaccaccgggtgcggactcctctggctatcaggaggcgcaaga

SEQ ID NO: 977 - DNA, 315 bp, Triticum aestivum
  Clone ID: LIB3280-028-P1-K1-A12
cacagcatagataggttcccagcatatcacagcaaacaaacacatgccatgccaaatattccacggatttaaatttttaaagggtccaggcttgaccttgaccacgcaagttctcccacagaaccaagacggtgctaaaaacatgaaaggaagttccaacaaagttacagataaaccgaaccgccagaccacagcaacaggccgcttggctcggttcaaaatcaattgagccgggccacagcgaggtgttccttctcttttatgcgaaattccagccggtacaccaaacatttcagaacccaagaccggagcaaa

SEQ ID NO: 978 - DNA, 462 bp, Triticum aestivum
  Clone ID: LIB3280-028-P1-K1-A2
gtacgccggcacggaccggtacttcccggccggacccacgcgtccgcccacgcgtacgtcgagcccgacttgtgaagaggcgacacggcccaccagccagccacgccgttccctatccgattcgtgatccaacccctcttccgcctcctcctcccccgcggctgccatggcggccacgctgctccagcgggcgctgcagctccgccgtgccgttccctgtcgagctttcttgcgcgcgctcctccccggggtcttcagccgcctcctctccgtcaccgactacacccagcagaacaccgtcggcaccgccatcgacctgtgcaacgacgagagccggcgccgtctggtcaacagtctgatgtacaggagcaagcagaggggcttcctggagctggacctcgtgctcgggacctgggtggagcaccacgtccggtccatggaccaggccaacatccggttcct

SEQ ID NO: 979 - DNA, 400 bp, Triticum aestivum
  Clone ID: LIB3280-028-P1-K1-A3
caaaaccctagccgtcgtctcacagctcgccgccgacgcagcgagctcttcctccaccgccgcaaccatggcgacccagatcagcaagaagaagaagtttgtgagcgatggcgttttctacgccgagctgaacgagatgctgacccgggagcttgccgaggacggctactccggcgtggaggtgcgcgtgacgccgatgcgcacggagatcatcatcagggccacgcggacgcagaacgtgcttggtgagaagggccgcaggatcagggagctcacctccgtcgtccagaagcgcttcaacttcccggagaacggcgttgagctttacgccgagaaggtcgtcaaccgtggcctctgcgccatcgcccaggctgagtcactccgctacaagctcctcgga

SEQ ID NO: 980 - DNA, 408 bp, Triticum aestivum
  Clone ID: LIB3280-028-P1-K1-A4
ccgcgctgctgggctacctcggcgacgccgcgggcgtcgaccgcgtccccgcgtggatgccgctcgtctactccctcgcctccttcgtcctcgggtcgctgctggtggcggacgcgtcggtcagcgacgaggagtgggacgagtgggtcgcgcggcgggagcgcggacgccacctctcgttcctcgagtacgacgaggcgctgtggcacacggagcgggggcagcccgacgcagaactcgcttgcagagaagggccgcaggatcagggagctcaccttcgttgatcataagcgctttaacttcccggaaaacggcgttgagctttacgccgagaaggtcgacaaccgtggcctttgcgccaatcgcccaagctgagtcacttccctacaagcctcttggaagcctttc

SEQ ID NO: 981 - DNA, 61 bp, Triticum aestivum
  Clone ID: LIB3280-028-P1-K1-A5
cggacgcgtgggcggacgcgtgggcggacgcgtgggcggacgcgtgggcggacgcgtgggc

SEQ ID NO: 982 - DNA, 215 bp, Triticum aestivum
  Clone ID: LIB3280-028-P1-K1-A6
ccccggaggcccggcgcagtattcccgggtcgccacgcctcctccgagcggtcgaagatgggaagggttccacctttaccttagagaaaacaaaacgggtgatttttacacgtgtattgcacagcgctcaacgaatcggatgcttatttaccgctggatgcaccttcttaacgggtccagcctgacgctacaccccccaggttcaactacaaaac

SEQ ID NO: 983 - DNA, 379 bp, Triticum aestivum
  Clone ID: LIB3280-028-P1-K1-A7
gtacgaggtggtgacacgcgagtacaccgtcaacctccacaagcgcctccatggatgcaccttcaagaagaaggcaccaaatgccatcaaggagatcaggaagtttgcacagaaggccatgggaaccaacgatgtccgcattgacgtgaagctcaacaagcacatctggagcagtggcatcaggagtgtcccgaggagagtccgtgtcaggattgcccgcaagaggaatgacgaggaggacgctaaggaggagctgtactctctggtcacagttgctgaagttccccaggaaggtcttaaaggtttgggtaccaaggttggggaggatgaggactaaaccccctgtctgtcgtatcgatcagttagaacttaatacata

SEQ ID NO: 984 - DNA, 409 bp, Triticum aestivum
  Clone ID: LIB3280-028-P1-K1-A8
cggacgcgtgggatcatttctcgaggaatgtacggatttctcaaagtgacgcaatgctatgatcttcaaccatgaaaacgaaactgtcagcgctgatggcctgctcctgtgatctcatagcattgtgtcaaggagcaggtggagagggagaaagagaaagggagaatggaagccaagtgatagacaaagagagtgaaagcttttgttgaattctcatggttggagatactgcaagaattctgattcggcacggccctcatggagacaatggagatggtgttcagcggtgcgctcatccagagattgcctcttctgcaatacgtccgacatttgctgattcggcagggcccttatggaaacaaattcagggcgcagagaaactaatggagcgaccaggagtccaatcatt

SEQ ID NO: 985 - DNA, 343 bp, Triticum aestivum
  Clone ID: LIB3280-028-P1-K1-A9
gttatagatggtaacatgcctctcggaatctacaaatttttcaaggtgggggggggctattatcttgaacccttaaaactacgctgtcatggatgctggtgctgttcctgtgttctcatatgacattaaggtggtgctgctggtgagggaaaaagattaagggccatacggttgccatttttatcttttctatagtgtcacctaaaatcaataaactgggcggggagatactgtaagaattctgataagagacgccccttatcagaaactataatgatggtggtcaatagtgctttcaaccggtggttaattgacgtagaggtcctcaccgattggctttatt

SEQ ID NO: 986 - DNA, 115 bp, Triticum aestivum
  Clone ID: LIB3280-028-P1-K1-B1
aaatcatgtacgtagattcatgtgcacgccgtgcttttatcttgtttaggattctagttttgtactccataggatcctacgattatatttgttctaatttagtggagtttgatcc

SEQ ID NO: 987 - DNA, 422 bp, Triticum aestivum
  Clone ID: LIB3280-028-P1-K1-B10
aacgccgggcggaagaggagcagcatgcagggtgaggtcgagaaccagctccctgctgccgccgccgccgtggcgaggaagaggagcctgcagggcggcgaggtgaggtcgaagagggcgtcgatcccggcgaggccttggacgtcggcggctgctgctgcgcagaaggtggtggtggctcctggttccaggatgaccaggcagcagcagcagcaggcggcggcgagcagcaacaagaccaaggggtgggtgaggtgaggtaggctgcgagcgtttaggtgcgtgtgttgtagtagatgagatgagatgagatgagatgagatgagacgggacggggacgggacgccattgcatttgcattgctctagtgatgaccgacttgtctgtaactttgtttgtttgtagtatttgtactttatact

SEQ ID NO: 988 - DNA, 388 bp, Triticum aestivum
  Clone ID: LIB3280-028-P1-K1-B11
ggggactgtcaaattcttggagacatgtagaggtagcgtcatagggcaatgagtcatcaagaaagggtgttatgtacaccattgcactcttttgtcatctgtactcttttgaagtcatctgtacccttctaaattagcttatcttggtatagaaatcctgctcgaatacatttagatcaaagttttaaatagcccggtatagcttccctgtagcattgctatagcttttgaagggcccttccgcaaagccatgcacttttactggtaaattacagatgaccgtaatagcttgctattttccgctataccgctaaatttgaagtcatttagcgccggtaagctactgttgggccaaaaatttctgcgcttccaaaatcacatcgcagcg

SEQ ID NO: 989 - DNA, 422 bp, Triticum aestivum
  Clone ID: LIB3280-028-P1-K1-B2
gagaaggggtccgagaagagaggagaagagaagagaatccaaggaacgagccggcggcgatggcgtggcgggcgagcctatcccggaacgtgaaggagatccgcttcctcttctgccagtcttcccctgccagcggccccgcccgggagttcgtgaagaagaactacggtgacatcaagacccgcaaccccaccctccccgtcctcatccgcgagtgctccggcgtccagcctcagctctgggcgcgctacgatatgggcgtggagaggtgcgtgcgcttggacggcttgacagaagcccagatcgacaagaagttggaggagctagccaaggcaggagttgcgtaaagctaaaaactgtcaggctagccaagttttcttgcgttaaatcttcacaaataagagaaaagttaacatgggatg

SEQ ID NO: 990 - DNA, 87 bp, Triticum aestivum
  Clone ID: LIB3280-028-P1-K1-B4
gacgattgaacaagagcattatttcgtttatttcattcaggtcgcgatacaacaatgcatatttacaacttctaactccgtcgcttc

SEQ ID NO: 991 - DNA, 360 bp, Triticum aestivum
  Clone ID: LIB3280-028-P1-K1-B5
agttggcattccagcagcaaagcttcagagctgccgaatgggtggtataatgtctcttccaacacaagcttcttgctcatcacatatgccccatgcataccgtgatgtaccctaggcaaacacgaagcaggtccccacgtaccaaacttacacaaaaagcagggcactcgcggcgctcatcttggatggaggtcctacaaacttacaggtcatgcgagaagcggctaacaggagaagagagagatcactccaggagaacttcgccttcgccgatcgctttgttcatgattttcgtcgacacgtcttggtcttctttctgagcgtcgccgccgccgtcttctttattgctggccggagtgg

SEQ ID NO: 992 - DNA, 386 bp, Triticum aestivum
  Clone ID: LIB3280-028-P1-K1-B6
gagtacaacgaacgcttgttattagctgatgaaggaaccgttatgcggattcaagcctttgatgcggcttgcgagagaagcatgtccagggagcgcctgacagaatcatgtcgggacaaccctggcgtcggcgatgatcgggctccgcaccacgtgatcttcagacacccagcgtaggctcccctcggccagctgcccggcgttggcgtcggcgtcacctcccctgctgctcacggtcaccgtgaatgtcttcttctccatcgccgacgtgaactccagcgcctctggctccaccttcaccttgagccaattgggcacgtccaggtgagcggtgtacatcgacttcgccggccctacgtttgtcaccgtccgctttgccttgaacg

SEQ ID NO: 993 - DNA, 421 bp, Triticum aestivum
  Clone ID: LIB3280-028-P1-K1-B7
ccgccgcccgctagctagcagcccgcacgccgccaaccacccgccgtctccagcacgccgtcacctgtctcctttatcctcctgcacccccactgcttaggccccgaacacttctaaccctagctcgtgcgctggagttcggggagaggccaaggcgcggtggtggacgccgccatccctctcagatccggggctaagagagggagggagggagggagaggtgggtcacctgcgagaaagagcactcgcaccctcgctcgtcagccgtcacccaggagccgccaccaccgccgccacgccaggggcttcctccgatctgcgctcactggtttgtttgaagaaggatctagccgttgactggtggtgcttcccctccccgggcgccatgacttgggatagtacttctatccagcaagcaacg

SEQ ID NO: 994 - DNA, 367 bp, Triticum aestivum
  unsure (1)...(367): unsure at all n locations
  Clone ID: LIB3280-028-P1-K1-B8
aagtcttaatccgaatttataattacataaattctcggacaaaaaaatacagtataaaggaactgctgtgctaaataaaaaaggagaagtcggaagatggatcacttcttgcggttcctcgcaaggaacccatccataaccgccttggtcttgatcgtctccgcttgtctcctcgacgccgtgccgtgctccggcgacgacgcaaccagcagcaggctctcggccgccctggccctggcaggcggccatgttcgcgggaagaagcagagcaccgcggtggtaagcagcgtggccacgagccggccgcagaacatcatcatcaagaggcacaccagcaccgccgccacgccgaccgngggcgaccttt

SEQ ID NO: 995 - DNA, 177 bp, Triticum aestivum
  Clone ID: LIB3280-028-P1-K1-B9
attttgggggtctttaggagggaactaagaggttttggagataacttttgcaggcagtttgaaaacagggttgtgggattcccttcacaattaggaaacttttccaagttcctgaaagggattgagaaaaggcttgggcggatttaaagggtggaaccaaaggttaccccacatttt

SEQ ID NO: 996 - DNA, 423 bp, Triticum aestivum
  Clone ID: LIB3280-028-P1-K1-C1
gactgggaagcatcttgctgagcactgcagggctgaatatcccaaggtcacaaatttcatcttatggattcttgcagaactggctgtagttgcgtgcgacattcctgaagtaattggaaccgctttcgctttgaacatgctcttcaaaattccgatatggtgtggtgttctcataactgggctcagcactctgatgctcctgttcctgcaacaatatggggtccgtaaactggaatttctgatagcatttttggtattcttgatagcaacttgcttcttagttgaacttgggtattctaaaccaaattcttcagaagttgtgcgaggcctttttgttcctgaaattaaaggagatggagctacaggtcttgctatctcactacttggtgctatggtgatgccgcacaatctttttctccactc

SEQ ID NO: 997 - DNA, 416 bp, Triticum aestivum
  Clone ID: LIB3280-028-P1-K1-C10
gatttccttccccatggctccgatcaagatcggcatcaatggtttcggccggatcggcaggcttgtggccagggttgcgctccagagccccgatgtcgagctcgtcgccgttaacgaccccttcatcaccaccgactacatgacctacatgttcaagtatgacactgtccacggacagtggaagcaccatgaagttaaggtgaaggactccaagacccttctcttcggtgagaaggaggttgcggtgtttggctgcaggaacccagaggagatcccatgggctgctgctggtgctgagtacgttgttgagtccaccggtgttttcactgacaaggacaaggctgcagctcacattaagggtggtgccaagaaagtcatcatttctgctcccagcaaggatgctcccattgttgtct

SEQ ID NO: 998 - DNA, 421 bp, Triticum aestivum
  Clone ID: LIB3280-028-P1-K1-C11
cccacgcgtccggcctagggtttttgacgccctcgccggcccgccgccacctcctcccttctcacgagcgctgccccttgactaccaccgtagcaccaggatgacggcgcagactgccgaggagctcgccgcccagatcgagcaggagcagctcgaggcgaagaaaacagaggcagaggaggttgtggttgaggatgatgatgatgatgatgacgacaacgacgacgacgacgatgatgatgacaatgatgatttggatgggcaagaaggtgatgccagtggcaaatcaaaacaaagcaggagtgagaagaagagccgcaaggcaatgctgaagcttggcatgaaatccatcactggtgtaagccgtgtcactgtgaagaaaagcaagaatatattgttcgtcatctcaaaagccgatgtg

SEQ ID NO: 999 - DNA, 352 bp, Triticum aestivum
  Clone ID: LIB3280-028-P1-K1-C12
gacccttacttcgtgaagcttgctgatgccatggtcacctggatcgaggcctgggacgagctgaacccatctgatgctgtcgttgctgctgggaacggcaaggcagcagccaagtaggctggctggggagccaagaagagtgtatggttggggcctagatatagctctttttgagaaagagattactgaagcagcttttataattctttcatgttatgctggtggttcttttgtagctggacaaggatttgttatcatttacataattcaagacaataatatttatcatgtatttttgagaaatcaagcaccctttgttattgtcgtgaaattattttcgttgagcatcaac

SEQ ID NO: 1000 - DNA, 423 bp, Triticum aestivum
  Clone ID: LIB3280-028-P1-K1-C2
gagctaatggctttctacatgaacctgagaagaagcaagaacaacgagactgcgatggagctctttggtgactgctcgctcacatttgatgacgaccagccaacgctctcatgcaacctctttgactctatgcgcgttgacatcagcttgacatgttcaatttgcttggacccaatgtttgatccggtctcgctttcctgtggccacatattttgctacttgtgctgctgctctgctgcatcggtgacgattgtcgatgggttgaagtccgcagatcacagatcaaagtgcccttgccgacaggctggggtctttcctgatgctgtgcacttggacgagctgaacatgctacttagctatagttgtccggagtactgggagaagagaatgcagatggagcgagttgaacgtgttcgtctggct

SEQ ID NO: 1001 - DNA, 403 bp, Triticum aestivum
  Clone ID: LIB3280-028-P1-K1-C3
cccacgcgtccggcaggactatatttggttgatgtctggataaaagtcttggctgaaaaatgcttggcctggagcctccttgcaaagtgcacggactatgtttggttgatgtcctgaagaaatgtatattgacttgtgctatttgcattagaacacttgtccttatgtgatataaagtttgcatttttagtgtcttgtgcttccattactagttgcatgtttatgatacagcaggtttaccattctatgagagatccattttgagtttccagttttccaaagacacacaagttgatggaggtttgtaagatctacatacaagcagttgacgatttggaagttctacagcggctgaaggtttggaagacatacaattaagttggtgtagtgataatgtagtgca

SEQ ID NO: 1002 - DNA, 424 bp, Triticum aestivum
  Clone ID: LIB3280-028-P1-K1-C4
cccacgcgtccggcaggactatatttggttgatgtctggataaaagtcttggctggggaatgcttggcctggagcctccttgcaaagtgcacggactatgtttggttgatgtcctgaagaaatgtatattgacttgtgctatttgcattagaacacttgtccttatgtgatataaagtttgcatttttagtgttttgtgcttccattactagttgcatgtttatgatacagcaagtttaccattctatgagagatccattttgagttaccagtttttcaaagacacacatggtgatggaggtttgtaagatctacatacaagcagttgacgatttggaagttctacagcggctgaaggtttggaagacatacaattaagttggtgttgtgataatgtagtgcatctagtttgctgaacctgcat

SEQ ID NO: 1003 - DNA, 430 bp, Triticum aestivum
  Clone ID: LIB3280-028-P1-K1-C5
cggacgcgtgggcgcctcctcgccatcgacgagaagacggggcccctgctcaaggacatgctcaacaagcccaaagaggacttcatgtcggcattcggcaaggccatggagaagctcaccgtgctcaaggccatcaccggcaaggacggcgaggtcaggaaggcatgcaacgagttcaacaaccccatgtccagcgacggcccctcggtcatacggatcagctccgtcgaccccgaggtcctggatggcttggcggccggcaacaagcaggagcaggtgtcaagcatcgtctcgcaggggcacgcggacgcacagccggaggccgccgccggcaacgcggacgctaaggccgagaagccccacaagaaggcgtccggcaagcacaagctccgcagcgactagaagcagtgcgcgtgagcgcgtcactact

SEQ ID NO: 1004 - DNA, 423 bp, Triticum aestivum
  Clone ID: LIB3280-028-P1-K1-C6
cggacgcgtgggcgcctcctcgccatcgacgagaagacggggcccctgctcaaggaggggctcaacaagcccaaagaggacttcatgtcggcattcggcaaggccatggagaagctcaccgtgctcaaggccatcaccggcaaggacggcgaggtcaggaaggcatgcaacgagttcaacaaccccatgtccagcgacggcccctcggtcatacggatcagctccgtcgaccccgaggtcctggatggcttggcggccggcaacaagcaggagcaggtgtcaagcatcgtcttgcaggggcacgcggacgcacagccggaggccgtcgccggcaacgcggacgctaaggccgagaagccccacaagaaggcgtccggcaagcacaagctccgcagcgactagaagcagtgcgcgtgagcgcgt

SEQ ID NO: 1005 - DNA, 171 bp, Triticum aestivum
  Clone ID: LIB3280-028-P1-K1-C8
ctcgctcgcggccgatctatagtatccaagcttatttgcgcgaacaacccatgtggggggtgttttatcttgtgcctcaatacaaattacttggcctatgtttagatcatgatcactggaaaaaccttttgcctactcatcttaaccttctgacaccagattcccctttct

SEQ ID NO: 1006 - DNA, 383 bp, Triticum aestivum
  Clone ID: LIB3280-028-P1-K1-C9
ctcatcctcccacttccttttctcggccattctaagccaccatgccgggctccatcgccttcggtcgcttcgatgactccttcagcttggcctctttcagggcctacatcgccgagttcatctccaccctcatcttcgtcttcgccggcgtcggctctgtcatcgcctacaccaaggtgagcggcggcgcgccgcttgacccatccgggctgatcgccgtggcgatttgccacgggtttgggctgttcgtcgcggtcgccatcggcgccaacatctccggcggccatgtgaaccctgccgtcaccttcggcctcgccctcggcggccagatcaccatcctcaccggcatcttctactggggtgcccagcttctcggcgccatc

SEQ ID NO: 1007 - DNA, 196 bp, Triticum aestivum
  Clone ID: LIB3280-028-P1-K1-D1
cggacgcgtgggcacctgtagaggtagctagcagctatgcgatgatgatgatttaggtgtgtgtgggtgtgtgcgtggtgttctatttttgtatgcgcgtcagatgattatgtatggacttgtttgatggtggcatgattctgccatcatgtgagtgtttggctatttagttcatgctaatgtgtgtatgtactcc

SEQ ID NO: 1008 - DNA, 404 bp, Triticum aestivum
  Clone ID: LIB3280-028-P1-K1-D10
gaaaaaaaacagtgggggagaatgaatttacagggaggcttggctccgccaccatcgtcatcatctcgcttgaggttgagggaaatgtacactcgctcgcggacgcaaactcgctgctggctcggctatttacacgggcgggcaggcacgccggccggctgcccagcccagctcgtctcgctctcgccacggggaaaggggaaaacgcacgcacgcacgccacctggcatggccaaggtggaattggtaactgaacggtatcatcactccgccgcaacgatcgccgccggcctggtggctcgcaggctcgcgcttcgcggttgccgcagcatctcgatcagcgcctcagccttggttttgagcttggggcgtgcggaggaggactgggagagcgcgaccagggg

SEQ ID NO: 1009 - DNA, 424 bp, Triticum aestivum
  Clone ID: LIB3280-028-P1-K1-D11
gccaagacgaagatgagcagcagcaactccaaggcacacaatgcagtgagacaggaaacttaagaagaacaataagcagtatgaagacctgatccagaagtgcagagataatccagagagttttgaagatcacattgcagacaaggtttcggatgatgatagtggtgatgatggtagtgacgtagatattgtggatcctgaaccagatccagatgacagtagcgatgacaataagagtgaactgggtggagcctgggaaaagaagttgagcaagaaagatgagattatggacaaacagttcttgaaagaccccagtgagatcacatgggatattgttgataaaaagcttaaggagattgtggcgtcgaggggtaagaagggcactgggagaattgagcgtgtggagcagcttacattttttgac

SEQ ID NO: 1010 - DNA, 334 bp, Triticum aestivum
  Clone ID: LIB3280-028-P1-K1-D12
gccatgactaagatgagcagcagcaactccaaggcacacaatgcagtgaggggggtacttaataagaacaattagcagtatgaagacctgatccataagtgcagagataatccagagagttttgaagatcacattgcatacaaggtttgggatgatgatagtggtgatgatggtagcgacgtagatattgtggatcctgaaccagatccagatgacagtcgcgatgacaatataagtgaactgggtggagcctgttgaatagaagtagcgcaagaaagatgagattatggacaaacaggtcttgaatgaccttagtgagatcacttgggatatt

SEQ ID NO: 1011 - DNA, 409 bp, Triticum aestivum
  Clone ID: LIB3280-028-P1-K1-D2
tacacatgcactcctttggtccaggtggtgtccatgggatccaggtggctgtacacgtgcacgtccgacgtgcggatggcgtccactttttgttaaagggtccaaaataaagcgtctcagtcaattttaggttgagaataataaaacaagccgagatgtaaaaggcttgtttttaggtgttaggtttgtgttgcgtcgagtcatggttataagttggttaggctgcagctcgaggacaagctgcatgtccaggtggggtgtagtgttagagtacgtaatggtcctaatgggcccattagtcttagggtcgcttacttaggggtcaagtaagtcttgcttgggagtcaagtaaacctctctatataaagagaggagatgtatcaatctaatcaagccagaattaagaagg

SEQ ID NO: 1012 - DNA, 396 bp, Triticum aestivum
  Clone ID: LIB3280-028-P1-K1-D3
agcagcagcaccaccgtcaccgccaccgtcaccaccaggaagcgcagtagtcgacgcagctgagccatggcccgccgcacggccctcatcctcgccgcgctcctcctcgtcgcactggccgtcgcgccgttggccaatgccaagaaggccgccaaggaggagaagtcctccgacgccccctcggccgacgcgccggccgccgactcgcccgcggaggggccctccgacggaccggcggctgcccccgggcccgagggcatcgccggcctctcgcccgacaacgacgacaacgacgacaagtgaacccgagtgcatgcccttctggaaggatccgctccatgctgaccagatcgtccgcatggattttagtttcgagacaataataataataatact

SEQ ID NO: 1013 - DNA, 423 bp, Triticum aestivum
  Clone ID: LIB3280-028-P1-K1-D4
cctcgccccaatccagtattccccgtctccctccgggtctcccgagaaaaatcgtcgccgcccatctgccccatggccgcggacaaagcactctgccaacgccatcggcgctgcttcaatgggcttgtactctgactcagatcacgagtttgatgagggcctcaacctggtctgccattcctgtatcatcacgggtgacgctgttgtgcacagctctcctcctaccttgatgccgctgggatccacaacccaccggaaaggagtagcggcgccctcacaggttggaccactcccggatccgtcgccgccttcacagccaggacgggccgaccaccgagggcatctttctccaccacttgtgatgagtggccgagccatggagcggaggcggcggggagtactgattatattggaaggccaagg

SEQ ID NO: 1014 - DNA, 369 bp, Triticum aestivum
  Clone ID: LIB3280-028-P1-K1-D5
gcttcggtcagctgctaatccttcacaatagggttatatttgggtgtcagtagaattgttccaggagagatggggaaggagcgtgaaggccacatacgatgcgaggtggtgagatcgtcttgagttcaccacggggaatcatggcggagacacacgcagtgtaccattattaatttgagtttgttattatgagcaggagggttgtcacttatgggaccagcaaactttattcgttaatattgtcattgcattttgtagagagaaagaggggactggtaagaataaggtaaggctgtgctgctgctgtatgtgtttgtatatttataacaagtgttggatttttttggaaagacctgttgattgatgttg

SEQ ID NO: 1015 - DNA, 412 bp, Triticum aestivum
  Clone ID: LIB3280-028-P1-K1-D7
atggggcggctgcaaaagcaaggctggtcgccggcgggagcgccagccacgcggggttgctcgccagaagcatccgatgcaaggccgctcaccggaagcatctgatgctattgacggcgaccggcgggcggggtgacggcggatgctggtgttgcgaggatgacgaataccctagccaggtcgtttgcatccgcttttcatctcaaagatgtatctcatgttgatccatgtacgctcgaggcttcttacgaattttaattcaatgacctatataaattggtatgaaaaaaaaaaaaaaaaaaaataaaaaaaaaaaaaaaaaaaaaaaaaaataaaataaaaaaaaaaaaaaaataaaattaaataaaaaaatttattaaaatattaaataataaaaaaattttgggggggg

SEQ ID NO: 1016 - DNA, 280 bp, Triticum aestivum
  Clone ID: LIB3280-028-P1-K1-D8
atggggcggctgcaaaagcaaggctgatcgccggagggagcgccagtcacggggggttgctcgccagaagcattcgatgcaaggcctctcaccggaagcatctgatgctattgacggcgccacttttagggggaggagaaataaaacctgccgtggtgagaaaggcttgttctctagcgcaggggttgggatgcgctttgaatttgaaataagtagctcatgttgaaccatgtacactcgatgcttcttacggaagttaatttcattgacctatataaat

SEQ ID NO: 1017 - DNA, 394 bp, Triticum aestivum
  Clone ID: LIB3280-028-P1-K1-D9
aaaaccccagacctgatgtagccaaagggtggagttgccgtgatgtagccattggaaagggggaaaagatttgggcgttcgtgcgccggccggaaaaaaaaaaaaaaaaaaaaaaaaaaaaaaaaaaaaaaaaaaaaaaaaaaaaaaaaaaaaaaaaaaaaaaaaaaaaaaaaaaaaccaaaaaaaaaaaaaaaaaaaaaaaaaaaaaaaaaaaaagggggggggcgtttggaaattaaggaccccgggggggggggaaaaaaaaaggggtggggaaaaaaacttggaaattcccttttttggggggggggggggttcttaaccaaaattggggggtctaaattggcgggtttcttctaagggaaagggttgatttccaaagaaaaattttttt

SEQ ID NO: 1018 - DNA, 339 bp, Triticum aestivum
  Clone ID: LIB3280-028-P1-K1-E10
ttttttttttttttttttttttttttttttttttttttttttttttttttttttttttttttttttttttttttttttttttttttttttttttttttttttttttttttttttaaaaaaaaaaggaggaaaaaaaaagggtaaaaaaaaaacgcccaaaaatttaaaatattttaaagaaaaaaaaaaggaaaaatacttaatttgggggggggcaaaaaaaaaaaaaaagggtttttaaccccaaaaaaatttaaaagcccaaaaccctggggggggttttttttgccctcgtgggtcaaaagggtaataaaaaatcccaaaattttttttttgggg

SEQ ID NO: 1019 - DNA, 259 bp, Triticum aestivum
  Clone ID: LIB3280-028-P1-K1-E11
gggcactacacatgcttacaaaatacaaatcgatcgatacatatatatactaactgaaaacaaaacagagcaacttaaaaaaaacagaggggaaaaaagaggcaatggcacattctaattcatcaagcagggatcaaatggtgaggccatccgtccactgattagcaaactagcacccgacggtgaaccaccttcggccagccgacgcccggccggtgcgctccgcctttcttttttcctcctcgcacgcgcacttggc

SEQ ID NO: 1020 - DNA, 333 bp, Triticum aestivum
  Clone ID: LIB3280-028-P1-K1-E12
gataagcccatcgctttccccgtgccggggaagtgctacgcgaggtttttcccgaactgcaccgagccgcggtgcaaaaagttctgcgtccagccgctccccggagcagtctgcctcgacaaaaaacctgctgctgccctgttgcttaactataagtgccgctgaagcgatcgagccaagaaacggtgaaagatgacaataagcaatcttggtacacctccaaatacatagtccttatttgttaacgttgtccctatttatgacctgtcaaccaaagatttgtgtattgtattaatgtgtgtattatatcaccacaacaatgtgcctgctatt

SEQ ID NO: 1021 - DNA, 426 bp, Triticum aestivum
  Clone ID: LIB3280-028-P1-K1-E4
cgcccgtcacgtccagccccctcgtcgcgtggtacctctccaaccttcccgcgtaccgcaccgccgtcagcccgctcctccgtggcatcgaggtcggcctcgcccacggctacctcctcgtcggccccttcgcgctcaccggcccgctccgcaacacgccaattcacggccaggcgggaaccctcggcgccatcggcctcgtctccatcctcagcgtctgcctcaccatgtacggcgtcgcctccttcaacgagggcgcgccctccaccgcgcccgccctcacgctcaccggccgcaagaaggaggccgacaagctgcagaccgccgaaggctggtcccagttcaccggaggcttcttcttcggcggcgtctccggcgccatctgggcctacttcctcctctacgtgctcgacctcccatacttct

SEQ ID NO: 1022 - DNA, 333 bp, Triticum aestivum
  unsure (1)...(333): unsure at all n locations
  Clone ID: LIB3280-028-P1-K1-E5
gggggacccacgcgaccgcgcccgacacgnccagcccccacggcgcgaggaaccnacaccaaccaacccgcggagggcaccgacgacagcccgcaccnccgaggcaacgaggacggccccgcccacggcaaccnccacgacggccccagcgcgcacaccggcccgcnccgcaacacgccaanncacggccaggcgggaacccgcggcgccaacggccacgacgccaaccgcagcgacggccacaccaaggacggcgacgccaacaacaacgagggcgcgcccaccaccgcgcccgcccacacgcacaccggccgcaagaaggaggccgacaag

SEQ ID NO: 1023 - DNA, 322 bp, Triticum aestivum
  unsure (1)...(322): unsure at all n locations
  Clone ID: LIB3280-028-P1-K1-E7
aaccaagcaaagcatccacttgacgattaagattcagtttgacaagcgatgaccacagaccacgataggtttttcttgttctcgcaaacataaccactgaccgaagatgttcaccgacaccaccaccgacatttgcatctcttaacccaacaagcatccatccatccatccatcgtcaagcagtgcgcctgcccgcagctagtaagctgccaccggaccaacaaagccagccagccaacaatggcccgcgcagctgtcttcatcgtcgccctcctcctggtcgccgncgcggtggcgccattcttcgaagccaacggcaaag

SEQ ID NO: 1024 - DNA, 380 bp, Triticum aestivum
  Clone ID: LIB3280-028-P1-K1-E8
gacacttcaaccatgattgatagacgaatatgcaatgagttcacttctcacaaaacaaagtgttgaatttacataataagttcacagctcaaaaaatatatgagctcacagctgagagaaattggagaaattgagttcatataggagatcggcggcgtcatgacgtccaggagatgggggtggcgtccagcgattgacccaagaagtccaggcaatcagggaatgtaccagcaaagaaggcaatgacttccatatcacccatatcatgaatttttcgactgcgaactgtatgatatcatggactctcatgtattggcacgggtctcgccgatcttagcttggcaacaaaacataccagcgtgcaaaatgctctacacggt

SEQ ID NO: 1025 - DNA, 319 bp, Triticum aestivum
  Clone ID: LIB3280-028-P1-K1-E9
gacacttgaagcatgattgatagacgaatatgcaatgagttcacttctcacaaaacaaagtgttgaatttacataataagttcacagctcaaaaaatatatgagctcacagctgagagaaattggagaaattgagttcatataggagatcggcggcgtcatgacgtccaggagatgggggtggcgttcagcgattgacccaagaagtccaggcaatcatggaatgtaccagcaaagaaggcattgacttccatatcacccatattatgaatttttcgactgcgaactgtatgatatcatggactctcatgtattggcac

SEQ ID NO: 1026 - DNA, 420 bp, Triticum aestivum
  Clone ID: LIB3280-028-P1-K1-F1
aaactctccattcccctcaactcgactccgtcgtctcccctccatttcgatcatgagcatcccggtgaacgggcagtcggtggtgccgccggggttccggttccaccccacggaggaggagctgctcacgtactacctcgccaagaaggtggcctcgcagcgcatcgacctcgacgtcatccgcgacgtcgacctcaacaagctcgagccatgggacatccaagagcgctgccggatcggaactggcccgcagaacgactggtacctgttcagccacaaggacaagaaataccccacgggcacgcgcaccaaccgcgccacggccgccgggttctggaaggctaccggccgggacaaggccatctactctgccgctggctccggccgcatcggcatgcgcaagacgctcgtcttctacaa

SEQ ID NO: 1027 - DNA, 393 bp, Triticum aestivum
  Clone ID: LIB3280-028-P1-K1-F10
gatgagctcatcaagaacgctgcctacattggcacccccggcaagggtatccttgctgccgacgagtccaccggcaccatcggcaagcgctttgccagcatcaatgttgagaatgttgaggacaaccgccgtgccctccgtgagctcctcttctgcacccctggagccctccagtacctcagtggtgtgatcctctttgaggagaccctgtaccagagcaccaagggtggcaagcccttcgttgacatcctcaaggagggcaacgtcctccctggcatcaaggtggacaagggtaccgtcgagctcgctggaaccaacggtgagaccaccacccagggctttgatgaccttggcaagcgctgtgccaagtactacgaggctggtgcccgcttt

SEQ ID NO: 1028 - DNA, 420 bp, Triticum aestivum
  Clone ID: LIB3280-028-P1-K1-F11
cctatgtcaaattcctggctccgtccctggtcgctggcggcacaaacgcgtcgccgggcaaggacgcggtgtgcttggtggacgcggaggcgtgccagggtgactcctccgacccccggcaaaaagcgaagatccggatgctgctgctcctgttgttgttggtagcctgaaagaacggcagaccgcggcgtcgtgctcgcctcggcctttcccgggcttggtcccgagctacaaggtccataggatgtcggtcgccaggttcagcccgcaccacccgaggaagaaatcggccatcgtcaggctctccttccggaggagatcgtacgagggcgatgaaatgaccgaaatgactggctcggcgaagtacctctacccgccgagagcgggcctgaggctgccgtattcgaccgacgagaaacc

SEQ ID NO: 1029 - DNA, 423 bp, Triticum aestivum
  Clone ID: LIB3280-028-P1-K1-F12
ggccggcaagctcgccttcgtcaagaacaactacctcaaggccgacgctccctccgccaccccggcaaagcgcggccgcggccgcccgcccaaggaccccaacgcgccgcccaagcccaaggcggcgcccaaggaccccaacacgcccaagcgcggccggggccgcccgcccaaggtcaaggaccccatggccgacgccgtcaaggaggccgtcgccaaggccaccaccggcatgccccggggccgcggccgcccgccgggtccctcctcggccaagaaggccaaggtcgccacggaggccgcctctccggtccccgggtccggctccgctcctgccaagcgtggccgtgggcgcccacgcaaggtggcggtgtgaggcctgcgtgctgatgccttccggtctgtgtatctcgctgtggttgc

SEQ ID NO: 1030 - DNA, 426 bp, Triticum aestivum
  Clone ID: LIB3280-028-P1-K1-F2
acgcactcgagtaccttctaggctctccgttgccggttgcgtgacgtgccgtcgcccgcgcctcccaccgcagcacgccggccgagcgcccatggcgtcacccgaggacaccttccacccgccattctccttcaaattcgtcgggatccggcctgatccggatggatccggatgccgacggcccattcccgacctccctgccttgcctggttcgtcggcctctccgatgtcgtcatcttcgtcacgggatccagcgctaccgatggctggcctcctcctcgcctggatgtgaccccccccacgtcggagcctccaacatgagcagcagcagcgaacgcctcgacaagggcgtcttcggtggtgtctttattttaattttattttaaagaagtttgccagatcagtggccagggaaaagccatggct

SEQ ID NO: 1031 - DNA, 422 bp, Triticum aestivum
  Clone ID: LIB3280-028-P1-K1-F3
caattttctgaatagtttttgcgctttttgttagcatttttgcgcttggccccgtcgggggccggcccaccttgcgctgtaacgagcgccgcgtcttttaatcggcgcctgcaggagctccccttttttatgccctaggtgcagctcttctcggttcctttccccggaacttctcaattcgggcgctcgattcgattcctggctcgcctcgggccgatctcacctgttgttcagacatgactgcttgcaagcagaccacattcatgggcgctgccgccagggacgaggccgatagcaagtcggcagcgaaaagagatggagcggaggagcggaagtcctctaccaagtgcaggaaggggaagaaagccaagggcaagtttgcggtgaaaagcaatggtgcggagaagcccaagacccatgac

SEQ ID NO: 1032 - DNA, 422 bp, Triticum aestivum
  Clone ID: LIB3280-028-P1-K1-F4
cggcgcgtgggagcaagcgtgccgcagtcagccccagagtgcccccgtagatcgaccgaagatgttcggcgtgggcggcatcgtgagcgacctcacggggggcctccgcggccctcacctcaaggggtccgtcgtcctcatgcgcaagaacgcgctcgacttcaacgacttcggcgccaccgtcatggacggcgtcaccgagctcctcggccgcggcgtcacctgccagctcatcagctccacccacgtcgaccacaacaacgggggccgcgggaaggtgggcgcggaggcgaacctggagcagtggctgctgccgacgaacctgcccttcatcaccacgggcgagaacaagttcgccgtcaccttcgactggtcggtggacaagctgggcgtgccgggcgccatcatcgtcaaaacaacca

SEQ ID NO: 1033 - DNA, 215 bp, Triticum aestivum
  Clone ID: LIB3280-028-P1-K1-F5
cggcgcttggaagcaagcgtgccacattcatccccagagtgcccctatagatcgagggaagatgttcggcgtgggcggcatcttgagctaccttactgggggcctcctcgttcctcaccttaagggttacgtctatccttatgcgcaagaactctcttgactttaacgactttagctccaccgtcatggacggcatcacctaacttctctgtcgt

SEQ ID NO: 1034 - DNA, 294 bp, Triticum aestivum
  Clone ID: LIB3280-028-P1-K1-F6
agtggggggtttatttttgagtttttgtttttttgactattatgtttgttaatggtcttcttccacctccttaaaaaacgaagatccggatgctgttctgctgttgatgttggtagctgtaaaaacagaagaccgcggggatgagcttgccaaggcctttcccggtcttggacccaagctacaaggtccataggatgtaggtcgtcaggttcaacccgcaccacccgaagaagaaatcgggcatggttaggctttccttccgaaggagaacgtacgagggcgatgaaatgaccg

SEQ ID NO: 1035 - DNA, 379 bp, Triticum aestivum
  Clone ID: LIB3280-028-P1-K1-F7
gaggaaatgagtatacctctgaaggaattgatcgagaagcactgcggaggtgtgagaggaggatgggacaacctgcttgcagttatccctggcggttcatctgttcctttgttgccaaagcacatatgtgatgacgtgttgatggactatgatgcactaaaggctgtacagtccggattaggcactgcagcagttatggtgatggacaaatccacagatgtagttgatgcgattgctagactgtcatacttctataagcatgagagctgtgggcagtgcacgccttgccgtgagggtacaggatggctctggatgatcatggagaggctcaaagtgggcaatgcaaagctagaagagatcgatatgcttcaggaggtga

SEQ ID NO: 1036 - DNA, 359 bp, Triticum aestivum
  Clone ID: LIB3280-028-P1-K1-F8
gataaccaagcaaagcatccacttgacgattaagattcagtttgacaagggatgaccacagaccacgatagggtttttttgttttcgcaaacataaccactgaccgaagatgttcaccgacaccacctcatagactcggggataattacaacccattacgacagacataaagaagagcgctgaaatacagacatgacgaatactacgcgtagttttttcagcgcgggggggggatcgcctagatgctcctctactcaaaggcccactggttctccctgcggatctcctcctcctcctcgggcgtaaagaagttcttgatgttgaaggagttgcggatctcctccggggtcttgcccttg

SEQ ID NO: 1037 - DNA, 291 bp, Triticum aestivum
  Clone ID: LIB3280-028-P1-K1-F9
gcgagctttcttcctttgggggttttttttgattaccaatctttttattcacttttattttttatattattttttcatgtttttaccacagaccaaaaaaagtgggggggttttattaagcggaaccactgaccgtccaagttaagcgccgccaaaaaatatacaaaagttttattgcaaaaaagttctacagacataaaaaaaagcgctggaacgcagacatgactaaaactaggcgtcctaatttgagcgcggaggaggaatcccctatatgctgggggactcaaaggc

SEQ ID NO: 1038 - DNA, 425 bp, Triticum aestivum
  Clone ID: LIB3280-028-P1-K1-G1
cccgcctcctctcgtctctaggaccagttcccctttgtcgacagtttacttgccttgtcgaaatacaaggaaatcagattctcgacacagaccgcactgcgcaatcgaccgggtctcctatcgaccgggtgcgaggtccgtcctgtgctcggatgttttcagactatctatcagagtccaaggaagattcggggataaagaacatcatggtgcttgaacgtgggttcaatggatgggagatttctggccaacccgtgtgccactgcaaagatgctccttgcaaaggcacatgctcttgatcttctggattaccatctggtccatttatactcagcttttgaacgatctgcaattcagcatcgctgctgagctggtcctttctcattgagatgatgatgcataacaatccattgaattccgcaatg

SEQ ID NO: 1039 - DNA, 379 bp, Triticum aestivum
  unsure (1)...(379): unsure at all n locations
  Clone ID: LIB3280-028-P1-K1-G10
aggagctcagcgcggcggccagccacgcgcgcgaccgcaagaaggagcacagcgacccgctggaggagttctgcgaggacaaccccgagaccgacgagtgccgcacctacgacagctagccgtgagtagctgctccagccgtcttctgccattgccggccgtcatcatgagcggtagcttctggcttagcttgcgtggcacattggcatgttgggcgtgtaagtttggtttgttgctttatttggcttggcttactataaagcgagcagagatttgtttgtgaaattacaagatactataatgtttattaggagttctgaatatcaaattatcaaggcaagctgcgaggtagagtgctaattaaggtgcaaantaaaaa

SEQ ID NO: 1040 - DNA, 356 bp, Triticum aestivum
  Clone ID: LIB3280-028-P1-K1-G11
gtgtcggatgagttgacgcggcaggacgagcggaggcgagggcgaggcgaggcagcgcggtaggcgggggtgcggccgaggtggggcggcaggcagatctggggaatctggcaggagcggcggtggggctgcgggcgcgggggcgggcggtgggctgggcggacggcgcggacgagggcggcgagggggaggactgcaggctcaggccctggcggcggaggctgctcgcgtccatggcgttctcgtggccctaggacctccgcctcgccggaggcgccggcctgattacgggcggcggcgttgtgcttttcacgctccccgttgagaagaatctgaaggatttttttggttggatc

SEQ ID NO: 1041 - DNA, 366 bp, Triticum aestivum
  Clone ID: LIB3280-028-P1-K1-G12
agtgctcagcaagtttcaccattggattcttctcatcatagcaaaatgagaatgtctgattaacaaaatgaaaaagattacaaaaatgctatacatcaacagccttgtctgcaatgcctgaattacacaccctgatcagtaacgaatcaacttgcttgctgctcgtcaagtgttgatcgatcggttacttcttgccgctaaggatgttggccctcatggtctccagctctgccatgttggcctcgacgccggcgaaggacggctccgggatcggctcctccaccatctgcgacagcctgacgaggctcctgcaggccaacacggcgcgcgcgtccatggtctccatggccctcaggtagaggcact

SEQ ID NO: 1042 - DNA, 305 bp, Triticum aestivum
  Clone ID: LIB3280-028-P1-K1-G2
tttgtgggacagcaacagcactagcgaatgagtttattagccacagcaggcacagtaacaagtaccaaaatggacaggcactgtagtgcgcattagacagtagtccacctctatgcaatgtacagacgatcccggcagtggaatagggcccatttttattactgcatatccaaactaaagagcgagcaaagtcccgtttgtctactaataaaacaaatcacgcagcccttttttatactttttttcgggatatttccaggtcaacaactttcaaaatttggtcaaggaagcccgccctaactttt

SEQ ID NO: 1043 - DNA, 361 bp, Triticum aestivum
  unsure (1)...(361): unsure at all n locations
  Clone ID: LIB3280-028-P1-K1-G6
aattaangcctcatcttttattatctcatttcaagtgtctaaattctctaacttattatttcctttctattatttaatttatttctttttttatcattacactttaaaactttttttattttcccttttttctatttagctctttctttttattcttgtttaatttatttttcttttgtttgatcttaattgttcatgtctttatattattaatttcttgttattttattattttttattccttcttttttataatttattttttagaattttttttttttcttattataacaaaaatcttttctcctattcttttattttgtttttagatttttatttttattattttttttactttatt

SEQ ID NO: 1044 - DNA, 422 bp, Triticum aestivum
  Clone ID: LIB3280-028-P1-K1-G7
cacccagctgacaaccttgtttcattcctcaacaatgccaagggagcaactgtgggcgacgctgtgaagaaacttggtctgtggggtctgtttactcgtggtctccctctgcgtatcgtgatgattggtaccctcactggagctcagtggggcatctatgatgctttcaaagtcatggttggactgccaactactggtggagttgctccgactcctgctgccgctggagagcagctcaagggctgaagctttgattctatactgcatataatatctgacaagactttttggcgccgaattggatgagatgacgaaatagctcatctttcatccttttaagagcaaaatttgatatttttttttcaggactgcctagccgcggccctggtaattagaagtccaagacagtttaggaacaattt

SEQ ID NO: 1045 - DNA, 404 bp, Triticum aestivum
  Clone ID: LIB3280-028-P1-K1-G8
cccacgcgtccggtcgcagagaagaagaccgaggcacctacgcaagggagctcagagcaagggacagccaaaggcaagcaacaagaagaaattagaattaccgatgagccgccaccaccgcagggtgggcagaagaggcagcgcagcgatgatgccccaggagaaaccgctgacctgcagggcaagcttgttgagattctagaccggagcagccggatggtggcggcacagctggaggcgcagaacatcaactgccaactggatagggagcagaggaaggaccaagtgagcagcttgctaggtgtgcttggcaaggtggctgatgccctctacagaattgctgacaagctgtagtttgcccgctgtaaacgtcttgagcaaagtaaataattactgcaaataag

SEQ ID NO: 1046 - DNA, 259 bp, Triticum aestivum
  Clone ID: LIB3280-028-P1-K1-G9
ccttctctttcgggcgtaccgcgctgcgagcagcaatggcgttggccgcggccgcgcgcagaagcctcgcatccggtggcctctccggtcccctcgcccgccgcctccatccgtcactccctcaactgcttccatccaactccaccggcgatcctcgaaaaccctcgacccttccacccccacccgcaccacgaccggttcacttcgggctcgcccctggggggacattccaaaccctaagcttccccccatgcggtct

SEQ ID NO: 1047 - DNA, 383 bp, Triticum aestivum
  Clone ID: LIB3280-028-P1-K1-H1
atagtaatggtgttggtcgtggggagagcaaccatccacattcacgagacacacacagcacagcattggcgtaaagggaacaccagcaagatgtttcagctcgcccgcgccagcctgactgtgatggcgatgctccttcttcttgccgctgctgcggcggcggcggggccggcggccggcggcgcggctgtggcggacccagcaggctgccaggacgacgttgtggcgctcaacgaggcctgctacaagtacgtgcagaagggcgcgccgacggtgccgccgttgcaggagtgctgcgacgccgtgaagagcgtggacgtgccctgcgtttggagttacctgggcagccccggcgtgaggggcaacatctgcatggagaaggt

SEQ ID NO: 1048 - DNA, 255 bp, Triticum aestivum
  Clone ID: LIB3280-028-P1-K1-H10
cgaaccggaaggccggggtacgacccacgcgtacgagaaccaaccggcgggggctgtaatcctaggcgcacctccctcccctggcggggcacccgagcggcgaggccgccaccgcatgctgtctccccaatgtacctcctacttctcgcgatagggtatggtaaagcggattcatgccgaagtcgaacggactgaaggtgccacaacgcgcgacgcgacagccccgcggggaagagccctacaaatttgtagggg

SEQ ID NO: 1049 - DNA, 358 bp, Triticum aestivum
  Clone ID: LIB3280-028-P1-K1-H11
ggctcgtcgggtgcgcgcgggacgtgcggaacgcagtaatgcggttgggctcgtcggccgcgtcgggtgcgcgcgggacatgcggggcgccgagggacgtcgggcgtgtgtcgccggcgaagaagaagctcggcgtatgtcgccggggtcgtgacggagcacggtgcgaccggcgtcagtgcgccaggtcgggttcgtggcggtgcaaccggtgtcgatgcgccgggtcaggtccgcgggctgggtcacggccgtgacgacgacaatgacaagagctgcaataactccaacgacggcgagatcatggtttaggcggagtatgttggagtaaaccacattaggtgcgcgcgtgggtgcg

SEQ ID NO: 1050 - DNA, 386 bp, Triticum aestivum
  unsure (1)...(386): unsure at all n locations
  Clone ID: LIB3280-028-P1-K1-H12
gaagagcaaacccggcgtgcgaagatgaagacgatcctggcgtcggagacgatggagatcccggaggaggtgacggtgaaggtgtcggcgaagatgatctcggtgacggggccgcgcgggacgctgacccgcaacttcaagcacctcaacctcgacttccagctgcaggagggcgggcggaagctcaaggtggacgcctggttcggcacccgcaagaccatggccgccatccgcaccgncatcttccatgtgcagaacctcatcaccggcgtcaccaagggcttccgctacaagatgcgcttcgtctacgcccacttncccatcaacgcctacatcaccgncgncaacaagggcattgagatcaggaacttccttggcgagaagaa

SEQ ID NO: 1051 - DNA, 378 bp, Triticum aestivum
  unsure (1)...(378): unsure at all n locations
  Clone ID: LIB3280-028-P1-K1-H2
ggggcgacacgcgcccgcccacgcgtccggtttgatagtttttggtcgccacggccgtccacggcaagcccaagcccaagccgaccggcgcccccgagccaccgtcgccctcaccaccgncgacggcggcagaagcgaaaaagggcttcatgcgccggatgttccccttcctcctagccggcaacgccttcgtcggcgcctacatgctcgtcaggacctactacaaggattccccggccaagaccgccgactctgccgctgccactgcaacggcgtcgaccccgtctgccaccggcgagtcccctgagccgacggtggcaacgcctgccaaggtgctgccgccgatccccgaggacgagcagcgccgggtctacaagt

SEQ ID NO: 1052 - DNA, 362 bp, Triticum aestivum
  Clone ID: LIB3280-028-P1-K1-H3
cccacgcgtccgttttgaagtcccagttaataaaaccgtcatcaataatcccccgccaccccgccgatctgcaccgcaccaccgtccgtccgaaatggagatgaagaagatcgccttcgccgccctcctcgcggccgcctcggccaccgccgtcatggcctccgaggctgcccctgccaccagcgacgcctccgaggtggcaatcgccccggccgccctcgtcgcctccctcgtcgcatatttcctctactgaagcagcggacagtaggggaggagttaattactagcattcattggccgcttgtgtgtatacatgcgaatgatgcggtgtaatttttattgttttcgtcttgatgagcacg

SEQ ID NO: 1053 - DNA, 427 bp, Triticum aestivum
  Clone ID: LIB3280-028-P1-K1-H4
gtttcgctcatgaacccccgggtggtgaaaaccgaggcggccgacgagcgcctcacgctgccggcgactggcgccggcggcggcggaccgcgcgccccggttcagttcatagagctcagcagcagcgactccgactctgacggcggcgtcagcggcagcgcaaagaggtcccacagcgcggcaggggacagcgccgcggggaagcgggctagggtttccgcggggcccgtggtcggcgtggacgtgccaccaggcttcctcgatccgctaccggcgcctccacagccgtcgaggggcacgacgaagcagttctggaaggccggggactacgacgggaatccggctgggggtgcggagccgccgccatctgcatctggattggaacatgtccgcgtacattctaaatttttgcactcaaatgcaacaa

SEQ ID NO: 1054 - DNA, 228 bp, Triticum aestivum
  Clone ID: LIB3280-028-P1-K1-H5
acagcacgtaatttaaagcacctctggcctctccccagcgcccgatcttctccccgcgcgcgcctaggttagtgtttggagccccctcctcctgtcgtcctcctgccgcaaccgcatctgctcgccatgagggtccacccggccccgtggaagcgcaccatcgccgtgcagcgctgcgccgcggccgccctaagcgcagcgggcggagccaataagctgcggcgcctt

SEQ ID NO: 1055 - DNA, 160 bp, Triticum aestivum
  Clone ID: LIB3280-028-P1-K1-H7
gggtttttaagaaaaacttggaagagcatacgtgccccatgaattccaactccaagcacatgtaaagagcatgtcgataatttggcttattgaacatttgaaaagagcccatgtaaaggccagtctcaccctttaaaccgggaaagggaaaaggaaaaag

SEQ ID NO: 1056 - DNA, 375 bp, Triticum aestivum
  Clone ID: LIB3280-028-P1-K1-H8
aggatctccacgccacgcctgtggagaaagccgcatggcgcataccctgtggcgacgaagcgcacacgggatttgtatctagcctcactttcatgtcagctctggtttgctccatgtccatagtcttagcagcttccctagctccttgatacacgtgctggaaacacaggacacggtgcattgatatggtcgggagaaaatgactttttttgtcgcacgacttgtgcacatcatttcacgcgtacttttacgcgtcatttgcaaaaaagaaaagaaggatgaagcgagcacttgtggtgagtggatccgctggacagggcctccatgaagcctctctgcacttcacctgatcacctctcttattttactactccc

SEQ ID NO: 1057 - DNA, 416 bp, Triticum aestivum
  Clone ID: LIB3280-028-P1-K1-H9
agatcccctcgccgtggtctctcttccttcccccacctccctcccccctccggtcaccggcgcggcgaggcggccaccgctgctgtctcccccctcttcctccctctccgcgcgatagggtctggtggagcggattcgtcccgaagtcgatcgaactgattcgttcgtaatggcgaacctgcagccttccgtccccgagccctcctccttcgcaggggcctcgccgccgtctccatcctcgatcggtggaggcgctgcctcggcggcgcaggagcccaggaagatggcgtcggcggagcagctggtgctcgacctctgcgaccgcgagctgcgcgagaacccccctccttgagctgtcgaagaaacgagagatatttcaagacctggccccgcttctttggcactcttttggcaca

SEQ ID NO: 1058 - DNA, 212 bp, Triticum aestivum
  Clone ID: LIB3280-029-P1-K1-A1
agactcgtgatggaatagaacaccagccccccccctctatctcaaacttgtgatgcgggggcatgtttgctttgttgcacaaactagccatctactaatctacgacagcataacattccttatggagcggtagtgtgatgcgtctgaatcatagccaaataccaattgtttaagcgatcatacttattagcaaaacactgacgtgcaaaatc

SEQ ID NO: 1059 - DNA, 87 bp, Triticum aestivum
  Clone ID: LIB3280-029-P1-K1-A10
aatttcttgtttagggtgggggggattattttttatcatgattcataacaaaaaaagttttattacttttaaattgagtacgtgtgt

SEQ ID NO: 1060 - DNA, 428 bp, Triticum aestivum
  Clone ID: LIB3280-029-P1-K1-A2
gacgagagaaccagcggcgaccccctcccctcctacttaccccaatcgaactgggcggcccccgttccggcgactccggccatgtcgatcttcgagtacaacggctccgcggtggtggcgatggtggggaagaactgcttcgccatcgccagcgaccgccgcctcggcgtgcagctgcagaccgtcggcaccgacttccagcgggtcttcaagatccacggcaagctctacatcggcctctccggcctcgcctgcgacgcccagacgctgtgagccgctccccagatccccccgccctctcggctctgctcgatttgtctttcttagggtttgtttggttggttgtttggttggttgctggcgtcggcgcgcaagtaccagcggctcgtgttcaagcacaagctgtaccaggttggggaggagcgaga

SEQ ID NO: 1061 - DNA, 180 bp, Triticum aestivum
  Clone ID: LIB3280-029-P1-K1-A3
gctcctgcgcgctgccgtaccgatttcccgtttccgcctccgcgtccggtgcacgtttgttctgaaagtttttacctattttggtttcctggtacaaaaaaaaaaaaaaaagggcggttctttttctatttcaaacttgactagttttagttccgccgcggccgctttcttttctttttt

SEQ ID NO: 1062 - DNA, 433 bp, Triticum aestivum
  Clone ID: LIB3280-029-P1-K1-A4
cccacgcgtccggatcgatcaatcgatatggctttctcccatgggggcacatggccggtgacccctgcagtagttctgctaatgggcggcctgttcgccgccttccctgcggcgtccggcggccacgtcgacgccggtgacatgctgatgatggacaggtttcgccagtggcaggccacccacaaccattcgtacctcagcgcggaggagaggctgcggcgcttccaggtgtaccgaaccaacgtggagtacatcgacgccaccaacaggcgcggcgacctcacctacgagctcggcgagaaccaattcgccgaccttaccggggaggagttcgtcgcaaggtacgcgtcgtcgcacgaagctggcggtggcactagctcggtcatcacgacggcggccgaggctgacggcatgtggtcgtcgggcggtggca

SEQ ID NO: 1063 - DNA, 262 bp, Triticum aestivum
  Clone ID: LIB3280-029-P1-K1-A5
gccacatacaataaccacattttttttgaaatgttcccctcaacaaaaaatgccgtttttaacagggtttaaaacagggaaatttccctgtttgaactggtgtttgatttaagcaaataatgcaaatttgcgggggcttctggggggttaactgtttgcaaacatgccacgttggggagcctttccccgtgcaggttggtcaacccaacggataaggaagccccccccggaagggagatgcccacccacattgatccccaat

SEQ ID NO: 1064 - DNA, 386 bp, Triticum aestivum
  Clone ID: LIB3280-029-P1-K1-A6
gttcacgatgccatcagagtcgaaaatagtttaataattgcaaaaacataccgtaaacctttaccctggagcatgctctcagacgttatgatactggggaagagcgttgcattgcctgtaaactctgtgaagctatatgcccagcccaggcaattactattgaggcagaagaacgtgaagatggcagtcgccgaaccacaagatacgatattgacatgaccaaatgcatctactgcgggttctgccaggaagcttgccctgtcgatgctattgtcgaaagccctaactttgagttctctactgaaactcacgaggagctgctgtacgacaaggagaaactgctcgagaacggcgaccgctgggagaccgagattgctgagaacttg

SEQ ID NO: 1065 - DNA, 424 bp, Triticum aestivum
  Clone ID: LIB3280-029-P1-K1-A7
gacgaggcaacccgccgccacgccgccggtggcaaaatcatcgatacaacggcggccggccgccggctttttcgccccatcagcggcgaagttttaccgcgtgactatgtaaatgcctgcatttcggcaaaatgttgacggcataaaaatctgaccgaagctttctgctgagggcgagcggcggaagaacaggcagtgtcctgcagagaatcatcctcatcgtcttcatccatgaggtccgacgtgaggaaggagtcggtgtcggagccgtcacccaaggaatcaaatgaggaagagaagccagaggagaaatcactgtcagaggcttctcctccttggtgatccatctcctgtctgttgtctgttgatgccacgaagtttgcaaagtgcatcgcccagctgctctcgccggccgacatggacg

SEQ ID NO: 1066 - DNA, 429 bp, Triticum aestivum
  unsure (1)...(429): unsure at all n locations
  Clone ID: LIB3280-029-P1-K1-A8
accgattgcatcacgcaaagtagcgtcccatccagatgccatggtgatctttgagccggacgagactaaatctctagtctatctgagagctgtcttgtacgagactctcaggttgtacccaccggcccctctcgagcgcaagatggtggccgccaatgatatcatgccgagtggtcatgaggtgcatgccggcgacaccatccttatttctctccactccatgggaagaatggagggtatatggggtaaagactgcctcaactacaatccaaataggtggctctcggaggatggcaacgagctaaggtacgtaccatctcacaagttcttggccttcagctcgggtccgaggatgtgcctcggcaaggacatcgcggntatgcagatgaagacagtcatcgcctcaacgttgtggaactttgatgttga

SEQ ID NO: 1067 - DNA, 366 bp, Triticum aestivum
  Clone ID: LIB3280-029-P1-K1-A9
tgggtccgcatgatttctttttatcatgatgcaaaacaaaaaaaactaatcagttccaaaatgattacggggcttatatcatgttatacacggtctattcaaaacctagcctcaggaactaggataatgggttaccaacacaacatctacacaaaagtgcagacgaagaccttcagtctaatcactaatgatataggaacgagaccgggtccgctcatatctcgctaaggtactctagaagagattcgacctcttgcctcagcgcagcgatcttctgctgctgggaagcaatccggttttctatgtcttgcccgcgctgcttcttctcgacgctgtcaaccacggtggcatgccttgccatgagct

SEQ ID NO: 1068 - DNA, 370 bp, Triticum aestivum
  Clone ID: LIB3280-029-P1-K1-B1
agatgccctcatggcacgtaattcttcccccacccggcccgtcaccaaccggcataaatacccacccctcctcgcctccgaagtccaaactcgccaccgcccccgggaacggaaccaacaaatccccaaccaatctcgtctccgatcgactccaggctcgtcgaatccccaccgcctcaagatgcagatctttgtgaaaacactgacgggcaagaccatcacccttgaggtggagtcgtctgacaccatcgacaatgtcaaggccaagatccaggacaaggagggcattcctccggaccagcagcgtctcatcttcgctggcaagcagctggaggatggccgtaccctcgctgactacaacatccagaag

SEQ ID NO: 1069 - DNA, 426 bp, Triticum aestivum
  Clone ID: LIB3280-029-P1-K1-B10
cagctgcaacacgagttgtccttgacatgacaacattaacaataatgcgcactctaccacgtgaggttgatcccgtggtctataacatgctacacgaagaccccggcaatgtcagttactcagctgtaggtggactgtcggatcaaataagggagctgcgggagtccatcgagttacctcttatgaatccagaattgtttcttcgtgttgggattaaaccaccaaagggcgttctgctctatggcccacctggaacgggaaagacattgcttgctagagccattgctagcaacatcgatgctaactttttaaagattgtttcaagtgctatcattgacaaatatattggtgaaagtgcacgtcttataagagaaatgtttaactatgcacgtgagcatcaaccatgtattattttcatggatgaga

SEQ ID NO: 1070 - DNA, 387 bp, Triticum aestivum
  Clone ID: LIB3280-029-P1-K1-B11
cccacgcgtccggccacgcgtccggatcaatcaaataattcaagtaccagatacgtggagatgtccataaccggggacactactaatcatgattagttagtacactttgaaaaggtttgcgcccttttccccacaagactcgatctatttcgttgtatttctcgtactgtatgatgtttgagaaacggatgaccgagacacagtctttccgaagaggaccacttaaccgatagataggtcggttcacctacaattccctacatttactagcccatcatgaaaaaggattatcacaatttacttatttatgccaaagcccataatggcttgtggctgcacactgaagtttctagcaagaacaattttatgatccctttgagcctgggt

SEQ ID NO: 1071 - DNA, 425 bp, Triticum aestivum
  Clone ID: LIB3280-029-P1-K1-B12
cccacgcgtccgcccacgcgtccggatcaatcaaataattcaagtaccagatactcaagatgtccataaccggggacacgactaatcatgattagtttgtacactttgtaaaggtttgcgcccttttccccacaagactcgatctcgtccgttgtatttctcgcactgcatgatgtttgagaaacggatgaccgagacacagtctttccgaagaggtccacttaaccgatagataggccggtacacctacaatcccctacatctcctagcccatcatgaaaaaggatttccacaatttactcaactatgccagagcccataatggcttgtggctgcacacggaagtttctagcatgaataatcttatgatccctttgagcctgggtggcattccaataggataatcacacagatacctcgggatc

SEQ ID NO: 1072 - DNA, 324 bp, Triticum aestivum
  Clone ID: LIB3280-029-P1-K1-B2
ggggcaaacttttctccactttcccacctgtatcgtcacctcacaaatgggcaactgacatgtatccatgaattaatatataggagcctaaagccatcaaaccttcagacacttttcacaaaaaacaaccgaacagaagtcaaaatattatagtatgccatccaagattttagtatgtctagttttggaccagccaaacatgctctataatctatatgaccacccatgtatacagaggtaaaaagaaccgtaaaacagtctttagttctttccatcacatgaagcattccctttttcactttctttctttttttggcttcaact

SEQ ID NO: 1073 - DNA, 360 bp, Triticum aestivum
  Clone ID: LIB3280-029-P1-K1-B3
ggagcttgagaaggagcaggagacccagcagccaggactcaccggcagacccccgctcgccaacggcaggtctggaatgttgccaatgtcgagccctccagcaaatccgggacagcttaccattttttatggtgggtcagtatgtgtgtatgactcagtgccaccagagaaggctcaagcaatcatgctcattgcagcagcagcagctgcggcctcaaaaagcaatggcaccgctgctgttaaccctcagcgatgtctgcgaccaaggtatccaagccattcctaccccggcggttttacttcaaagcacttttgtagcaaatggaccaccttaagctggcgcggattctggcttgattt

SEQ ID NO: 1074 - DNA, 433 bp, Triticum aestivum
  Clone ID: LIB3280-029-P1-K1-B4
cgcctcgcgcccgcacccgaggaaggtaagctcaagaggctgtcctgagaagctcaaatggctcccaaagttgctgttgccaagaagggcgatgccaaggcccaggctgccaaggttgccaaggctgtgaagtccgggtcaatcaagaagaccgcaaagaagatccgcacgtctgtgacatttcaccgccccaagaccctgtccaaggccagggaccccaagtaccccaggatcagcacccctggcaggaacaagttagaccagtaccagatactcaagtacccgcttaccactgagtctgcgatgaagaagattgaagacaacaacacccttgtcttcatcgtcgacctgaaggcagacaaaaaaaagatcaaggctgccgtgaaaaagatgtacgacatccaggccaagaaggttaacaccctgatcaggc

SEQ ID NO: 1075 - DNA, 326 bp, Triticum aestivum
  Clone ID: LIB3280-029-P1-K1-B5
cgcctcgcgcccgaacctgaggatggtatgctcaagaggctgtcctgagaagctgggaggggctcccaaagttgctgttgacaacaaggtctatgccaaggcccaggctgtcaaggttgccaaggttgtgatgttcgggtctatcaagaggaccgcatagaagatcctcacgtctgttacattttaccgccccaagaccctcgtcaaggccagggaccccaagtaccccaggatcatcacccttggcaggaactagttagaccagtacctgatacttaagaacccgcttacccactgagtctgggatgaaaaagattgaagacaac

SEQ ID NO: 1076 - DNA, 383 bp, Triticum aestivum
  unsure (1)...(383): unsure at all n locations
  Clone ID: LIB3280-029-P1-K1-B6
actgttaattaagcggtattttttgtagaaaaagaatccatcacaaaaatgcttctaggactagctgctagagtcatgtacctaccaaatgctggtatggcctattggtatggtgagatgggaggagagagatgagggggagaggttnagatggacatgtcgcttactccttccattccattccatgggggttggcttctctttctggttgggcggcgctatcttttctcatttcttttctttttcttcttctttcctttcttgatatgggaggagtagggagttcttcctttctgcgtgctcttccttcccatggtatctttcctggcacttgccgatcaccttttgatcatggatggattggatgggcggcattggtcacg

SEQ ID NO: 1077 - DNA, 431 bp, Triticum aestivum
  Clone ID: LIB3280-029-P1-K1-B7
gtttaaagaggacgtatcccacgaggccacgacgatggccgcatcgggaggctcttgcggcgggtgcgcgtggccggacctccagccggagatgttgggcgtcgtgctctcgcgggtgccgtcgcacgccgaccgcgtccgcctcgccgccgtctgccgcccatggcgttccaccgcgcggctgctgcgtcctcttcctcgtgcacggcgacggcaggctctcgcgggggagctgctacccccgctgctcccgtggctcgccctctgcgatggcaccttcctcagcctccccgacggcgccgtgcaccgcctgcccgtcgcggatgacgcctcgagccgagtctccaccggcagcgcgctcttcctcgtgcacggcgacggcaggtgctgcctgatgaacccttcccccgtgacgacgagccccgtccccg

SEQ ID NO: 1078 - DNA, 437 bp, Triticum aestivum
  Clone ID: LIB3280-029-P1-K1-B8
acgcgagcttgagaaggagcaggagacccagcagccaccactcaccggcagacccccggtcggcaacggcaggtctggaatgtcgccaatgtcgagccctccagcaaatccgggacagcttaccattttttatggtgggtcagtatgtgtgtatgactcagtgccaccagagaaggctcaagcaatcatgctcattgcagcagcagcagctgcggcctcaaaaagcaatggcaccgctgctgttaagcctccagcgatgtctgcgaccaatgctatccaagccatgcttacgcggccgctctcactccagagcacttctgtagcaaatggacaacctcaggctgtcgcggatcctggctcgatttgcaagcttcaggctgatcttcccatcgccaggagacactcccttcagcgcttccttgagaagcgccgtgaca

SEQ ID NO: 1079 - DNA, 428 bp, Triticum aestivum
  Clone ID: LIB3280-029-P1-K1-B9
gcttgtgttccagcctgctgaagagggctacgccggtgcttactacattttagaggagggtgtcctcaacgatatctctgccatctttggcttgcatgtcttcccacatcttcctgtaggcatcgtcgcatcgcggccaggtccatttcttgcagctgcagctcggttcaccgcaacgatcactggaaaaggcgggcacgccggtaaccctcacgatgccgttgaccctgtcattgctgcttcctccgccattctcagccttcagcaacttgtcgcccgcgaaacagatccactcgagtcagttgtggtgtctgttacacagctgagaggaggtgatgcttacaatgtaattcccgaatctgcgtcgttcggcgggacctttcggagcatgactgatgaaggcctgtcatatctaatgaaaagggtga

SEQ ID NO: 1080 - DNA, 385 bp, Triticum aestivum
  Clone ID: LIB3280-029-P1-K1-C1
aaggttgaaaaattggataatcccctagattttacacaggccagaacccacagggcaggcattttgaatcataacaatctcacataaaatttgtataggaaataattaaaatctaagaaaaaaatccgagttccgaaggagtgcaagctaatcaagaccaaaatttatcgaggctttgcgatggatctcatctaatctgcgaacctacaagtgcgccagcacgcacgccattcccagcgccacgccggcggcggaccaccagcccatcatcgcctgcagcgcgtggccctgcgacggcgccggcgcggacgccggggtctcctccatgggctcctcaatgggcatggtcacgggcgggcacgggagcgacgacggggacggcgac

SEQ ID NO: 1081 - DNA, 350 bp, Triticum aestivum
  Clone ID: LIB3280-029-P1-K1-C10
aatccgagcaaaattaaccaagttaaattaaaaacatccaggtcagatcagcattcaacacccctccaactcaactgtacaagtttccaaccctcagaacacacacccaaacctttatccttcttccattatacacctaatcttgtctgctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaggggatccaagtttacttccccgtgcttgggaggtattagttttttttttggggcccccaa

SEQ ID NO: 1082 - DNA, 339 bp, Triticum aestivum
  Clone ID: LIB3280-029-P1-K1-C12
caatgatcaattcattcataagctagtactaattttacatgctcggatgtgatcttactctggtacaaacatgttgttggagcaaaggcatggaattcctatattacagacaaaacccaatccgtttgatcatctgatcgaggaggcatctgcctgatcatctcatcaagatcgatcgatccaagaacaaaatactgacagcatcgacaagacttactactttaccggagcacgcacgcacgcacgcacgcataatgggggaattgctactatggggtggcatgggcatggcgtcacaagctgaggaagcctctgccctggcgcgccgacaccggcgcc

SEQ ID NO: 1083 - DNA, 290 bp, Triticum aestivum
  Clone ID: LIB3280-029-P1-K1-C2
gggaccaaacaaaaacaacccatgaaaattgctaatccagcaatactaaaaaggggctcaaaaaaaaaaaaaagtttgaaatttgttaataaacaaaaaagggacgttgtccaaatgccccccctaatgactgtagcccaataggaacttaaactcgccaccctttgaatagaaccattctaccacctcaatttcaatttccatttccatttttaaagccaaccagaaaggatccttccttgggcgttccaacaaagccaacaataacaggggcccgggctgttgtttta

SEQ ID NO: 1084 - DNA, 435 bp, Triticum aestivum
  unsure (1)...(435): unsure at all n locations
  Clone ID: LIB3280-029-P1-K1-C3
cacgccggttcctttgaaagagcccgtccacgtcgatcgccgaccaaccggaggagacgcgcctgaataagaagacgaccgtgcgtccccattgctcggcggatcaccggcgcgcatcgccatgtctttcaccggcacacaggacaagtgcaagacgtgcgacaagaccgtncatttcatcgacctcctcaccgccgacggcgtctcctatcacaagacatgcttcaagtgcagccactgcaaggggaccctctcgatgtgcaactactcttccatggatggtgtcctctactgcaagacccatttcgagcagctcttcaaggagacggggaacttctcaaagaattttacgccaggtggcaaatccgcagagaagggcgaggcaaaggctccaagcaagatgtcatctgccttctctggaactcaagataaatg

SEQ ID NO: 1085 - DNA, 421 bp, Triticum aestivum
  Clone ID: LIB3280-029-P1-K1-C5
cttgtggggacataatctttcgttgttgcatgaccgtgttctgaagtacccagagcgtgtcgaaaatctgtacttcacatacctatttgttcttcgggcagtgactaaggcggcagattaccttgagcaggcagagtacaacactggcaatcctgaagaggacttgaaaacacaatctttagtgaggcaattgctttacaaccacaagttaagatctgcatgtccattaccttttgatgaagcaaaactgtggcaaggtgaaaatggccctgagttaaagcaggagatccagaagcagtttagaaatatcagtgcaattatggactgtgttggttgtgagaagtgtcgattatggggaaagcttcaagttcttgggcttggaacagcgctgaagattctattttcttgtgatggagagaac

SEQ ID NO: 1086 - DNA, 390 bp, Triticum aestivum
  Clone ID: LIB3280-029-P1-K1-C7
gaaaaatgtatgcgcttacatgggctctgcagtatattaatcttttcatgatcaacactggctttatcatcttagctggccaagcactgaaggcaatatacgtcctctttagagatgacggacttctcaaacttccctactgcatagcattatctgggtttgtctgtgctctttttgcatttggaattccttacctatctgctctccgaatttggttgggattctccactgttttcagtctcatctatatcgtgatagcatttgtgctgtcgcttagagatggcataacagcacctgcaaaagattacagtattcctggatcagagtcaactagagtcttcactacgataggtgctgtagcaaatcttgtatttgcgtacaacactggaa

SEQ ID NO: 1087 - DNA, 375 bp, Triticum aestivum
  Clone ID: LIB3280-029-P1-K1-C8
ggagagggacaattgtactactacgcaatttacttgatcatcaccttttacccttattattacatgagcattggatgcctttgatggatggtatccaagccggccaaaaggcacaacacttgacgggaaaaaaatctacacagttcgcacgcaggcgcatgcgcacatttgtccacaaatcaatcccacaaatcgaagaaggaaaaaaaaatgaaaataaaacataacaacaaacgaataatcaaacccgatcgattgatgcaaatttaacacatgaagaacgtcagcggtaggaatttggagaaagcatcagtggtggttgacgaaacggcacattttcctgatctcgcccttgctgccgtgcggcatgggcag

SEQ ID NO: 1088 - DNA, 429 bp, Triticum aestivum
  Clone ID: LIB3280-029-P1-K1-D1
cacagtgcacagtccacctcaaccccctttcgatccgaatccaccgtctcctcgtcgccgacgacgccaccatggcggcgctcctagcccggcaggcagcgatggccctccgcgctaggcagacggcgcgtctcggcccgtccgcgacggcgatgcagggccacctccggacctacatggacgcgggggcgcccaagaggttcaaagaggacgaggagaaagaacagcttgcgaaagagctcgccaaagattggagtgctgtgtttgaaaggagtatcaatacattgtttttgactgaaatggtccgtggtttgatgctgacgctcaagtacttcttcgagaggaaagttacaattaactatccatttgagaagggccctttgagcccccgtttccgaggggagcatgctctcagacgttatgatactg

SEQ ID NO: 1089 - DNA, 213 bp, Triticum aestivum
  Clone ID: LIB3280-029-P1-K1-D10
cccacgcgtccgtccacgcgtccggagatggaggcggcgccgatggaacggggggggccggcgccggtggctgtgatggctgcgccgcccaggcggaggcgcaggtcgatgcgcgtggcggcgcctgccctcgtgccgtcgacgtcgatgctgagcgcgtcctatatggagctttaggacgttgtgttctttcttctgttgctcttgcgcgac

SEQ ID NO: 1090 - DNA, 405 bp, Triticum aestivum
  Clone ID: LIB3280-029-P1-K1-D11
agcccgagtgcgacaagctcatccagaactccgtcaacaagaactacgtcgacatggacgagtaccccgtcaccaccgagttccagaaccggtgcgtcaacatgatcgcgcatctcttcaacgcgcccatcggcgaggacgagacggccgtcggggtgggcaccgtcggctcctcggaggccatcatgctggccgggctggccttcaagaggaagtggcagaacaagatgaaggccgagggcaagccccacgacaaacccaacatcgtcaccggcgcaaatgtccaggtgtgttgggagaaattcgcgcgctacttcgaggttgagctcaaggaggtgaagctcagggaagggtactacgtcatggaccccgcgaaggccgtagagttggtcgacgagaacacca

SEQ ID NO: 1091 - DNA, 429 bp, Triticum aestivum
  Clone ID: LIB3280-029-P1-K1-D12
caatggcaacatcagcgaggtgagcagcggctaaaggctcccacctgaagaaatcgaggcgttggcggcggagtcgatggggagaaggccccgccttgatgcagttggagacgctgctggcgctcagcctcaaacagcaaagtcaccttgtaacgaaggtttcacaaaattcaaacatacatcatttccatgccaggttacatattttaggtgccagaggattgtcgaaagaaactcagatgtttgagaaattctactcacttcaagctctcatcacttgcatatctatgtgctacccacactgcattttgttttttgaaatggccgtctcctaccaggcaccgcccaggaacttctcaggcggcagatttcggcttgtcaacaagtgacgagcgtaaacagtgatgttcgtaaggatttggtctacga

SEQ ID NO: 1092 - DNA, 251 bp, Triticum aestivum
  Clone ID: LIB3280-029-P1-K1-D3
agacaatgatgtctccagtttgggatttctagtttttacttcctagtctttttccaataaggtgcatattggccatcaactggacaatgtattttattttctctactatgggttgctctcagtttctctatgatgttcatgtttgcacctatggaaaactaaatgccagtacttttcagtctatcagttcgcacatgacctgtaagtattcaatgaccgtaaaaataatatcggggatgcctactttcttc

SEQ ID NO: 1093 - DNA, 431 bp, Triticum aestivum
  Clone ID: LIB3280-029-P1-K1-D4
aagtccagatgcgttggtgaggcctgtcaatgttggaaggcttgtcaacaatggaatgccaagagatggcgaaaatgatgccttccttgaacctcaggattcacagagtgtgactagtaactctgaggctgaggatgctggtgggcaggggtggtggaagcccagttctccttatgggacgtctgttggcacacctggtgcagaattttacgacgcatttgaagaaatatcaagcgatggtgcaactcgatcttctcgatgtattgatgacgaataccgtgaaatgcggttaagcatgttgacagaaattgagggtaggaaacaagctgaggaggtagctgagacctggcaaaaggaatggaagaagcttagtcatcacctatcgctgatcgccttgtcacttccatctccaactgtagctgagaacgatg

SEQ ID NO: 1094 - DNA, 431 bp, Triticum aestivum
  Clone ID: LIB3280-029-P1-K1-D5
gatcggtatgcattggaccggttgaagctcgcatgtgctcagaagttgtgggaaggtgtgtcggctgatacggttgcggatgctttagcttgcgctgagatatacaattgccaagagttgaagagcaggtgcattgactttgttatggcaaaagataatttcaagaagactgtgttgactgaaagtttcattagcttgttgcataaattcccctctattcgtgctgagctgagagcgaaggttgggagttgagacataggttagtgggatgcatctccacttatgtttcaggcgtcaaggattgctttagtacggttttatgatattttgggcttagtttagggactactatatcatatgggaggttgatttcaaactgttccttttgcagcactggattagacgaaaaaaatcgttgccaagtgatactg

SEQ ID NO: 1095 - DNA, 341 bp, Triticum aestivum
  Clone ID: LIB3280-029-P1-K1-D6
cccacgcgtccgcccatgcgtccgcccacgcgttcggagaggtaaatcacacagagaaccatcagcaatggcgaagatttctagtagcaccgtcgttctcctggtgtttctcgtctcgtcgtggggggcattgccggcgttgtcccgtggagggatggaggatggaggaggcggtatcggtgctaatattgggcttcaaaagtctatcggcgctaatgttggtgttggtgcgaatggaggcgccggtgctggtgctggtgctggcattggcgcatatgtaggtgttggagcaaatataggtaccgatgctggtcttggtgcccgagctaatggaaacggtg

SEQ ID NO: 1096 - DNA, 333 bp, Triticum aestivum
  Clone ID: LIB3280-029-P1-K1-D7
aaggggagaaacatgttcgatcctcctcatgataacttcaaaatctggaactggattagttcaaggttcaaagggagctgctccaccactagactgacagacggtatatcaggtgctacatttgactaggataagaacactggattccagacatttcagacaattttcctgaccatattctcacttgagaggaatgaacctcgacgagggggtggcaccgataccaggcctcccgtgcttcaccggtttgtacgacagggagaactctgccaggtagtgcccaatcatctccggcttgatctccacctggttgaagcacttgccattggagat

SEQ ID NO: 1097 - DNA, 339 bp, Triticum aestivum
  Clone ID: LIB3280-029-P1-K1-D8
ggggaaattcttcattcaaattacgaatcagtccaaagtagttgacttttacaagcccactgaaacgcaaacacaaaggaccatgaacacctatagtcccctaagacaaccataacacaagaggatctccggagccctgtgtcatcatccctgaatcttgagagaagacccctgcagcaaaagaatttgcaaccagtcgcaaacaggtcatcatttttgaccacacaaaccgatcgaccgatcaccacacgtccacaccacagcagcagcatggctaccaccagtcatgccctcctaatcgccctggtggtcctcgccggccttgccgacctggaggcc

SEQ ID NO: 1098 - DNA, 429 bp, Triticum aestivum
  unsure (1)...(429): unsure at all n locations
  Clone ID: LIB3280-029-P1-K1-D9
cccacgcgtccgcccacgcgtccggagatggaggcggcgccgatggaaccgctggtgccggcgccggtggctgtgatggctgcgccgcccaggcggaggcgcaggtcgatgcgcgtggcggcgcctgcccccgcgccgccgccgncgatgctgagcgcgttcgagaaggagcaggaggacgtcgcgctctgcctnctgatgctctcgcgcgactccaccggcggcatgcggggctcgccggcgccgaagcaggcgcacctcccgaggaacggctacggctacaattccgacgaagactcagctctgttccagtacggcgacgccaagaccaagagcgtggccaagagcaagaagcgaaggaccagccattacgctctcaactccgcctcgccgaagcaacggggcgaggcggcgccgccaccggcgaag

SEQ ID NO: 1099 - DNA, 396 bp, Triticum aestivum
  Clone ID: LIB3280-029-P1-K1-E1
acgcttggtcatagtgttaaggctcctgttggtagatggcagaaagggaaggacttgatggggtgtacaagggataagcaatctgactcagaagacgctatgaaggaagaaattaggagagtgaaagaggaggaggaacaggccatgcgtgaggcacttggcttagctcccgagcgtagcagtcgaccaaagggcaatcgtttagataagcatgaatacgctgagctaataaagaggggatctaccgcagaggatttgggagctggccatgctgaagcagcacaagtgcaaggattaggtttatacaaggctcctcacaacgaggaagaaccaagctctcttagtcctgaccctgctagaacggagcctgagcaggttgactttgcacctgcaacg

SEQ ID NO: 1100 - DNA, 427 bp, Triticum aestivum
  Clone ID: LIB3280-029-P1-K1-E10
catcccccaagtcataaacccaagtcggactcgccttcctcctcccccaactactcctcctcgcctccgcgcatcgcaccgcaccgggggtcacctgagatcacatacacaatggtgaaggctgtggctgtgcttaccggcagtgagggtgtcaagggcaccatcttcttcacccaggagggagatggcccgaccaccgtgacgggaagtgtcactggactcaaggaagggctccacggcttccatgtgcacgctcttggtgacaccaccaatggctgcatgtcaactggaccacacttcaaccccgctggtcatgtgcatggggcacccgaagatgaaatccgccatgctggtgatcttggaaatgtgacagctggagcggatggtgttgctaacatcaatgttactgactgccatatccccctta

SEQ ID NO: 1101 - DNA, 408 bp, Triticum aestivum
  Clone ID: LIB3280-029-P1-K1-E11
cttcccccgcctgccggccatgccaccaagggcctcgccgtcggccacctcatgcgggagctggtgctagagggcgtggcgacgttcctggtggtgttctggtcgtgcgtggcggcgctgatgcaggagatgcaccacagcctgaccttccccacggtctgcctcgtcgtcgccctcaccgtcgccttcgtgctcggctggatgggccccgcgcacctcaaccccgccgtcaccttcaccttcgccgccttccgctacttcccatggcgcaagctgccgctctacgtcgccacgcagatcgccgcctccgtgctcgcctgcctctccgtcaacgccatcatgagcccgcacgacgacaacttctacggaaccgtgccgaggccgccaggggccggcgcccggttgccg

SEQ ID NO: 1102 - DNA, 420 bp, Triticum aestivum
  unsure (1)...(420): unsure at all n locations
  Clone ID: LIB3280-029-P1-K1-E12
tctagtacatacgtaagtgtagctagcctcctcctgtaccgcacaccatggcggtcctgaagaagaacacgagctccctgagcttcgtcgtggccgccctcatggtggtcatggctgccacccttctcctctcctcgtgcgacgcccgcaaagtgaaggataagcccatcgctttccccgtgccggggaagtgctacgcgaggtttttcccgaactgcaccgagccgcggtgcaaaaagttctgcgtccagccgctccccggagcagtctgcctcgacaaaaaacctgctgctgccctgttgcttaactataagtgccgctgaagcgatcgagccaagaaacggtgaaagatgacaataagcaatcttggtacacctncaaatacatagtccttatttggtaacgtngtccctatttatg

SEQ ID NO: 1103 - DNA, 430 bp, Triticum aestivum
  Clone ID: LIB3280-029-P1-K1-E2
ccgagacacagtcgagaccttcaacccttttggtgcaaaaggagaggagggtacagggtgggcgttctcaccgctaaccgtggacaagatgttgtgggcattgcgaaccgcgatgtcgacattcagggagcacaagccgtcctgggaggggctcatgaagcgaggcatgacgaaagaccatacgtgggaccatgccgccgagcagtacgagcagatcttcgaatgggccttcgtggaccaaccctacgtcatgtagacggggactggggaggtcgaagcgcgggtctccttgagctctgaagacatgttcctcatccttccgcggcccggaaggatacccctgtacattgcgttgtcctgctacagtagagtcgcaatgcgcctgcttgcttggtccgccggttcgagagtagatgacggctgtgctgct

SEQ ID NO: 1104 - DNA, 179 bp, Triticum aestivum
  Clone ID: LIB3280-029-P1-K1-E3
agacaataatgtttccagtttggaatttttagttttaacttcctagtcttttcccagggggtgctttttggccatcaactgaccaatgaatttaattttttctactatgggtggctctaagttcttctataatgttaatgttggaacctatggaaaactaaatgccagtacttttcagt

SEQ ID NO: 1105 - DNA, 403 bp, Triticum aestivum
  unsure (1)...(403): unsure at all n locations
  Clone ID: LIB3280-029-P1-K1-E4
agaaaatatatcaattcaatggtgctaactccaatattcaagaaagagccaaagcactggaagtgatccaacatttaaaggacaagtaccatgaaggagtttgtgatgttgcaattgttgatgatggaaaattgcaagcagaatcagattccggtgaattctgggtggtttttggtggttttgcaccaatagggaagaaagctataagtgatgatgatgttattcttgaagctacaccaacaaagctttacagtgtcaataatggtaaactgacgttagaagataccgttttgacaaaatcaattcttgagaacactaaatgctttttacttgactgcgggtccgagttatatgtatgggttggtcgagtaacacangtggatgataggaaagctgcaagtgt

SEQ ID NO: 1106 - DNA, 422 bp, Triticum aestivum
  Clone ID: LIB3280-029-P1-K1-E5
cggacgcgtgggcgccgcggcggtgggaggtctggttatgctggtagaggaggctctgggcagggcggtgggtaccaaaatgacaggggtggccagggttcccgtgggggctatggtggtggttctcggttccaggatggaagggctcgcaaccagtctggttcctcgtctagaggggatggcaatggacgcatggtgaacctaaacaggcctggtagaaattagaagtctgatagatttgagataaattccgagcaaggttgccttgaagcattgtttccgcaccgttcagaacttgagttgtcgtttgctctatttttgtagcttctgttgtctgtcataaatctaccaagaagtcttgagtaatagttgtctggtttgtatcatgggagtgaggactacatattcactcctttataaca

SEQ ID NO: 1107 - DNA, 305 bp, Triticum aestivum
  Clone ID: LIB3280-029-P1-K1-E6
aagaccagatgcctccgtgaggcctgtcgatcttggtaggcttgtaaacaatgctatgggtagagatggcgaaactgaagcctcacttgaacctaaggattcacagagtgcgactagggactttatggatgacaatactgaagggctcgcgtgcaggaagcccactcctctttatgggacgactgtgggcacacctggagccgaattttaccacgcacttaaagaaatatcgagcgatggggcaactctatcttccaatagtatcgatgaccaatgctgcgaaacgcctcataacatgttgacag

SEQ ID NO: 1108 - DNA, 427 bp, Triticum aestivum
  Clone ID: LIB3280-029-P1-K1-E7
cccacgcgtccggttcgccatgtgcggtggcagacggcgccgtcgcggcggctctgacgcgacggcaggagagcccggcgggtggggtttctgcgcgccagcgctcgccttcctggccctggcggccgctgcggcggtcgcgttcctggagggcaccgccggcggcgtcgcctacgccggcgacgggtggttccacgagtgcgccaagtgggacgccgagggcgggaggttcctggtgtccaccttcttcggcgccggcgtggccgaggtgcgcgtcggggcggggggagaagaagccctggcggagcgggtcgtggtggcggaccccgaggtgaccgggagggtggcgctggggctcgccgtggacgcgcccaggcagcggatcctcgtggcctacgccgaccggcctccgagcttcgggtacgcc

SEQ ID NO: 1109 - DNA, 430 bp, Triticum aestivum
  Clone ID: LIB3280-029-P1-K1-E8
cccacgcgtccgcggacgcgtgggtttttcaagcacaaaaacagagtatattttcagggactttggataggcacaagcaacacaaaaggaaaaaaataaatcaagttgaacccagagaagtacttactatgctatgaaacaacaaatacaagcaaatgggactttttttgtatatatatatataccaaaagaaacttttgatatttacattctaaggactacctggactagaacagattggaagagagaagattagttacagaagttttggtggtggaggtccagagagatcatgatgatgatggggatgcttgagcttgtggagccagtgggctagccatttcttgggatcatgactctcctggcagtttgagcttggcatattgtcaagtgttccatctctttcaagaaccatcttgaacttgtccag

SEQ ID NO: 1110 - DNA, 432 bp, Triticum aestivum
  Clone ID: LIB3280-029-P1-K1-F1
cccatctattaccgtcttctcggaccgtgcttccctgccgccctcgctgctgctgcgagctccggtcggcaatcttttcccggttcaagatgaccatcatcatcgagcagcctcagttcgatgcggcggcggagaggaaggtcgccggcgacccggcggagctcgtgctcgacggcggcttcaccgtaccggactccaacgccttcggccacaccttcagggactacgacgcggagtcggagcggaagaagactgtggaggagttctaccgcgtgaaccacatcaaccagacgtacgagtttgtgcagcggatgcgggacgcatacgggcggctggacaagacggagatgagcatctgggagtgcatcgagcttctcaacgagttcatcgacgacagcgaccctgacctggacatgccgcagatcgagcacc

SEQ ID NO: 1111 - DNA, 228 bp, Triticum aestivum
  Clone ID: LIB3280-029-P1-K1-F10
cggacgcgtgggcgacaagccgtccaactatggcgccaagctggagcaaagtgcttagaactaccttttgttgagctaccggcaggaatcgactaatgtaacttttcattttttggaccctttgatcttcggatctacgccatgtgtttgcttttcccattgcttcctgcttaatatatgaatgccggcagcgctggatctttcaaaaaaaaaacactctccttatgt

SEQ ID NO: 1112 - DNA, 422 bp, Triticum aestivum
  unsure (1)...(422): unsure at all n locations
  Clone ID: LIB3280-029-P1-K1-F11
cggacgcgtgggttcgataaactccaacaagcacttgaagactatgattgtgttctgtatgaaatggtgataagtcgggataatttaaataaccagcaggacccaacgtttgcgaagaagatgagatcttcgcgcaaaggtttcagtattcttggtttcatacagaaacaaatggctcgtatcctttcattggattaccagctagattgccttgattatggcgatgagaaatggcaacatgctgaccttgactatgagacattcaagctgcttcagactgaaagaggtgaaagctttctcacatttgcagtggacatgaccctgaaatcaactaaagccttggtacaaccaacttctccagatggtcttgatttctggagatnccaagtgctatgggcctcgcgtgttctaccaatgccact

SEQ ID NO: 1113 - DNA, 359 bp, Triticum aestivum
  unsure (1)...(359): unsure at all n locations
  Clone ID: LIB3280-029-P1-K1-F12
gacattgtttctattgtaacaaacatctagatataaatatgcatcagtgatcgaactcagtaatatgttatcgatccagcacgatttatacatctggatatatatcttcatgacgcatgtatatttttgaagttaacccttataccatattgcactaatatgacggggatcatgcaaggtaattgtcgccgtagttggaggtgtccatccgcgtaaggcggcggnctgggtgggtggggggcgccggcggcgtgggggcggccgcaggtcctggatagggtggcgtcggcttgggtttgggagcaggcggcggcttgggttttggggcaggcggcggcttgggtttgggagcaggaggc

SEQ ID NO: 1114 - DNA, 432 bp, Triticum aestivum
  unsure (1)...(432): unsure at all n locations
  Clone ID: LIB3280-029-P1-K1-F2
gaggctttacacggctctgacgtcgatccagatgggcctggcggaggacaagaagggatggacggtcgcggttgattgagtaggataacagcgtgggcgcatgcggcgccggaagcattcatcagcatttcttatcatgtcttgccaatgtgaataataatagtgatggtgatgatatctcggggatgtcacggcccgaagggtgatggtttctctgatgctactgatttcttgggaaatatggaaagagagaaatgcacgtgtgttccgtaacaacgcagttcccgtgggtgttcttgttgctcgaactaaaaaggaagcttctctgtggggtgacatttttatgtaatattatgctgagagtgaggcttgtaattcggcccctggcctagaccctaaaaagattctttntattcaacgaaaatggtaagc

SEQ ID NO: 1115 - DNA, 432 bp, Triticum aestivum
  Clone ID: LIB3280-029-P1-K1-F3
caagagtgaaaggttggatcagtgcagccgccttcatgactcctaaatctcgaatgtcaattttgagctcgatgcaagtcacattgctcaggaactcgcagggactgcaaccgtaattgaaagagagaaggtatctgttcaggagttgatgactgttgtcaatgaaatgatgtggaacacagaatttgctattcgctcatatatgatgttgagaccaaggttcctcaaatcagccacaggttcttcaaatccttctggacctgctggagctctgcccaatcagcctggaccaaccaatgatttctatagtggcgtcccaaagaggccttccctttttatgctgcaaactgtcaacaagtttgagaagtatcttgacgaatgctgcaagtggattactgaactagagcagctggttcaaatcgagagcaataa

SEQ ID NO: 1116 - DNA, 147 bp, Triticum aestivum
  Clone ID: LIB3280-029-P1-K1-F4
gggtgccaacctgaataaagaagcttgattgaaaattacgggttacaccatggatagacaacaaggcacttgttatgctacatcggacattcgttcatggcaaaattgactggaggtggcatcctctgacgttatggtatctagaca

SEQ ID NO: 1117 - DNA, 130 bp, Triticum aestivum
  Clone ID: LIB3280-029-P1-K1-F5
aggcccagatgccttgctcaggcctgtcaaagttcgaacgctcgacaactatggaatggcgggacatctcgaaaatgatcccttccttgaacattatgattcacacagtgcgactagtaacactgacgct

SEQ ID NO: 1118 - DNA, 261 bp, Triticum aestivum
  Clone ID: LIB3280-029-P1-K1-F6
cggacgcgtgggcggacgcgtgggcggacgcgtgggcggacgcgtgagcggacgcgtgggcgggtccgagagtagctagcctagtctagggtttccgtagtacggagaggagagaaagggagagatccatggcgtagaccgagtaccgctgcttcgtgggcggtctcttctggggcaacgacgaccacaaccttcagcaggtcatcagccagtacggcgagatccttgacgccaagatcatcaacgaccgctagacgggca

SEQ ID NO: 1119 - DNA, 417 bp, Triticum aestivum
  Clone ID: LIB3280-029-P1-K1-F7
cggacgcgtgggggaggactgccaaacccacacccatacaaggggcaggcaaggccgcaaggggcaccctcctcaagcctcaagcaaccaacgcagcgccaaggaagaacccctcccttcttccaccgatccttccctcctttcctcgtcctcaccggcgacgacccgcagccatggcaatggcttacaagatggcgacggaggggatgaacatcaaggaggagtgcaagcggtggttcacggagatgaagtggaagaaggtgcaccgcttcgtggtctacaagatcgacgagcggacgcgcgccgtgctggtggacaaggtgggcggccccggggaggggtacgaggagctcgtcgccgcgctgcccggcgacgactgccgctacgccgtcttcgacttcgacttcgtcttcgtcg

SEQ ID NO: 1120 - DNA, 314 bp, Triticum aestivum
  Clone ID: LIB3280-029-P1-K1-F8
gtccccctctctcgctcgcatcacaacaaacgcgctctcgcccagcttccggaactctccccccgtccccgtcgccaccggcatggcctccgccgtctccctcgccgcctcctcctcgcccctcgccgccttcgccgccacctcgccctcgcgcgcgggggcgccgcggccccaccacgcgctcccgcccgcccgcggcccgcggtcccaggcccaggcactccgcgcggtctcaggccccgccgggagccgccggtggggcaccggccgcggcgcgacggtcgtctgcgccgtccagggccaggacaccacca

SEQ ID NO: 1121 - DNA, 383 bp, Triticum aestivum
  Clone ID: LIB3280-029-P1-K1-F9
gattcttgacgaggctggttgatgcaagggataacctgggacgtatttgaattggtgagattcgattcattgaagcaaggtgggattattcgattcgatgtacaatcaatctacgacggactcaattttgagcatggatacaggacaacgaaaatcgaacatcaaacgcagcgaaacagatagtaccaccttgaatagtaaaaatatatcaagaaatcaacatatggagaactatgaaatcttctttactttattatgaggtaaagattcgagcctatagttacacaatttaaccttatttgcattttcccatggggatattaaaccttggcatgttgattagcttttattcagtcactccctctatttcactattactggca

SEQ ID NO: 1122 - DNA, 434 bp, Triticum aestivum
  Clone ID: LIB3280-029-P1-K1-G1
gcaaagaccccgagcggaaaaggagcgagggcctctctctccatcccgacctctcgtggccgccgcgaagaaaaggagcttatcatggcttcaaaacgtatcctgaaggaactgaaggacttgcagaaagatcctccgacatcatgcagtgcacgtccttctggtgaggatatgttccattggcaggcaaccattatgggtcctcctgatagtccctatgctggaggtgttttcttagtgaatatccatttccccccggactaccccttcaagccgccgaaggtatcgttcaagacaaaggtcttccatccgaacatcaatagcaatggaagcatatgccttgacattctgaaggagcaatggagtcctgctttgacaatctctaaggttctgctttcaatctgctcgctgcttaccgaccctaacccggacga

SEQ ID NO: 1123 - DNA, 434 bp, Triticum aestivum
  Clone ID: LIB3280-029-P1-K1-G11
cccagagctacccatcatcttcttccctccacaaacatctgctccatccagcagctagcttgcaatggcgcctcagaggcagcagcagcagcagcacaaggccgccgtgatcgccctcttcctgctgtccgccctcgtggctgcgcccgccgttgctgcttccaggcccgaatccggcggttacgcacccgccacgccatccgaggccgcgacgccggccgagcccgccagcagcacgcccgccgacgcggcgtcaccctccaagaaggcggcaggctacactgactctacgccagccgagccctccgccagcacgcctgccgatgcggcgacgcccgccaagaaggcgggaggctacactgactctacaccggccgagtcctcagccagcacgcccgcccaggcggcgacaccgaccgatgccgctgccagca

SEQ ID NO: 1124 - DNA, 426 bp, Triticum aestivum
  Clone ID: LIB3280-029-P1-K1-G12
gaaagagaagaaaaggccggcagtgtgaggctccggccaccaaatttcttgcgcgtccattgttgtatatgtgagctgtgagaggcagccaccgaggtagaagaagaagaagcggcgctgcgggaggcggcgccaacatttggtatcaaagccttgtcgatccgaggcgacggtggcggcgcggcagactccatgtgagggggacgttggcggcgcaaggtgaacgccgttggcggcgcgatgctgctagcggccggtgcgtgtctccatcatcgtcgagttgcgtcacgagcgatggagaggggtgtgctgcccggtaagttgcggcatcggcggcaaggtggtgatggccatgcgtggaggccattgccataaggagttccatgtccgagtcttcgataaggtgcgtcatcgtcgacaacatgg

SEQ ID NO: 1125 - DNA, 402 bp, Triticum aestivum
  unsure (1)...(402): unsure at all n locations
  Clone ID: LIB3280-029-P1-K1-G2
aaacagaggtaacagggagcctgaacatcaccacatcaagaaggaagctgatgatgatgaatacaaccatcttggcatggattgctgctgctgccatgcccatgtncagcaacatgttgttgtgccagtgctgcaatcttctactccaaacacgatcgcaggcaatgtggtcatgaacttttgggatacttaatgttccctgtatttttctagcaatgtcttaggtaggacgtagatgcaagggctcatataaatatcaatgaattgatattagttaccatgataatttggttatatatatgaccatatccgaatcattttaggcttataatggcatttgttttaatgatttatttatagagtattacaatggtgacaatggagggattcttctctttttgt

SEQ ID NO: 1126 - DNA, 423 bp, Triticum aestivum
  Clone ID: LIB3280-029-P1-K1-G3
aaacagaggtaacagggagcctgaacatcagcacatcaagaaggaagctgatgatggggaatacgaccatcttggcatggattgctgctgctgccatgcccatgtccagcaacatgttgttgtgccagtgctgcaatcttctactccaaacacgatcgcaggcaatgtggtcatgaacttttgggatacttaatgttccctgtatttttctagcaatgtcttaggtaggacgtagatgcaagggctcatataaatatcaatgaattgatattagttaccatgataatttggttatatatatgaccatatccgaatcattttaggcttataatggcatttgttttaatgatttatttatagagtattacaatggtgacaatggagggattcttttctttttgtaaaaaaatataaaaagggcgg

SEQ ID NO: 1127 - DNA, 332 bp, Triticum aestivum
  unsure (1)...(332): unsure at all n locations
  Clone ID: LIB3280-029-P1-K1-G4
cttcccccaaattccccacgccgcgccgcgccgccgatcgagcgcagaatcccgagcgccgcccgcgatgccgaagaagatgggcgtcaactccaaggcggaggccgcccgcgagcgccgctccgccgaggagtcggaccgccgccagcgcgccgagcgcgccaaggaggaggagtactggcgcgaggccgaggggtccaagtcccgcgccgcgcgccgncgcgaggaggaggccgagaagcgcgccgaggccgccgcccgcaaggccgagaaccgccgcctcgccgaggccgaggccgccgccgtcgccttcgccgtgtccaagacggacg

SEQ ID NO: 1128 - DNA, 437 bp, Triticum aestivum
  Clone ID: LIB3280-029-P1-K1-G5
aaaatgttcttatcgagttctatgcaccctggtgcggacactgcaagaagctagcacccatcctcgacgaggcagctgccacccttcaaagtgaagaggacgttgtgatcgcgaagatggacgcgaccgcgaatgacgtgcccagtgagttcgatgtccagggttaccccaccctgtacttcgtcactcccagcgggaagaaggtctcgtacgagggcggcaggacggccgacgagatcgtagactacatcaagaagaacaaggagactgctgggcaggcggctgcggcggacaccgagaaggcggcggaaccggctgccaccgagcctctgaaggacgagctctgagcatcggtctgtctagcagcagacaggtagaggagggggaaacatgttttggcaaggcagcttccaacgccagattttgcgaggggggga

SEQ ID NO: 1129 - DNA, 436 bp, Triticum aestivum
  Clone ID: LIB3280-029-P1-K1-G6
gagctcgacgccgacgcgccccggccgtccaagctccgtgcagtggcctcccagtccgacccgtccaagccggcggccttcgggtcgcccacctacgacggcgtcatcgccgggcgcgtctcggggcggacatggaaggagccacgcacgcgccgctcctccgcgctgatggtgtcccggaagcccgtccctctggagcagcgcgtgagggacaagtccctgaagaaggcgtatcaggcgcgcgtggcggagctcaaggacgagatccggcagaacaaggtcgccaagcgcaagcagaaggaagagcgggagaagcgcaagaaggagaacgtgctgcgcaccggctcgaagctgcagaaggtcaccaaccccaagacgatccagaagatcgccaagtccaagaaccgaggtcagctcagggtcgtctccgacgaca

SEQ ID NO: 1130 - DNA, 429 bp, Triticum aestivum
  Clone ID: LIB3280-029-P1-K1-G7
atcccaacgttgggaagtcctcagttatcaacacattacgctccaagactgtttgcaaggtagctcccattcctggggagactaaggtgtggcaatacatcaccatgactaaaagaatcttcttaattgattgccctggggttgtgtaccaaaacaatgatacagagactgatgtagttcttaagggtgtggtacgggtgacaaatttggatgatgcttctgagcacattggggaagttctaaggcgtgtaaagaaggagcatctacaaagagcttacaaaatacaagactgggctgatgataatgattttctcgtccagctgagcaagatgagtggaaagctactcaagggtggggaacctgatctgacaacagcagccaagatggtacttcatgactggcagaggggcaagataccctttttttgtg

SEQ ID NO: 1131 - DNA, 428 bp, Triticum aestivum
  unsure (1)...(428): unsure at all n locations
  Clone ID: LIB3280-029-P1-K1-G8
cgcccgcagccaccgccgccgaagcgtcgtcagtgcaggaggaggcagcaccggccgaggcacctgtggaggcacccgcggccgccgaggcggtgccggcagaggcaccagctgctgccgccgccgccgacaaggccactgagtgagttgatgcgcgcgggtgcgatcgtgccccgtgagctagcctttgcctggctggctggcttccgtgcgcgtgccgtgacatgccatggcacgctacctagttcgtttattattggatccgtatgtgtgggcgtatttcgtgagtggtcgtcgtcgttgtcgtctgggtgcattgtacgtgatgtagtagctgcgtattaagtaggactgctgcgtataatgtctatcaatattgtgtcgtatgctagtcgtatgtgtgtcgntctcggcgtgatctcaataag

SEQ ID NO: 1132 - DNA, 415 bp, Triticum aestivum
  Clone ID: LIB3280-029-P1-K1-G9
cccacgcgtccggcgagtcataagctttcgttgactacgtccctgccctgggggggagaagaactgcaaggccaatatgggcctgtggacctacaatatctacatctccaaggtgttgaagcaggtgcacccggaccattgaatgtgctgcaaggccatgatcataatgaactccttcatcaacgacatcttcgagaagctcgcctgcgaggccgtcaagcttgtcctctacaacaagtagcctaaccattactctcatggaggtccagactctcgtccgatttgttcttcccggggagctcgtcaagcacgctctctctgagggctccaaggccgtttccaagtttacctgctcgtatattctattctttgtagaatttttattggtctgctatttttagtggttgttgtcttc

SEQ ID NO: 1133 - DNA, 428 bp, Triticum aestivum
  Clone ID: LIB3280-029-P1-K1-H1
cccacgcgtccggaggccaccgagtccgaccgccttccccgcctcctcgccgccggcatcaaggcccgcaagcccgacctgaagaagagcaccaaactgaccatttgtgaaggagaagacggcactgagtcatctcttggagacgtgttgatctttcctgatatgatccgatacagagggctgacccactttgatgttgacaactttgttgaagaagtactcgtgaaagatactgaatggcttcctggatctcctgaggctatcagaggttcctatgtttttgtctgctgccatggaagcagggataaaaggtgtggtgtttgcggtcctgctttgattacaaggttcaaggaagagattgaagcacaaggtcttgatggtcacgtggctgttagtgcatgctcacatgtgggaggtcataagtatgc

SEQ ID NO: 1134 - DNA, 213 bp, Triticum aestivum
  Clone ID: LIB3280-029-P1-K1-H10
aatataattgcaatctttccctaaaaaaatgctgggtgatgaactcaccactcacaggatccggaccgagtgtttagtacatacagtatgcctcacgaaccgaatcccgcaagcaatgaacatccatcttattctaaggataagccaccagtggaccatttggtactattctggcagcgccctctttttaccggatgggattttaacacaatc

SEQ ID NO: 1135 - DNA, 431 bp, Triticum aestivum
  Clone ID: LIB3280-029-P1-K1-H11
gaaatctcctccttaccgtgctgcagttgatagtctctcgagacagttccttccggggccgatcccggatcctctgcgccggcaacgctcgttgaagaagtgatgggggaggcgctcggggtgttcttgtacatagtacatgtaggttcaggttccgttctggtgtgttgggcgcgatgcctaggactggcgatatgccgatgaggagcgcgccgcctgcgcgtacgatcagcgcatggtggctagcgacaatgctttggttgatggcggtggcgtagtgctactcgctgctgcctgattcatcgtcctcgcattctacactaagctcgggtgctgccatgattcgatgaaggattccctcaatttctctgtcgtttcaagcttacatggaggtggatggagcgatggccatgcttaagatctcttttttg

SEQ ID NO: 1136 - DNA, 414 bp, Triticum aestivum
  Clone ID: LIB3280-029-P1-K1-H12
aaaaactgatgaatatggcgatgttgaaaatcgcgacctctccacttctatttctggcgagaggaaaaatgatgagatagacaagatggcaagctattatgaacaaatagcaaatgagaaaagagctgctttccggggacgttgattgcaaattatctaccacgctagtgcaggagcgacactgttgactgatgtcacattttggggactccttgtgccatgatcttaccgtgataagtttgggctttccatggtcactgatggcatgcactctggtaatgctgctctcctactcatagacacacttcttaacaatatgccttttgcctggtaccggatcgctttcttggtattttggaggtgcttctatgtgaccttccagagggtcattcatgcttacggagctgtatcctg

SEQ ID NO: 1137 - DNA, 433 bp, Triticum aestivum
  unsure (1)...(433): unsure at all n locations
  Clone ID: LIB3280-029-P1-K1-H2
gaaaagcagcagtccgtgggactgcagatcctcatctccacgctggagcactcctcccagcactctaccggggcgtacacggacacgaccgagtcgggtgccgtcggccgggtgccgacgccgctgggcctacctgtcgccatccccgacgaggccgcgacctcgcgctcggcgatagcatcggcgcactctgctgtcgaccggttcaagggcgtggtgccgcagaccaacgggcggtggggcgcccagatctacgatcgtcacgcgcgcgtctggatcggcacgttccccgacgaggacgccgaggcgcgcgcctacgacgtggccgcgctccgctaccgcgggctcgacgccgncaacaacttcccgcgcacgggcgcgtcgacggagctcgacttcctggcggcacactccaaggccgagatcgtcgaca

SEQ ID NO: 1138 - DNA, 173 bp, Triticum aestivum
  Clone ID: LIB3280-029-P1-K1-H3
aggcccactcagtgtcatctaagtttaagggcgtagtgctgtagcccaacacggggtggggcgcccagatttatgatcgtcacacacgcgtctggatctgcacgttccccgacgaggacaccgaggcgcgcgcctacgacgtggccgcgctccggtaccgcgggcttgacggt

SEQ ID NO: 1139 - DNA, 285 bp, Triticum aestivum
  unsure (1)...(285): unsure at all n locations
  Clone ID: LIB3280-029-P1-K1-H4
gaccatgtatatgtaagaacagataggaatcacattcttcacaatttgtcctccccaaccacacacacacacacatagagaacggtaaacaggcgcaacacgtatcataggtgcgaatatagtataagagtactccacaattccatataattatgcaacccgaatcctntgcctgccgacgacgattgcaaagcccgatcctagttagttcttaccggcgacgacgtccttggcgccgaggatgatgacatacccggccttcttggggctttgggcgccgtcgtc

SEQ ID NO: 1140 - DNA, 298 bp, Triticum aestivum
  unsure (1)...(298): unsure at all n locations
  Clone ID: LIB3280-029-P1-K1-H5
ggtgcatccgaggtagcaacaacgccgtcttctgcgccaccgactgcaccacccaggggctctgattcccgatcagtccatcgaccaatccatccggctagcgatgtatcaacgcatacgcaccgcatccaagtatacacgttccaccccggaccctctcacgtatgaataagatcagttgtactgtacttcgtttcagtcgacacgtgcgactagacacgagcttgtatgctgaagtggtgaatatacacagcttgctaaaaaaaaccggaaacaacntactaggcgccggggatga

SEQ ID NO: 1141 - DNA, 439 bp, Triticum aestivum
  Clone ID: LIB3280-029-P1-K1-H6
taggcctacgcaaatctcctccttcccctgctacagttgagagtctctcgagacagttccttcccggcccgatcccggatcctctccgccggcaacgctcgtcgaagaagtgatgggggaggtgctcggcgtgttcttgtacatagtagatgtaggttcagtttccgttctggtgtgttgggcgtgatgcctaggactggcgatatgccgatgaggagcgcgccgcctgcgcgtacgagcagcgcatggtggctagcggcgatgctttggttggtggcggtggcgtggtgctactcgctgctgcgtgattcatcgtcggcgcatcctccaataagctcggttgctgccatgatttggagaaggattcgtccccttcctctgttgcttcaagctgccatggaagtggatggagcgatggtgatgctagaggatctggttt

SEQ ID NO: 1142 - DNA, 391 bp, Triticum aestivum
  unsure (1)...(391): unsure at all n locations
  Clone ID: LIB3280-029-P1-K1-H7
gtacacgttccaccacggtggtgggttccccggcgggggcttacccggtggcttccagttcaacttcgggtaaaaagcaggccaggcttactgtttagttttgctgtcactgctagtgagtagtgtgtcgtggtcttttggtttaggagggagagcttaacgacaacatgtgttaattatatatatctagctaagagcttttaccatcttggctcttactctggttaaagaaagttttgctttagcaccaattatacaagaaattttccgtgagatgaattgtactagtgtattatgatttatagctggcgattctgtgatgcatcggccagttgattggaaaaaaagctactccnaannccattactctgttgcttcaagctgccatgga

SEQ ID NO: 1143 - DNA, 326 bp, Triticum aestivum
  Clone ID: LIB3280-029-P1-K1-H8
aaaaatgaagggagagtgaataattattggcagcaatcatcatatatatacaggaggaaattgatcgtgatcatcaacaggcccgtgtgccaacccagggcagcttcacggggccgatgggccaggcggcgccgcgcactgaatgccacgcggggccaccggcgacggggccctccacggcccacgccatgcagcatcgtcacaccggcgacgcggagggcccggcgccgctgatcgccgaccgccaaacggggtcgacctcgccgtcggcggcggcggcgagccaggcgtcgacgtcgtcgaagagcgcgcgctgcttgctgggc

SEQ ID NO: 1144 - DNA, 359 bp, Triticum aestivum
  Clone ID: LIB3280-029-P1-K1-H9
cgcaagcggccgacttgttttagatttttagcaaactgactggagagtgggttagtattggaagcgctcattatatatatacaggaggtaattgatcaacttcataatcaggggctcgtgccaacgcagggcagatatacggtgccgatgagccacgcggtgccgcacactgaatgccacgcggttacaccagggacagggcactgcacggcccacgccattcatcatggcaacaccgtctacgcagagggcgcggcctccaacataggcgaccaactaacctacgagctcgtcttagaggatgcaagcttaagcacggctgcatacgacgtcaaaagcgcgctctagttgctcctaaa

SEQ ID NO: 1145 - DNA, 293 bp, Triticum aestivum
  Clone ID: LIB3280-030-P1-K1-A1
gctagacatacatagcgataggcctacatttttagcggccctcctttttttttcggggggggttgcttcagttttcggggtgtttaatttacatcccgaacattcggccaatctttggcaaccaaaaagggtcgtcactagcatgtattcctgagcgtggcaaaggcacattccattttcccaatagcatggtgacatgcctgcacagacaaaaacaatcctgccaaggttccgggttagaataaaaaaattaagtccgacatcagcacacaaattctttgatgagacaaacc

SEQ ID NO: 1146 - DNA, 321 bp, Triticum aestivum
  Clone ID: LIB3280-030-P1-K1-A11
aacgaaccgcactgccgccgtccccgtctgcctccggccatcaaccatggcgaggagttccatggccgcggtgctcgccgtcctggccgtggcggcgctccggtgcgcgccggccgccgcggagctcccgctggtggagcacccggccaagaacgacgggtcgctcagcctgctcgtcatcggggactggggccgcaacggcacctacaaccaatccagggtcgcggaccagatggggaaggtcggggagaggctggacatcgacttcgtggtctccaccggcgacaacttctacgaggacggcctcacgggcgttcatga

SEQ ID NO: 1147 - DNA, 358 bp, Triticum aestivum
  Clone ID: LIB3280-030-P1-K1-A12
aacgaaccgcactgccgccgtccccgtctgcctccggccatcaaccatggcggagaggtccatggccgcggtgctcgccgtcctggccgtggcggcgctccggtgcgcgccggccgccgcggagcttccgctggtggagcacccggccaagaacgacgggtcgctcagcctgctcgtcatcggggactggggccgcaacggcacctacaaccaatccagggtcgcggtccagatggggaatgtcggggagaggctggacatcgacttcgtggtctccaccggcgacaacttctacgaggacggcctcacgggcgttcatgaccagcatttctaggaatcctttaccaatatctacacc

SEQ ID NO: 1148 - DNA, 437 bp, Triticum aestivum
  Clone ID: LIB3280-030-P1-K1-A2
ggcgatccgccgtgggtcctcctgcgccgtcctcgccctgctcgcgctcgcctccgtcgccgccgtcagcgccgacgtcttcttccaggagaagttcgaagatggttgggaaagccggtgggtcaagtctgagtggaagaaggatgagaacatggctggtgaatggaaccacacatctggaaaatggcacggagatgccgaggacaaaggtatccaaacctcagaggactacaggttctacgccatctcggcggagtaccctgagttcagcaacaaggacaagacactcgtgctgcagttcacggtgaagcatgagcagaagcttgactgcggtggtggttacgtcaagttgcttggaggtgatgttgaccagaagaaattcggtggtgacacaccctacagcattatgtttggaccagatatctgtgggtacagca

SEQ ID NO: 1149 - DNA, 342 bp, Triticum aestivum
  Clone ID: LIB3280-030-P1-K1-A3
cccacgcgtccgcatccacgtacgtgcttagcttaagcccttccggcgaagtcaagtgcaatggcgtcgtctagcaagccctgcgccgcctccgtcctcctcctgctgctggccctcgccgtcgccacggcggccgatgcggcgaaaaagagcatcgcgtcggagcccaagtccatcttctcgaggccgtcgggagccatcttcccgaggccggcggcgaagcacatcatcgcgtcggagcccaccatcccgaggccgtcggcggtggacgtgtcggcgacgtgcatggggtcgctgctggagctgagcccgtgcctggccttcttcagggacgcgggcacg

SEQ ID NO: 1150 - DNA, 389 bp, Triticum aestivum
  Clone ID: LIB3280-030-P1-K1-A4
gcagcaaatgaagctgcagcaggagcagcagatgaagctgcagcaggagcagcagatgaaggagcagcgaatgaagcagcagttggctgagcaggagcagcaaatgaagcaggcggctgagcaagagcggcaaatgaaaatgcagcagcagcagcagttggcgttatcagacgatgacgagggggattcgtttgaggtggagagcatcacgaaacaagtagcagcggcggcggcgggcaaaaccaagcagcttgagacagatcctgcatacgactacagcccgtcaaagacggagaaggcagcatttgcccagttacctcctccggcgccgccaaataagctgcagacgatgcggggagtgttctcagaagaaagacgcgatgagccat

SEQ ID NO: 1151 - DNA, 422 bp, Triticum aestivum
  Clone ID: LIB3280-030-P1-K1-A5
cggacgcgtgggttcgccgcttacgaggatagaaggctttgttagtctgtttgcacaagctaaggacaaacgctttttttcgataccatcaagggagctactgagatttctcactgtgttcccttttatagaacacattaaaatgaaagggggggcgttgcagaagagctcctggaactggatacagcagctctttcaagtgatctggaaacagaatttcctttcattactctcaacacttacatgtgttcggaactcatttcttatccatatccagaatctgaattccacaactttgaagaagaccggtcatgtgagaagtttgaaagtggccaaatttgggctctctacaatgacgctgatacattcccgaaagtgtatggctgggtgagcaaagttgagatacaaccatttgaagtgca

SEQ ID NO: 1152 - DNA, 311 bp, Triticum aestivum
  Clone ID: LIB3280-030-P1-K1-A6
agtttgtttgtagaggctaatgacatactctttttttttataccattaagtgtgcggccccaaaaatattacttaaacaagttttttggacgggtaaaaatgaatgaatttgcattacaaaggctcttttggaattgaaaaaagaaagagttccaagtgaacagatttacagaaatttctaccattgctttgatctctcacatgaagtttttatcttatgtttaaaccagagggggaaacggggctataaagcattctttttttctatgtaaagtgcgaaaaacctaagtggcctaagtggctctttttaa

SEQ ID NO: 1153 - DNA, 278 bp, Triticum aestivum
  Clone ID: LIB3280-030-P1-K1-A7
gtaaaggggtattaacatgttctaccccacccgaaccctttcatcttgtctttcccccaaaaacccttgaataatttccaaaaaaatacccccgacccaccccaactgttctgaaaataaaatttctgccctcccccccccaaatagtaccccccccgaaccctccatcccgatgaaccccaataacctaatcccccccaatccccccaaacattcgctaggtttcttttaccaacaatccccctcccaaaaagcccaactttctctcaaaacccccc

SEQ ID NO: 1154 - DNA, 309 bp, Triticum aestivum
  Clone ID: LIB3280-030-P1-K1-A8
ctcttccggtccaagaggctggactctgagattttcttcgcccccaactaggagccattcgtctcgcatcggctggttgccttatgcaggaataaataaatttagttaggatattgaaactctttgagtgtgagtctgtcagttgagctgctggtggttttaatggatcacctatgataatctatcttagttgcccctggcagaacacaatgttactgtcaggtcgccatcggttatatcgagtgagtgtttgtggctggccgagctggtctgagaactgctgaatgcaatctatccttaaattcgtgg

SEQ ID NO: 1155 - DNA, 160 bp, Triticum aestivum
  Clone ID: LIB3280-030-P1-K1-B1
aggaacacaaaaaattggtgggttattaaaaaaaaattttagggaatatttagttttttttttgggggaaaacccaaaaaaaaaaaatttgggtttttaaagggttaaatttttttttttcaaaaataaaaaaattttttaaaaaaaaaatttccggttt

SEQ ID NO: 1156 - DNA, 267 bp, Triticum aestivum
  Clone ID: LIB3280-030-P1-K1-B10
gacggaaaaacaaaaatttgaattacgacggcatcctcctagcagggcaacaggcctatacgtagtagtattattattgtctcgaaactaaaatccatgcggacgatctgatcagcatcgaacggatccttccaaagggcatgcactcgggttcacttgtcgtcgttgtcgtcgttgtcgggcgagaggccggcgatgccctcaggcccgggggcagccgccggtccatcggagggcccctccgcgggtgagtcggcggccggcgcg

SEQ ID NO: 1157 - DNA, 410 bp, Triticum aestivum
  Clone ID: LIB3280-030-P1-K1-B11
cccaccgcgccggccccgactccgactccgacaccccccggcggcgcgcgctcgccgagctcggtcgcactgcggttcggatcccccggaggcgtgcggcttcgtcgcgggcgagggtcggcggcggtcgcgatggcatccgactggcgcgtggagcggatcgcgtccagcatccgcgccatccccaacttccccaagccagggattttgtttcaggacatcacaaccttgcttctcgatccgcaggcattccgtgacaccactgacctctttgtcgagcggtacaaggacaaagacataactgtagttgctggtgttgaagccagaggattcatttttggtccttccattgcattagccataggtgcaaagtttgtttcaataaggaagccgaaaaaaatacctggtga

SEQ ID NO: 1158 - DNA, 434 bp, Triticum aestivum
  Clone ID: LIB3280-030-P1-K1-B12
aataacttctacagcagccactggtgatcaagctgcttttatattgagcattcccaaaagaaaattgtcggacgagacacaagaaactcttagaacatccactttcccaagcaaccatgtgaaggagaaatgggccaagaatctttacattgcctctatatgctatggacggacagtgtcgtgagacttgcagtcacaccaactcagtcagggctgagcatattaaaatgagttgacatcgaaaaccacagcaaatttagttgctgctgtgttactctgtatgtgtaggtaaattgcgtagatgaaccttacatcatggccagagcaggggcgctccagaaagaactgggatgaaggtggaccacagctagccaataagaagatggaagaggatgcgtgatccggctggtggtgctgcagcatggttttgcttc

SEQ ID NO: 1159 - DNA, 439 bp, Triticum aestivum
  Clone ID: LIB3280-030-P1-K1-B2
agccgtcccaatcctcgatctgttctcaacctcccctccgtccgtcgcagctccagatttccttccccatggctccgatcaagatcggcatcaatggtttcggccggatcggcaggcttgtggccagggttgcgctccagagccccgatgtcgagctcgtcgccgtcaacgaccccttcatcaccaccgactacatgacctacatgttcaagtatgacactgtccatggacagtggaagcaccatgaagttaaggtgaaggactccaagacccttctcttcggccagaaggaggtagctgtgtttggctgcaggaaccctgaggagatcccatgggctgctgctggtgctgagtacgttgttgagtccaccggtgttttcactgacaaggacaaggctgcagctcacattaagggtggtgccaagaaggtcatcatttc

SEQ ID NO: 1160 - DNA, 438 bp, Triticum aestivum
  Clone ID: LIB3280-030-P1-K1-B3
cccacgcgtccgcatcgggagaggttctgtcgtgctcgctctccggttgctcgcgaccgctctccgatcgctcgcggtggctctccggtcacatgtgctcctcgtcagcggagccgctccccgcccatccagccttgtccttcgctggccaggagttgggttgaggttgtgggccactcgtcgttgtgtgtatcggtgccgccaaggtctcaatctgggtgttgcaaggattccaatgtctgcacctctttggtgtctgctttggagtcgcagcttgccctgctgcgcacggagctccttcaggaggttgagctgctccgcattgagcttcgcgacactctagccaagtttgaggttgcatcggttgtgcctttgctgcctgagctccaggttggttccattgatgaggatgctgaatgttgctttgaagatttttct

SEQ ID NO: 1161 - DNA, 413 bp, Triticum aestivum
  unsure (1)...(413): unsure at all n locations
  Clone ID: LIB3280-030-P1-K1-B6
gtggggcttggagagcagaagaccgtacatccaaggtgaaggtgacgagaacagctctggatccgaatcagatcaatcagaagacaacggggaaaacggccagcccatggacgaggagtatgaggaggagcaggttccagattactcgagagcctattctggtggattgagaccccttgcccatgtcatgatggatgatgagaccgaggatgatgatgaagatgctgaaggggacggagagggtgacgaggaagaatatgacgtgaaccatgcttccgccgatgttgatgatgagatggacgaggatgatgatataggtgatgatggggatgatggtggtgatggagtngaggtgaatgcagatgaagatgaaggcgcgacctcatactcgtcagagtacagtgaataagagc

SEQ ID NO: 1162 - DNA, 433 bp, Triticum aestivum
  Clone ID: LIB3280-030-P1-K1-C1
gcccaagacaaacaccttctccggtctccacgtacggccatggacgccgacgccgacacggtggtgttcgaggcaccggcgcacttccgcttctacaagagcggcaggatagagcgccttcaccggccacccatcctgcctgccggcgacgacgaggccaccggcgtcacctccaaggacgtcgtcctcgacgcggacactggcctctccgtgcgcctctaccttcccaagctccaggaaccctccacgaagctcctggtcctcgtctacttccacggcggctccttcctcatcgagtcggccgactcctccacgtaccacaactacgtgaacgccctcgccgcggcggccggcgtcctcgcggtgtccgtcgactaccgcctggccccggagcacccgctccccgcggcctacgacgactcctgggcggcgc

SEQ ID NO: 1163 - DNA, 354 bp, Triticum aestivum
  Clone ID: LIB3280-030-P1-K1-C10
tctaaatatctagagaacgcttctcttgactttatttccatctatctggaatcagagaagaagaggctgttattaagtacatctccagcaacatcttctcatactatgaccaggtgcttgacacaactgccattcttggtgccgttcttgaccgtttctcttgtactgtcggtgaaatgggtcacaacacctacttttcaatggccaggatcaatgccattgtccctgctatggagatgaccaagtggattgacaccaactaccacttcattgtaccttaattgagcccagcaaccaaattcttaaacgcttcacacaagtctgtctttgaattcaaggagttcatggctcttt

SEQ ID NO: 1164 - DNA, 269 bp, Triticum aestivum
  Clone ID: LIB3280-030-P1-K1-C11
cggacgcgtagggcgcggatcgccgtcgaccacgccgccagcacggaggccaagatcgaggacctggcggagctcgaggcggaggccgagggcgccgcctcgcgcgcgcggttcgagcactgcctggagcagtacggcggcgccgccgacctgctccgcgacgcgctggacaacctgcaggccaacgtgtacgggctggccatgcagcagctgatggcggggctgggcgcgtcccggagctgcgaggacgcctggaggggcgccccggc

SEQ ID NO: 1165 - DNA, 304 bp, Triticum aestivum
  Clone ID: LIB3280-030-P1-K1-C12
atcaatcaatcccacctactccacctctcgccggagccccagcaaggagcaagcaaggaagatggacgccggcaagctgaagaaggtggccgggaagaagttcggcgggccgaggaagaagtcggtgaccaggtccgtcaaggccgggctccagttccccgtcggccgcattggtcgctttctcaagaagggccgttacgcccagcgcgtcggctccggcgcccccgtctacctaagcgccgtccttgagtacctcgcagtcgaggtgctggagctggccggtaacgccgtctaggacaacaag

SEQ ID NO: 1166 - DNA, 350 bp, Triticum aestivum
  Clone ID: LIB3280-030-P1-K1-C2
gggatagaatcattatgtaaagcacataatagcaagctgtgtatattcactagtcatcacttgagcatacaagctcgcgtgcgtctagtggaacgggtcgagtgaaacgtagtagtacaactgatattattcattcatacctgagaggggccgggccggggtggaatgtctatgcagtatgcttgattgcgcgtgaatgcattatatatgcatgcggtgcgtatgcgttgatacatatatataatgtcatacagattgaggctatatattgttcatcgctggccggatgggttgatcgatggattgattggggatcaaaacccctgggtggtgcagtcggtggcgcaaaa

SEQ ID NO: 1167 - DNA, 234 bp, Triticum aestivum
  Clone ID: LIB3280-030-P1-K1-C3
cccacgcgtccgcatccgggtcactcaggcggatttctgctgtccaacgagttgatctcgcttgcctttgggactatttcgccatgacaagagtagctggcttttcgcattgataattccacattcttatttgtcagattttatctgacaaaattgacacttactgatcagctaatgtctagtatatcagtaagtgtcaatttttgttttacaaaattgttcaattgttcagct

SEQ ID NO: 1168 - DNA, 393 bp, Triticum aestivum
  Clone ID: LIB3280-030-P1-K1-C4
gctgaggatttggagaaggttgccgctgacctcagggccagcatctggaagcagatgtcagaggctgggattaagtacattcccagcaacaccttctcatactatgaccaggtgcttgacacaacggccatgcttggtgccgtcccggaccgctactcttggactggcggggaaattggtcacagcacctacttctcaatggccaggggcaatgccactgtccctgctatggagatgaccaagtggtttgacaccaactaccacttcattgtacctgaattgagcccagcaaccaagttctcatacgcttcacacaaggctgtctctgaatacaaggaggcaaaggcgctcggtgttgacactgttccagtgcttagtggaccagtctcatac

SEQ ID NO: 1169 - DNA, 273 bp, Triticum aestivum
  Clone ID: LIB3280-030-P1-K1-C5
gggggttggttggatttatttcattccagaaacacctttttatactataaccaggggcttgacacaaccgtcattctttgagtcttcttggaccgtttctcttttactggcgggggaagggggccaccaccaactttttttttttcaaaaaaatttctctggcactgctgtggagaccaccaagaaaaagaccccaactacgagttcattgcaccttttttttgcccccagccaagaactgatactcttgagacagggctgtttctgaataca

SEQ ID NO: 1170 - DNA, 92 bp, Triticum aestivum
  Clone ID: LIB3280-030-P1-K1-C6
cccacgcgtccgaattatgcttgtaaaagatcaataatgtgcctttgttgtgctcggctgttaaacgtttattaagaggtaacatttgcatc

SEQ ID NO: 1171 - DNA, 362 bp, Triticum aestivum
  Clone ID: LIB3280-030-P1-K1-C7
cttgctccgttccagctcaggcgagcagcgaccaccttccggcgagggcagtgggcagcagcgatggagggcaaggaggaggacgtgcggctcggggcgaacaagtactcggagcgtcagcccatcggcacggcggcgcaggggtccgaggacaaggactacaaggagcccccgccggcgccgcttttcgagcccggcgagctcaagtcctggtccttctaccgcgccggcatcgccgagttcatggccaccttcctcttcctctacgtcaccatcctcaccgtgatggggtacagcggcgccgcctccaagtgcgccaccgtcggcatccagggcatcggctggtccttcggcggcatgat

SEQ ID NO: 1172 - DNA, 266 bp, Triticum aestivum
  unsure (1)...(266): unsure at all n locations
  Clone ID: LIB3280-030-P1-K1-C8
ccggnccggaaggcccggggggggcgacgcgcgcgcccacgcgnacagagccagcgcacgcaagcggaaaccagcagcccaacaagacgaaggggggaggcacagggagcgaaagcccaggacaagaggagccggcacaacaacaacgcaaacgccacagccgaaagagccagagcncaggggacaaaagngacacccaccgagcagccaaaggcgagccaacaggagcgcaacggcggaaacaaaagcgcgcaacgggccagcgc

SEQ ID NO: 1173 - DNA, 435 bp, Triticum aestivum
  Clone ID: LIB3280-030-P1-K1-C9
aacgcctcgagccacccattcgtccactcgtccacatccagctcactcaagcctattttttctttccaacaatttaataagaatgagtctttgaaactatttctccatcacaagcatctctgttttttcgcattaataattccacattcttatttgtcacattttatctgacaaaattgacactcactgatcatctaatgtctaatatattatttaattccaatttttgttttacaaaattttccaattgttcattcttaaataaaaaaataaaatcattgccttcctctctaaaagatccaattctacgtacccgtgcatgcttacatatatcttttctatacctttacctaaatttaatttactttcctttcttttataaacttataactttgaaaaccctatcttttcccaatcttaatctcccttaataca

SEQ ID NO: 1174 - DNA, 366 bp, Triticum aestivum
  Clone ID: LIB3280-030-P1-K1-D10
ggggggtgggggcataaaaaaagctgaaatagttttacttggctgcaaattaaaccggcaaagtgctgggagcgataacgagcacacctgtgctccaacacataatagagggcatataacatggctttctcacgactttatgccactaataaaaagtccttttaatttaaatcatgagttgacgaaatttattccccaacatatatgataattgaggagggccccaaatctctgattttggacctaaaacaaacaagacctttttatagcacggatacaacaaatgctagaatggagttgttgaaaaccaacaacgaaaagaattatcttgatatggtcttatgaaatacatcttaaattatgaga

SEQ ID NO: 1175 - DNA, 432 bp, Triticum aestivum
  Clone ID: LIB3280-030-P1-K1-D11
tttcaatcggtacaatgattgctggatttgatgaaactggtccgggcttgtactatgttgatagcgagggtgcaaggctcaagggaagccgattctctgttggttctggctctctatatgcttacggtatcttggatgagggttacaaattcaacatgtcagttgaggaagctgctgagttagctcggcgggctatttaccatgcaacattccgtgacggagctagtggtggctgtgttagtgtctactaccgttggccctgacggctggaagaagctgtccggagatgatgttggagagctgcactaccactactacccagtccaggcggctcccgtcgagcaagagatgggcgaggccccctctgcgtcaacctgattgatgtcgtaccaaattccgtgaactgtgctgaagcaccttgttttatggact

SEQ ID NO: 1176 - DNA, 405 bp, Triticum aestivum
  Clone ID: LIB3280-030-P1-K1-D12
ctctcgccggataacccaaccccagctcctccccttcctgctgcacctacaactactgctccggcgccatctaccggcccctctcgcctctcgccggataacccaaccccagctcctccccttcctgctgcacctacaactactgctccggcgccatctaccggcccctttcgcctctcgccggataacccaaccccagctcctccccttcctgctgcacctacaactactgctccggcgccatctaccggcccctctcgcctctcgccggataacccaaccccagctcctccccttcctgctgcacctacaactactgctccggcgccatctaccgacccctttcgcctctcgccggacaatccaaccccagctccgtcccttgctgctgcaccaacaattact

SEQ ID NO: 1177 - DNA, 347 bp, Triticum aestivum
  Clone ID: LIB3280-030-P1-K1-D2
ggggggggcaaagcagattcaagagtgtgagatgagcacgccaaacgtcgtttacaattattggcaaacaaaaagaatgctcacggaaagcagtttatgccgcacaaaggcacatccaaagtacccaatattatgtagacatgtgaaaagagcatacaaaaacacagtaatggttcctgctaataataagagaagcacgtaagaagccagcgcccaagtcctttgacaagacaaaccttgtcaagaccgccgtatgtcgaaaaattccacaaaaaaccgcaacatggaaacaccatttcctttccataacttttgctaagtcctaacataggcatgccatttgcagg

SEQ ID NO: 1178 - DNA, 262 bp, Triticum aestivum
  Clone ID: LIB3280-030-P1-K1-D3
atttccttcagggggggggatagcattttttagattgtatgattagctccctaaacttttttaacaattattgctaaacaataaatactttcactaaatcgcatatttgccacttaaaggcacatttaaatttacccaattttatgtatacatgtttaaatagcttacttaaacactcctatttgattcctttcttataatcaaaaattctccttataatccattccctaaattttttaatatcacaaatcttttcaagacc

SEQ ID NO: 1179 - DNA, 430 bp, Triticum aestivum
  Clone ID: LIB3280-030-P1-K1-D4
ggaagaattcggtcagcactccggttgaacatggaaggaatagaacatgaacttgagaagatgggatgatacttgatgaaatcaacaacatactgcctccggaactattgaaagaatggcacaatgggtaagaaagatttcagacagctctccagttgaggaaggagggaaaacttgataaaattagagaactcgaatgaaaacacgacacttcggttaaatggataagcacggaaagaccatgatctttgacaaacgagatgatgggttggaaagagcaacatcacaatgactctggaacgaagggaaacaagatcttgagagagcacggatacaacaaatgctagaatggagttgttgaaaaccaacaacgaaaagaataatcttgatatggtcttatgaaatacatctcaaattatgagatgacaac

SEQ ID NO: 1180 - DNA, 443 bp, Triticum aestivum
  unsure (1)...(443): unsure at all n locations
  Clone ID: LIB3280-030-P1-K1-D5
ggaagaattcggtcagcactccggttgaacatggaaggaatagaacatgaacttgagaagatgggatgatacttgatgaaatcaacaacatactgcctccggaactattgaaagaatggcacaatgggtaagaaagatttcagacagctctccagttgaggaaggagggaaaacttgataaaattagagaactcgaatgaaaacacgacacttcggttaaatggataagcacggaaagaccatgatctttgacaaacgagatgatgggttggaaagagcaacatcacaatgactctggaacgaagggaaacaagatcttgagagagcacggatacaacaaatgctagaatggagttgttgaaaaccaacaacgaaaagaataatcttgatatggtcttatgaaatacatctcanattatgagatgacaacctgccactcacgg

SEQ ID NO: 1181 - DNA, 130 bp, Triticum aestivum
  Clone ID: LIB3280-030-P1-K1-D6
cgaagacatgcatcatgttactagctaggtagtacgcttcagtttcagcaggcgattgtcgaattgatcaataaagattctggacgtgagtccgttttgttaaaaaaaaaaaaaaaaaaaacaattaatg

SEQ ID NO: 1182 - DNA, 349 bp, Triticum aestivum
  Clone ID: LIB3280-030-P1-K1-D7
gtttgccgcaaagtgtttgatgaaaaggacattgagcatgttcgtgatctgttggatgcaaacacttctcagctgatggcatgtttaacagttgaccttggagtagatgataaagagttgctccattccgaggcagagaagaagaggagagaaaaatttgggtcattgtttaatctgcaacaagaacggaatggtttaattgaaccaaagaaagaccttgccatacagcccggaatgtatgtttctcttgctgctagtgagccaaccacaagtgcaggagacagcaccaattcttgggaagcaaccgcaagctcaactttcaaaacagttctttccggcatggcaaaca

SEQ ID NO: 1183 - DNA, 395 bp, Triticum aestivum
  Clone ID: LIB3280-030-P1-K1-D8
cgcacccactttccccgtctgtctttcttctcggcggaggcggaggcgacaggaaggcgaacgacgaaccctagccgcgcgaggaacgcccagatccccaaggccggcgacgatggcgatggcggcggttcgctgcgccgcgaggaggctcggtggctccctgctccagccaacgcaggcggcggtcgcggaggagggacgccgcctcgtgccaagcaggttcatgcgctcccgccacctctccaccaagcatgctagcgagacctggatggaaaagaagatgcagaagttgagatctatgtgggcccagtacaaggcggacatagagagaaggatgagggaacctccagaagaggatgagtttaagttgcttgtcgagtcctacgcacgtacga

SEQ ID NO: 1184 - DNA, 351 bp, Triticum aestivum
  Clone ID: LIB3280-030-P1-K1-D9
gcttaaaggttatctggtaaatattattggtcagcataacaagttcagggacgttcaccacacttgcaagaaacacaaaaaatcacataacaagaactacacatgtccagctcaacacaactattttcacaatgccattactgaacaagatcatcagggaggcgctgaggatgcactctataagaccatctaatccaactttgcataagcgaatccgtcagcaccttctttcttgccattgcttggtgccagatccttcaactttgctaaagtagccttagggaatctgtaacctttgtcggtcccatatatccgtcatccgactcgatccttatcgaaatttggacaatg

SEQ ID NO: 1185 - DNA, 430 bp, Triticum aestivum
  Clone ID: LIB3280-030-P1-K1-E10
cagaaggcgacgctagcaacagagacatccatccatttgtgccaccatcaataacaacgttgtaacaagcatggctctgcactggttgctgaagcagtagagtggcttatgtcatgtaggcaactggtggctacaaggatccgtacgtaaacatggtatgtgaaatttgtgctacacaggaatggaaatgccaatttacaaaatataatatgcatgtttggttgatgattacttggggtagccgaatagaacttggaaccattataatttaagtgtggctatgaaaattttagatggagttggtggtttggtacctattggagtaacaaattccagttacccagtagaaagcaaggtgaatcggaaatcaattattaaatctgctttataggctttgctaaagagagaaactgagagctactaatatcct

SEQ ID NO: 1186 - DNA, 433 bp, Triticum aestivum
  Clone ID: LIB3280-030-P1-K1-E11
gttggtacgagcaactgcaaagagagagtggcgatgaggaatttcgttgagaaattggtgctctctttactatggatctccctgttccaagggtgcatggtccagtctgtggaatatgatcatacagctagtattgagtgcctccgtgatccgatgaagcccctctacaagggcggcatcatccagaacagcgagttcaacaacggcctcatggggtggtcgacgtaccggaacatcaaggccggcgtcggcaagtcggcgtccggcaacaggttcgccgtggtgcaaggcgcgatcagctccctgttcagtgccgccggcgacgcagccgcctcgcagtcccacagcgtctaccagaaagtccagatgcagggcgacacccactactcgctatcagcatggctgcaagtgtcggccggcacggctcacgtga

SEQ ID NO: 1187 - DNA, 439 bp, Triticum aestivum
  Clone ID: LIB3280-030-P1-K1-E12
ctccgcactctccccttaccgccgggatggacgtgcagatgggcgagccgcaggcggcccctcctcccgccgccgcagcggcggcgccggcgccggccccttccaccatccaacatctgaaggagatcgccgcggtgatcgaggcggggtcggtcaccaaggaggtccgccggatctcccgcgccgtccgcctcaccgtcgccctgcgccgccgcctcgccgcccgcgacgtctcggccttcctcgccttcgccctcccggccaacagcgacgcatacgcccgcctcactcccctcctccccaaggaagatgaagctgagatggatattgatgcagcagctccagcaactcagatttctatcaagcatggccttcctgagattgaaatatattggtctttgcttgttctgattttcctcattgatcagaagaaatacga

SEQ ID NO: 1188 - DNA, 301 bp, Triticum aestivum
  Clone ID: LIB3280-030-P1-K1-E2
tttctcccaaccatgtggcaggatttgggggttacaactcaacaacagaagttacaagacactctcacacatgaatacaaaacaccccatgcatgtacttctaaagcacccttaactaaatcaccttgcggtgtttccacaacgcaaggccacactaacaatgatcaaaatgctcaactccacaataagtaataacttatttatgtctactactgtgctactagtatgagagaagggaaggcctaagcgggtgctgatcaaaagcagcctcggaatagccgaaggcctctttttttactat

SEQ ID NO: 1189 - DNA, 326 bp, Triticum aestivum
  Clone ID: LIB3280-030-P1-K1-E3
aggttttttttttgggaggttttttttttttttttttttttactttttttttttttattttattttttttttttttttttttttttaattatttttttttttttttttaaatttttttttataaattatttttttttgttttataattttaggtctctttaacatttataattttttttactccacaaaaaaaaaaaaaaaaaaaggtgacctctgcgctactagtttgagaaaaagaaaaaattatggggggcaaaaaaaaaaaaccctgggaataaaaaaaagcatattttaaacaaaaacaaataatttttcttttttttttt

SEQ ID NO: 1190 - DNA, 428 bp, Triticum aestivum
  Clone ID: LIB3280-030-P1-K1-E4
gttttctgagtttcaccatgtgtgtgtgtgccttgtgtgagacaaagagagttgagctgtgagaggcagctcaaggtagtagaagaagcggcgctgcaaggagattcagcgccaacaattggcatcagagccctgtcgatccgtggcggtgactacggtaccggcggctatggtggccggcgtggcggtggcggaggcaacggctgcgacggcggcgacgcggtggactccatgtgaggtggaggacgccgacgcgaggtgatggctggcggcggcgcgatgccgctggtggccggttgcggtgcaatgctgcgaggtgatgatggcgtggtgatcggtgttgcgaaggcgccgtccacgacaagaggtggccactgcgtgtggcaggacgatgtggtgatgggcgccgcgacagcgtcgtcctcggc

SEQ ID NO: 1191 - DNA, 440 bp, Triticum aestivum
  Clone ID: LIB3280-030-P1-K1-E5
cccgccgatatcaccaccgctccctctccggccgccatgttgccgccggccgcccgcctcgcggcccgccgcctcctcggcctcgcctccgcctccgcctcacagtccgccgcccgacgactatccccgtctccgatctcctcccccgccgaggccgccgccacgggttacttctccaggtccttctcttcggcgcttaactaccacatcgattcgccggacaacaaccccaacatgccgtgggagttcaccaaggccaacatggacaaggtcaacgaaatcctatctcattacccaagcaactacaagcaatctggcattattccaatgcttgatcttgcacagcagcagcatggtggatggatcccggttgcagcaatggacgccattgctaaaatagttggagttgcaccaatcagggtctatgaagttgcaacatt

SEQ ID NO: 1192 - DNA, 441 bp, Triticum aestivum
  Clone ID: LIB3280-030-P1-K1-E6
tccgccgatatcaccaccgctccctctccggccggcatgttgccgccggccgcccggcgggaggcccgcctcctcctcggtctcgcctccgccttcgcctcacagtccgccgcccgacgactatccccgtctccgatctcctcccccgccgaggccgtcgccacgggttacttctccaggtccttctcttcggcgcttaactaccacatcgattcgccggacaacaaccccaacatgccgtgggagttcaccaaggccaacatggacaaggtcaacgaaatcctatctcattacccaagcaactacaagcaatctggcattatttcaatgcttgatcttgcacagcagcagcatggtggatggatcccaattgcagcattggacgccattgctaaaatagttggagtggcaccattcagtgtctatgaagttgcaacattt

SEQ ID NO: 1193 - DNA, 390 bp, Triticum aestivum
  Clone ID: LIB3280-030-P1-K1-E7
cgcgtcccctcccttgttcgatccagcagcgcgcctccagatccgctccaaggcccagccagcctcctccaggccccgcggtccagcggcctccaggcccagcgagcacctcgccggttcgctcccgttgacgagcgcgtgggccagcgcccctggcccatcttcccccgcggcctgccaggcctcctccaccgacctgggccgagcccatgggtgagaacccccccaagcgcccctgtcctgtgcagcccggtagactagattcggcccgcatgtattttttttacctgcctgcgaattttgtcattatccgtagaattacagaattgcagaaaaccccctgttgttcatgcatttaataactcacaaaatatgcatcatatgttaatt

SEQ ID NO: 1194 - DNA, 349 bp, Triticum aestivum
  Clone ID: LIB3280-030-P1-K1-E8
atacgaattgcccctttttattagatttctataaaaaagacagactaggacactatacactattggagctttatcacacgcgaagaagaaccacatgtgttcgacgcatgcgtgcatcacttgacgaggttggttatggcgatgccaatgatggtcgtctgcaggcagtcggcgctgtacctgggcagcggcgacgggagcccgaccttgacgagcccgccgtcgcaccgctgcaggagcggcgcgacgctcgccatctcctccttggccgccgggtaccggcgcgccctgagctcgtcggaagcctccgcgaaggccaagcccaccttgtcgtacgccttcacgcacg

SEQ ID NO: 1195 - DNA, 405 bp, Triticum aestivum
  Clone ID: LIB3280-030-P1-K1-E9
gcgtcggcgacaagatctggaacaacgggcccctcgacagccagatccagtggttccagaacctcctcccctccgtctgcggctcatcgtgcaagacgtacctgtccaagtccctgttcgtgctgggcgagctgggcgggaacgactacaacgcgcagctcttcggcggctacacgccggagcaggcggccgggcagagccccaccatcgtggacgccatcggcgccggcgccgagaagctcatcgggctgggcgccatgtacgtcgttatccccggggtgctccccgtcggctgcttccccatctacctcacgctctaccagacctccaacgccggcgactacgaccagtacggctgcctcaagcggttcaacgcgctgtcggcccgacacaactcgcttgttc

SEQ ID NO: 1196 - DNA, 437 bp, Triticum aestivum
  Clone ID: LIB3280-030-P1-K1-F1
gccgacgagctcaaggtcgacgtcatcaagagggctgcagtcttccactatggatcaataagcttgatcgccgagccttgccggacagcgcatctgcacgccatgaaggttgccaaagaggccggcgcgcttctctcgtatgacccgaacctgagggaggcattgtggccctcccttgaggaggctcgcaccaagatcttgagcatctgggaccaggcagacattgtcaaggtcagcgaggtcgagcttgagtttttgactggcatcaactcggtggaggatgatgttgccatgaagctgtggcgccctacctttaagctcatgcttgtcactcttggagatcaaggatgcaagtactataccaaggatttccgtggaactgtcccatcctacaaggtacagcaagttgattccgacaggtgctggtgatgcattta

SEQ ID NO: 1197 - DNA, 399 bp, Triticum aestivum
  Clone ID: LIB3280-030-P1-K1-F10
cggacgcgtgggcttctacgcgacgacgtgccccagcgccgaggccaccgtccggagcatcacctgggcgcaggtcgccggcaaccaggccctccccggccagctcctcaagctgcacttccacgactgcttcgtcaagggctgcgacgcgtccatcctgctggacaacgcgcagagcgagaagacggcgccgcccaacggctccctcggcggttacccggtgatcgacgctatcaaggcgcagctcgagaaggcctgcccgggcgtcgtctcctgcgccgacatcgtcgcgctcgccgcccgcgacgccgtctcctaccagttcaaggcttcgctctggcaggtggagaccggccgccgggacggccccgtctcgctcgccagcaacaccggcgcgct

SEQ ID NO: 1198 - DNA, 436 bp, Triticum aestivum
  Clone ID: LIB3280-030-P1-K1-F11
agaaggctgaaaaacttttagcaacgaatcttcctttcccatacacctcaaatgatgtgtatgaaaatagcatgcgtatgcctcttggacctgatttcaacccagcaatatcactctctgctcttaaccgacctgcgattgtgaagaagcctggtgttgttattaagccaatacagtacggggaaattgatccgcatgagaagcctgatgaactcaagcgggtcattcagagagtaaaaccgaacccaaacataaagaaggcgtctgcgaaacaagcgaagaggacagcttcacatcggaggactggatgagacagtagtacccagttaatgtggtgagagatgcgcataacagaatgcgggcctgggttttcttgccatggctattttcaaacacttgagaagtatacaaagattcttctcatggagtcaaacga

SEQ ID NO: 1199 - DNA, 329 bp, Triticum aestivum
  Clone ID: LIB3280-030-P1-K1-F12
aatagagcttgggaatggtctgccagatatcagaagtactcggcaatgtcttcaagctgttaaagatgctgggtttgaggttatttgggacaaggatcttgctgaagattctccgttgccttggtacttgcccttggacccaagtcggttttcattgagtagtttccggttgactaccgtgggacgaataattactcgcaatatggtcaaggtattggaatatgttggtctggctccggaaggcagccagagggtctctagtttcttagagaaggccgcggaaggtcttgtcgaaggtggcaagaaagagatcttcactccgatgtact

SEQ ID NO: 1200 - DNA, 438 bp, Triticum aestivum
  Clone ID: LIB3280-030-P1-K1-F2
aaaggaacaggataaaagaaaggcttgacaagatgcacaaggagaagctgctagatttttgtgatatacttgatgttcagaccaaacacactttaaagaaggttaatttgcttcagcacatgattgtaatgatctaagcagtgaattctgtagtaacagtattttgctgtactcaggaggaagtttctgccaaattgctggagtttctggagtctccttgcattaccagagatgttgttatcagtgatgtgaagaaagggaagaaacgccggaggaagtctaaaggaacttctggagagaagaaaaagaggaagagccggaaacaagcagttgaggctgaaaaagagaatgatgatgaagatgatgctggtcctgctggttctgaggacgcatcaatgggagaaagtgatgaggactctgaagtgaaagaagaaacca

SEQ ID NO: 1201 - DNA, 351 bp, Triticum aestivum
  Clone ID: LIB3280-030-P1-K1-F3
taaggaacaggttaaaagaaaggcttgacaagatgcacaaggagaagctgctagatgggggagatgtacttgatgattagaccaaacacactttaaagaaggttaatttgcttcagtacatgattgtaatgatctatgcagtgaattctggagtaacagggttttcgctgtactcaggaggaagtttctgccaaagtgctggagtttgtggagtctccttgcattaccagagatgtcgttagtagcgatgtgaataaagagaagaatcgcttgaggaaaactaaaggaacttttggagagaagatgatgtatgcagatccttaaacatgcagtttatggtgaaaaagagat

SEQ ID NO: 1202 - DNA, 437 bp, Triticum aestivum
  Clone ID: LIB3280-030-P1-K1-F4
agagggctgagcagagaaaccatgtagccattgtggttcaccaagggagtgtctctggcaaagccgttcctcttccttggtatatgtgtgcgtgtgtgtgtgtgttcatgagagagttcttgagagaaaacacaagagaattgtgtgagagggagaagagagttgtgagaggcaactcgaggtagaagaagaagtggcgctgcgaggtgaggtggcgccaacaattggcatcagagccttgttgatccgtggcggcgacgacggtgccggcggctatggtggccggcgtggcgctgggcgcgaggtgatggctggcagcggcgcgatgccgcgggcggccggttgcggtgcgatgccgcgagatgaaggtggtgcgatgatcggcgtcgcgaggacgtcatccacgacaagatggtccgtggtgaccggcgctgcga

SEQ ID NO: 1203 - DNA, 399 bp, Triticum aestivum
  Clone ID: LIB3280-030-P1-K1-F5
ggtttgtttaacttatatatgacgagccactaatccactattattacaattggtaattaagttagagatcctcttccagtagcctcgtgtgtattagaactgacttattctgaactaaatacaattatttcatggtcctatatataagcaacaagaaacaacaaaacgtctagaaaacgctaactatagaagaagaaaaaggaaacccaattggccgtacgtctagatgcatggctctgggtgctggtagccaacataggtggcattggcgttctcgcagtgtgacaaggtgcctgcctgtccgttgtagctgaggtcgacgttctgcagcacgacgtcgcggcacggcacgccgcaccggagcagcacggccacgggcaacgtcgatgttcccttgat

SEQ ID NO: 1204 - DNA, 267 bp, Triticum aestivum
  Clone ID: LIB3280-030-P1-K1-F6
aatagagctagggaatggtctgccagatatcagaagtactcggcaatgtcttcaagctgttaaagatgctgggtttgaggttatttgggacaaggatcttgctgaagattctccgttgccttggtacttgcccttggacccaagtcggttttcattgagtagtttccggttgactaccgtgggacgaataattactcgcaatatggtcaaagtattggaatatgttggtctggctccggaaggcagccaaagggtctctagtttctt

SEQ ID NO: 1205 - DNA, 312 bp, Triticum aestivum
  Clone ID: LIB3280-030-P1-K1-F7
aggcactcaatgcatatccaatgactagctttctaaagatcaactactcctcagaagaggttttttatcatctcactcccccaaaccatcttttcgctgcttcttttgccatacatgcaaccaaaatatcttcttattacactgtcctaactataaaatttccccccactacttagaaagttcttccaacaatctacagcattccaaacctcgcaagcattgaaaatgcgattacattaaaccttttgatcttgacttacatcaactacctaaatgaataccttaccatctaaatccatcacccaaccttta

SEQ ID NO: 1206 - DNA, 366 bp, Triticum aestivum
  Clone ID: LIB3280-030-P1-K1-F8
atcaaactgttacctcattcattccagtatcgtagagagaacggcccggttaaaacaacaccgccaaccaggcggcgtcaggttattcaggtgtccatgcagcgcgcacagatgacaaaacggaaccgaaccgaaattcttacaaaaagatgcaccatactgttctgagtttggcactaattgccgtggcgcgacaagaaaaaaaggttcagctgcggtttattttactgccatggcaggcagcgggcatgtcagcgtccctacgtttccgggatcgactcaaaatttgtataccatatctgccgtgtatcctaaatccttgagaaggccagtgacctcgccctgtgaataatcctttgccttatt

SEQ ID NO: 1207 - DNA, 338 bp, Triticum aestivum
  Clone ID: LIB3280-030-P1-K1-F9
gtcttgctatcattctggtgcgcaatttatgggggtacgcatacagcaacgaaaaggaagtggtggaatacattgccagaatgatgccaattcttgccgtgacattcttgtttgatgacctgcagtgtgtcctttcaggtatcgttaggggctgtggcttccagaagattggcgcgtatgtcaatctcagcgcgtactaccttgtcggcatccccgcggctttatattttgcctttgtgtaccaccttggtggaatggggctgtggttcggattaacctgtggacttgtcgtgcagacagtgttgctcctgtccatcaccctgcgaaccaactgggac

SEQ ID NO: 1208 - DNA, 390 bp, Triticum aestivum
  Clone ID: LIB3280-030-P1-K1-G1
cccacgcgtccgtccatcgatctccgtctccacatcgtacgtttcaccggggaaccatctatggtctccatggcggcggccaagctcgccgtcctcctggccgtggcggcactcttcgccgtggcggaggcagcgaatccccaggaagctcactgctggcagtgctactactcctgcatgcagcagaagtgcggcggctaccgcaacccagccgcccacacagccgtcgacgacggtacggcggccgcctccgtccccctcaactccaccgacggcactacagccgtcgtgcaccccgccgatggtggtgcagccgcccacgtcgccggtgggtacgagagctactgcaagtgcaacaaggcgtgcatcgtggactgctacaaggccctg

SEQ ID NO: 1209 - DNA, 359 bp, Triticum aestivum
  unsure (1)...(359): unsure at all n locations
  Clone ID: LIB3280-030-P1-K1-G10
gctagcggatacccgcacggtaccattgggattataggaatttgtatacacacagaatcatcagccttatttaatcccacaaaaagaaaagaatctatggtcttttttgaacactccatacaatgtactggtgtctgcatacggagacacgaacttactagccttatttaaccgctttggtgctggtaaaccgtcgatcagtccttcagctgcaggctgggcatggtgtagtcgccgcacttgtagccgatggggcggtcggccaggtcgcagcgcttggggatggtgatggccacctccggctagaccccgacccggcgcacgatcttggagagcagcaccgcgcanaggcacgcggt

SEQ ID NO: 1210 - DNA, 330 bp, Triticum aestivum
  Clone ID: LIB3280-030-P1-K1-G11
gagtaacataacatgatagatcaacctgggaaatacaagagtcctgcaagttgcaacgtagtcaaagtataatacaactataaataacttcaactgaatggcaatacattccttgtgctccggcatcgtccacctatgagttgaccgggacgtcttatttattccagcagtgctaactgcgctgcttacgttatccaagcttgccattcagccggccttttcttgcttcagaccattccttccacctttaagcgcattcacacacacacacaccacagaccaccttttcccgcccaagcattcccattcgcattcttatccatggccccc

SEQ ID NO: 1211 - DNA, 437 bp, Triticum aestivum
  Clone ID: LIB3280-030-P1-K1-G12
cccacccgtccgaataaatataccattgggggttgccgatgagctgtgggccaatgagtgagagtgctcaagacatcatgctggaatccttgataaatttcgtatagagagatcacaatctcaatagccagcagaattatgacaccccactccagaaaattcgaccgtctattttggagcacttcttgaagaaaatgaatattgtgctccacgaatttcagtttgaagtctaggcttccaaaacgttgattcagttcatattcttcccgaagatactccagaatttgtgcataatttgcatttttccaagcaatttctgacctgtcaaaaaggccgagtctaatgataacatctgcaagattagaattagccttgcccacaagttgaaagagcttctttcttttcattgtgaagtccccagtcttcttcatgatacg

SEQ ID NO: 1212 - DNA, 210 bp, Triticum aestivum
  Clone ID: LIB3280-030-P1-K1-G2
gtcactacttctaacaggcgagaggctgcacgcgatctagcaacctcgcccgcctactggccgtcgcgagtctcttcgcgcgtcgcggaggcagtcaatccccacgaagctcactgctggcagtgctactactcctgcatgcagcagaagtgcggcggctaccgaaacccagccgcccacacagcctgcaacgacagtacggcggtcgcc

SEQ ID NO: 1213 - DNA, 403 bp, Triticum aestivum
  Clone ID: LIB3280-030-P1-K1-G3
catggagaatgatgacaacgaggttgtcaacgatgaaggagtcgagccaaaggacatcgagctggtgatgacacaggcgggcgtctcaagggccaaggctgtcagggctctcaagtctgccaatggagacattgtcactgccattatggaggtcacaacttaagagtatggcgacatttctggaactagttgaaccatttctctttgagcgatttgcagcttgagttggtacagtgtttgctttgcatctctgataaggtcgtttggacatgatcctgcctgcggttaagttggtacagtgtttttagcacggacatgtcagtggtggcaattttctggcatgtttttcacctttgactgaaatattattagatttaatttaaataaaccccggtgtattctt

SEQ ID NO: 1214 - DNA, 401 bp, Triticum aestivum
  Clone ID: LIB3280-030-P1-K1-G4
tatggataaagatgacaacgaggttgtcaacgatgaaggagtcgagccaaaggacagagagctggtgatgacacaggcgggcgtcttaagggccaaggctgttagggctctataagtctgccaacgtagacattgtcattgccattatggaggtcacaactgaatagtttggcgacatctctcgaactacgaaaactatctctctttagagcgcaatgcatctggagatgatacagtgtttgctgtacatatccaataaggtcgttgggacataatcctgcctgcggatagcttggtccagggttcatagcacgagacatgtaattggaggtacttttttggcgtgttgtagacctttgactgaagtattattagattgaattgaaataaacctttttgta

SEQ ID NO: 1215 - DNA, 156 bp, Triticum aestivum
  Clone ID: LIB3280-030-P1-K1-G6
cttgtcatgtttaaattaggccaaggtaacacacactatgcatataatacgctgcagggaggttgttatctggaaagcaatgtctacgtgggggccttctcttagaatatatatgtacaaagtcagattgctctgatattataataaaacccttct

SEQ ID NO: 1216 - DNA, 386 bp, Triticum aestivum
  unsure (1)...(386): unsure at all n locations
  Clone ID: LIB3280-030-P1-K1-G7
attggagtcgtttgctaaatggattgcttcctcctcagttttgaatggtataagtggtgcaactggaccaaaaacttcttcactgaaaagaagcatatcattgcttacattccctaccacggttggctcataaaagctcatcccaaggctgtgccttttaccaccgagcatgatgttggctccctntgaagtagcatcacctacaaacttctctaccttttgaacagcagcttcattgattagaggaccctgtgatgtactctcttctagcccattaccgacttggcaactctgaacaggcttgacaaatgcccttgcgaattttttatagatacctttttggcaccaatttccggtttggacatccacacgtttgtccactgttc

SEQ ID NO: 1217 - DNA, 352 bp, Triticum aestivum
  Clone ID: LIB3280-030-P1-K1-G9
gatttttgtcaagacactgaccggcaagaccatcaccctggaggtcgagtcctctgacaccatagacaacgtcaaggcaaagatccaggacaaggagggcatgcccccggaccagcagcgtctcatcttcgctggcaagcagcttgaggatggccgcacccttgctgactacaacatccaggagtccaccctccacctcgtgctaaggctccgtggtggcatgcagatttttgtcaagacactgacaggcaagaccatcaccttggaggtcgagtcctcggacaccattgacaatgtcaaggctaaaatctaagacaaggaaggcatccccccggaccagcaacgtctgatc

SEQ ID NO: 1218 - DNA, 268 bp, Triticum aestivum
  Clone ID: LIB3280-030-P1-K1-H1
ccgcccaggagctgtcggaggagaaggcgctggcctactcatgcctcgcgtaaatccacattcgaagggcagctgctcctctgatgttttgaataaatgaaaccttccgctccttagaaactctcgtctccacccagaacagccgcacatcgcgatgcatgctccttttcgctggttttcccagtgtgtatgaatgaggcttgtagctccccttttgcctgatgatttacaggacagtacatttgctggaaggatgaaacaatttgac

SEQ ID NO: 1219 - DNA, 437 bp, Triticum aestivum
  Clone ID: LIB3280-030-P1-K1-H10
ccatcaataagcatcccgccgcggcgccaagatccaagaagcatcacaggaagaagcggcgccatgaaccttgggcacgtcgaggaggaggtcgggaagctccgggaggagatccagaggctcggccagcagcagcccgacggctcctacaaggtcaagtttggtgtcatcttcaatgacgaccgatgcgcaaacatatttgaagcattagttggcaccttgcgggccgtcaagaagaggaaagttgtcacctacgacggtgaaatgcttctgcagggtgttcatgacaatgtggagataaccctgttccctccccccacggtcgctgccacttgaagtttgcaacaccggcaagtctcccacattattgtgtcaatctgcttgtaatttgttgtgcttaaattcccatgaactgtttggtgcttagaagagtacta

SEQ ID NO: 1220 - DNA, 419 bp, Triticum aestivum
  Clone ID: LIB3280-030-P1-K1-H12
tcgcccacttttacgttttattaaagcagtaggtattgactggtgagccgctgtagaaggagtaagagtacttaagacatcatgctggaatacttgttaatttcgcatagggagatcacaatttcaatagccagtagtattatgacacctcactgtgaaaaatttgatcgttcatttctgagcagttttggaaaaaaatgaatattgtgcttcacgaattccagtttgtaggctaagctttgcaaaacgttgatccaggttatattttttcctaagttactgcaaaatgtgattataaaatgcattaattcaaggaattgctgacctgataaaaaaggctgagtctaatgattacactctttagataagtatttgcctttgcctcacaaggtgtaagagcttttttttttttaattgtg

SEQ ID NO: 1221 - DNA, 431 bp, Triticum aestivum
  Clone ID: LIB3280-030-P1-K1-H2
ctggcaggcaccggtgatcactcatttgagagaaggctccggcttggtggacctcttttgaaggacaatattgcaaccatggttcttgagagcccctattatggacaacgacgtcctagcatgcagcatggggccaagcttcaatgtgtgagtgacttgctactcttaggaaaagccactattgatgaagctcgcagtctcttatactggttgcaggctgaggctggttatggcaagatgggcatatgtgggctcagcatgggcggtgtacatgctgcaatggttggatccttgcatcctacgccaattgccacactaccatttcttgctccacattctgctgttgtacctttctgtgaaggactttacagacatgccacagcttgggaagcactgagggaagatgcagcagcattagctaaagatgcaac

SEQ ID NO: 1222 - DNA, 307 bp, Triticum aestivum
  Clone ID: LIB3280-030-P1-K1-H4
gaatagaatcacaacaaatatcattcaatttgttcgaatgaaatgataacacggcgccattggccacgggttacagacgcggattgggttgagtttaccaaacgggtcgaaaagaggaattacatgtagtagtgccgataaatgtgcggcgtaatcatcatagagtggtcattcgttgatcggtggattgaattgaaattaaattaaatttaaatcaaatcaaccgacgcgtctgcgtggcgccgcgtgggagcgtgcgcgtctcagtgcaggtagtaggcgacgagggagacgaggagcgcggtgg

SEQ ID NO: 1223 - DNA, 430 bp, Triticum aestivum
  Clone ID: LIB3280-030-P1-K1-H5
cccacgcgtccgttttttttttagaaataaaaatatataattgaagcacaaaggtcatccagaaatatatttaagcaccagaatgcactgcaacaacatatctgaacatgcagcagcaacaccccactactattcacatttacagaaccaacatatgacaagaaacaagggctagactgtagtgtagcaagctgggatggcagcaatcgtccacagcgcatacatttttttttccttctgtggcttctgaggccatccatggcggccgtctctccacggcaaagcgtcctatgatgagcagcacgacgtgctgctcaccatcctctcggccggtctctgtgagagcaccatccccgcctgcgggttctgcgcctgctgccctgcgagcagtctctttgcgagctcatagaatacgtcgttcacattgatg

SEQ ID NO: 1224 - DNA, 261 bp, Triticum aestivum
  Clone ID: LIB3280-030-P1-K1-H6
cccacgcgttcgttttttttttagaaataaaaatatataattgaagcacaaagggcggggggaaatatatttaagcaccagaatgcactgcaacaacatatctgaacatgcagcagcaacaccccactactattcacatttacagaaccaacatatgacaagaaacaagggctagactgtagtgtagcaagctgtgatggcagcaatcgtccacagcgcatacattttgtttaccttctgaggcttctgaggccatccatg

SEQ ID NO: 1225 - DNA, 347 bp, Triticum aestivum
  Clone ID: LIB3280-030-P1-K1-H7
gacagttcttcggaagaagacaatctattctttaagaagtacgataaagctaagccagaactgaaaggtccaataaaagatttttcacaatacgaagattatttgcaggagtacaatgagaaatataaggtctactcttacttgaacagtcagatagagaaaacacagtctgagttcctaaaggttcaggaggatttcaatgttgctaaagaaagagacaaggataagtactattacattgttgacagactcagagacatgtaccatgaatcgggcacaaggcataaattgatgaagaaggtcttcgtattgcttcatgaagaattgcagagtttcaagcaaagaat

SEQ ID NO: 1226 - DNA, 421 bp, Triticum aestivum
  Clone ID: LIB3280-030-P1-K1-H8
cggacgcgtgggcggacgcgtgggcgcccagctccaacaacaccggtgatcccctcctccggcgtcggcgaccttcctcagctatcgtccccgcgtcgccctccacatccaccttttcttttgttccgacgtagccatgaattacatcatcggcgccttcaagccgccctgcgacatcttcgtgaccttttccgatgagaggagccggaagcaggttgcagtcaagaaggataatggaaagacaaccatggtgccggcgttccagagcctggagaccatagccggagaggtatcaatagcgcctgttcctggtaaaaggattgagcacatgggtgttaagattgagctgcttggacagatagagttgtatttcgacagaggcaacttctatgacttcacttcactggtgcgtgagttagat

SEQ ID NO: 1227 - DNA, 299 bp, Triticum aestivum
  Clone ID: LIB3280-031-P1-K1-A1
gttacatgaagagcgacagtcgcatggacaaagttaacgccctgggcgagcgcctgaagatcagatgctcggaagtcagccgcaagatgtccaccggcgtgactagcatgagtttgaagatgaaggagtttttccaaggccggaacatggtcgacaggcttggtgacgaggcctccttgcagaccatggacggtcccggttgggctacctagcctgagatatgcgatatggccaacaccaggagggtcaacagcgttgatctcatccgctccatcaagaggcgaattatgctcaagagc

SEQ ID NO: 1228 - DNA, 239 bp, Triticum aestivum
  Clone ID: LIB3280-031-P1-K1-A10
ggaaagcccaagaatccccagagccccaccccgagatcccgagctttctgcgttgctccgtcgcaatccacaggaatccccatcggaggtttcgcgtcctccgtgcggttcttgatccagggtgcgcaccgaggactcgccaatgcagccggacgcgagcggcaacgctggcgggggcggcgcgaattcgaggccttagctgccgccgctgttcgtcttgacaattcctattttaagta

SEQ ID NO: 1229 - DNA, 406 bp, Triticum aestivum
  Clone ID: LIB3280-031-P1-K1-A11
caatgaaggaactcctgaatatcagcagcaaccaccatgaatacaagaatctgttaaaagaactcgttgttcagggcctgcttcggttgaaagagccagctgtactgctccgctgccgcaaagaagatcaccataatgtggaatctgtactgcattcagcaaagaatgagtatgcatcaaaagcagatgtccatgagcccgagatactagttgaccacagtgtctacctgccaccttctccgagccatggcgatgagcacggccagatttgccatggaggtgttgtgctggcttctcgagatggaaagattgtgtttgagaatacagttgatgcaaggcttgaagttgttttccgcaagaaattgccagagatccggaagcttcttgttgcggcataatgcgcact

SEQ ID NO: 1230 - DNA, 306 bp, Triticum aestivum
  Clone ID: LIB3280-031-P1-K1-A12
caaagaaggaactcctgaatatcatcttctaccaccatgaatacaagattgggtgaaaagaactcgttgtgcagggcctgcttcggttgaaagagccagctgtactgctccggtgccgaaaagaagatcaccataatgtgcaatccgcactgcattcaacaaagaatgagtatgcatgaaaagcagatctccatgatccctaaatactagtttaccacagtgtctacttgctaccttctccgagccatggctaagagtacggccagatttgccatggaggtgttgcgctgtcttctttagatggaa

SEQ ID NO: 1231 - DNA, 214 bp, Triticum aestivum
  unsure (1)...(214): unsure at all n locations
  Clone ID: LIB3280-031-P1-K1-A2
cgaatcgcaatttcgacccacgcgtacgcttcatacaagggtactatcaaatggagaaccaataatattgctgcctngcccttgatgagtagattctttcagggcacacacactttctccttctttttcaggaacatgagccgaatataaattacaacttccccacgtatgcttgttctatgggcgacttgacaatcaatacttccagattaat

SEQ ID NO: 1232 - DNA, 398 bp, Triticum aestivum
  unsure (1)...(398): unsure at all n locations
  Clone ID: LIB3280-031-P1-K1-A4
cccacgcgtccgcctccgcggagcctgaggacgagatggaggcatcatcgagccatccctgcaggctcttgcccgcaagtacaaccaggagaagatgatctgccgcaaatgctacgcgcgcctgcacccaagggctgtcaactgccgcaagaagaagtgtggccacagcaaccagctgaggcccaagaagaagatcaagaactagagtgctactagtcagtttcatggaccggttgaatccattgctgtgttagcgtttatgctattgtcgtctcgttgtcgttgaaccttattttactttgctttcagcctccaatcgttgtggtgatgataattgacagtattggtatatggtagcaaacctataantttgccgtnnaaaaaaaaataatttatat

SEQ ID NO: 1233 - DNA, 382 bp, Triticum aestivum
  Clone ID: LIB3280-031-P1-K1-A5
aataaggacgaacttgttctgaatttaataggaggctcctattcagttcatcacaacccctgctgttttctttttcttttggagaacagcacaagaatatttacacccggcgaataaaaacgaaaactacttgcgtcatccgcatgacacgtacatgtacatttatccgaaaatacgtggattaaataaagcctttttaccactcaaaggggcgcacggaagtggcaaaagggatcctccgtatgccaccggggcgccgagaagtggcgcgtcgtcatgctcttgcccgcctgggcgagctggcgttgcgggcgggcgcgaacctggccgtgaagtccggctcgtggagctcaaggctgctgtcgtcgaagttctgcgcgta

SEQ ID NO: 1234 - DNA, 426 bp, Triticum aestivum
  Clone ID: LIB3280-031-P1-K1-A6
agaaaagataaatcgtgctcatttcatgttaaataagatcgagaaagaaaagactcttgaggtagagaatcttgagagggaggtcgtgagcctcactgcacaggtctcctccacacacgaggagagagaaaatgccacagtagatgccatccgggaggtctctgtcctgcgagctgaaaaggccaaacttgaggctaatttcgaaaatgtcagtgcacagttgagacattatgagtctcaactggaggaccttcgcaaggagtccaaaagcaagattaaaggtttggttgattctcttaatgcatccaaacagagcgaggaaatgttgacagcagatgcagaacatatgaagaagttgatggaaactgctaaatccaatgaagacgagttacggaagtcttctggtgaactagagttaaagcttat

SEQ ID NO: 1235 - DNA, 81 bp, Triticum aestivum
  Clone ID: LIB3280-031-P1-K1-A7
gtcttattcatccaatcttacttacgcgtgcatgctaagtcatagcttttctatagcgctacctaaattcaattcagtgat

SEQ ID NO: 1236 - DNA, 69 bp, Triticum aestivum
  Clone ID: LIB3280-031-P1-K1-A8
gttcattcgagctaccatacgcgtggatgcaaagacataggtattctatagagacacctaaatacaatt

SEQ ID NO: 1237 - DNA, 387 bp, Triticum aestivum
  Clone ID: LIB3280-031-P1-K1-A9
cccacgcgtccgcggacgcgtgggccgccgccgcctcctctcggttccttgtgcttcctcggagcttcagccatgggtaaagagaagactcacatcaacatcgtggtcattggccatgtcgactctggcaagtcgaccaccactggccatctgatctacaagcttggaggtattgacaagcgtgtgatcgagaggttcgagaaggaagccgccgagatgaacaagaggtctttcaagtacgcctgggtgcttgacaagctgaaggccgagcgtgagaggggtatcaccattgatattgccctggggaaggtcgagaccaccaagtactactgcaccggcattgatgctcctggtcaccgggaccttatcaagaacatgattactggt

SEQ ID NO: 1238 - DNA, 293 bp, Triticum aestivum
  Clone ID: LIB3280-031-P1-K1-B1
gatgaagcactacgcctgaggcagatgtcaaagtactcgctctactctgatgaccgccagcggtctggcctggatgccatctctgacatatactccatcctgagagatgaagcagcaaggaccagcagcatggatgtgaaatatggtcatgctcttaacctgatctccagaaagggatacagtgaggctcagttgaaggagtgcctggaggagtatgcatccttgtacgcgtggcagatccacccaagcaccttcgacattcacttcatcgatgcctgatctgggaagcgaac

SEQ ID NO: 1239 - DNA, 200 bp, Triticum aestivum
  Clone ID: LIB3280-031-P1-K1-B10
atccttattagttataaaaggggacaggggaggcgggcttaagaagtggtggatccgcacaaagtcatagcaatgatactgagaaggattcaatgcaatttatggaagagactcctatatctttcacgaagaaccttgttgcattgatttgtaatatgggtaaggttcatttcatacattctgtagtagtggtattattt

SEQ ID NO: 1240 - DNA, 456 bp, Triticum aestivum
  unsure (1)...(456): unsure at all n locations
  Clone ID: LIB3280-031-P1-K1-B12
atggaagtgcagggccgcggcactcttgctggcttctacgaggcgtactgtcgagcgtcacgcttcggcgggatagtctgacccaccgcggtctcggtaccaacacananttctacgtagaaatctcgcttgtgcctgagcgacacaaagaaatctcgacagtgagagcatgtcnagtgagggtgaccgaatgctnnagggtcttatgagttgagccatgatagtcgcttcggtgtattgcattttgtgtttcaagttatgcagactggtgcattctaaaancggtaccttctgaaagagagaagctcagtctgagattatatacctcctgtgcagcatacatacattctatgctctatttagtactagctgaaatataataattttgccagaatggatgttaagcaattatgtaatagaatgatagcatgttctcacctaatcccaggttcagat

SEQ ID NO: 1241 - DNA, 415 bp, Triticum aestivum
  Clone ID: LIB3280-031-P1-K1-B2
cggacgcgtgggctcgcgaataatccaccgcaataagcacataaacccacctccatccgcgcaatctctcaatcttgcaaaggcatcaatggcgggcgcaaggaacaacgagctgcgcatgaccctgctcggcctggccctgctggggctcctgctggtgagccacaccgcggctccggtggaagctgccgcgggcgtgcaggagaacagcttctccatgaacggcgccggcggccgcagtctcaacagcttcagcatgaacaccgccgagggcgagggcgccaagggggggaaagccaaacccgccgccggcgacttctgatcgacgaccctccgtccgccggcgtcgagtactaattaaataatttatcctccggttaccccgggcttgcatgcatgcatgcacgcatggctc

SEQ ID NO: 1242 - DNA, 287 bp, Triticum aestivum
  Clone ID: LIB3280-031-P1-K1-B3
gtacgcgtgggttcgcgaataatccaccgtaattgcacataaacccaccttcggcgggcaatcttcaatgttgaaaggcatcaatggcgggcgcaaggaacaacgagctgttcatgaccctgcttgggctgcccctgtttagggctcctggtagccagccacaccgcatctccattcgggggtgggacattcttgacagtctgcaccttccgcatgtttttcggggcgacaagcataacaaatggttttacgacatacacgggtttctgcttatcgcaaaacttttg

SEQ ID NO: 1243 - DNA, 257 bp, Triticum aestivum
  Clone ID: LIB3280-031-P1-K1-B4
aagtaccattcattataaataaactcatcgagacaatccaaaacgttaacaccattcagcctcacagataaggtgcaaattcaagagggcggggtaataacttgacaaaggtctatgatagtaggataggaaacaaggctaggcagcacaactctatgtctattggcgtaatcgactttcaacgcactttcaacgcttcccgccgccgccgccaatctttgggcccttggaacccttctgcacggcgcccttgcgac

SEQ ID NO: 1244 - DNA, 404 bp, Triticum aestivum
  Clone ID: LIB3280-031-P1-K1-B5
agaagctcaaggaggtggaggccgcgtgcaaccccatcgtgtcggccgtgtaccagaggtccggcggagctccgggcggcgagggcgccgacggcggcgtcgacgacgaggaccatgacgagctgtagatgggtttaaaggggaaccaatttttgtaatgggttagtagggagaggagacatggataattggtgctacttactttgtgttggggttgggggtggtcgggtttattcgcagacaccggagacttgctgatattagtctgttggccgcgttgtagagaactctctttgctgctgctgctacttccttcggaggctgcttcgttttgttattatatagccggatggattcgaatcggaactctatgtgaagaatagatgatgctggtttatctaaaa

SEQ ID NO: 1245 - DNA, 412 bp, Triticum aestivum
  Clone ID: LIB3280-031-P1-K1-B6
cccacgcgttcgaccagcaggagacgaacgagctcgagggctcctccgccggcggcgggggaggcgggcccgagtccggcaacgacccctctggcgccgacgacttgcactccccgacgaccaccggagcgcagcagcacccgcagcagcaagtagtaatgcagcacggcggcggcaggtacggccaacaagagcacggtatgtccggcgtccacccccataagctcgaccccggcgcggggccctcggtggcggacgccgccttcgtcggccttgacccggcggagctccttggcggcgacgcgcacgtgggtgccgcggacgacctgtacgggaggttcgagcccggggtgaggatgaggtacgggcccgccgcgaccggcgcggtctccggcgacgtgtcgcttacgct

SEQ ID NO: 1246 - DNA, 397 bp, Triticum aestivum
  Clone ID: LIB3280-031-P1-K1-B7
gaggcatgcgacctgcccctccgccacctgatctatgagctccagcaaaaaggctggagctcatagatcaggaggcatgcgacctgcccctccgccacctcaaccggagaacccaacattttgcctattcccaccgggttcatctggccatagttcaatggataccgatgaagctggaggaagccgattctatgcctgggagcgcgatcgcttcgcgccgtacccattgatgccggtcgactgcgagacgagctggtggagctcacagcagtcccacggcgcatcagaatccacacccgcacctgcaccaaggagactctttgggcagtggatcggcctcggcaggtcgtcgcccgagaatagatcgcccgagggctcatcgtatcgacagatgcac

SEQ ID NO: 1247 - DNA, 409 bp, Triticum aestivum
  unsure (1)...(409): unsure at all n locations
  Clone ID: LIB3280-031-P1-K1-B8
aacaaaatgaaaataatgaaaacgttgatattcctgcagtaaggtctgaggtggatggctctgcaagtgctggtcctgcacctcctcacagtgatgaacttcaaagagatgcatccaatgcaagtgagcatgtcgcagatatgcaatatgaacgtagtgacacggctgtccgtgatgtggaagcagtaagccaagcaagcagtggtagtggtgctactctaggggaaagcctcagaagtttagatgttgaaattggaagtgttgaaggacatgatgatggtgaccggcatggggcttcagacaggacacctntgggtgatgtacaggcagctactcgatcgcggaggccttctggaaatgcagtaccagtcagcagcagggacatatcattggagagtgttagggagat

SEQ ID NO: 1248 - DNA, 357 bp, Triticum aestivum
  Clone ID: LIB3280-031-P1-K1-B9
gtgtgcaaggcagcggagcagaggcttccgacagaggagaggagacaggggagccatgcaggcgaggcggtagatccggacgaagccggagcagcgggaggaggaggatgcagtgtcagcggtggcggagacgccgatgagcgcgcggtggagcccggaggcggagatcgggatgcgggtggaggacatctgggacaggctggaccagccgcagttgtgtcggagcgacaagctcaacagctgcttcgacgccatgccggtctgctccttaccgcagaccttaggggcgcagctggtggacatgcactcctacgccacgctggccgagggcgtctacatcctctgccggaaccggat

SEQ ID NO: 1249 - DNA, 228 bp, Triticum aestivum
  Clone ID: LIB3280-031-P1-K1-C1
aacgggtagttcggttgggttatttattacatgcaagacaagaacaggggcccagacgcatgggaaataaaaactgtggcgcccaatcgaactccggagaatcttaccggatatgggacggccagcaaccttagtacgattgttgctactactcaacctgatgggatggtttggcccgggatagatctagaaagagcttgatgtcacacggggtgcccgcgcatggag

SEQ ID NO: 1250 - DNA, 67 bp, Triticum aestivum
  Clone ID: LIB3280-031-P1-K1-C10
cccacacgtccgctcgccactaatctattttataattcacctaatcctacgttggtgtttacaaact

SEQ ID NO: 1251 - DNA, 404 bp, Triticum aestivum
  Clone ID: LIB3280-031-P1-K1-C11
aaaaaaaaaaaaaaaaaaaaaaaattaataaaaaaaaaaaaaaagaaaaaaggtatgggggtaaaagagtttacgtttgggcggatgctacgtttcgtctgttttattgcgccatcttatgtttttctcgtgtccctgtatgcaacttgattgctgtctgttgcctgtgttttactgggttttccttggatatacctttttggatccccttttagtcttttacgtttcggccgttggcgttatggccttttggtccggtcggtttgttttatgggcgcttgcccaggcggtgtgctttttgtttggcccctgggtttggctcattaagtgccccttttccggtgctctttcccaagtcccccgcaccgtttcctttccttttttcttttttttttcgctttttt

SEQ ID NO: 1252 - DNA, 400 bp, Triticum aestivum
  Clone ID: LIB3280-031-P1-K1-C12
tacggctttatacaattattttgaactaattcgttttatgacaggtctgtatactgctgcaaatccccttttttccactggcgatgtgtacaccaggaccttggtgataacctacacaaggcaaggcgattgttgatggtttcaagaacccttaggccgcgaacttaaaaaataataacgcaataatgctctgatagttaggtaaataaacacagctggtagagagttgagtaatacatttttcacccgcaaaaaaaaaggtgcatagttcgacatgcagacctgttgtgccaaagttctgaaataagactgcacattattcttaacggggaacttggactctcactagatttgcgtgtgctatctcaagtgttcaatgagataagttcgagggagatgg

SEQ ID NO: 1253 - DNA, 372 bp, Triticum aestivum
  Clone ID: LIB3280-031-P1-K1-C2
gtcgacagatccgtcgcttgctccctgttcgaggtttgtgacgaggacgagcagcagattcgacgcgcgcctccgaggttcttcctggaactaatttgatgtgctatggaatccaagggtggtaaaaagtccagcagtagtcgttcctccctcatgtacgaagctcccctcggctacagcatcaaggacgtccgccctgcaggaggcattgagaagttccgctccgctgcctactcaaactgctccaggaagccatgctgataatccctctcgcgcccccatcctaattgcttagaattcccttctgctttcaattcatctacctaaaatttctctggctagctgcttttctctgaccagcaaagccttttc

SEQ ID NO: 1254 - DNA, 374 bp, Triticum aestivum
  Clone ID: LIB3280-031-P1-K1-C3
cgctaatggctgttaggtgctgatcaatctcctctgtcgtgagcgagcgcgactgagctatgagactgtagctgtcaatgcaccataaactgttattttgtttcatagccagccaagaaacattcagtgaatcatttcatgtgtagcaagaaagacgggcatccactctgccatgtattagttggatcatcctttgtgtggttgaatttgctacggctatttctatcgtcttaacctgtctcagattatgtggtgccgcaacggattttgagattcaagtttggtcatcaatttagccaaggaactcactcgcgcacatattattaattgataaaaataaccttcgtggtttaaattcatttaaataaaatttt

SEQ ID NO: 1255 - DNA, 420 bp, Triticum aestivum
  Clone ID: LIB3280-031-P1-K1-C4
cccacgcgtccgggcgccgcgagcgcgcccttcagttcgccgaaccgggctctcgggatgctgaactacggcagggtttgcaagatcaaggcctgcagtgtggtcctctacatgatcagctggccgcaaaccggagtacgctgtattagaagatgcaagcacatcagatgtctagtgtaatatggcccttgctgtagtttcactgcctgtactattattgaagtaattgatcatggggattttccagaacatagcagagagaggaggtgtgctggtgagtggtgatgcttggtagtagtccataagtgttggtgttgatactgagaatgtcaggggaaaaggatgcaggggatgtctagaacttgatgctgtagtatgttcggacagacagggaatgctagtgctcagtactggtcatgc

SEQ ID NO: 1256 - DNA, 120 bp, Triticum aestivum
  Clone ID: LIB3280-031-P1-K1-C5
ataccttctttatctgtagttgcatgaagaaaatcaatagtatgtaccggctcgaactcgaatttgatcgccttccatactttacaagctgaggctagggcaggactccatttgcaagct

SEQ ID NO: 1257 - DNA, 303 bp, Triticum aestivum
  Clone ID: LIB3280-031-P1-K1-C6
gattcaacaacctttatgagaggactccaaccgccagctgtgggttatttatcatctgaccttggagacatcagaggctacacctttaagtgcgctaggctcaggtcaggttgattttttcaggatcgatattatcagctgcttggcggtggctttcccaatactgcactgacagttagggaaataaacacagctggtagacgagccgaaacatacatttttcacccgtgaatgaaaaaggagcatagttgcacaggcatacctgatgtgccacagtttctgaaacaggactggacattattc

SEQ ID NO: 1258 - DNA, 284 bp, Triticum aestivum
  Clone ID: LIB3280-031-P1-K1-C7
tgaagatgatccttcaccacctgtatatcgtgtattctgagtgaagctcgcggggttgacaagtataacttgctattactctcagaaccttgctccagcattgaaaaatactttgtcggatactcagtttgccagaacatgtacaacctcaagtacggcctccaactctaagacaggatgtgctaaacgcacaccgtctaataagcattcgcccagattatcttctgaccatacttatgatactaggctcatgcgagcgctgaacatttgtgaatttctattta

SEQ ID NO: 1259 - DNA, 418 bp, Triticum aestivum
  Clone ID: LIB3280-031-P1-K1-C8
cggacgcgtgggctcgcgaataatccaccgcaataagcacataaacccacctgcatccgcgcaatctctcaatcttgcaaaggcatcaatggcgggcgcaaggaacaacgagctgcgcatgaccctgctcggcctggccctgctggggctcctgctggtgagccacaccgcggctccggtggaagctgccgcgggcgtgcaggagaacagcttctccatgaacggcgccggcggccgcagtctcaacagcttcagcatgaacaccgccgagggcgagggcgccaagggggggaaagccaaacccgccgccggcgacttctgatcgacgaccctccgtccgccggcgtcgagtactaattaaataatttatcctccggttaccccgggcttgcatgcatgcatgcacgcatggctcgtg

SEQ ID NO: 1260 - DNA, 267 bp, Triticum aestivum
  Clone ID: LIB3280-031-P1-K1-C9
cggacgcgtgggctcgcgaataatccatcgtaatatgcacataaacccagctgggtgcgcgcaatctatcaatcttgcaaaggcattaatgggtggcgcaaggaacaacgagctgcgcatgaccctgctcggcctggccctgctggggctcctgctggggagccacaccggggatccggtggaagctgcctgctggcgtgcaggagaacagcttattcatgaacggcgccggcggccgcagtcttaacagctttaggatgaacaccg

SEQ ID NO: 1261 - DNA, 417 bp, Triticum aestivum
  Clone ID: LIB3280-031-P1-K1-D1
ataccactgaaaaggagaagcgtgcaaagaaaaaacaggccaaacaaaaaaagaacaatcggaaggttaaagacaaggatagagaggaaaaatctgattcaaattttgcagagaaggatcaagatgaaagcacaattcatgatagtgaggattctaagcaggcaggacaagtagccatgaaagttgatacctccgaagaaggtgcttcagacatctcagacaatttagatgggtcagctgaggtatgtcaaactgatgcaggtgacaaaatttcacaacctgtgaatggggtgaatgatgttggtgtttagatgaaaaatgtgcatactgggaagaactctaccgtggagcacaagccactgccgtgtttatcagaatctgctactatgaacattatgcaaggcaaaaaaaataact

SEQ ID NO: 1262 - DNA, 418 bp, Triticum aestivum
  Clone ID: LIB3280-031-P1-K1-D10
gttcgcggcgccggcggacgggggagcggagacgcgtgcctggtgggcggaggggaggatggggaatccgcgtggcggcctcgacgagcagatcgagcagctcctgcagtgcaagcccctcgtcgagcccgagttgaaagcactgtgtgagaaagctaaagagattttgatggaggagagcaatgttcagcctgtgagaagccctgtcacgatatgtggtgatattcatggtcagtttcatgatcttgcggaactattcagaattggtgggaagtgtcctgatacaaactacctatttatgggagattatgtggaccgtggttactattctgttgaaactgtatcgcttctggtagctttgaaagttcgttatccgcatcgacttacaattcttagaggaaaccacgagagccggcag

SEQ ID NO: 1263 - DNA, 346 bp, Triticum aestivum
  Clone ID: LIB3280-031-P1-K1-D11
gttacccgtgccgtcgtacggggtagcgtatacacgtccctggtgctcgggggtgaggattttaaatccacgtggccccctctaccagcatatcgagcagtttttgcattgcaagccctttgtccagcccgatttgaaagcactgtgtgagaaagctaaagagatttttatggaggatagcattgtatatcctgtgagaagccctgtcacgatatgttgtgatatatatggtcagtttcatgatcttgcggaactattcagaattggtgttaagtttcctgatacaaactacctatttatgcgaaattatgttgaccgatgttactaattcttttgataacttgta

SEQ ID NO: 1264 - DNA, 421 bp, Triticum aestivum
  Clone ID: LIB3280-031-P1-K1-D12
cccacgcgtccgcggacgcgtgggcacgaacaggggctccgtaccgcgagagacagaggagaacaccgatcccgccggccggccggcgacgtgaaaccgcgactccggcgagaggagaggcccgaccgcaacgatgggcaacgagatgtcgcccctccagaagcaccgcgcggaataccgccccgagctcccgccctggctccagggcaccgcggtgaaggtggagtacggcgacgccgcgatcgcggctgacggcgctgacgcgcatgtgatccgccgcgcgttcccgcacacctatggccagcggctggcgcatttccttccgaagacggccaatgcgccggacgctacggtcataacagagcaccctgccgtcagggttggtgtcgtcttcagtggtaggcagtccccaggtggtcac

SEQ ID NO: 1265 - DNA, 406 bp, Triticum aestivum
  Clone ID: LIB3280-031-P1-K1-D2
cccacgcgtccgggctagggcagtttttgctagggtgatgtttggcttagcttcgatccagtttattctttcagtttcttttctgttcagtggttagtttggacagcatcatgcagttctccatttgtttagataaagataatgggtgtatttgggacgtaatgtgttatgtgatgatccattttgtaccaggggtttgctaggtctgagtggactgagattttcttaagtctcaatcaattcagaaaagaaagaaaatacaacttgcacttcttcactaaactaaagttgcattttcctagatcgattgagaaacctttatgctgatgaagaacaaagtggtgatagattttacattttcttgtttgctacttcttctgtctcagaatgtaagacttttttttga

SEQ ID NO: 1266 - DNA, 378 bp, Triticum aestivum
  Clone ID: LIB3280-031-P1-K1-D3
cccacacgtccgggctagggcagttattgctagggtgatgtatgccttaacttggatgcggtttattctttcagttgctttcctgatcaatggttagtatgtacagcatcatgcagtcctccatttgtttagataaagataatgggggtatttggcacgcaatgcgttatgtcatgatccattttgccccaggagtttgctaggactcattggactgagattttcttaattctcaatcaattcagaaaagaaagcaactacaactatgactctttcactaaactaaatatgtgtttttctagatcgattgaaaaacctttatgctgatgaaaaccatagtggtgatagcatttacattcccttgttatctacatcttc

SEQ ID NO: 1267 - DNA, 297 bp, Triticum aestivum
  Clone ID: LIB3280-031-P1-K1-D4
cacgggattcgcaagcgcaccacgagaggagaggagccaaagccaaaagagccggcgaggaggaggaggaaggggcgtccaccatgggcgtgagcctggcgcaggcggtggcggagctggtgggcaggtgcgcgcggcggctgtcgcgggcggcgcggcggctgcacgtgcgccgcccgccgggctcatccttcccgtcgcgcgccgtcgtgccgttcctcggggcggacgggggcaaggccaagagagcgctgtcgtggccggcgacgttctcgtcgaagaaggggagggaggcgg

SEQ ID NO: 1268 - DNA, 424 bp, Triticum aestivum
  Clone ID: LIB3280-031-P1-K1-D5
agaggaaaagcccagcaatgtcggggcggcgcgggcgcgggcgcgggccgccgacgcaggcggaccgcctgatgcgcggggccatcgaccacttcggacggatgggctacgccgaggccgacatccgcagcaccgtcgggcaactcatcgaggtctatggtgaggatgcttcgtcgttcctgaaggaagatgactaccgggtcgtgcaggacgcactatttgagaagcaggagcaggaagagcagcagcaggagcctaaacaaaaggaagcagcaatctctgaggcaccaacagcaagtgacatgccaattgtggacatgcacaatgagatgccacctggggctgagttatcagttgagggagcagaccctatgcccatcgacccgcctgctcctgaggctacaatggcacatcctgcagctac

SEQ ID NO: 1269 - DNA, 373 bp, Triticum aestivum
  unsure (1)...(373): unsure at all n locations
  Clone ID: LIB3280-031-P1-K1-D6
ataggaaaagcccagcaatgtcggggctgctcgagcgcggtcgcggtccgccggcgcaggcggacctcctgatgcgcggggccatgaaccacttgtgacaaatgggctacgccgaggccgacatccgcagcaccgtcaggcaactcatcgaggtctatggttaggatgcttcgnngnataccgacccgagctcccgccctggctccagggcaccgcggtgaaggtggagtacggcgacgccgcgatcgcggctgacggcgctgacacgcatgtgatccgcctcgcgttcccgcacacctatggtcagcggctggcgcatttcctttcgaagacggtcaatgcgccggacgctacggtcataacagagcaccct

SEQ ID NO: 1270 - DNA, 414 bp, Triticum aestivum
  Clone ID: LIB3280-031-P1-K1-D8
catctccacaaatttcaccggagaagcatggcctccatggcggtggccaggatcgccgccgtcttgaccgtggcggcgctcttcgccgcggcgggggcagcggatccccaacccgcaaagggagcacattgctggcggtactactcttcctgcatgcacaagtgcgacggctaccgtgatgccgccgcccgctccgtcaatcgtactcagcccgccgtccacacaaccgtcgacgatggtgcagcagccgcctccatccccgtcaactctatcgatggcactgcagcaatcacacactccaccgatggcactctagccgctgtcgacaaaaccgatggtgcagtcgcccatatcgccgacggctacgacgacagggacgacgatgacaagtggcgacaaaaggatgacgatgac

SEQ ID NO: 1271 - DNA, 289 bp, Triticum aestivum
  Clone ID: LIB3280-031-P1-K1-E1
acaatcgacatagcactcagcatcgccggccgggtctcttcccatctggcgggcagcagacgagaccggtctcctccacatcggcctcaaggtcaacgacgcgcacaacctactgactcgactctgccacccggagctacatcgaccacgatggctagtagggcatgtgcaagagcttttggccttacagcgctgacgccgcaggacttggatcgacaggccgttgtagtggcaacacagccgccactcacatatgagtcttcaggtcttctgcgcaaacttgggacat

SEQ ID NO: 1272 - DNA, 422 bp, Triticum aestivum
  Clone ID: LIB3280-031-P1-K1-E10
cgaaggagcacagtttcatttgcatcgtctcatcgcccgcggatccttgccatgaacttctggggcgccaaccataacctgccgatcaggagagcaacacaaatccctgcagctgttccaggcccagaaagtttgccaagagtaaatctccctatgtccaacatgccttcatggatgaccttggtcgttggtgcagtccttgttgcgatacctatttacagaaagataagagcattggaagataaggtggagaagacggcagaggtggcggtcgaggtaatggacacggtggccgaagctgccgagaaagtcgccggcgaggtggccgaggcgttccccgaaaatgaaggcctcaaggaggcagcgtccaggatcaagaccgtcgccgatgcgatcgaggaggatgccgagttagccgaggc

SEQ ID NO: 1273 - DNA, 341 bp, Triticum aestivum
  Clone ID: LIB3280-031-P1-K1-E11
cggcgagatggccggcttggcgggctcgggaggaggaggcggcggcggcggcgaggtaatccgcttggcaggctgtggcatgggaagccgcaggatggtgggcttggcaggctgcggcatgggaagacgcaagacggtgggcttggcaggctctggcggcgggaaggagaaagggaagccgtcggccgggcggcggctcccgctgatgcggatcttggcggcgtagtaggcggctgcggcctcctcggcggagtccaaggtgccgagccagatgcggcagccctggatcgggtcgcggatcttcgaggcgaacttgccccagcggcgctggcgcacgccgt

SEQ ID NO: 1274 - DNA, 81 bp, Triticum aestivum
  Clone ID: LIB3280-031-P1-K1-E12
tgaagggatgaacgattaggcgctttttttaggaggacgctaatccttggggtaggttttttgtatgacaaccttagtctt

SEQ ID NO: 1275 - DNA, 306 bp, Triticum aestivum
  Clone ID: LIB3280-031-P1-K1-E2
ttattctacttagcactcagcatcgccggcccggtctcttcacatctggcgggcagtagacgagaccgtgctcctccacatcggcctcgaggttaacgacgcgcacaacctacggactcgactctttcacccggagctacatcggccacgatggcgagtagggcatgtgcaagagctcttggtcttccagcgctgccgccgcaggactcggatcgtcaggccgtcgtggaggcaatccagtcgccgctcacatatgggtcttcaggtcgggtgcggaatcttgggacatggatagttactttttgt

SEQ ID NO: 1276 - DNA, 271 bp, Triticum aestivum
  Clone ID: LIB3280-031-P1-K1-E3
ataccactgccaaggagacgcgggcaatgaaaaaacaggccacacaaaaaacgaccgcccggaaggttaacgacagggatggagaggaaaaatctgttttaaattgtgcagagatcgatcaaaatgaacgcacacttcatgatagcgctggatcttgcgcaggcagcttacgttgccacgaaagatgattcctcctatgaaggtgctgtagacctaatagacattttagatcgggcagctgatggctgtgaaacagatgcaggtgacaatt

SEQ ID NO: 1277 - DNA, 187 bp, Triticum aestivum
  Clone ID: LIB3280-031-P1-K1-E4
ataccacagccaagtcgacgtggataataaaaatacaggccacacagaaaaaggccgggcggggggttaacgtcacggctgcagacgacaaatctcttataaatatagtatagactgaggaagacgaacgcacaattcatgtaaacgcggatttttctcatgcagaataagttaccacgatagatga

SEQ ID NO: 1278 - DNA, 317 bp, Triticum aestivum
  Clone ID: LIB3280-031-P1-K1-E6
gtgaataacacttttttatttacagttgttttgtgtttgtcatttacttggtgaacaaggacaccaaccgattttggacaccacctacagtggtgtgaaaaactaaaaatgctggggatggaaccacatattacggcaattgctcataatgggtacaggaaaaaaggcgtgcctatgaactgtgaatagaggggggtggacaagacttttgttagggaattagcgcggccaaggaaggccttttcgtattctgactaattgaaaaaaaaggtcctgacttagatagaagtcgcgtctttggttgggccccctgtact

SEQ ID NO: 1279 - DNA, 326 bp, Triticum aestivum
  Clone ID: LIB3280-031-P1-K1-E7
ggatcaaattcagacaatgctagtattattctgaagacagagatgagcactcagacatacatatatgtatatactggagaaaccaggcaacataaaaagatggttaaattggatgatgtcgatccccatctttattgggaggagaaaatacaaaaaacagattaacaaaatgttatggattacaaaacaccaccagacaaaggggaaaaagaatcggcagaacaggaatggcattgaccaaacctccatcttcatatgttgctgccactgaaacttttatgccagtagataaacctccaagctctttggcgctatgctagctacat

SEQ ID NO: 1280 - DNA, 414 bp, Triticum aestivum
  Clone ID: LIB3280-031-P1-K1-E8
cgacaaatgcaggcacaaagcgtttaatacaagaaggttatcatactcataatcaaatggatggactgccaaccgttgaggatgatattgaggcaaagaggcaacgaacgactgggacatttggtgaaaaaagttcggtgccggcgtttggaggccgagcattcaccgatgccaacacactggtgaacttcaggccgaagctgaggcccgtctgctccatgtgaagacagagatggttgatgggcgactgcacccaccggtgctgctgcagctagcatttggttgtttcgttcctgctgctcctcctatactacctacttagtgcttgcgccgcgattatgtcacctgcttgcttgaggcttgcaagtctcctagaactcataatgttatgttatgctatgatgctactatatg

SEQ ID NO: 1281 - DNA, 212 bp, Triticum aestivum
  Clone ID: LIB3280-031-P1-K1-F1
cccacgcgtacgagtatacaaggcgaaggttgatgcggtactgtcatagatatggacgtgacaggtacagacagagggatcatcatcgtattagcacgaatggtgccctagccttgctgattacaagaggcctgtcacgagacacaagttcttggggcagcacgagccgcaactacagcactaagcatctccggatggggggcagcaacctt

SEQ ID NO: 1282 - DNA, 377 bp, Triticum aestivum
  Clone ID: LIB3280-031-P1-K1-F10
ctcctgcgacgaactcgcggtcccgtccttgatctgccctttccccccgcgccctgccttaagatcaggccgtcgtgccgtcaccgacccccggatcaggccgccccggcgccaccggtcttggatccggccgccgcgctgtctacctctgctccttacctatccgactccgcgcccgcacgaggggatgccaagccctcgtgctactcgatcggcagccacaggggggcctcccgcgcaccttcccttcctctctttctctccttccttctccctcacaccctgtctgtgtggtctcctgcaggtacccgccatgtccatcatggacagcagccatgcggcaagagctcgtcatcgaagttcttaagcaccggacg

SEQ ID NO: 1283 - DNA, 206 bp, Triticum aestivum
  Clone ID: LIB3280-031-P1-K1-F11
ccatagtctcctctcccgccgcggtagtacgacccacgggaacgcccactgtccccacgggaaccaccatgtacaccgtcacggtagggctggcgatgccttgggaactcatcaaatgtttgtgtgttcttttttctaagttctgaaaacttttgccttcctttttgtccgcctggctcaaatttccaaccaggaggggacatgaa

SEQ ID NO: 1284 - DNA, 224 bp, Triticum aestivum
  Clone ID: LIB3280-031-P1-K1-F12
aaaaaaaaaaaaaaatatttaaaaaaaaaaagggggccaaaaactaaaaaggaaaaaaaaaaaaccaacccttggttttttggggatttaaaaaaaaaaaaaaaacctcattttttttttccccttgaaaaaaaaaaggcattagggctttaattttgaaaaaaatgtcccctttttataaaaaaagaaagggaattttcatataaaaggagatttattttcca

SEQ ID NO: 1285 - DNA, 411 bp, Triticum aestivum
  Clone ID: LIB3280-031-P1-K1-F2
atctgctgctgctccggccgggagacgccgcgagcctgcgagcctgggccgggtgtgggagctctgtagctggttaccccctttcctgcccacgccgcaagggggaggcgtgttagtgcaaggaagacgacgagggcccgcgactggggagcagccggtcggggttgtttcaaccggcggggctggcggagagtggggtgcgtgtcgttatgattttttgctacaaccttcgtcagattttgctaccactgacacaaaattttgctacaaggatttcatggtgaagctgtaagcacggcggcgatgacgaagttttgctacatccattgctggattttgctacgaccgggacaatttttgctacaaggatttcacggcgaagcggcaaccacaacggcggtgacgaagttt

SEQ ID NO: 1286 - DNA, 421 bp, Triticum aestivum
  Clone ID: LIB3280-031-P1-K1-F3
aaagcagagccgcgccgccgaggtggatatggccgaggccgacgacgccgccgccgcccgccggcgcaccgtcaccacggagtaccgcaacaagctcctcaactgccgcgagctagagacgagggtccgcacaggtagggaaaacctaaaaaaggcaaagaaagattacgataaaactgaagatgatttgaagtccttgcagagtgtgggccaaatcattggtgaagtacttcgaccattggacagtgaaagatttatcgtcaaagccagtagtggcccacgttatgtggttggctgcagaagcaaagttgacaaagaaaagctgacagctgcaacacgagttgtccttgacatgacaacattaacaataatgcgcactctaccacgtgaggttgaccccgtggtctataatatgctacac

SEQ ID NO: 1287 - DNA, 400 bp, Triticum aestivum
  Clone ID: LIB3280-031-P1-K1-F4
cggacgcgtgggcggacgcgtgggcgcccactgagggaacttgcaaacttagttctgatcatggggaaccaaaaataccatcaaggagatccctcccggcaatgcaaatgtcctaaccactgttttgaagctggttgacaagtatgatctgtacggaagtgtggccttccccaagcataacaagcaggccgacgtcccggagatttatcctctaacaccagaacaaaggtggtatataaaatcgtgctctgggagagtctttgccttacacattaagagggtgtggcgcacgggctctcaaaagtgtccacaaagagagggggggcgctcgacattatacatacactgtacagagggctgctagtggattcgcacgaccagaacgccattgccgacgcgc

SEQ ID NO: 1288 - DNA, 181 bp, Triticum aestivum
  Clone ID: LIB3280-031-P1-K1-F6
ataggagcaggactcaaacgccttgtctttttaagaaaacgcgaacaccaattgcgggcgacaacgcaccgtcttgacctagtatcgatcactattcgctacagtagcatgactaaagacaaactaacctatatgacgccagtataaactcaacgcaagtgtcgtattcgataaaaatcaa

SEQ ID NO: 1289 - DNA, 417 bp, Triticum aestivum
  Clone ID: LIB3280-031-P1-K1-F7
ctgcgccgaagacgccgcgctggacaaccccgccatcgtcgaggacctgaccatgttctttgccaggtcagtggtcgacgaggttatagcgccgtcggacttggaggcgatggaggaagaggccggccgccgaaaagccgcaggctccccagggatgttggctctgcgcaacgcccacgccatgctcggagcaaagctctccgcggagcggatcctgcggtgctggggcggcggtggcaccggcaaggccggctgggagctgagcgaggtgaaggacaagatcgggaagctgctgcaggagtacgacagcggcggcggcgtccgggaggcgtgccggtgcatcaaggagctcgggatgccattcttccaccacgaggtggtgaagaaagcgctggtggcgatcatcgagaagcgggg

SEQ ID NO: 1290 - DNA, 245 bp, Triticum aestivum
  Clone ID: LIB3280-031-P1-K1-F8
cctgaccaagatgctttaactcagctccaaagacaaagaccaaggatctctctattgatacaccataatgattaaggatcaagcttagtccggcacgggactactaccaattttaaatatgaaaaccaccgctgctattaatcatgcaatactcttgccaacgccataaaaccaaaccaaaggaatgaacaaaaaatgtacaccacccctgggagaaaaaggaagttcaggtcaagttcacgcac

SEQ ID NO: 1291 - DNA, 359 bp, Triticum aestivum
  Clone ID: LIB3280-031-P1-K1-F9
aatcttctgaaaaatgcatcatcttatgaggagtacacatatactcaagtctcggttcacctcagcgccggtttgatccgttttagaccaacagatctcagatcggttctgctctgttctcggcggaaaaactatttacagggctcctcggtctgtctcggacaactaaacaaaaatacaagaggaccagaacagaagaaggaaaaaaagcgttccctgcaggaaaaatgagaaactacagtcatcatctaaaaatgtgtcctttgtctagtcctcggaaagccgcggcccggttgagatccaatatcaaaacgcgacccggctttattgcgctggcacacgcgggggggcgaacgggg

SEQ ID NO: 1292 - DNA, 421 bp, Triticum aestivum
  Clone ID: LIB3280-031-P1-K1-G1
cccacgcgtccgcccacgcgtgcgacggtgtgtaagttggataaaaaatacccaccttatgagctaatatgggaggattctaatcagctcgcaggaaagtcgttctatttgcctgcatcgtttgatgctgatcataatcagatggatcagtggaatctatcacctcctcctgtttctctggggagccgcagcgattttgctcagaaacataatgagattgttaaatcaaaggggcacctctgcagcagaagaccgagctataatgattcacaaagggacatcgcaggctatgcatatatgagcaccagccatttggaaatgggcatggagggtgatgcgtgcatccctgacgaagaaatgcacggagagcgacatgcacgacgcctgcgttatagaccagttgttggctgacacataccat

SEQ ID NO: 1293 - DNA, 352 bp, Triticum aestivum
  Clone ID: LIB3280-031-P1-K1-G10
gtttctatctagaactagcgctttccatgaatgtaaacagcctggatatcctactaattaatatgtgcacactgcaggctgaggcggcaagcatggaacaaacccacattcactttcttttatatgcggtctggtacaaacaatatgagaattcacggaacgggtctgaggttggcaacatcaattaaaaacagccagtcctagttacagagacaacctaataatagttttggcccatatattagcacgacaattaactaactccatttacaatgtatttcagccattggatttcttaggaccttaaaaaaggcaaactcacatattttctaagttaggcataagaaatttt

SEQ ID NO: 1294 - DNA, 224 bp, Triticum aestivum
  Clone ID: LIB3280-031-P1-K1-G11
aactagcattagatcgctggctgaaggcttctacgtgggcgtgccccatcccatgggtgaactctgcgcagctctcaacacggttgtagcggatcactccatgccgggcacagatcaagaggtacaaggcctcatactactctcgcatagtgggctacggctcattcaaacagcacaggtcactgatgaagcttgtcatggccaacatttatcacctcaagcta

SEQ ID NO: 1295 - DNA, 285 bp, Triticum aestivum
  Clone ID: LIB3280-031-P1-K1-G2
aataatatcggccggtagacggccattggattagattgaattgaaacatgccaccaccgcgtcattcataaattaaatgacgagggaatgggatgcatagatagcatctgctccaattagaataaaattgaagagggaaaagaaatcatgatttatgtagaaagattggcaagcaagaaaaagaaagggaaacaagaaaaaaaggaccatcgatggcgatcggacgggcgccccggcagcattaggaatgatgatcccatgcattgcctgcgcgcctttactatt

SEQ ID NO: 1296 - DNA, 359 bp, Triticum aestivum
  Clone ID: LIB3280-031-P1-K1-G3
gtcaggagggaatgccaagaccgccggcgcggccaagaacattgaggtggaggtcgacaagccgctcggcctcacccttggccagaagtccggcggcggcgtcttcatcaccggtgtggagtcaggagggaatgcagcaagagcagggctcaagtcgggtgaccaagtgctctatacaagcagcttcttcggtgatgaattgtggccggcagacaagctgggattcaccaagacagccatccaagcaaagccagactctgtatactttgtggtaagcaggggtggtggtgatattgatgtgaagcgcctgaccaagaggccggcgccccctcggtttgaccggaagttatcttattcac

SEQ ID NO: 1297 - DNA, 311 bp, Triticum aestivum
  Clone ID: LIB3280-031-P1-K1-G4
atcacgcgggaatgcatagatcgccggctcggtcaataacattgaggtggaggtcgacatgcctctcgtcctcaccattgtccagaagtaccagggctgtattttcattaccgttgagacgtcgggacggaatgcaatatgatcagttctaaagtcgggtgaccaagtgctttatactgtgcagtttcttcggtgatgaattggggacggcaaacaagctggtattcaccatgacagacttccaagcaaagccagactctgtatactttgttgtaagctacgttggtggttatattgatgtgacgcccctc

SEQ ID NO: 1298 - DNA, 408 bp, Triticum aestivum
  Clone ID: LIB3280-031-P1-K1-G5
aaaatacctcaacgcccagccaccttttcaccaccacacgccagtcagcgcacgaggcagcggaactggatttgtcttcgtccagggaagtgaagtcgtctgctcctgtgcggtgctgggccaacgaccttcggttctgttctccatggacaaacttcaaaaggcaacagcaagccatatcaagggaggggattgaagtcaccccacctcaaattcatgggcgccatacacaagaaccgtggccaggacaaggaggcggacatcttcgcactgctttttggcggagggcgacgcacatttgcgagccttgtggcgcaggttgaccggccggtgccgcgcgaatctggttcgacgaggtcgctggcgacctgctgcggtggccggataacaggatcagctccgggatgt

SEQ ID NO: 1299 - DNA, 427 bp, Triticum aestivum
  Clone ID: LIB3280-031-P1-K1-G6
gttctagatcgccttcatgcgcgcccagaacatcaacccgttcgccgacgcggacggcaacaccgcggcgtcgccgttctcggacccgttcgcgctgccgcccaggccgccgtcgtccaccaaaccggcctctcactctcactcctcgccgctgatcaaccagcactacccgctcctcaacgagatgcaggggatgcagatgcgccaccacgccgtccagcacgcgcacccgcagccggcgttccatcaccaccacggaggcatcaggttgccggggctcccgccgttgccgactaggccgcgcgagctcccttcgaaccaaatcgagacggcgagctgcagcggcggagccgacggcctgctcgaggcgctgctgctcggcgtcgacgaacatcaactcccccgtcccaaccatggcgtgtgcagg

SEQ ID NO: 1300 - DNA, 253 bp, Triticum aestivum
  Clone ID: LIB3280-031-P1-K1-G7
atgaaccacatgaaagatatgggcgtgctggtggggaagggcggtttcttcggcaatgtgttcagggtgacgcctccgttgtgcttctccaaggaggactccgacttcatgatcgaggtgatggacatcgcgctgtcgaagctgtgaagaggcactgctctcatcgataaataagagacgatctgcgaaacagcacctcgttgtctcgtgttctgtctggcaaatccatgatgcgcacatgcgatctgcgcct

SEQ ID NO: 1301 - DNA, 363 bp, Triticum aestivum
  Clone ID: LIB3280-031-P1-K1-G8
atatataacatttgttgttgcttgacccaacaataattcctaaccatgataatgaccgtaccacgaggatacagaaacttttgacacaattatcaacacttccatgtcaagagcaggaagagagaaccggcacatttgaggagcagaatatctaactctatcatgtggcacactccagaaaaaacatcaaaacttctggaatttcttgtttccaaattagaaaccgagcccaattactcggcatcagcatcatcaaaaccatcgtcttcaccgtcgtctaacgctggaggccctacactgtcttcacctattgtagtatcgtcatctccagacttttcagggcctggtcctgcagacaccttg

SEQ ID NO: 1302 - DNA, 415 bp, Triticum aestivum
  unsure (1)...(415): unsure at all n locations
  Clone ID: LIB3280-031-P1-K1-G9
ccacaacagcgcgatactggctgaaggcttctaggcgggcgggccgcagcccaagcctgaactgcgcggggctctcaacacggctggggcggatcactccatgccgggcacagatcgagtggtacaaggcatcattcgacgccgacatagggtactacgacgcattcaagcaacagaggtcaccaaagaagttcggcaaggccaacatttatcgcctcaagctgggccagttttgggatggggtcctcacaatgcttgacaacagccagctgccgcacgacttccatcgccgggccaagtgggtgaacgccgcccggttctaccagctcctcgtcgagccactggacatagcagactatcaccgcaacaacctncacaagaccagaggcggctacatcacccatggtcgtgacag

SEQ ID NO: 1303 - DNA, 310 bp, Triticum aestivum
  Clone ID: LIB3280-031-P1-K1-H1
accacgcgtacgtccttagcctggagccaccagcttagacaccaccagcaacggcgaaactagtcctggcaatgcagatgagcccgccgacggctgcctaatgaccgttggcatgcaggagctggccagcgccgtgcctttagacaagctcaacctctcaagcgttactgcagtcaacagccacatgtgcagcaccattcaccagattacaacagcactcaagtgtgccggaagtggccgggctgagccccctcctgcaggttccgacccgtagcaagagtcgctgggtgggagaggagggaagcacacg

SEQ ID NO: 1304 - DNA, 401 bp, Triticum aestivum
  Clone ID: LIB3280-031-P1-K1-H10
atatcacttcaccagctgaatttggtgaattccgtgtgaagcttgctgggctgacaagtataactctaaattactttccacatcccttacctagcatttcaagaggggttggaggatgtccagtgtgccggagaggctgcaacctcaagcaaggcctccaactctaagaaaggaggagcttattggtttggccttctaaaaaccatgcccctcagatcaattattggaccattctgatgattcttggctctgcgagctcttggcatttcttaatccctcttcatcggatgcgtgtactgcctgtgataagcagcgcgcctagtatattaataaactgcttaaaaggcagtgacgcaagaagctcaaagcgccatgaaacatgtgtgtgctttatgctttag

SEQ ID NO: 1305 - DNA, 414 bp, Triticum aestivum
  Clone ID: LIB3280-031-P1-K1-H11
cccacgcgtccgggaaaaaactgctctgtatatgtgtttcacatcacaacgcttacgagattaagaaatataggaagctatgaagaatgggccagttacagtattcagatatcatatatagctgccacttacagaaaatatgattacaagtaggatttacaatcgtttcctcaaatcattaaatgggtagctattgtgagttccagtatggtcgtttattgatcacaaaggaattgcttctgccattggaagtatgacatgagtcctgacttctgcagggacattatggaggcatcagatgatcggggggatcgacaatgggaggctaccacgacaagcaactagcaaagaaagaggagctatggactaggcattacatgctggacaccatggactgaaaacatgagacatgga

SEQ ID NO: 1306 - DNA, 317 bp, Triticum aestivum
  Clone ID: LIB3280-031-P1-K1-H12
cccacgcgtccgccatgagctgccaggagatgagccgccgtcgacgacggcttgcaccatcgccggcggtcgagccgccgatggaggacgagaacctcctctttgagatgctcctacgtctgcccccagatccgtgctccttccctcgcgcctacgttgggtgcaagcgttggcgacgcctcatcttcgaccccggcttgttccgtcgcttccggctacaccaccgtcgcaacccttctttcctcggatccttcagccatttatacttggtacccaccatggaggcccccaatcgtgacccggatgggcacttctgc

SEQ ID NO: 1307 - DNA, 419 bp, Triticum aestivum
  Clone ID: LIB3280-031-P1-K1-H2
ctgacctcccacggcgtgttcgtcgtcgagggcgacatcaacgacggccgcctcctcgccaagctcttcgacgtcgtgcccttcacgcacgtgctccacctggcggcccaggccggcgtgcgctacgccatggagaacccggcctcgtacgtgcactccaacgtggcggggctcgtcaccctcctggaggcctgcaagaacgccgacccgcagccggccatcgtctgggcctactcctcctcggtctacggcctcaacgacaaggtgcccttctccgagtcgcacgcgacggaccagccggcgtctctctacgcggacaccaagaaggccggcgaggagatcacgcactcgtacaaccacatctacgggctgtccatcaccggtctgcgctttttcacggtgtacgggccctgggggcg

SEQ ID NO: 1308 - DNA, 365 bp, Triticum aestivum
  Clone ID: LIB3280-031-P1-K1-H3
gaaaatatattgctgtaaatctttatagcaatgctgaagttaacatcaattcataacagatagtttgcacaccaattcgtctcgcaccatggagtacttcacccggaaatttagccaaactgaccttacaaagcatgtaaatatagtactgaaaatcttcctatgaatgctgctgaatttaatgttataactgaggcactgacttcttgttccaaccaggaccctgtggattcatcttccccgtccacagcttaggagtgggatgagagctgcccctactcactaccgttttaagcccgccgcagatccaccctatggcgctcacaccttggcctcctgtagcgccacctcgactactgtccgtc

SEQ ID NO: 1309 - DNA, 523 bp, Triticum aestivum
  unsure (1)...(523): unsure at all n locations
  Clone ID: LIB3280-031-P1-K1-H4
cccgcaggccacccgggtcccggaatctgcccgggtcgagcccaacgcgtaccgtgtaagaatcatactcttcaaccagtnctgaatgttgttgtgaattcctgtngtnngaagctttgctggtcgtgacaaggtatttaactcggaattacttttgacgaacccttgtgtcgagcatatggaaggtatgggttggaaggatgtacctagtgtgcgcggagaaggcttgcaactctcacagcaaggcctctcaacttcgaagaaagcgaggagctaaaggcaaagctggcgaagaagcacgccgtcctagatcattcttcggaccattcntgatgatancttggccatgcgaggcgctgcacattatctgaatcctctcttcagcggatgcgtgtactgcctgtgataagcagcggtactagtagattaataaacggctcaaaaggcagtgacgcaagaagctcaaagcgcatgagaacatgtgtgtgctttatgctctagaaggagaagcagagctctcaac

SEQ ID NO: 1310 - DNA, 387 bp, Triticum aestivum
  Clone ID: LIB3280-031-P1-K1-H5
agcttaaagttgagttcctttcaatttcttcaaccatggaaaccggacaagatcaagcagccttacatctgagtttgaacacccgaaaatttgtttgccatattcacagccatgggatgaaagcaaccaatccgaccaccaactagaaattcttctaataccataccatccgggactctcctgaaaaccaagacactaaatcctacgaaacaagaaactccttcgtctttgtgatgcaaatgtaatccatggtgcgggcggtggcagcgagggaaaggacagggcctcagttgtcgtcgtcatcgacggtggacgccttggaggaagaggccttcttggggaggaggtgctggtggatgttgggcatcacaccgccgctggcgatgg

SEQ ID NO: 1311 - DNA, 287 bp, Triticum aestivum
  Clone ID: LIB3280-031-P1-K1-H7
aaaccgtttcttctctcgtgtgcgaacccatataagttgctgttccaaaccagacaatttggaggatgaactcgactctaataacgatgccatggttagcatctgtctttcagtaagactctgtgacaaaccatacattttatttaggcaaaattctggagccgctatcattcatactgtatttggcatggcagtggtccgacagaactcttaccgtcttgcaacatccctagaaataagattctgctgcaatctggtagtatgaatattctgttgtccacggttta

SEQ ID NO: 1312 - DNA, 348 bp, Triticum aestivum
  Clone ID: LIB3280-031-P1-K1-H8
gtaaaatgaaccctcccctttctcacgtcgccccggccccgtttgtcttacagatacagaacaacttaccgtcgtaaacacccgacattgctcgttctaaaaaaaaaaaaaaaaaaaaaaaaaaaaaaaaccaaaaaataaaaaaaaaaaaaaaaaaagaaagaaaaaaaaaaaaaaactatataataaaaaaaaaaaaagggggggcggatctgaatttaaaacaagtagcatttgaacttgcgcggggagggggtccatcccggaggcgcaatttaattaccagggtatactggagccgctattagtaaagccgttcaaggtaaaagggccggtgacaaacgtgga

SEQ ID NO: 1313 - DNA, 419 bp, Triticum aestivum
  Clone ID: LIB3280-031-P1-K1-H9
ctgacctcccacggcgtgttcgtcgtcgagggcgacatcaacgacggccgcctcctcgccaagctcttcgacgtcgtgcccttcacgcacgtgctccacctggcggcccaggccggcgtgcgctacgccatggagaacccggcctcgtacgtgcactccaacgtggcggggctcgtcaccctcctggaggcctgcaagaacgccgacccgcagccggccatcgtctgggcctcctcctcctcggtctacggcctcaacgacaaggtgcccttctccgagtcgcaccgcacggaccagccggcgtcgctctacgcggccaccaagaaggccggcgaggagatcacgcactcgtacaaccacatctacgggctggccatcaccggcctgcgcttctttacggtgtacgggccctgggggcg

SEQ ID NO: 1314 - DNA, 355 bp, Triticum aestivum
  unsure (1)...(355): unsure at all n locations
  Clone ID: LIB3280-032-P1-K1-A1
tttctgggatcaatctggtagaaaccattgtcttacaatttcctaggcactagctctgctaaacaatctggagcagcaaacagaaaanangcaatctctcttaattaacacccaaattactctcaagtctcaactaaaccaaggacggacctatcaaaaacttttgaccacccgctccggtccaggcacatagggggagaccaataacaaattaagcaccatatatatgtagctatatatatgtaggtcggcagggcacacacagatggactagtcctactggctagctacgtacgtagcgtagaggtagacgtgctagttcctggtgttgtccatggcgaggatggtgctgagg

SEQ ID NO: 1315 - DNA, 345 bp, Triticum aestivum
  unsure (1)...(345): unsure at all n locations
  Clone ID: LIB3280-032-P1-K1-A10
ggtttcccggtgcaacgcacgggcccttttgctagttcattacttaaggatactgctgtgccagcaacggtttnnnccaacataacatggggactcgatagttttcaaaccaacacataggactgacacaaacgagaaaacagttcaaacgatcgacagggcaccaccaaccggacgaccaaggataaaccagcaggtacaacgccaggacaattactgaccaccacggaggcggagcaccaggtggagggtggactccttctggatgttgtagtccgcaagggtgcggccatcctccagctgcttgccggcgaagatcaggcgctgctggtccgggggaatgcc

SEQ ID NO: 1316 - DNA, 166 bp, Triticum aestivum
  unsure (1)...(166): unsure at all n locations
  Clone ID: LIB3280-032-P1-K1-A11
cttcttctgattgttttgtttagtagtactatgttatgttgtagactgaacttggggcatgcatatgcatgcgctgcttgttttgggctgaacttgctgcatgcgtacgcatgccatgggtgngnnncggttcatagtactccatagtgtgcgtgccttcccgttt

SEQ ID NO: 1317 - DNA, 243 bp, Triticum aestivum
  Clone ID: LIB3280-032-P1-K1-A12
aaaaaaaaaaaaaaatttgggccttttgccgccctttgggtttgtttgatttaaaaacccccccccccgggctaatccaaaaaaaaaaagcgggggggggggggccaaaaaaagccttttttccaataaaaaaaaaagggggggggaaaaaaaaactttttttttttaaaaaggttggcaagaaaaaaaaagaagggggaacaaaaaaaaaggggtttttttttgggttgggccggccccccc

SEQ ID NO: 1318 - DNA, 397 bp, Triticum aestivum
  unsure (1)...(397): unsure at all n locations
  Clone ID: LIB3280-032-P1-K1-A2
ctccccccatctcctcccccgacgccgaaccgaatcgccgcagcagccgccggagaagaacaaatcgagcgccagccgccatgtccggcgtggaggaggaggagaacgccgccgagctcaagatcgncnnnnagtttctcaaggccaagtgcctgatgaactgcgaggtggcgataatcctggagcacaagtgggagcagctgcagcacatgtcggacggcggcgccgaccaggtctcgcaggtgttcgagaagtcgcaggcctacgtcaagcgcttcagccgctacaagaaccccgacgccgtccgccaggtccgcgagacgctctcccgctacagcctcgtcgagttcgagctctgcaccctcggcaacctctgccccgacaccgccgacgaggc

SEQ ID NO: 1319 - DNA, 393 bp, Triticum aestivum
  unsure (1)...(393): unsure at all n locations
  Clone ID: LIB3280-032-P1-K1-A3
gtagccatgccgggattcagggcacaagcagaccaactcactaccatgtcctcttcgatgaaaaccgtttcactgccgatgggctgcagctgctcaccaacaacctgtgctacacatacgctcgatgtactncgctctgtctctgttgttcctcctgcctactacgctcacctggctgcgttccgcgcacggtattacgacgagccatcggagggctcggacagcgcctcgatcgtcagcggtggcacccgggagtcagctgccaccggcgcaggagctgctggtcctcctgggacataccgtcgcctccccaggatcagggataacgtcaaggacgtgatgttctattgttgaatcggcccattgacaagttcatgggagtcgtgtgttttg

SEQ ID NO: 1320 - DNA, 265 bp, Triticum aestivum
  unsure (1)...(265): unsure at all n locations
  Clone ID: LIB3280-032-P1-K1-A4
gaaagcaaacaacgcaacgcacatcgttcaacaaacatcttaaactgaaaaggtacaaggnnggcaacatacaacacaactaactaattaagggcgatctaatagcacaactaagtaataacactaacaatgagccaagacgacgtgtttcgccccctatggaacttcaatatttaggacgcatcgacggatcttctaataagattagagacggcctaggatgcgttccgctaactggcctacttcatgggcggaggctaatttt

SEQ ID NO: 1321 - DNA, 344 bp, Triticum aestivum
  unsure (1)...(344): unsure at all n locations
  Clone ID: LIB3280-032-P1-K1-A5
gagacaaaatgttgatgcagacgcaccgttcccacacacttgtattacagataatgtcagatagagagcacaagaagacctatgcagcagncgagagagatatgtatacacacagacaggtataccggcatagttgtagtactcttcccgctgaaaaccacgcaacacaaggacggacggaccctttccggccgcccccaccggagcagcaatcgatcagatcagatcagacggtgtagttctgcggaatggcgtcgatatcgatgcccttctgcttgacgaccgactcgacgtggcccttgagcgtgtgcagctccctgagcctggcgatctcggcgcgcttg

SEQ ID NO: 1322 - DNA, 390 bp, Triticum aestivum
  unsure (1)...(390): unsure at all n locations
  Clone ID: LIB3280-032-P1-K1-A7
gcggatgtcaaaaacaattggtgaagaaatcggctgtgggcatccagtctggcctgctgtgattcatgggcattacgccagcgcgggaatagctgctaccctgttatcaggagcacttaacctgnntatggcatttacaggacatttccttgggaaagataaactggaagggcttctcaagcaagggcgacaatcaagggaagaaataaatatgacatacaaaataatgcgccgaatcgaggcggaggaattgtctcttgatgcatctgaaattgttattgctagtactaggcaagagatagaagagcagtggaacttgtatgatggttttgaggtcatacttgcaaggaagcttcgagcaagagtcaagcgtggtgctaactgctatgg

SEQ ID NO: 1323 - DNA, 345 bp, Triticum aestivum
  Clone ID: LIB3280-032-P1-K1-B10
gagataattttcacattatacatctcatatactattaatcttatcaatagtcaaagaccatctcgaaaatatattagacaccctctatatatggattgagggagtaaataaaattcatcctttgtcgtaagaaagaaaatgtagcaatcatatagggcgccttcatatattcatatcgtcctttttgaatgtatgtgtgcatagaccttcgtcgcgtaccgacgtacacccatcagttgttgctagtgttgctcgacgcggatacaactagtagccattggctttggcagcggccttcggcggggatggcttcggtggcatgggcgacggccgcggccatgggct

SEQ ID NO: 1324 - DNA, 395 bp, Triticum aestivum
  unsure (1)...(395): unsure at all n locations
  Clone ID: LIB3280-032-P1-K1-B3
atttgagagcaagctagtttatcatctcaacagttggataaggtttcccattataggctgagcatagtcaggtgtgatctagacgatgaactaaaggtggtcctgcgaccattgtccaacctgaagtacnnaagagtcaaatactgcgggttcaccaagatagagttccatgctgccaagctctccacctttgtgtataaaggggactgcatacctattgccctccatcaagctcccgagatggaaaatgcagaaatttgtttctgtgcttctacctttcggcgtggttcagctgtggttctcaatgggcttccacatgttcagaacctcactttgaaaatttcagttgaagtgctagagacttcattggacatcagatagccgttacatgttcc

SEQ ID NO: 1325 - DNA, 324 bp, Triticum aestivum
  unsure (1)...(324): unsure at all n locations
  Clone ID: LIB3280-032-P1-K1-B4
gataaacttgtccattcattaaagacttcgataaatgagttttgggtgaaggctacaacaatcagtagcctccttacnaaagaccgcaaccaaaatcaccacacatgcttgctttttattaagcgcccacgaggtcacacacttgacacacgaactaaactcgactcatccctaataataaaagtgcagctaaactcccctaagattcaaccccgactggcggcgcgacacaatgcgtctctagttgctgcccttgctgatgagctccagggcggtggcggtggtgggcaacgccgggatggcttccttcttggtggtgcagat

SEQ ID NO: 1326 - DNA, 393 bp, Triticum aestivum
  unsure (1)...(393): unsure at all n locations
  Clone ID: LIB3280-032-P1-K1-B5
cccacgcgtccggtgccaggcacacaggtactatctccagggaccaaaggctggccactacgagctgctcgccgacctgccgggctacccggacaacgtgcggcgggacgagaagggcggttactgggtggcnncgaaccaggagaaggggcgcccgggcgtgaccacagcccccgtgaagcacttggttggtgtccggctcgacggcggcggcgttgaggtcgaggagctgacggcggccaagggcgtgacgctcagcgaggtgaccgagaggaaaggacagctgtggctcggctccgtcgagctcgattatatcggcctagttgtctagttacattactaagttttttattagaagattgtcataatgtggtcagttatgtaggttaattt

SEQ ID NO: 1327 - DNA, 389 bp, Triticum aestivum
  unsure (1)...(389): unsure at all n locations
  Clone ID: LIB3280-032-P1-K1-B6
cggacgcgtgggtggcctcgcacctcgactttcgctacctcgacgagggcctcggcggcgagcgcggcaagcgcaagcgccgggaggaggaggcagatgccgccgattccatggacctcgacgccgacnnnnnncggccgtcgaagctccgcgcagtggcctcccagtccgacccgtccaagccggcggccttcgggtcgcccacctacgacggcgtcatcgccgggcgcgtctcggggcggacatggaaggagccacgcacgcgccgctcctccgcgctgatggtgtcccggaagcccgtccctctggagcagcgcgcgagggacaagtccctgaagaaggcgtaccaggcgcgcgtggcggagctcaaggacgagatccggcagaac

SEQ ID NO: 1328 - DNA, 317 bp, Triticum aestivum
  unsure (1)...(317): unsure at all n locations
  Clone ID: LIB3280-032-P1-K1-B7
ggcgaagggggggagtagatttaaaagatcgggggtaagagcatgtttcnngcccggtgatcgtgccaagagggaaaaaggggtgaaaaaagagagatgtgacatttagaggcctttgccatgttgggtgccctcgcatggcaggccgccaccgtaataaaaatggtttttgtgtcccgggtgggagatcgcacgggggttattttgttttagccccggggtctccccccatcgggtcctggtgtgctcctttgtttgcacctttcgtccgatccgattttcctggcacaacgttttaccgtcgcgaatcgatcatg

SEQ ID NO: 1329 - DNA, 361 bp, Triticum aestivum
  unsure (1)...(361): unsure at all n locations
  Clone ID: LIB3280-032-P1-K1-B8
gtcaacaggtaaacgcttttccgataaaatacatcacagtgaagtttctgtgaacaaaatcacataaacatatttggacattcctgccgtatncnaaattgtagcatctggcttccattcctcaggtaaaacagtggtcccttgctacaaaatcatactggtagtattcgttctaggaaggataatcaagaactgaataactcgagcatagatagcaaaacaagtttattctgttgcaaatagttaacacagcggagcgagttattttgatttctctttctctttcttctgatcgggggctcttgaccctataatgctacagatgggttgatctggcgactgaagcaatttcagcgccggg

SEQ ID NO: 1330 - DNA, 388 bp, Triticum aestivum
  Clone ID: LIB3280-032-P1-K1-B9
cccacgcgtccgctttttttttttttttacaagctcaaactttcatgagtgacgacttcaaagcacaacccagcgtgatgaatacaaggtaacacggagtatttttcaattcccggaagttcacgaatttttgtgtgtcgatcagcatcgaataaactaagacagcaaaacatggatagccatgaaaaggcaggatcgacttcattgaagctggatgtcaaagatgctttttcagaccccaaaaccgaacactgcacgtatcctctggaagatgagctctttccagcctctctcagtgttctccaccacggttgagttcccatacctgtcttcctctggcacatcagtttgtttgagctttattgttgtcactcctgactcaggctca

SEQ ID NO: 1331 - DNA, 390 bp, Triticum aestivum
  unsure (1)...(390): unsure at all n locations
  Clone ID: LIB3280-032-P1-K1-C1
gagatcttcctcccctttcactcaaacttgttgatttttggggactcaaggacaagtgcctgatctatactcccaccaaagcaaaagttcattcccacttgtttctttgatggatcttgttactctngcaccttggaggctcctaggtggtaggagtcctcggtgagaaaatgatttatgattgttcccgtcgttcgtgaagatttagaggccgcctcaaggtataccactagtggttgtgaatcaccttcttggtgatatctcaatgagaagagggtgagctttcatggtgttggtgtgccttcatggtaacacccacccctccatcagtgattagttttcctccaaagaagtaaacatcggaatacatcatcgtctccggtgttttcg

SEQ ID NO: 1332 - DNA, 397 bp, Triticum aestivum
  unsure (1)...(397): unsure at all n locations
  Clone ID: LIB3280-032-P1-K1-C10
gggagagaagcagcccaacattacaatttcgatcttggcctcagttgctgtcatccttgttactgtgctcttcagaaccattttcggtggcaagaagccagtggcacctgtgaagcccgttgccgnggtnaagaagcccaatgccacggaagctgatgccgctggaagcagcggcgacaaggaggagaaagaggacgacaccaccgcaccacgcagaaggtcgagaagggagacataggctaggtcttaggaccttcacatttcggacgtctcggtccttgcctttttgtgaactcctgagtgtataatcgaacagtcttgctgccctctgctgctacccttagttttaagtcgctagaatctacgagccggtgaagctttgtgttgtttgtgtgct

SEQ ID NO: 1333 - DNA, 272 bp, Triticum aestivum
  unsure (1)...(272): unsure at all n locations
  Clone ID: LIB3280-032-P1-K1-C11
cggacgcgtgggcggacgcgtgggcggacgcgtgggcggacgcgtgggcgccaccaagcctagcccccgccgcggcgctcttcctcgccgcgctcctcctcctgtccgcctccccggcgtccgcggcgnncccgcgctcctcctccaaggcggtagtcgggccgcacgacatcccggcagtgttcgcggtcggcgactccacgctggtcaccgggcaacaccaaccaggtgccgacggtggtatgcgccgtctacccgacttacagacgggc

SEQ ID NO: 1334 - DNA, 399 bp, Triticum aestivum
  unsure (1)...(399): unsure at all n locations
  Clone ID: LIB3280-032-P1-K1-C12
ggagctgtgtacagatacaagaagttaaaggaaatgagcgcagaagagaggaagaaggttacaccacgcactgtcatggtaggagggaaagcatttgcaacatacaccaatgctaaaagaatagtgaaattnttaaatgatgttggtgctgtggtgaacaatgatgctgacgtcaaccaatatctgaaggtggtgttcattccaaactacaacgtatcagtggctgaagtgctcattcctggcagtgaactgtcacagcacatcagtactgcaggcatggaagcaagtggaacaagtaacatgaagttctctctgaatggctgtgttatcattggaactctcgatggagccaatgttgaaatcagagaagaagtagggcaagacaacttcttccttttc

SEQ ID NO: 1335 - DNA, 344 bp, Triticum aestivum
  unsure (1)...(344): unsure at all n locations
  Clone ID: LIB3280-032-P1-K1-C3
gttttcccggtgcaacgcacgggcccttttgctagttcattacttaaggatactgctgtgccagcaacggtttnaannaaaataacatggggactcgatagttttcaaaccaacacataggactgacacaaacgagaaaacagttcaaacgatcgacagggcaccaccaaccggacgaccaaggataaaccagcaggtacaacgccaggacaattactgaccaccacggaggcggagcaccaggtggagggtggactccttctggatgttgtagtccgcaagggtgcggccatcctccagctgcttgccggcgaagatcaggcgctgctggtccgggggaatgc

SEQ ID NO: 1336 - DNA, 394 bp, Triticum aestivum
  unsure (1)...(394): unsure at all n locations
  Clone ID: LIB3280-032-P1-K1-C4
cttctcccccacgcacgtactcaatctcatcatctccacagcaacaatggtgcagcgcagctccaacgccgaggtgatgtgcatggacctgtcgcccaagaagccggccaaggcctacggcagcgacnnnnnnncctactacgactggtcgccggccgacctgcccatgctcggcgcagcctccatcggcgccgccaagctgcacctctccgccggcggcctcgccctccccagctactctgactccgccaaggtcgcctacgtgctccagggcgccggcgcctgcggcctcgtcctccctgaggcggccaaggagaaggtgatccccgtcaaggaaggcgacgcgctcgcgctccccttcggcgccgtcacctggtggcacaacgccgagggc

SEQ ID NO: 1337 - DNA, 382 bp, Triticum aestivum
  unsure (1)...(382): unsure at all n locations
  Clone ID: LIB3280-032-P1-K1-C6
cctctttctctccttcctcccatggagtcggcatagccagtagccggttctgcccgttgagagcgctcatataccctccacacctgcagatctgtggcctgttgtagtctctgccttctcagaacaacgngctnccgcagccgcgcccggatcggatggacacacgcatgcaccccgacggcgccgacgacggcggcctcgtcgacccgctcaccggcaacgcgggcacaggcaccgagggcattatttgtggtgtgccagactataagatgggtgggaagaggggcgatgaatctccccctactgatgctggtgatgaagacggcgaagatgatgacggcgatgaggatggcgacttctcggagggcgaagaggaaatctc

SEQ ID NO: 1338 - DNA, 392 bp, Triticum aestivum
  unsure (1)...(392): unsure at all n locations
  Clone ID: LIB3280-032-P1-K1-C7
aaatcttgatcactctcctctaagctccagcccttccctcgccgccggcgccgccgcgacctcgcgccgccatgctccgcctccgaagctgcctcctcgcccaactcctctcgccgcgctnnngnntncccctctcccctctccaccgactcctctccgcggccgcggccgcgcccgccttttccccagaccctagcatcttcgccgtggaggagtacctcgtctccacctgcggcctcacccgcccgcaggccctcaaggccacccccaagctctcccacctcaagtcccccgctaaccccgacgccgtccgcaccttcctcgccggcctcggcctctccggcgccgatgtcgccgccctcgtcgccagcgacccgcagctcctctgcgcc

SEQ ID NO: 1339 - DNA, 328 bp, Triticum aestivum
  unsure (1)...(328): unsure at all n locations
  Clone ID: LIB3280-032-P1-K1-C8
ggacaattccaagcacaaatattggaattatttgagtacatgtcaagctagaccatcagttgcnccaatattcgagtacacgtcaaactagacccttcctgagcacacatatttgtcaatctggcgcatccacaagagacatacatacatatgaagtgatacataagttgacatgatcatttctagtgcatgaccagtaagaatgagtgcaaaggacttaaggatcacaactgaacaagcattgctttaaaaaattgtgtcagctttgctatcctgatggtatatgacagaatgttcttctcttgccgccagttatactgtttcttgc

SEQ ID NO: 1340 - DNA, 391 bp, Triticum aestivum
  unsure (1)...(391): unsure at all n locations
  Clone ID: LIB3280-032-P1-K1-C9
atccgttcgtctctctcccccattccccaatccccacgacgagatccatccaccccagaggccaagaagagaggagagagagagagaggccggcggcggcggcggaggagcaggcgatcgnanatnnnacggaaggcgaaggtcgagttcgacgagaggccgccggatgacttcgacccgaagaacccgtacggggacccggtggcgatgctggagtacagggagcacctggtgcgggagaagtggatccagattgagaccgccaagatcatccgcgaccgcctccgctggtgctaccggatcgagggcgtcaaccaccaccagaagtgccgccacctcgtcgaccagtacctcgagtccacccgcggcgtcgggtggggcaaggaccacc

SEQ ID NO: 1341 - DNA, 343 bp, Triticum aestivum
  unsure (1)...(343): unsure at all n locations
  Clone ID: LIB3280-032-P1-K1-D1
agatatataagtgttgaaatccagctataagttatggatcgagcactatctatatatccgggtacctccatgatatatggggcnncccctttagttaattcgcataccatattactggcatcatgcatgcatggcaattgtcggcgtacgtctagggggaggtctcggtgttttgacgggcgtatggcggcgggccgggtgcaggcttggggggtgccggcttgggcgcgggcggcgccggtggcgttggcggcttggggctcggcggcgagggcgtgaggccgcancggatcatgcagacgatgctcttctggttgcagctgatgatgcagagcggcaggtc

SEQ ID NO: 1342 - DNA, 329 bp, Triticum aestivum
  unsure (1)...(329): unsure at all n locations
  Clone ID: LIB3280-032-P1-K1-D11
aggcaaaatcatatcctcgacatttatttctgattctcactcatccctcactaatcgaacactncgnnnnagaaattcaaactcctaactgcgatccgccgccggcttggtggtgaggccgaagccgaaggggaagagcgggtcgtagagcttgtcgccgtagttcatgggcagctggtccacggacctgacccacgtccgcggcagcttcccggagaagccgtagtccccgaagagcacgtcggcgacgccgtggccctcggtgcccggcagccacgcggcgacgagcgcgtccatggtgtccaggtacggttcgacgaccagcgggc

SEQ ID NO: 1343 - DNA, 396 bp, Triticum aestivum
  unsure (1)...(396): unsure at all n locations
  Clone ID: LIB3280-032-P1-K1-D2
atgaacaaacgcaagaagtagttctatggggcaaacatggagaatcatttgatgaagaagcaatacttaaaaaatctctagaaggaattgtgatagctatttttgctggtataactgcaacttcacagnngtttacaggtacaatacaaggatcttcaagttcggcaacacaggtgtatcttgacctcaatatacctgaagttcaacactatcgcagcagctaccaatggaaatttccaactctacaaaagaatctccctaaagtcgcacatctatctccacttgaagcagcaggcaagctgtataccattgaacaaatatctaccttgccaaccacatcttttcagggaggagcaacattcagtactattgcaaaggtgacatccattataccat

SEQ ID NO: 1344 - DNA, 250 bp, Triticum aestivum
  Clone ID: LIB3280-032-P1-K1-D3
ctcacaattcggccgcccgctactgcctttggaaccaagcccacaaacctatcgggggaatttgagctagaactcccacctgctcaatgaccaccccatcactttaaaatgacggtaaagctaacccgaacgccgagcgcgaatactaactaggaacggcagccatggagctacaaccaacacttgcgcattctgcttacaacaacacgatgacccgatactaaaacttcaaacagacacacctgttcaa

SEQ ID NO: 1345 - DNA, 400 bp, Triticum aestivum
  unsure (1)...(400): unsure at all n locations
  Clone ID: LIB3280-032-P1-K1-D4
cggggatgaaggacgccaatgctgctgggcatgataatgttggaaattctgaacctatggaccaaagtggagataatgccatgccatcggctcagcaacaggaacaagtaatcaagaagaagtttggagggctnncccctaaaaagccaccgctcatctcaaaggatcacgagcgggcctattttgactctgctgattgggctctcggaaagtctggacagcaaggtgttgcaaaacccaaaggaccgctcgaggcactcaggccaaagttgcagcccacacgacaacagcaacagcgttcaaggagctctatctacagttcatccgaaaacgaggatggagatggcgctgggtcggaggacatgaatatcaactgatcaacagcgtggaatctcgtgtt

SEQ ID NO: 1346 - DNA, 345 bp, Triticum aestivum
  unsure (1)...(345): unsure at all n locations
  Clone ID: LIB3280-032-P1-K1-D5
cataaaaataatggaatatgaatcagtggagaaaatgatacatgtatcaattaatgtgcattgatatgcagctaggctnnnnaaacataataaaaaaatcatgcacaacaggtttcaagtaagtagtcatttcccccttgttacgtacttcagtgctgcagcaccaccgttcttacatagctcgccaacacagaaagcgacatttctcctattagtagcctcataagatgcaagatctttcaatgtcaaaggcattatctgctgtaaatgattcaaatatgagtaatattaagaggacacttctaattataaaatagcatgtttttttaaggaaatttataggca

SEQ ID NO: 1347 - DNA, 403 bp, Triticum aestivum
  unsure (1)...(403): unsure at all n locations
  Clone ID: LIB3280-032-P1-K1-D6
cccaaccaagggcggctgcagggaggaggagaaaaaaccagcagacccccacgggattcgcctggatcaaacccagacccaaaccagagggatttctccagaggtcgatccgatccgcggcgcgtccggcggnnnnntctctccttcgggatcgatcgtcgcggcccgcggcgggcgggttggtgagggcggagttggggttcgaattgggctgctgcggcgcggatttgggggcggaggcggctgcggcgggattcgcgtcgcggaggtcgttgcgctgcaccgcgccgcgcggcggtgcgggtttgtggagggcctcgcgccattgcatcgagggctcgcgtgcggcgtggacgagcccctggacgccgtcgccggagccaggtcggtccgaattgggcgg

SEQ ID NO: 1348 - DNA, 384 bp, Triticum aestivum
  unsure (1)...(384): unsure at all n locations
  Clone ID: LIB3280-032-P1-K1-D8
attcgcgcggccgtgtctgcctctgggtccgcgcttccgttgtctagcgtcctgagctgagctagatctctcagctcgctctttgccggcgctttgggcttagatctggctggggcgagtaggnnnntgccgatcgcggattcgtgacgagggaggggagccatggagctgggggcggccgggatgcggcggtcggcgtcgcacaactcgctgtccgggtccgatgacttcgacctcacacacctgctcaacaagccgcggatcaacgtcgagcgccagcgctccttcgatgaccgttcgctcagcgacgtctcctactccggtggccacgccagaggaggcggaggcttcgacggcatgtactcccccggcggcggtctacgc

SEQ ID NO: 1349 - DNA, 387 bp, Triticum aestivum
  unsure (1)...(387): unsure at all n locations
  Clone ID: LIB3280-032-P1-K1-D9
ctgatgtgtatgctataaacgttagacatctgaactatctgaataaaaaagaatggacacgcactaggtgctcgctctcggctccccccctcgcccccttctcttctctcttccaccggtgcggnnnntaacccctcctcctttctctcccccagatgcgaacaccccgccgcctcctcctcataacccgcccgaccgccgtgccgcctcttctcgccttccttccgggtccctccccccttcaaccaagcctgatttctccggtgttggtcggcctggggaggagactccgccgaggttgggtgggatttctcggtttgtatttgagccggcggtgcgttgatgtttgatgctgctgcccgatggagggggtagggagagagcacg

SEQ ID NO: 1350 - DNA, 243 bp, Triticum aestivum
  unsure (1)...(243): unsure at all n locations
  Clone ID: LIB3280-032-P1-K1-E10
cacaatgtctaattttaactgattaattgtagatagacactaaacagaaccagacagaattgcaaaaccaaaaatggtttatgggattctccaagnnnncatagaaaatttggtctcttgttcatctaaatcgctccaaactcaaaagcgttacatgaaattgataatatgtagaacaagaccagcctgaagttggagtggttgtgcaagtccttttaaattaactattatgtgccgaaaaat

SEQ ID NO: 1351 - DNA, 383 bp, Triticum aestivum
  unsure (1)...(383): unsure at all n locations
  Clone ID: LIB3280-032-P1-K1-E11
cggacgcgtgggccgccttctagcacaccggaaccggcctcccgcagagtcccccgcccgccctgcgtcgcgccgacagagatccgggccatcttcggactgcagatgcacaaaacatagtgtaccagctnnncctcactcaacatgtggagttttgcatcaaatgccatagctggaagcataaagaaaaaggtacaaccatcaaaaggcagcctatccaatcatgattgctctgatgacgatggttcttcatgtgcaagtcgagaggaaggccttgaatgcccaatatgctgcgaatccttcaacatcgtagagaacgttccttatgtcttgtggtgtggtcacacaatgtgcaagaactgcatcttgggccttcagtgggc

SEQ ID NO: 1352 - DNA, 395 bp, Triticum aestivum
  unsure (1)...(395): unsure at all n locations
  Clone ID: LIB3280-032-P1-K1-E2
cgatctgttgtttttcacgtcattctgctagccggctgctgttcaccttagatttagcagaagaaacgctgaaagggggcggaaagctgtcaccggaaaaacaaaatgcagcgagcaattcaagctatnnnntcacatggcagtgtgctcaaatctgctgtcctgcaacacatcagtgttgtgaagcctgctatgctgcctgctgtgttcccgcgcttcatgtcagtatcacctgctcaaatagaggagagtggatttgagagcagcactgttgcggacattttgaagtccaaagggaagagtgctgatggatcatggctctggtgcaccactgatgacagtgtctatgatgctgtcaaatcgatgacacagcacaatgtgggagctttggtggt

SEQ ID NO: 1353 - DNA, 395 bp, Triticum aestivum
  Clone ID: LIB3280-032-P1-K1-E3
gtccgatggcacgccacaccccaagcctcgaacccacctgctaactaaccctagagaagccctcggcctcggatcgccgccgccgtcggcgactccgagggagttctcctcttcccttgccggtggaacggaccacctctctgccagccgtttctcgttttgaagcctttaggtaagaaatttgaggtagggttgctatggagtcgtcagatgacgagcatgccatggagagtgatactgagactgaaagtgatctgatcagcgggctgcctgaagacatcctccagaaaatcctgtcgtgcgtgtggattagaactgttgtgcgcatgcgcagggtgtctaggaagtggatggaactgtgtgaaagcctgcagttcatacgccttgattacaga

SEQ ID NO: 1354 - DNA, 403 bp, Triticum aestivum
  Clone ID: LIB3280-032-P1-K1-E4
ccgcacaacccctcgtgccctcctctccctctctctctctctcaggaaccctagcactccactcctcccttgccgccgccacctccggcgctcggtcctggcgacctcaggcgggaatcgaagaccgctgtccggccacgatccggcccgcgcggcgagatccatctctctctcacacatgagaaggaaaatcccccgccccattctcacgactcatctgcccctccctcgatccccttccttcctgaggacgcacgcgccgccccctccccgatccacatctcccctcgccctcccacatcgtgccgccatccacctcgtcgcctcccagatggttgcaggcgattgaatccggtccgggtccatggcatccacgaccgtggcggtgctcgcggtgacggac

SEQ ID NO: 1355 - DNA, 229 bp, Triticum aestivum
  unsure (1)...(229): unsure at all n locations
  Clone ID: LIB3280-032-P1-K1-E6
cccacgcgtccgcgcgaataatccaccgtaataagcacataaacccacctgcaggcgcgcaatctctcaatcttgcaaaggcatcaatggcgggcgcaaggaacaacgagctgcgcatgaacatggtaggcnnnnncctgctggggctactgctggtgagccacaccgcggcttcggtggaagctgtcgcgggcgtgcaggagaacagtttgtccatgaacggcgccgg

SEQ ID NO: 1356 - DNA, 389 bp, Triticum aestivum
  unsure (1)...(389): unsure at all n locations
  Clone ID: LIB3280-032-P1-K1-E7
ctcaagaaatggcgagtaggctcacatcaatggtggagctgtacaacaagtgctacttggacgagtgttgggctcctctgcatcgcttaaacttggacatgtttgctgctgaatttcgtgccncctgncactgccagtcgacatggaaggtcggagctgagctcaggtacaacctgcggcaggagattgtggattccgttgttccaccgtatgaggcgctcttgtctgaccgaagcgcatgttcagggccgtccttttcgttgaaacgaatggtgttcggagggaagaaacaaaagaggtatgatactggtgcccaactggaagggaagataagaggattgtttgagggatgagcgatctcctctcctgtcatcatctcgattgttgca

SEQ ID NO: 1357 - DNA, 357 bp, Triticum aestivum
  unsure (1)...(357): unsure at all n locations
  Clone ID: LIB3280-032-P1-K1-E8
cttgccaaactgaagttgaagtcggtggcggcgacacgcccgagtccaagcggcgtaggctagagtgacctgagcttgttgagatctgttcttgtagtctctctgtttcaatcttgcaggcatcatcntcccagaaaaaaattcttgtaggctttgctagagagctcgtaaccccagcatgttatcggataccaccttttgtatccctgatttgttgatcttttttagaccgggcatcagcagagatgtctttgttagcttggacaagctgaatagcatccgtttccaccatgatcttactcgtcccaagttcttgggctttgtataactctttcacgcaagctttttgttttaccc

SEQ ID NO: 1358 - DNA, 308 bp, Triticum aestivum
  unsure (1)...(308): unsure at all n locations
  Clone ID: LIB3280-032-P1-K1-E9
cttttgtcattagttaagctcatcgagactgaatttcctgaccgaccattaatacannctccccacacttatggttctgttctttgtaacatggactatttacatgtggcacacgctggtggcccttttaaaagaagttagcatgtgaagtttagcagaaccagcacagtagaaaaggccatttatttactgaactggtggtgcatggccgtgcatgtacacagtacataaacgctgaatgttgaacgccacagaaaccccaaatgtttactattctttagcatctaatgcgccctgatagaaggttt

SEQ ID NO: 1359 - DNA, 394 bp, Triticum aestivum
  unsure (1)...(394): unsure at all n locations
  Clone ID: LIB3280-032-P1-K1-F2
cccacgcgtccgatcagatcttggcggactcgaatccaatccaatccaatccaaggcggaggtcgagatcaaagccaccggagatgaagttcttctcggcgttcgacccgtggccggtgttcttcctccnnnactggggccgcacctggcccttcctcgccggcttcgccgtcacggggaccctcatcaccaagatgaccgccggcttcaccgaggaggacctcaagaactccaagttcgtccaggcgcacaagaacaagtagtcgccgcccgcccggcccgtccgccgccaggtcacaggggcagcagctgagttaccggcatgtgtccttgatgcggcgagccaatccccaccctcactattgtgattgaactttctgttttttgttcgaat

SEQ ID NO: 1360 - DNA, 394 bp, Triticum aestivum
  unsure (1)...(394): unsure at all n locations
  Clone ID: LIB3280-032-P1-K1-F3
ggatcgaggagaagatcgggcagatgacgcagatcgagcgccacaacgccttctgcgccgtcatcgagaagtacttcgtcgggagcgtgctgagcggtggcggcagcgtgccgtcggagaaggcgtttgnggccgacgtggcaggagatgatcaccaagatgcagaaggcggcgctcagcacccgcctcggcatccccatcatctacggcatcgacgccgtgcatggcaacaacaacgcctacaatgccaccatcttcccccacaacgtcggccttggcgccaccagggaccccgaccttgtcaagcgcatcggccgcgccacggcgctcgaggccagggccaccggcatcccctacaccttcgcgccatgcgtcgcggtttgccgtgatccga

SEQ ID NO: 1361 - DNA, 367 bp, Triticum aestivum
  unsure (1)...(367): unsure at all n locations
  Clone ID: LIB3280-032-P1-K1-F5
cgaatccggagattggtcaggcagattctgggatggctgagatggtgtgcgacggtgtactgactgacgctcaaggaggtgcccggcgtcgccgtgatgaatctcatacgaggtctgctcaatcgattgacagannnnatccagaggcccccggctggactaaaaggcatcggctggggagcgcgccaccgggccgtgtgccctgtccatcaagaatgagcgccctcgagctgtcgattcgcaaatatgcaaagcaccatgacaagagcgtggtgcgacctgagctaggtttaagttttgattcgctgggtgaggcgtatgatttctacaacttatatttttgagaaatcgggtttgggataagata

SEQ ID NO: 1362 - DNA, 391 bp, Triticum aestivum
  unsure (1)...(391): unsure at all n locations
  Clone ID: LIB3280-032-P1-K1-F7
aaccgatcgaccgatcaccacacgtccacaccacagcagcagcatggctaccaccagtcatgccctcctcatcgccctcgtcgtcctcgccggcctcgccgacctgcaggccgccgcggggcccgttnacgccgcggagcactccgcggcggcggcaatggcgacggcgtacccaatggcggacgaggcggatccggacctgaacgggatgatgcagtgcatgttcgggtgcttcacgtcggtgatgagctgcgcgttcgggtgcatgggcaagggccccgacctgccgctctgcgtcatcagctgcaaccagaagagcatcgtctgcatgatccgctgcggcctcacgccctcgccgccgagccccaagccgncaacgccacccgggccc

SEQ ID NO: 1363 - DNA, 352 bp, Triticum aestivum
  Clone ID: LIB3280-032-P1-K1-F8
gccattggaaagggggaaaagatttgggcgttcgtgcgccggccggaaaaatcctcgtgtccagtgtgtctcctttctcctacctctgtccgtgagtgagctgagagaaagagagcagccagactcggcaacaacaattggtatcatgagcttggttgtcttgggcgtggttcgccgtgccggaggcgtgccggcaatggcggtgttcgccggcggctgcgcgatgctccgggccgtgtgtcggaggtgcgcggcgcggtgaggaggccgcggtggcacggtgaggaggccgcggaggacctgcgtggtggcgacttcaacgacacacagcggcatggcggcatggaggtgc

SEQ ID NO: 1364 - DNA, 394 bp, Triticum aestivum
  Clone ID: LIB3280-032-P1-K1-F9
gcagcaccaccagaacacagaaagcagttcatcttataaaacgtaaaaggacttctttggaggtttctatgcagagatctcttgctgttggcattaagtctgagaacaatggcaagcgggattacactgcaactggtactgttccatccttgcataagcaagatagcaagatactgaccaaaaagaccataaagttgttggatgcgccaccttgtccaaaaaggccaaagctagagccaactcaaaccactagaggtgctgaagctaagggccatgaatcgctgccacataagattgttcctgaaatggtacgatgcacagcatctgaaaaatctgggttgctaaagcagaggcgcatttctgatgcaaagagaattgacaagaagaatgctag

SEQ ID NO: 1365 - DNA, 375 bp, Triticum aestivum
  unsure (1)...(375): unsure at all n locations
  Clone ID: LIB3280-032-P1-K1-G1
aaaacacggcagacaagagagagggaggggcgagcgagcgagacagggagagggggcgcgccgagccagccagcccacaccgaccgcggggaaggccggaaccgaccccaaccggggcagcaggaaagacnnccagcgcaaaaacaacaaggcgggcaccgcacgaaacaccagaaaagagggaagacaggccccgggcaaganaggagccccccgccagcaggagaaggaaccgaaaggccaaggacaaagaggcgagnagggccaccccagacgccgacggagaggggcgacagcaggacaaggcaccggaagcaccgccacaaacacacccaaaaaacccgaaaaggcaacagacggaccccggaagaaaag

SEQ ID NO: 1366 - DNA, 300 bp, Triticum aestivum
  unsure (1)...(300): unsure at all n locations
  Clone ID: LIB3280-032-P1-K1-G11
cgcacctccaatcaccattccccactccaatccaatggagaccagcagtaagaaaatggcgtcgcatctgacggacatccccgaccacctcctggccgagattttcctccggctgcccgacccggctganntnncccgcgcctccgccgcctgcgtgaccttccgccgactcgccaccgacggctccttcctccgcagattccgcccacgctccaccaatcctnggattcctctgggccggcggcatgttctataccactctgccgcctaacccctncgcgcccggccgccacgcgctcg

SEQ ID NO: 1367 - DNA, 309 bp, Triticum aestivum
  unsure (1)...(309): unsure at all n locations
  Clone ID: LIB3280-032-P1-K1-G12
cgcagatgcagcgcaagggcgcaacgcagaatgagtgcatagccgccgcgaatggcgggctcgcaccataggtcgccaatcgggacggggacttcaggtggaaatgctgcaagcttggacgaatcgacgngnnnccgttcaacgtgaaggcgacgaatgaccaatttggtaccatcgccgatgtaaacgctgtggtcacagtcgccacggccggtaagacagagatgtttcagctactgcgcaacgacggtgacaaaaataggaagaggatcaaagcaccgaatgggtgcttgttgcaggcaaataaag

SEQ ID NO: 1368 - DNA, 358 bp, Triticum aestivum
  unsure (1)...(358): unsure at all n locations
  Clone ID: LIB3280-032-P1-K1-G2
agaaatagtaataaaataaccttcataatgaccagtgaggccacgtacagacgaacagacggcccttacactgaagaacacaacggatggntncnnnacacgcactgcatctgcacatccaaattacatacacaaacaaaaatcgcgatacttaatcaaacgcagcagcatacgcgcgcgcgcgcgcatgcaggagctccgggcggccggccgatgcgatcgatcctgcccgcccaccgcaggagccatgcacgcgtgcatgtaagcacggggtaaccggaggatattatttaattagtactcgacggcggcggacggagggtcgtcgatcagaagtcgccgccggcgggtttgacct

SEQ ID NO: 1369 - DNA, 389 bp, Triticum aestivum
  unsure (1)...(389): unsure at all n locations
  Clone ID: LIB3280-032-P1-K1-G3
ccaggtttcatgttggcagctccagtgaggcagcgagagttgtccggtagctgtggtggcacaggatggtgggcggctgatgggatgctgcatttcgaagtgcctggggtggtggtggtggtggtcatggnnnaggagaaatccctgtcggcttgttcggcaccgacacggtgatgcctgcgggtgccgttggtccttcctgaggggcgtcgggtgtatcccttccccactatcccccgtgtaccaggggaaaccctagaacattttcgggcaacaacggtgatgccgtctcatcccttcttgatggtgttgcttggtgcacagcgattcgggatgctggaagcatggtggtacttcttcggagggtgcagcggttgccgggctttctt

SEQ ID NO: 1370 - DNA, 349 bp, Triticum aestivum
  unsure (1)...(349): unsure at all n locations
  Clone ID: LIB3280-032-P1-K1-G5
gccgccgcctcctccttctcctcgggtttgcacagtcgtccaccatgccgaagcagatccacgagatcaaggactttctgctgacggcgcgcnnnnnggacgcgcggtcggtgcggatcaagaggaccaaagacgccgtcaagttcaaggtgcgctgctccaggtacctctacacgctctgcgtcttcgacgccgacaaggccaacaagctcaagcagtccctcccaccaggtttgagcgtccaggaggtttaagcatcaagccagacaatgccttttttagtagcgggaatgttctatccatcttgctttagtaactgttagcaggctcttcttgtttaccctcatta

SEQ ID NO: 1371 - DNA, 370 bp, Triticum aestivum
  unsure (1)...(370): unsure at all n locations
  Clone ID: LIB3280-032-P1-K1-G6
cggacgcgtgggttcttcatgccattcttggacaagaagaacgtcttcgacgaggtcttctccaccgatttcaagatcggcaaaacctaccaaccagaatattgatcgataccgtccaagtttcagttggtcaannccgtcgtaattaattaattcccatgtatgagtcgcgttggaaatatgcgcctgcatgagtggatagtgaataatttaaatatattatgcacatacatgcatatggtaggaaaagcaaggacggatgtgttcccgttgctcgcccatgcatgcatccactgtcgatcgacgcagcacttttcttttgtgtaaccgaatatgctcaagattttgaaatatttgaataatttttgtc

SEQ ID NO: 1372 - DNA, 351 bp, Triticum aestivum
  unsure (1)...(351): unsure at all n locations
  Clone ID: LIB3280-032-P1-K1-G9
caaaaatgacatcagtttgataatgggccaaatctaaagcccaagttatgttatgtattattcagtgttgaatttgtcattttttttgngnaatgtttcaaattttgatttgaaattttgtgacaacctgcattgatgttgtgtgagtgtgataattttttttcagaattctttaaacattttaaaagcacaatatgacttgggtgcaccagatattttgcgcatggtccaacccccattctttatgaccgcctcttaagttaccaccaatggttgctaacgctccaccgtcagactgagatacaagattctttttttggctcttgctgcatgttagattagagtaaatac

SEQ ID NO: 1373 - DNA, 396 bp, Triticum aestivum
  unsure (1)...(396): unsure at all n locations
  Clone ID: LIB3280-032-P1-K1-H1
aaatacactgcagataagagagagggaggggcgagcgagcgagacagggagaggcggcgcgccgagccagccagcccacaccgcccgcggccatggccggcgccgaccccaaccggagcttcatgaaggnnnnnaagcgcatcatcatcaaggtgggcactgcagttatcaccagaaatgatggaagactggctttgggcaggattggagccctgtgcgagcaggtcaaggatcttaatgctcaaggatatgaggtgattatggtcacctcgggcgctgtcggtgtggggcgacagcggctcaggtaccggaagcttgtcaatagcagctttgctgatctgcaaaagccacagatggagctggatggaaaggcgtgcgctgctgttggtcagagtg

SEQ ID NO: 1374 - DNA, 259 bp, Triticum aestivum
  unsure (1)...(259): unsure at all n locations
  Clone ID: LIB3280-032-P1-K1-H10
tcagataattgctgcaggcagccttcacgtcaggagtatgccgcccagcaaacaaacacagagtaggctgtggcgctgtcnnncttactcagctccatgctctgataagcccccagctcgtcttgctgatagtccgaagctcgtggcatgaatggaacctaaatcttcttctggagatcccgcaacatgatgatgcggtttattctcttgtccggttgttagatatagcgtgcgccggtcttatttatcatattgcaag

SEQ ID NO: 1375 - DNA, 321 bp, Triticum aestivum
  unsure (1)...(321): unsure at all n locations
  Clone ID: LIB3280-032-P1-K1-H11
cgctggaaaaactgccaagggagggacttcactattaatggattaatgttcaatccatattcagaaaagatctacgactacctgggaggcattgaagatattaagaaagctaaggttcgtactgttatnnnnnncgccacttcgttccatgaggattgtgctcgtattctacgtgcaatcagaattgcagctcgattaggattcagctttcccaaagaaacagcttattatgtgagaaatcttgcctgttctgtggcaagactcgacaagggaagattactcatggaggttgactatatgcttgcttatggatcagctgaa

SEQ ID NO: 1376 - DNA, 400 bp, Triticum aestivum
  Clone ID: LIB3280-032-P1-K1-H2
cccacgcgtccggaggacaagaccattacagtatacagatgtggtcctttggtcgacctttgccgtggcccgcacatcccaaatacttcctttgttaaagctttcgcttgcctcaaggcttcagcatcatactgcagaggaaaagcagaccgtgaaagcctgcagagagtatatggaatctctttccctgattctaaacgtctcaaggaatatcaacatatgatagaggaagctaagaaacgcgatcataggttattggggcagtcccagaaactcttctttttccatccacttagcccaggtagctgcttcttccttccaaatggcgctataatatataacaaattgatcgattttttgcgcaaggagtatagagagagaggctaccaagaggttctgc

SEQ ID NO: 1377 - DNA, 349 bp, Triticum aestivum
  unsure (1)...(349): unsure at all n locations
  Clone ID: LIB3280-032-P1-K1-H3
ggataaacttgtccattcattaaagacttcgataaatgagttttgggtgaaggctacaacaatcagtagcctccttactcnnngcccgcaaccaaaatcaccacacatgcttgctttttattaagcgcccacgaggtcacacacttgacacacgaactaaactcgactcatccctaataataaaagtgcagctaaactcccctaagattcaaccccgactggcggcgcgacacaatgcgtctctagttgctgcccttgctgatgagctccagggcggtggcggtggtgggcagcgccgggatggctcccttcttggtggtgcagatggcgccgcaagcgttcgagaact

SEQ ID NO: 1378 - DNA, 367 bp, Triticum aestivum
  unsure (1)...(367): unsure at all n locations
  Clone ID: LIB3280-032-P1-K1-H4
gagaggagtgcttttccttcggtttctgccatctttagttgacgaatcggataagataaggcatttggctgactacctatttggaagcatcttaaaagccaaagcgccacttcttgcatataacagtttcatagannttatctacgtcctaaacaattgcacaggacatggtggatatagtgagtctcagtctcagagttctcaagggtcccaaagttcagacagaggacaagccctttttgcgatatggggaactgacgaaaggtcaaggtcaaaacgaatgcacatatatgtgtccttgttgaaacaaatggccccggagcaccttctagctacatcagccaagttatgtgctgagatcttagca

SEQ ID NO: 1379 - DNA, 359 bp, Triticum aestivum
  unsure (1)...(359): unsure at all n locations
  Clone ID: LIB3280-032-P1-K1-H5
cccaatctcatccccaattctgttcggcatggcggccagccagatcgccatcgcctgatcgcacagcggcacgggcaggccgacgacgctacgcaggcatccggcgacatccatctctcggtccaccagcctnnnnnnatctttactccatctcggtagtgggcagcagacaatatcggaggatcactcagtttccagttccaaacttccaaatcccacacattcaaccggcttcaagatggaagtccgtggaggactctactcgggtcgatcgggacagatccacatgtgattggcttcagttcaagaatccaaaatcagaggacggggcttcagcgtggtttcaaagacacgcacgg

SEQ ID NO: 1380 - DNA, 57 bp, Triticum aestivum
  unsure (1)...(57): unsure at all n locations
  Clone ID: LIB3280-032-P1-K1-H6
cgaanatatataaataaaataaaaaataaaaaaaaaataaaaaaaaatatagggggg

SEQ ID NO: 1381 - DNA, 396 bp, Triticum aestivum
  unsure (1)...(396): unsure at all n locations
  Clone ID: LIB3280-032-P1-K1-H8
gcaccctcttccgtcgccgtcgattcgaacctcccccaaatcagcagcagtcgaccggaggcgccgccatggcccgtaccaagcagaccgcccgcaagtccaccggcggcaaggcgccccgcaggcagntngccaccaaggcggcgaggaagtcggcgccgaccaccggcggagtgaagaagccccaccgctacaggccggggaccgtggcgctccgggagatccgcaagtaccagaagagcacggagctgctgatccgcaagctgcctttccagcgcctggtccgcgagatcgcgcaggacttcaagacggacctccgctttcagtcccacgccgtgctggcccttcaggaggcggccgaggcgtacctcgtcgggctgttcgaggacaccaacc

SEQ ID NO: 1382 - DNA, 337 bp, Triticum aestivum
  unsure (1)...(337): unsure at all n locations
  Clone ID: LIB3280-032-P1-K1-H9
gacgtctcctctcctcctccaaatcgagaggccatagagagagagggtcagagagagaaacctagccccttgaatggaggactcgaacggtgccgagatcaaggccccgccgccagtccaccggngcccnccgcgcccgcgtggaggcggcttcacccccgagggcttcgtggccgcgcttcgccgccggctgagctccggtgccgcggtggccgcgcgtgccagcttcgcggcggactctggggacgagttcggcccccccgagccctcctcgtcgcaccgtcgccgcgactcaagcggcgacacctcgtccaccggcggccccggngacttcacc

SEQ ID NO: 1383 - DNA, 339 bp, Triticum aestivum
  Clone ID: LIB3280-033-P1-K1-A1
aagctataagttcaggtatattctgggacgaaggaagtagaaaagaaaagatacatgacccagccaccaagattagactaacacgactgtcaaattagcagatggaaactgcaagttgttttttcccctacctcactggttcatgaaggccgatggaaattgaataaatgtaatgtacaggtacaagatggtgtagaaaaaaatgattactatgtatgtgttgatctatttaggacgtggagcctctgtctctaatccattttgtggcgacccatttctctcctttgaccactgggcagcttccatgaagtgaagtcggatcaatggtaccatttagca

SEQ ID NO: 1384 - DNA, 379 bp, Triticum aestivum
  Clone ID: LIB3280-033-P1-K1-A10
gcattgcattgacatggtctcgtcttgcctcgcctcgccggccaccgcgcgcggtggctctgctctacgtctgcagtttcagccgagagggtgccgcgtgacgtgcttgcccgacgctgggggagccgggagcggcggccgcgccaaggccgtgggagggttcgcgtgcggcttgctcgcagcctgggccgtcgcgtcagcccccagcccggtcatcgccgccggccaggttgcctccactatcaacagacccaaagagatgcgaggctgcatttgttgggaacacaattggtcaggcaaatggggtgtatgacaaggtgcttgatctccggttctgtgatttcacaaatgataaaagtaatcttaaaggcaagactct

SEQ ID NO: 1385 - DNA, 368 bp, Triticum aestivum
  Clone ID: LIB3280-033-P1-K1-A11
tgttcctcaccttcagctgtattgggtatgccatgcctttcatcctctgcgcaatgatatgctgttgtctcccctgcattatatctgtcatgggcttcagagaagacacaaacaatacaagaggggccacttcagaatccatcaatactttgccgacttataaattcaaaaccaagaaacgccgccatggttcaggtaacgaagccgaaggccaagagggaggtatagtggctgcagggactgacaaggagcgatcgctttctgctgaagatgctgtttgctgcatctgccttgccaagtatgcacacaacgaagagcttcgtgaacttccctgcacacactgtttccacaaggaatgcgtggacaaa

SEQ ID NO: 1386 - DNA, 359 bp, Triticum aestivum
  Clone ID: LIB3280-033-P1-K1-A12
tgttttttaccttcagctgtattgggtatgggggggctttcattctgtgcgcaatgatatgctgttgtctcccctgcattatatctgtcatgggcttcagagaagacacaaacaatacatgaggggccacttcagaatccatcaatactttgccgacttataaattcaaaaccaagaaacgccgccatggttcaggttacgaagccgaaggccaagagggagtgtatagtggctgcatggactgacaaggagcgatcgctttctgctgaaaatgctgtttgctgcatttgccttgccaagtatgcacacaacgaagagctttgtgaactttcctgcacacactggtttcacaaggaatg

SEQ ID NO: 1387 - DNA, 108 bp, Triticum aestivum
  Clone ID: LIB3280-033-P1-K1-A2
gccacccgttcgggacattatgatgagcaaacgcccttttgcttcgtgatccaattggtaggggtgcttctccggtgctctctttaaaactaaggaaggaaacccctg

SEQ ID NO: 1388 - DNA, 352 bp, Triticum aestivum
  Clone ID: LIB3280-033-P1-K1-A3
gatacaaggttatctcagtgacctcatttgataagtgccctatttttgtgattgcatgtttgcaatcgggacctcaaggagcagtgctagttcggaagaacgataatgtctccattttgtgaactatatatgaatacttgtgcttatgctaaccaggctggctgagtacaacgaacgcttgttattagctgatgaaggaaccgttatgcggattcaagcctttgatgcggcttgcgagagaagcatgtccagggagcgcctgacagaatcatgtcgggacaaccctggcgtcggcgatgatcgggctccgcaccacgtgatcttcaaacacccagcgtaggctcccctcggc

SEQ ID NO: 1389 - DNA, 292 bp, Triticum aestivum
  Clone ID: LIB3280-033-P1-K1-A4
gatacaacgttatagcggtgacctcatttgataagtgccctatttttgtgatcgcatgtttgcaatcgggacctcatggagcactgttaggtcgcaagaaccataatgtgtgcattgggcgaactatgtatcaagacttgtgcttatgctaaccaggctggctgagtacaacgaacgcttgttattagctgatgaaggaaccgttatgcgtattcaagcctttgatgcggcttgctagagaagcttgtaacacaaccgctcaatcaaatggtgtgtatacaaccctggcatt

SEQ ID NO: 1390 - DNA, 385 bp, Triticum aestivum
  Clone ID: LIB3280-033-P1-K1-A5
acccccgcagagccgaaagccacacaccttcttcctcctctgctcgcatcccggatcggggagaagaaggatctgaggcttttggcagggccggggacgatggcgccactcctcaaggacgagctggacatcgtcatcccgacgatccggaacctggagttcctcgagatgtggcggcccttcttcgagccgtaccacctcatcatcgtgcaggacggcgaccccaccaggaccgtcatggtgcccgagggcttcgactacgagctctacaaccgcaacgacatcaaccgcatcctcggccccaaggcctcctgcatctccttcaaggactccgcctgccgctgcttcggctacatggtctccaagaagaagtacgtctacacca

SEQ ID NO: 1391 - DNA, 387 bp, Triticum aestivum
  Clone ID: LIB3280-033-P1-K1-A6
cggacgcgtgggacgaactccgatcgccactcccccagagaaatcctccctcctcacctcgaacgctccgggaagcagcaaacgcgaggccggccaagatgtcgtggcagacgtacgtcgacgagcacctgatgtgcgacatcgagggccaccacctcgcctccgcggccatcctcggccacgacggcaccgtctgggcccagagcgccgacttcccccagttcgcgcccgccgagatcactgccatcatgaaggacttcgacgagccggggcacctcgcccccaccggcatgttcgttgcaggtgccaagtacatggttatccagggcgaacctggcgctgtcatccgtggcaagaagggagcaggaggcatcaccatcaagaaga

SEQ ID NO: 1392 - DNA, 387 bp, Triticum aestivum
  Clone ID: LIB3280-033-P1-K1-A7
ggacaacccacagagcatcagccggagcacttcttcctcccctccgttcttctccggctccggtgctctcgtacgcgcgttcgtccgagaccaccacctcgtcgaccaagaagagatggagatgaagaagatcgcctgcgccgtccttgtcgccgcctccgccaccgtggccctcgccgccgacgccccggccatggccccggcccccggcgccgccgtcgccggctccgccgccgcctccgtcccggccgtcggcgccgtgctcggggccaccgtgctctccttcttcgcctactacctgcagtaagcgcgccccggcccgagtcagttcgctgcgaggaggaggaaggcaggaagaagaagatcactaaattcgctatgtatggg

SEQ ID NO: 1393 - DNA, 382 bp, Triticum aestivum
  Clone ID: LIB3280-033-P1-K1-A8
aaagtttatgatggcaaatggtgctttggcccgtgtactcattcatactggtgttaccaagtatttatcctttaaagctgtggatggaagctacgttttcaacaagggaaagatccacaaagttccctcaactgatatggaagctctcaagtctccattgatgggattgtttgagaagcgaagagcagggaaattcttcctttatgttcaagattacaaggaaaatgaaccaagtactcacaaggggctggaccttacaaagatgaccagtaaacaacttatctcaaaatacggtttggatgataatacaatagacttcattggtcatgcggtcgctcttcataaggacgatagttatctttcagaacctgcaattgacatt

SEQ ID NO: 1394 - DNA, 337 bp, Triticum aestivum
  Clone ID: LIB3280-033-P1-K1-A9
atataatacttttttgtttcttatatatattgatcattatgcgtcgatacagtacatacttctgtaaccacagtgtgcccaggatcgatctggtagctagtagtatcatatccatttcatgtgttgctaattcgaaactccacttagtatggagtatctatgatctgcattcgtatgcatccttcgtcttacttggaagaggggttgccatcttttactcacgcatctcctcctgggttgacagataccaggcgattcaagccgagggcgccgggcacacgtacagcggcggcacgccgccgttgtcgccgcagctgctcatgaggtcctgcggcag

SEQ ID NO: 1395 - DNA, 328 bp, Triticum aestivum
  Clone ID: LIB3280-033-P1-K1-B1
gtcgttgttgaatgggagacctcaacattagtgataagatatcccttaggtgggggcttgcaggcaatagtttacattattagccctcaacataaagaggacacattgtgatgaattgatcaacctggaagcactaaactctgtgcgccatctagtttgtcctcccaatccaaaaggcttgcctgttcttagagcataaacccttgtgatcatttcgcgaacttcgtgcaactcttctacttgtagtaaaaattctagtgtacttgcccgataataagcactagctggttggcgaagcataatcctcgcgtgagggaatgctatacgc

SEQ ID NO: 1396 - DNA, 334 bp, Triticum aestivum
  Clone ID: LIB3280-033-P1-K1-B10
gggacaccaatagagagtatgagatgagctcgtcaaaagtcaattacaaattattggcaaacaaaaagaatgatcacagaaagcaggtatatgccgcttataagcacatcagtactcaatactgtattatctagggcatgtgaaaaggccataaccacagcaatggttcccgctaacaagagaagcgcataaagtaagaagcatatccagcgtcgtatgacaagacaaaccttatcaaggcccgccgcatgtcgaaaaattccacaaaaaaccgcaacatggaaacaccgttttctctccataacttttgctaagacctaacataggcatgcca

SEQ ID NO: 1397 - DNA, 298 bp, Triticum aestivum
  Clone ID: LIB3280-033-P1-K1-B11
aaacaaaaaaaattgacttggggggcaaaggggtagagagggaaacaaaggctgcagttgcagtccttggtgatcttgcaaatacacttggcccaatataaaaagatctgttcaggaaccacctgttccatgtcgaattttttagggagggccttgattcggacaaaaaaatcagggaggcttcatcgtgggcccagggaatgataaaccaagcaggggttgcttaatatgtaaaatcattttctgttgttggttgggggggaggtttctttttgcgcatttgaaaagtccatttgcc

SEQ ID NO: 1398 - DNA, 337 bp, Triticum aestivum
  Clone ID: LIB3280-033-P1-K1-B12
aatgcaattgcatattttgcatttatacatagatatatagataggcacactcagttgataacatcacatcatcatacagctatatatatagctggactggaaattatgaaacgtacaggcactgcactcactatacgtcttgtatgctgcagctagccagcctatagtaacggcgacgtacggagggcagagagtcttgacatacacgtcgatcattatcgatcacaaaagtttttcacacaaggacgcaacagagacacagaactatgggacgtacgcgaacgcgatagtagtcgctcccggccccggaatatacgtacgtacgtagggtagaatg

SEQ ID NO: 1399 - DNA, 275 bp, Triticum aestivum
  Clone ID: LIB3280-033-P1-K1-B3
cggacgcgtgggcggacgcgtgggtttgcttgcagattctttaacattgaagaatcagatttggtgctcagacctgaaattcagaaagaaagaaagaagcatttgctaggttcaacaaacgacgaccttcactgccattataaaaggccatgttgcacaagtgtttcgggtttcaattcagggaggtgacaccttgatgaaatatttgttctacaataggtgttgctgaaactggagtcatgatggcggtaagaaccttggagggtgttcttata

SEQ ID NO: 1400 - DNA, 384 bp, Triticum aestivum
  Clone ID: LIB3280-033-P1-K1-B4
ccaaaagcagtactggacggatatttatatccaatggtcccctcttggaacacacttggctaccgtgcataggcagggcgcgcaggtgtggggtggtgatgataagtttgttcgtctaatgcgctttgctcatccacaggtgaaactcattgatttctctcctggtgagaaatatttgatcacttacagcagccaggagcccagcaaccctagggacacacatagggtcgtactaaatatctttgatgtacgcactggaaaagtgatgcgggacttcaagggaagtgctgatgatttcactactggtggaaatatgggtgtctctggtgtttcatggcctatcttcaggtggggtggtggaagagatgataagtattttgctag

SEQ ID NO: 1401 - DNA, 380 bp, Triticum aestivum
  Clone ID: LIB3280-033-P1-K1-B5
aacacgcgtctggccacgcggtcgaagtctacctaataaaactcgatctggattggtggttgatcggagaggaataaaccgagcgatacacttctggacccgccgatcgtgatgccgccggccgtacgtacccaatcgcagggatatgaacgaacgtggtcttcgcctctctcgatgacaatgcctcggacaccgctgtgctcgcctcctaggagtccaccgtggcaccacacacaacgggatgatccggtgggccaagcaccagcgggactactgcctacagcgccgtgaccaccagggcatcgataggagtgtggttgctcggctactatatgaaccagtgatggacgcaggaatagctggatctgttcgcatgttca

SEQ ID NO: 1402 - DNA, 381 bp, Triticum aestivum
  Clone ID: LIB3280-033-P1-K1-B7
cttgaagctggtggtattcaggtgatccagattgacgaggctgctctaagagagggtctgccacttcgcaagtcggagcatgctttctacttggactgggctgtccactcattcagaatcaccaactgcggtgtgcaagacaccactcagattcacactcacatgtgctactccaacttcaacgatatcatccactccatcatcaacatggacgccgacgtcatcaccattgagaactcccgctccgacgagaagctcctgtcggtcttccgtgagggcgtgacctacggagccggcattggcccaagcgtctatgacatccactcccccaggatcccctccacggaggagattgccgaccgcgtcaacaagatgctcgcg

SEQ ID NO: 1403 - DNA, 165 bp, Triticum aestivum
  Clone ID: LIB3280-033-P1-K1-B9
gcggacgcggacgatcgcgagcggacaccctaatttataaataaataatagaagcattaaatgaggtaaacaaacaacgaactaaattgccataataaaagatcatgtagaataatagtttagagtttaaatatatgactaatggatttatatataatatttatt

SEQ ID NO: 1404 - DNA, 154 bp, Triticum aestivum
  Clone ID: LIB3280-033-P1-K1-C11
ggggggggtgttcttaatgattttttcatattattatattttttaaatatttatttcttttttttttttttaaaaagccccaaaaaaacgaacgaagagagaagctcggaaacccgagaacaacaacccgggcgagaaagtaggggggcggccg

SEQ ID NO: 1405 - DNA, 374 bp, Triticum aestivum
  unsure (1)...(374): unsure at all n locations
  Clone ID: LIB3280-033-P1-K1-C12
cccacgcgtccgcccacgcgtccgcgacctctcacctagcgcacatccatggcgcgcttcctcgtcgccctcctcgctgccaccctggtcgcggttcaggctggagggcagctgggccacgcggcgccggcgacgggggaggtgttctggcgcgccgtgctgccgcactcgccattgcctgacgccgttctccgcctcctcaaacaacctgcagcagaatccaccagcttcgtgagagaccccgaggacaggccccccttcgactaccgtgattacagccgctcgtcgtccgatgatgaaccgagcaagagcaccgtcgccgcctccggagcggngggcttcgactacgacaactacagcggggccgacgaacg

SEQ ID NO: 1406 - DNA, 377 bp, Triticum aestivum
  Clone ID: LIB3280-033-P1-K1-C2
ggcacgccggcggccaccgtccacgcgcagcaccacctcgccatggcccggcgggtgctccacctccggccccacctcccgtccctcgctccccgcctcgtcccttcgcggcagtacatgtccgacatgcgccgctccgtcttcctcgaccgcctcctacgctccctacgctccgagatctcctcctgccgcgccgagccggcccctccgctcccgccctccgccgcgccgttcgccatcgaggaccgtcccggcgagcagtatgtccgcctgcgccgcgcgctctccgccgaggaggagatcacggtggacgcctcaatggtcgacggcgccgcggcgcccacccgctcgggcgtcaacgccgaagacggcgggcc

SEQ ID NO: 1407 - DNA, 372 bp, Triticum aestivum
  Clone ID: LIB3280-033-P1-K1-C3
gatggcatcaggaaaacattctaattattgaacgaacatgcatgccaccttcggtttccctggtgcttgctctcagactgtatgatactggggaagagcgatgcattgcctgctatctatgggaagatatatgcccaggccaggcactatctatggaggcaaacgaacgtgtagatggcagccgacgaaccacaacattctatatttgcatgaccaaatgcattgactgtggtgtctggcaggaagctcggcctgtgcttgctattgacgcacgacctaactgtgagttatttactgtaactaacggggggctgctgaacagcaaggagtaactgagaacgaacagcgatgggtggctgacctagattgctg

SEQ ID NO: 1408 - DNA, 344 bp, Triticum aestivum
  Clone ID: LIB3280-033-P1-K1-C4
ccgaacccgaaccacaccgtccggtccaccccgagaggagagcgcagccacaggccacagcgacatgccggcgacgccgaccatcatcggtgccctgctggggctgggcacccagatgtactccaacgccctccggaagctcccctacatgcgccatccctgggagcatgtgctgggaatgggtctgggtgtagtgtttgtaaaccaactggtgaagtttgatgagaaggtcaaggtggaccttgataagatgcttgagcgtgcgaaacacgccaatgagcagcgctactttgaccaagacgacgattagctgttcaaatttgtttggcggcaaccgggctttt

SEQ ID NO: 1409 - DNA, 372 bp, Triticum aestivum
  Clone ID: LIB3280-033-P1-K1-C6
gtcatactcgccaccaaaccccccaaaagtatctttccacgccacatatccgggctccggcacggcagatacccaaatctaccccggcatcccctccccccttctcttcccccatcgccgccccgtcccgtctcgtcgccaaccaccaaatcccccgccccgcctcgccaccaaccccacgccaccacccctcgccggccgcctggtatataaaccccgactgccacccccatttcccccagaccacacgactcgccctccgcacagcagccccacctaccgacctaccgcccgagcagctgcgcatctcgccgcccagcccctcccctcccctccccacccgccgcagcaatggcgctcgtcaccaacacc

SEQ ID NO: 1410 - DNA, 382 bp, Triticum aestivum
  Clone ID: LIB3280-033-P1-K1-C7
cattccccgcccgcctccagcctccagcctcctgcgacccggatcgccttccgttcctccagccgagggatccccaaccctagcccggcaaccgtccgcgcgggatcagcgccggcagcggcgatggcgtcgttctcggaggcacccccggggaaccccgcggccggcgagaagatcttcaagaccaagtgcgcccagtgccacaccgtcgacaagggcgccggccacaagcaagtcatgctgatctgcagggcctaacctgaatggtctgtttgggaggcagtctggcacgactgctggatactcttactctacggccaacaagagcatggctgtggtttgggaggagaaaacactgtatgactacctgcttaatccgaag

SEQ ID NO: 1411 - DNA, 381 bp, Triticum aestivum
  Clone ID: LIB3280-033-P1-K1-C8
gatttccttccccatggctccgatcaagatcggcatcaatggtttcgggcggatcggcaggcttgtggccagggttgcgctccagagccccgatgtcgagctcgtcgccgttaacgaccccttcatcaccaccgactacatgacctacatgttcaagtatgacactgtccacggacagtggaagcaccatgaagttaaggtgaaggactccaagacccttctcttcggtgagaaggaggttgcggtgtttggctgcaggaacccagaggagatcccatgggctgctgctggtgctgagtacgttgttgagtccaccggtgttttcactgacaaggacaaggctgcagctcacattaagggtggtgccaagaaggtcatcat

SEQ ID NO: 1412 - DNA, 383 bp, Triticum aestivum
  Clone ID: LIB3280-033-P1-K1-C9
ccttggtatgaatgttaaaagaatggtagatgactttcaacatctttcaaaaagcagccagaattttcagagtatagatgatatggcaaaatttgtgagcaactatcctgaatatcgaaagacacatggaaatgtgacaaagcatgttgctttggtgagcgagatgagcagaatggtggaggaaaggaagcttatgcaagtttcacagacggaacaagagctagcatgtgcaagtggacaagcagcagccttcgaggctgttacttccttacttaacaatgaaagtgtatctgatattgatcgtttgcgacttgtaatgctctatgctttgcggtatgaaaaagagagtccagttcagttgatgcagcttttcaacaaattgg

SEQ ID NO: 1413 - DNA, 361 bp, Triticum aestivum
  Clone ID: LIB3280-033-P1-K1-D1
catcagtggtcctcgcaggcctcttggcggccctgaagatgatcggtggaggccttgtggatcagacctacctcttccttggtgctggagaggctggaactggcattgcagagctcattgctcttgagatgtcgaaacacactgaactcccggtggacgactgccgcaagaagatctggctggtggactccaagggtctgcttgttgagtccagaaaagagtctctgcagcacttcaagaagccgttcgctcatgagcacgaagaactgaagaccctgctggaggccgtccagtccatcaagccaaccgtgctgatcggaacctccggcgtcgggaagaccttcacccaagaagtgatcga

SEQ ID NO: 1414 - DNA, 254 bp, Triticum aestivum
  Clone ID: LIB3280-033-P1-K1-D10
acatccattatatacaccagcgccctttttttttttattaaaaacacggggggcattcatcagttctcatactaatttcaccttccacaaacatacttaactcgaatcatactactattactctcccactaacattcttttctatctagggcaactaatattctatatcttaccttattcatgaaaacctccaccatctcaacctaaatactcactctcaataattttaaatattctaactaaattaacttatt

SEQ ID NO: 1415 - DNA, 376 bp, Triticum aestivum
  Clone ID: LIB3280-033-P1-K1-D11
tgaaaaccctcaggacatcattgtgcaatctgctaggccctatggacagagggctgtcctcaagtttgcccagtacactggtgctaacgccattgctggcaggcacactcctggtacattcaccaaccagatgcagacttcattcagtgagccacgccttcttatcctgaccgaccccaggactgatcaccagcctatcaaggagtctgcacttggaaacatccccaccattgccttctgcgacactgactctcctatgcgttacgttgatattggcattcctgctaacaacaaggggaagcagagcattggttgcctattttggctgctcgccaggatggttctgcagatgcgtggtaccattctcccaggacac

SEQ ID NO: 1416 - DNA, 328 bp, Triticum aestivum
  Clone ID: LIB3280-033-P1-K1-D12
tgaaaaccctaaggacatcattgtgcaatttgctaagccctatgggcggagggctgtgctaaagttagcccattacactggtgctaacgccattgctgggaggcacactcctggttcattcaccaaccagatgcagactaaattcagtgagccacgccttcttatcctgaccgaccccaggactgatcaccagcctatcaaggagtctgaacttggaaacatccataccattgccttatgcgacactgactctcctatgcgttacgccgatattggcattcctgctgacaacacggagaagcagagcatgggttgcctattcaggctg

SEQ ID NO: 1417 - DNA, 240 bp, Triticum aestivum
  Clone ID: LIB3280-033-P1-K1-D4
aataaagacgggcgggggtctgaaattaataggaagctcctattcaattcatcacaacccctggctgtttctttttcttttggagaaccacacaagaatttttacccccggcgaataaaaaccaaaactacttgggtgatcccgatggcaccgacctggtcatttattccaaaacacctgggttaaaataaaagccttttaccactcaaaggggcgccccgaagtggaaaaaagggatcc

SEQ ID NO: 1418 - DNA, 384 bp, Triticum aestivum
  Clone ID: LIB3280-033-P1-K1-D5
aacttatcaagttacgaggggaactgaacccactgcaggaagcatctggtggaaagaagatatctattaacgaccttgttataaaggctgcagccttggctcttcgaaaggtccctgagtgcaacagttcttggatgaatgattttattcgccaataccacaatgtgaacataaatgtagctgtacaaactgagcatggattgtttgttccagtagttagggatgcagacaagaagggacttggtacaatcggtgaggaggtgaagcagttggctcaaagagcaagggataacagcttaaaaccacaagattacgagggtggcacgttcacagtatcaaacttgggaggtccttttggaattaaacagttctgtgctattataa

SEQ ID NO: 1419 - DNA, 380 bp, Triticum aestivum
  Clone ID: LIB3280-033-P1-K1-D6
cactaatcgaattgcacaacatgactggcacttttgctcggaacattcagcaggtattttcagaatcagatcttggagttgtgctgagtacattgaaagctatttattccccatatgaaacctttaagatgaggtacgggcagatggagcgcgctgtgctttctgctgcgatggccggtatagatatccgtggagccatctcccgtggtttaggtgcacaaggtatagagctaagtgaaactgtccgtaggatggaggaatccatcccacagatgatagtacttcttgaagcagctgttgagagatgcattagtctcactggtggatcagaggcagatgaactggtactggctcttgatgatgtcatgctgcaatacata

SEQ ID NO: 1420 - DNA, 346 bp, Triticum aestivum
  unsure (1)...(346): unsure at all n locations
  Clone ID: LIB3280-033-P1-K1-D7
acaggaccggaacgcaagggggggggggaccgacgcgancagaggcacgcgcaggccgacgggcgggccagaagaggaacagaaggggggggaggaggagcagagcgaccaaacacggggagcagaagaggccggaacaggcanggcagagcgcatagcacaggagaaggagaaacacacggaacgcccggcggacgacggccgcaagaagaacgggcgggaggacaccaaggggcggcgaggggaggccagaaaagagaacaggcagcacaacaagaagccgggcgcggaagagcacgaagaacggaagacccggcgggaggccgaccagaccaacaagccaacc

SEQ ID NO: 1421 - DNA, 131 bp, Triticum aestivum
  Clone ID: LIB3280-033-P1-K1-D8
cagtgtgtttagcaagctgccatgtatcttgaagggcttagcaatggcgggaaatagtaataaaattgggatgaattcccccctagtgatgatgtgataacttgattgctttagtcggtacttcctcgatg

SEQ ID NO: 1422 - DNA, 341 bp, Triticum aestivum
  Clone ID: LIB3280-033-P1-K1-D9
aacaatcgagggcattcatcagttctcatactagttgggccgaccacaaacatactcaactcgattcaaacaacgatgacctgacactaacattctcttctgccaggggcaactaagatagattcgcagaggtgattgatgaaaaccaccaccagctcaaccgaaagactcacgctcaaagagtttcaatatcctaactaaatttatttattcctgcctaaggcaaccggccgatgcgcgacgaatggctcctagttgggggcgaagaaaatctcggagtccagcctcttggaccggaagagcttctccatctccggcgtggtgttgaacgacgcctccag

SEQ ID NO: 1423 - DNA, 354 bp, Triticum aestivum
  Clone ID: LIB3280-033-P1-K1-E10
gctacacatccggagctagagcgctagcggtcgtcctttaaaaccggtgggaaaaccaacggaatatggccatacatatactgatgatttgacttatgaccggaacagcaaacgcaacaacacatccgggtatacattgaaagatgaacggatggaagcttgcataaaagattgaagaaacgctcttacaaacaccatggccccgtgcatgtgaccatacatatgattcagcatccagtactgaatgcaacactgaaggataccgtaaggcaatgagtaaaaacatgaggcggaacatactgtcaccatgaactggacgatcgacaggtggtgcgatcgatccaagaatcggac

SEQ ID NO: 1424 - DNA, 144 bp, Triticum aestivum
  Clone ID: LIB3280-033-P1-K1-E11
ggtgtaattgaggagtgacttctatgacaggtgatttgttaaacggggggacattagggggaggctatccataaaaaatgtgaatgtgcaaactagcaggctgatgatagcaagattcaataaatcagattgttaattaaagat

SEQ ID NO: 1425 - DNA, 379 bp, Triticum aestivum
  Clone ID: LIB3280-033-P1-K1-E12
gttcccttgaatgcgtgcagctctctcgctctctcatgtctgatgcacgcacgctgtgctactgctatctggtgacttgctacgcacacactgcaacaggttcttctttggtgtatcaggccaggcgtaatttgttttcaaagatgctcacatacacacacaaacgacatccagtaggcgcttggacaaccgatagattgaaagcacagaagcaaatatttccaatacgaggccacgatgcccgacagagatgtagccaatatgcgcccaatccttatttcttgatgttggaacaaatcaacagggaaaggctcccctgctccatttgcattagaagcctgaacaaacatccctggcttcctctgaagagtgacatatt

SEQ ID NO: 1426 - DNA, 177 bp, Triticum aestivum
  Clone ID: LIB3280-033-P1-K1-E2
ttctctatctataacttgtataacgccgggcgggcgcttgataaagtacccatccatcattctgctgatcacaaccggctgaggtctaaacgtttcttatacgaaaacagactgacgattattgcacaccaggcgaattaaaaccaaccctccttgttttatccggatgacactgac

SEQ ID NO: 1427 - DNA, 346 bp, Triticum aestivum
  Clone ID: LIB3280-033-P1-K1-E3
gtcggacgcgtggcggacgcgtgggaatccgcccatccatccacctcctgccccccgcaggcgattccccaacgtctcggcgcggattcgggtgttcctcgcgcgaatcagcgtggatccgagcaacctacggaatttttgacggcattttctgcagcctgcggaacattgtatctgcaatagtaaaacaatatatgggctgactttggcatttcatgggaggttttgaagatgatgaaccaccctcaaaacgcgcaagagcatcctcagtagagtcagcaaatttaccagaaagtttctgttattcgaaatccattaaccctttgggaggtacaatggctagacc

SEQ ID NO: 1428 - DNA, 344 bp, Triticum aestivum
  Clone ID: LIB3280-033-P1-K1-E4
aataaggacgaacttgttctgaatttaataggaggctcctattcagttcatcacaacccctgctgttttctttttcttttggagaacagcacaagaatatttacacccggcgaataaaaacgaaaactacttgcgtcatccgcatgacacgtacatgtacatttatccgaaaatacgtggattaaataaagcctttttaccactcaaaggggcgcacggaagtggcaaaagggatcctccgtatgccaccggggcgccgagaagtggcgcgtcgtcatgctcttgcccgcctgggcgagctggcgttgcgggcgggcgcgaacctggccgtgaagtccggctcg

SEQ ID NO: 1429 - DNA, 347 bp, Triticum aestivum
  Clone ID: LIB3280-033-P1-K1-E5
caacaaagaacaaattaaaaacagttcatcttcatcacatttcacaggaaacgaacaaggcagacgcaactcagcgccctaccaacagcaaatcctctccggagttcaggtccactgcaaaaactccaagcctttcttttcatctccgcctcactgcagctgttcacgaaacaccctgaggatgtcggcgaaggtgacgatcccggcgagacggcagtcgtcctcctcgtcgagaacccacaggtagctcacgcggtgggcgagggcctgcaccatgacggccaccagcgagctcgcgggactgcacaccacgggctcctcggtcgaccggcgcccaaagctccccg

SEQ ID NO: 1430 - DNA, 323 bp, Triticum aestivum
  Clone ID: LIB3280-033-P1-K1-E6
ccattatacgtagtacatactagatagtcttatcacagcactgcacaatcagtatcgacgtcaccgtacgaacccgtcctacaagacgaagcagatcaagaacaccctcttcaggtcgaccgtggagttcaacggcatgcagtttgtggggcagccgtgcgccaacaagaagctggcggagaaggacgcggcgggggaggcgatcagctggctcacgggcggggaggctcctccggtgacggccaacgcgagagaccggcaggacgccgaccacatgtcggtgctgacgaagccggctccacgcatgaggcggcaccaccata

SEQ ID NO: 1431 - DNA, 380 bp, Triticum aestivum
  Clone ID: LIB3280-033-P1-K1-E7
cccacgcgtccgcccacgcgtccgggatcatcggggccaccaggccctgggaggcagctcctggcaccatccgtggtgaccatgctgtggaggttagcaggaatgtaattcatggaagtgattctgtggagaacggaaagaaggagatcgctctgtggttcccaggaggcttggccgaatggaagagcaacctccacccttggatctacgagaactgaactcacacgatcatctacttctacttgttgatgatgcctcgtttcttcagaattcgagcttgtcccggtctggctatccgagtcgatgattagatttcgtgctgtgtgatgatgttaataaccgaactgaatgtgttgcctgaacctatatggcttttgcgt

SEQ ID NO: 1432 - DNA, 377 bp, Triticum aestivum
  Clone ID: LIB3280-033-P1-K1-E8
cccacgcgtccggaggaactccataaggaagccgattcaggtggtggtggtgcagcgccttcagatgaagaggaagcagttaggtacttgttcaggacatggatgatgacttttgagtacatttgctcgattgcacgggaggatttaatatcgagacctgcttctgggctgatcaacattgaagggagactgcttagtgtggtgaagcaagtagcaattgacatgaggaggctggcatctggggattcgcaggtgtgcgtttgagctgcttttggtgtggggcagtctactgtttcacaagtcacatggaggtttatcgagtcgatggaagagagggctcggcatcatttggtgtggccgggccaggagaggatgga

SEQ ID NO: 1433 - DNA, 327 bp, Triticum aestivum
  Clone ID: LIB3280-033-P1-K1-E9
gataaacttgtccattcattaaagacttcgataaatgagttttgggtgaaggctacaacaatcagtagcctccttacacaaagaccgcaaccaaaatcaccacacatgcttgctttttattaagcgcccacgaggtcacacacttgacacacgaactaaactcgactcatccctaataataaaagtgcagctaaactcccctaagattcaaccccgactggcggcgcgacacaatgcgtctctagttgctgcccttgctgatgagctccagggcggtggcggtggtgggcagcgccgggatggctcccttcttggtggtgcagatgg

SEQ ID NO: 1434 - DNA, 382 bp, Triticum aestivum
  unsure (1)...(382): unsure at all n locations
  Clone ID: LIB3280-033-P1-K1-F10
ttttactagctgctagtagttgcattgacatgcaaagagagggagagggagcaccgaacatggtgcatgtgatatccatcctagcctacaagttatgccagtgttctatctcattggagagaagaagcccgattaaccttttcaatgctagtatagcgccaaggtatgcatgcagatcaagcaagtaagagccccgattgatcatcgacatgtgtgttctaagtcgatctctaggatgtttcttagcagtgcattgcacatatgtaatataatacaaactaataattgngggtgaaaaaaaaaaaaaaaaaaaaaaaaaaaagagggtggggaaaaaaaaaaaaaaaaaaaaaatttttaaaaataaaaaaaaaaaaataaa

SEQ ID NO: 1435 - DNA, 253 bp, Triticum aestivum
  Clone ID: LIB3280-033-P1-K1-F11
cttgactaatgggtgtgtgccttgtgtctatccagtgtcccacgggggggggtatgtacagagtttatccattatccatctcaatgggtgtattaacagtctgtaataacctattgaccagaactcagatgtataattattaaactattatactattgtctataaattaatgcatatcaaaaagattaaccttctccaatagtatatcaccataaatttatcaaactttaatggtaaatattttattttaaca

SEQ ID NO: 1436 - DNA, 316 bp, Triticum aestivum
  Clone ID: LIB3280-033-P1-K1-F2
cccccgcaaaaaaatgacaatggtttcatgcataaaccatcctacatttttttggcgagtatataaaccattctacatattggcgagagatccatcgttaatgcagaagcctaatcagcccagctaaattactaacaagtttgctactgaacagcatgtgatccactttgttgccatggccgacaccatccatttggattacatggaacagggctatccttttaactaacaacaagattggatcaacttttactcgactttttagaaatatactacggggtgctactactaaattaacgaacgagaaagcttaatt

SEQ ID NO: 1437 - DNA, 299 bp, Triticum aestivum
  Clone ID: LIB3280-033-P1-K1-F3
gtgagcaatccttttgtattagatgtcttgtaatccgaaatacttctactctgtgaccatgcttggctagatcctggttgcaatggcatgctaagcaatctcatgttgcatgaattttgtagacagaagccatgcttgaagtcagctgttacttgttacgcaatcgcgattgttcatactggaagcctgttttatcatgatgattgttcttttccaaggtttggctttggggttattgagaatttgtatcatattcttttttatcaagcagctggtgttttagctggctcctttgattc

SEQ ID NO: 1438 - DNA, 380 bp, Triticum aestivum
  Clone ID: LIB3280-033-P1-K1-F4
aagaaatttcaccaataacaagttcttgcttcctgtatacagatagagttttattggcagtgagatagctctgttatgttgaacattttgtactagccatgcaagaaatcaaccaacatttgttcagacacaaaatactttatcctaggcaatgtaggcaagaactacattggaaggcagagccagccatcttcattcgagattgacaggcactccatttatgaatataagtgatcgatgagatcagatcgtctgcatccaagctgattggtgattggtccggggccactgcaagcaggcaaccagccaccgttcttcttccacgtcgtcgtcgtcgagcctgcatcccttgtgctccaacagagggtttggggagaaca

SEQ ID NO: 1439 - DNA, 339 bp, Triticum aestivum
  Clone ID: LIB3280-033-P1-K1-F6
acgttctttggtgcaatccaaaggttagttcatgtctcatggcgtcggctgtttgcgggtgttctcatatacatgcatatacatatgcatcttgtcatcgtcgtgtatatttgtatttctcgaagaaggaaaattggcatacacacgtgccttgagctcgcactcggacatagccgccgatcgagcaggaaaagtaaatggaagtaaccgccggccagccgttctatactttgggggcggatggagtgggcgtggttggaggtttcaggtcttcgtacctcgcgtatggtgaaagtgggcgccctggatcagcaatgggggcggcggtggcgggagcgc

SEQ ID NO: 1440 - DNA, 352 bp, Triticum aestivum
  Clone ID: LIB3280-033-P1-K1-F7
tagctgtcccgatcctggagctgttctcaaccctccctccgtccgtcgcagctccagatttccttccccatggctccgatcaagatcggcatcaatggtttcggccggatcggcaggcttgtggccagggttgcgctccagagccccgatgtcgagctcgtcgccgttaacgaccccttcatcaccaccgactacatgacctacatgttcaagtatgacactgtccacggacagtggaagcaccatgaagttaaggtgaaggactccaagacccttctcttcggtgagaaggaggttgcggtgtttggctgcaggaacccagaggagatcccatgggctgctgctggtgctg

SEQ ID NO: 1441 - DNA, 382 bp, Triticum aestivum
  Clone ID: LIB3280-033-P1-K1-F8
gaagttagagggagggaggagaagatgcaggactgggctggagtgttcagccctctggtgctcttcatcctgctgtcgccggggctgctgttccagatccccggcaagtgccggatcatcgagttcggcaacttccacaccagcgccgtgtccatcatcggccacgccatcatcttcttcagcttcgccgccatcttcctcatcgccgtcggggtgcacatcgacctcggcccctaaaccgaacccggtgttccgtgttttcgccatccatccatcagctgaacatgtagctgggctgggttctctgaaagtttagggtattgtttctgtgggttcatgcataatagtgtccctcgctcgctcgccgtgtcgatcggcgatg

SEQ ID NO: 1442 - DNA, 383 bp, Triticum aestivum
  Clone ID: LIB3280-033-P1-K1-F9
cccccctcccccgccgccgccgccgccgccatatacctcatctccgtccgagtttctcctccccgccccactgctcacacatctcgtcgcctctccctaatccgcgtgccactaacacccaaaccgcgcgtcgccgagcgctagcttccgccctctctcgccgaacctcgtcctcctcgccgcgggccactaatttctgttggattccgtggttgggtttggatttggaggcatgggggaagtggaggacatgctcaaggactatgagatcaagaaggaaggcgaggccgagatcctcatgctcgcgagtaacgccgtgttcttcaatcccgtccaggtgcacaacagagatatgtccattgctgtgttaaggacatttgttg

SEQ ID NO: 1443 - DNA, 339 bp, Triticum aestivum
  Clone ID: LIB3280-033-P1-K1-G10
gatgggataaaccaattctattatacagtatttcacaaacatgtcacacagcatgtatatgcatgcataataacaagcactggtctgttcatgcatccatcacacataatctacgccaataaatccatcattacaagttcattaatatatataactgctcaaacaaaacagaaacaccactcacatcggcgccatcctttttattccagaaacattcagtacttgcttagcatatgcatcgttcaccaggcaacgatcttccagcgctggttgtcgccctcagtccactcccacagaatgagggtggttccatcacgcacaccgccatggtccttgtcg

SEQ ID NO: 1444 - DNA, 379 bp, Triticum aestivum
  unsure (1)...(379): unsure at all n locations
  Clone ID: LIB3280-033-P1-K1-G11
gctgacggagtgcaaccgggactcggacatctccggcgtctccatcgcgctccacgacgggggctccagcatcacccacctcaccggcaccatcgccgggccccgcgacagcccctacgagggcggcaccttccgcatcgacatccgcctaccaggtggctatccctttgagcctcctaagatgcagttcatcaccaaagtatggcacccgaatattagcagccagaatggagcaatttgcttggacatactgaaagatcagtggagcccagcccttaccttgaagacggcattgctatcccttcaagctcttctttctgctcctgcccctgatgatcctcangatgctgttgttgcacaacagtatctgcgtgacaag

SEQ ID NO: 1445 - DNA, 244 bp, Triticum aestivum
  Clone ID: LIB3280-033-P1-K1-G12
ggaggaattgtgtgctaacatcaaggacagttcatttgctttacacatgtttatcagattgagtttttccatatgaagtgggatattgccaactagcctgctgatgttagcaagatttaatagtttagcttgttaagtattgatgatgtagcaccgctggtcgagctactgtttcccctatatttagcgtctggtatggcaaccttgctggatataatatagtagctggtaattctaccttggg

SEQ ID NO: 1446 - DNA, 387 bp, Triticum aestivum
  Clone ID: LIB3280-033-P1-K1-G2
gtttctagctgtgtggagacaggaacgcaaactaaacacaatccgacatgattgatacaattataaagcatgaagagcgaaaaggctgaaactggaacgagacgtagcagctgttctcacacccaggcctcagcgtctggcagggcaccgctcactgcctgcctcgcggcttcgccctgctcgcctcctccggggttgacgggaacagctccacgtacctcgtcccgatggtcatcttatccttgcacatggcagtcttggcaacctcggccgtcgggaactccacaaaggcctcgccagtggccttgccgtccccacggtaagcgatgtgcacgttctcctccgacagctcgtactcaacaaaaaacttgatgatgtcctcgatgg

SEQ ID NO: 1447 - DNA, 278 bp, Triticum aestivum
  Clone ID: LIB3280-033-P1-K1-G3
ggaacgagatattgtttctgttcttacacttttatatatatggattttgtacctctatatatacctgcattacattttatacctattaaactctttcatttattaaatgtttatgtttaactacatattctctttatttatcataattgtttccatagtattgttaccaccttttttctttgctctgtggactaattcttttttaacgatatacttttaatttgtaagatcattttgattggcattcaactatacattgtgggggtgttcatgaactt

SEQ ID NO: 1448 - DNA, 385 bp, Triticum aestivum
  Clone ID: LIB3280-033-P1-K1-G4
cccacgcgtccgcccacgcgtccgtttcatttatggatatgtaccaagagaagcaaagcaaaagcaagatggtgccaggattgttcccaataccatgttgccaaggacggagatgggtgggtggaaaatagatattctgcatccttgaagatagaaataccaagagcttttgtctgtgcggagagtaaaatatttgatgtatctgagtgggctacttgccagggaatggagtgcaaaccaaacactcatggtccaacttttatggtgaacatggttggtgcggataggatgcctcagcgatctcacagttctcggtatccctttagcctggacgccgagatgatccctgaagacgaatttgagctgtggcttcagcaggcattgg

SEQ ID NO: 1449 - DNA, 116 bp, Triticum aestivum
  unsure (1)...(116): unsure at all n locations
  Clone ID: LIB3280-033-P1-K1-G5
tgtganancgacacaccacggagggggggggtaaagggatggtggtgccactcacaaatatgttacacagtaggtatgggcgggcataataactatggagtgtggattttatgcat

SEQ ID NO: 1450 - DNA, 383 bp, Triticum aestivum
  Clone ID: LIB3280-033-P1-K1-G7
cggacgcgtgggcagtggattcctttttagctggcaactcagcattcatgactcggataaaaactcggtgggagaaactaaaagtttccaactgcagcaaatacagaaggcctaggagagggagcaaaacagagccgtcatagaaaaccatgaccacgtagcagttcgggtcaagtaatgcttcgctattggcggggcgagttccgtgtaggcggacgacgtcgaggaggtgaagacgttgtccccggcgccgccgacgccgagtcgatgggggccagctcggattccggcgcgtccagcggatcgctgtgctcgtcgatcatgtcgagcctgacagacgacgacgcagagtcctccccggtggcgggtgatcctacgccgtc

SEQ ID NO: 1451 - DNA, 375 bp, Triticum aestivum
  Clone ID: LIB3280-033-P1-K1-G8
cccacgcgtccgcccacgcgtccgcgcaaagcgaggcaatccatcctcctctccggcggccgcgcgagagagagcgatctccggccacgagaggcgggcgggaccacgagagcctccgccgcccaccaaagccgcggagaaccgcaccggacgccttgtatctccgcccatcttctcaaaggtcttgaaacatggtggccatgtcaacgcttgccgctggatcgttgccgggaactgtggtccccaatggtcttctaacaaggaggtttcaaggctcacaatttcagacaactcaagttaaccgcatctcatttgagcgggaagtttctactaaagcaacactgaggagtgtaaaatgcagtgctcaaacccaaa

SEQ ID NO: 1452 - DNA, 368 bp, Triticum aestivum
  Clone ID: LIB3280-033-P1-K1-G9
ccatggctcctcgtgcgggtatctggccgccggcgccgtccaggataggagctcctccgcggggccgtggcgggcttcagggagaggggcgccgtccgagacaggagcggtggtggccactgtcgacgagttgctccacggcctccaccaacccatgcccgcaccctcctccccctgttacagctgagttcgtccctgtatctttttagttcgttttgtttcctcaccggtacgtactgaattcccagcagtgtttccactgaattccctagctgtgtcgatgattcatgtgtagaacgaaacagttcgaatttgcaagatcattttgattggcattcgactatacattttgggggtgtccatgaact

SEQ ID NO: 1453 - DNA, 345 bp, Triticum aestivum
  Clone ID: LIB3280-033-P1-K1-H1
aaaccaacggcccgagtaccaaggagatcgatgcgcaacgcaagggtcgatccagtccagagctagctccgtcctacaccaaggccaagtggacgatcgatccggccagagacacatgtggtggccgtcgtcgctgctctacccgccgccgccgtcggccttcgtcacggccatgtcggtggtgtcgttcgcgtcgctggcgtccgcgggcctctcggagctccgcggccagcacatggcctactccaagttctggcacgtcgtgtctggacagcagcataacaaggggggcaccggcggcgcgcacctggcgggcccgcacgggatgctggtggcctacgcgcc

SEQ ID NO: 1454 - DNA, 368 bp, Triticum aestivum
  Clone ID: LIB3280-033-P1-K1-H10
cccacgcgtacgcccacgcgtccgctccaggcggcggaagaaaagaagtggcaaaatggatcgacggagcggctgccgcccgtagcataacacaccggtacttcccgtcgacaaagcatgtactccaccgcgccctgcctttttgacgcacacacacacagaggggagagcctttttgtcttacgtacagtggtctggtctagtgctcatgagcccaccgccgccccaccaaccgtggccatcctcacccggattgtgcttttaaactcttggatctgcagagctgtgtccatcgacgatccctttccccaatggctgcgcgggtggccaagtccctgctcctcgtactcttcctctcgtactgctct

SEQ ID NO: 1455 - DNA, 378 bp, Triticum aestivum
  Clone ID: LIB3280-033-P1-K1-H11
cggacgcgtgggccgagctgcagcccccctcgccgtcgctacctcccacgcaaaccctaaccctaggcaccgccgccgccatggccagcggcaacgtgtccaccgtctacatctccgtcatcgacgacgtcgtcgccaaggttcgtgaggacttcattacctacggggttggcgatgccgtcctaaacgagctccaggctttttgggaaatgaaaatgctgcactggggcgcaatctcagggaacatcgaccgcaacagggctccccccgcttccgctggaggcgctcctggtgctggcgcgactccacccgtgcacgacctcaacgtgccctacgaggctacgtccgaggagtacgccaccccaaccgccgacatgc

SEQ ID NO: 1456 - DNA, 85 bp, Triticum aestivum
  Clone ID: LIB3280-033-P1-K1-H12
cgaacacgtgggcccaaacataaactacatgtcattcactacatacagggcgaaccctaaccgtaggtacctatgccgtcatttt

SEQ ID NO: 1457 - DNA, 58 bp, Triticum aestivum
  unsure (1)...(58): unsure at all n locations
  Clone ID: LIB3280-033-P1-K1-H2
ccggccggaancccgggcgacccacgcgaccgaaaccaaacggacaggaaacaggaac

SEQ ID NO: 1458 - DNA, 386 bp, Triticum aestivum
  Clone ID: LIB3280-033-P1-K1-H3
accccctaccgacgcggcgcctgagcactcctgccccctcgtggcggcgagagccaggcggggcccggccgccgccggcgcatggcctccgtcgacgccgcgggtgaccccctccgctccttcgcctctgcgacgtccctgcttttccggacccttggccctgccgcggcctccgcatccccctccagggcccctggggcgctgctcggcggatccctgaaacgctccacggagctgatggagcaggccagcctggtcttgaaggagcggggggacatccagaagctctatcaggaggatcgagtggatggcaagaacaaccagcagggtagaaggcctgggctggaccgcaagcgggctcagttctctctcaagcccacccaaag

SEQ ID NO: 1459 - DNA, 104 bp, Triticum aestivum
  Clone ID: LIB3280-033-P1-K1-H5
gtcgccacgcgtccggttctgatcgcggcgccgctcgaatcagaactactagcaaaaagggggatgcactggacgctattttacaacgtcatcactggaaaaac

SEQ ID NO: 1460 - DNA, 95 bp, Triticum aestivum
  Clone ID: LIB3280-033-P1-K1-H6
caactccaacgcagggacccaaacgggcatggagttgtggtcttctttagagcggctacaactcagggacccaaacgggcatggatttgctttaa

SEQ ID NO: 1461 - DNA, 339 bp, Triticum aestivum
  Clone ID: LIB3280-033-P1-K1-H8
gtctcgggttgccggacatctcggaggccaagaagaaggcggtggccgtgccctacgacggggaggacaagaacggtttcttgaagaagcttgcgctgaggtttaaggacccggagaacaccacattgatcatccttgacaagtttgatgggaactctgaactagttgctgagcttgtcacatccaatggctataaaggtgcttttgcggtaaaggatggtgcggaaggacctcggggatggcagagcagtgatcttccgtggactgctcccaagaagggattcagtttggacttcggtgagctatttggggatggttcagaaggtgtgcctgtcacaa

SEQ ID NO: 1462 - DNA, 381 bp, Triticum aestivum
  Clone ID: LIB3280-033-P1-K1-H9
cggacgcgtgggctctggagatgactctgccttgcagcccattcgtttgatcagggatgaacagaggacactctctattggaagcaaaccagatccgagcaattctgattcttcgttgtcgttccccttgccacaagtatcagagatccatgctactatcacatgcaagaataagggtttctatttgaccgatctcggaagcgagcatggtacatggtttaacgacaacgaaggcagacgctaccggttacctccgaacttcccagttcgtttccacccttctgatgccattgagtttggttcagataagaaggccatgttccgggtgaaagtgctcagcacgcttccatacgactccgcgagaggtggagaagttctgca

SEQ ID NO: 1463 - DNA, 409 bp, Triticum aestivum
  Clone ID: LIB3280-034-P1-K1-A10
cggacgcgtgggaacccctcacgagttcggccaaaatcctcctcctctctacccgaacaaaccccagctgcatccatggcgaagccgcggcttcttctctgcctgctggtcgccgccgccgcgctcctgctcgtcgcctccgcgaagaagtccggcgacgtctcggcgctccagatcggcgtcaagtacaagccagaatcctgcagcatctcggctcacaaaggtgacagagttaaagttcactaccgtggaacacttaccgatggaacagttttcgattctagctttgaaaggggtgacccgattgaatttgaattgggcactggtcaagtgatcaaaggatgggatcagggaattttgggcatgtgcattggtgagaagaggaagctgaagatcccttcaaagctcg

SEQ ID NO: 1464 - DNA, 396 bp, Triticum aestivum
  Clone ID: LIB3280-034-P1-K1-A12
cggacgcgtgggctgggtgaggaattcgagggctatattttcaagatcatgggtggctgtgataagcagggtttcccaatgaagcaaggagtgctaactcctgggcgtgttcgccttctgcttcacaggggcacatcttgcttccgtggacatggcaggcgtgttggtgagcgccggaggaagtctgtccgtggttgcattgtcagccaagacctatctgttatcaacttggtgattgtcaagaagggcaagaatgatctgccaggcctgaccgacactgagaagcccaggatgaggggacccaagagggcttccaagatcaagaagctcttcaaccttggcaaggatgatgatgtccgccagtatgtcaacacataccgcaggtccttcacaaac

SEQ ID NO: 1465 - DNA, 415 bp, Triticum aestivum
  Clone ID: LIB3280-034-P1-K1-A3
ggtcgagctccgatcgctcaaggccaagttcgtgtctctgaagagggactccggccatgtcaccaccaagaacctcccggggctgatgaagaagctcaggggacttcacgaagtggtccccgaggaggagatcgccgctttcttgtcggagtcgtaccccgacagcgaccaggagattgagttcgagtccttcctccgggagtacctgaatctgcaagcaagggtaagcgccaaggaaggaagcgccactgctggcggcggcggggctggcggccgcaagaactcgtcgtcgttcctcaaatccaccatcactacgctgctgcacaatctcaaccaggcggagaagtcttcttacgtggcgcatattaacacttaccttggtgaagacccattcttgaagaagtacttgccaatc

SEQ ID NO: 1466 - DNA, 341 bp, Triticum aestivum
  Clone ID: LIB3280-034-P1-K1-A5
tttttggttgttttttttttttttttttttttttttttttttttttttttgggagagcaaggtcataatcacttgaaattatagactaaatttgcaacaaaattggttctatgggaaaacaccaattccctacaagtccattcggattttgcccccacacacatgtttggggcacaggaatcccgaatcacagggttgtcttccagtaccatgcagcagggcgagaattcatcattcgcccatgttgtgacccaacttggtagcatcttcatgggaaattaaaggaggacgatgtctttccacttgttaaataaaccaagcgcaaccccacctgtgttttt

SEQ ID NO: 1467 - DNA, 411 bp, Triticum aestivum
  Clone ID: LIB3280-034-P1-K1-A6
gctaaatacaagtcggggcttgttcaattcctgcttaagcaggctggtgttgacaaaagaacaggcgacttgtacgggaaccgtgacctattaaatattgctcgcaacatggctcgtggacttaagggcgttgagaacgtatacacccaacaccagcctctgatcttccaaacaatggaaggaattgtcaaggggcgattacgggatgctgactatccacttgttggcaaccatttccagcagggcaggcctcaagatgttgtgatattcatcgttggtgggacaacttatgaggaagcaagatcagtagccctttataatgcagcaaatcctggagttcgtttcttccttggaggttcagtggttctaaattcgaagagatttcttgaaaacctgggggaggcacaaaga

SEQ ID NO: 1468 - DNA, 391 bp, Triticum aestivum
  Clone ID: LIB3280-034-P1-K1-A7
cccacgcgtccgccaaggcaaccaccacctacagagagcagctatcatcctcttcaaggaagaaagaggagcaagaaatggcggcgagggcggtgacgatgctggcagcggcggcgctcgtcgtcgtggcggcggtcctggccggcggcgcgtcggcgcagtcgacgagcgggtgcacgcagactctcatcggcatgtcgccctgcctcaactacatcacggggaacgagacggcgccatccaagtcgtgctgctcgcagctcgccaccgtggtgagctccaagccggagtgcctctgcgtggcgctcaacgccgaccccgccgcgctcgggctcggcaccgtcaacaagacccgcgccctcggcctccccgaccagtgcggcgtcaagac

SEQ ID NO: 1469 - DNA, 410 bp, Triticum aestivum
  Clone ID: LIB3280-034-P1-K1-A8
gatggattaatcagatgctgggattcaacaattttccatgaaaagtatcgcatcactgctggattaggcggtgctggtagtggaagtgaattttgtatatggtcattactatttctaaggtgcggaacccttgttagcggagatagttctgggagcgttcaattttgggataaccgccatggaactcttctgcaagcccacacttaccataaaggcgatgttaatgcactagcaactgtgcctagtcagaaccgggtattttctgcaggatctgatgggcaggtaattttgtacaaggcatcgaaagatgagttcagtgctcataacgagaaggtggctgaagagcaaatgcacaagtgggtctatgtgggatatgtcagggcccattctcatgatgtaagggcattgac

SEQ ID NO: 1470 - DNA, 396 bp, Triticum aestivum
  unsure (1)...(396): unsure at all n locations
  Clone ID: LIB3280-034-P1-K1-A9
cccacgcgtccggcggcggcggcggcggcggcggttggccctctcgagtcatggtgctacccgccaccctctcgcgcgacgccagagctcactcgtgccctgcacaggacggccagggggaagcggggccgccgcgcccgtgcagaccgcccgcgttctacagctccgtgttcgcgcagatcgaagaggtcgggtgggggcagctagtgagcgccacaggcgacgacggcgtgtcgtgcatcaccttccgcgtcgtggatgagcagcgacggcaacatttactggagatcacactgcccatgaactacccggcatgccctccttcaattgctgcggatgttccttatctccccaaattacagtggtcaaaaaagctcgaganctgaagatgttctc

SEQ ID NO: 1471 - DNA, 402 bp, Triticum aestivum
  Clone ID: LIB3280-034-P1-K1-B1
gtttggtggaaatttttttggcttaggtggcttcggactcgggggctttggacccgggcttgggcggtggcggcggcggcggcggcggtggtggcggaggctcctgtagcagtccatgatgcacttcttcttgcacttgaagtactttccccagtcgctgccgccgctgtcgtcgtcgtcgtcatcatcatcatcatcatcatccttatcgtcgtcatcatcatcatccttatcgtcgtcatcatcatcatccttatcatcgtcgtccttgtcatccttatcatcgtcgtccttgtcgtccttatcatcgccgtcgtccttgtcgtcatctttgtcgtagtccttgttatcgtcgtcgttggcatcaccgatgtggccgactgcatgatcggtggctggagt

SEQ ID NO: 1472 - DNA, 410 bp, Triticum aestivum
  Clone ID: LIB3280-034-P1-K1-B10
ggtcgagctccgatcgctcaaggccaagttcgtgtctctgaagagggactccgggcatgtcaccaccaagaacctcccggggctgatgaagaagctcaggggacttcacgaagtggtccccgaggaggagatcgccgctttcttgtcggagtcgtaccccgacagcgaccaggagattgagttcgagtccttcctccgggagtacctgaatctgcaagcaagggtaagcgccaaggaaggaagcgccactgctggcggcggcggggctggcggccgcaagaactcgtcgtcgttcctcaaatccaccatcactacgctgctgcacaatctcaaccaggcggagaagtcttcttacgtggcgcatattaacacttaccttggtgaagacccattcttgaagaagtacttgg

SEQ ID NO: 1473 - DNA, 377 bp, Triticum aestivum
  Clone ID: LIB3280-034-P1-K1-B11
aggaggcagcggtggtgggataatggcggcatcctcgcagcccctcttccggctcctgctctcgccgccgccgagaccatcccgcctccgcctccgcctccgcctcggccacccgcacctcctcgtccccgtccggtcccgcccgcatcgaccctccacatccacccgctgctgctcctcctcctccgccgcggcctacaacggctgggccgaactcccggccgccgacgacccgctgggcctccccttcctccgcatcacgcagcagtccctcgccgccgccccggtcctgctactcctcccggtcgccgcgctctcccttttccgccttccgcccgtcccggttcttgacgccttcttcgccgtcggtttcgtca

SEQ ID NO: 1474 - DNA, 407 bp, Triticum aestivum
  Clone ID: LIB3280-034-P1-K1-B12
cggacgcgtgggtgtgccgcttggaatctgttccgtccatcctctacaggtcagtttctctaccccttctgtacatcccctatttttgatggattcacttacttgatccgatctctgttttgggggaagaggagatcagaggatgagcaccagatgatccgactacagaaactgagagaaatcagagacttgacagccgtgatttattgcttcttatatcacgcaggcattagggctctcccaatctcatcctagaggaataggacaccttgcatgaccgtgagcaccgctgctcatcgcagcttgtcagattaggctggttcaagcagtgtcttaggcatgctactatccaaggcggtcttcgcgcttccaccctacatccacgctatccaccatgtcttctccta

SEQ ID NO: 1475 - DNA, 416 bp, Triticum aestivum
  Clone ID: LIB3280-034-P1-K1-B2
cggacgcgtggggcggcggcgatggcgacggcgacgagggcgaaggacctggcgcggaggtcgccgaagaagtacgtggaggaggcgctctaccggcggctgttccggcgggggtcgacgccgcaggcggtgcgggaggaggtggacggcttcctcggcagccgcaagcgcgccttcaagtgggaggtcggcgtctgcgtccgccgcctccggcgccaggagctctaccgccccgccctcaagcttactgaagttatgactagaagaggcatgaatcctacagtcggtgatcaagcaatccgcttggatcttgttgccaaatcgagaggcatcgctgctgctgagaagtacttcatggacctcccagaaacttctaaaacacatctcacatatggcgctcttctcaactgttactg

SEQ ID NO: 1476 - DNA, 405 bp, Triticum aestivum
  Clone ID: LIB3280-034-P1-K1-B4
cggacgcgtgggggctaagcagcatccagcagcaggtggcaagcgagctcactcgatcgcgctcgccatggccgcgtccaccgccgcccgacgcttcctcctcctcctcgccgcagtgaccgtcgtctccgtggccgccgcggcgccggcgccggcgccacccccgccgttccggacggtgtacgcgttcggggactcgttcacggacacgggcaacacgcactccaccaccggtccttactcgtacggctacgtctccaacccgccctacggcgccaccttcttccaccgctccaccaaccgctactccgacggccgcctcgtcgtcgacttcctggccaccgacgcgctcgcgctgcccttcttacttccgccctacctctccctcgccggccccaacgccac

SEQ ID NO: 1477 - DNA, 407 bp, Triticum aestivum
  Clone ID: LIB3280-034-P1-K1-B6
gccatggcatcacaagttacggtgtcttaaaggcgtcgtcttcatcagttaacttcgaattgggatcctcattcctgggcaagaccacatctcttcgggcatctgttaccacaagggttgtgccaaaggcaaagtctgcggctcagatactacctgaggcatcttacaaagtggcagtacttggtgctgctgggggcatcgggcagccattgggcctgttaatcaagatgtctcctctggtctcagaactgcgcctgtatgatattgcgaatgtcaagggagtcgctgccgatctcagccactgcaacacaccttctcaggtcatggactttactggccctgcagaattagccaactgcttgaaaggtgtggatgttgttgtcatccctgctggggtcccaagaaag

SEQ ID NO: 1478 - DNA, 390 bp, Triticum aestivum
  Clone ID: LIB3280-034-P1-K1-B7
cggtgatggaggtgcgtccacacctcctcgtccttctctgcctccttggcgccggcgccggcgccgggatggcgcagtctttgccgccggcgccggtgccgcagtccggggcggcggcggcggcgccgaggcccacgccgttcgggcgcaccatgtccacggtcatcaccgtggccatcagcgtcttcttcttcctgctcttcttctgcgcctacatcaaccagtgccgcctcgccgagaacgccgcgccgcagggggccaacgccgccgcggccggggccggtgcgtccaggagggggaagcgcgggctggacccggcgctggtggccacgttcccgatcatgcagtacagggagatcaaggagcacatgatcggcaggggcgtgctgg

SEQ ID NO: 1479 - DNA, 412 bp, Triticum aestivum
  Clone ID: LIB3280-034-P1-K1-B9
aggaggcagcggtggtgggataatggcggcatcctcgcagcccctcttccggctgctgctctcgccggcgccgagaccatcccgcctccgcctccgcctccgcctcggccacccgcacctcctcgtccccgtccggtcccgcccgcatcgaccctccacatccacccgctgctgctcctcctcctccgccgcggcctacaacggctgggccgaactcccggccgccgacgacccgctgggcctccccttcctccggatcacgcagcagtcccttgcccgcgccccgcttcttcttcttcttccgggcggcgggcttttcctttgccggcttccggccgccccggttcttgccggcgtttttgccggccggttcggcaaccgcagggcacctggcccgggccccggggccttc

SEQ ID NO: 1480 - DNA, 413 bp, Triticum aestivum
  Clone ID: LIB3280-034-P1-K1-C1
cccacgcgtccgcccttcgcctggagccaccagctcagacaccaccagcaacggcgaaactagtcctggcaatgcagatgagcccgccgccggctgcctcctcaccgttggcatgcaggtgctggccagcgccgtgccttcagccaagctcaacctctcaagcgtcactgcaatcaacagccacatctgcaacaccattcaccagattacaacagcactcaagtgtgccggaggtggccggactgagccggcgcctgcaggttccgaccagtagcaagagtcgctgggtgggagtggagggaagcacacgccgcagaccaaagtccaattattttgccacctgctaacacctcaagcatccctgttagcaacacagatgcaagggaggatttgacaggagcccacaagactaa

SEQ ID NO: 1481 - DNA, 274 bp, Triticum aestivum
  Clone ID: LIB3280-034-P1-K1-C2
gggaaaaaaaaaggcccaaggattaaaaaaccccacaaagggccccttgggggctccacactataatcgggttaccctgggggaagcaaatgagtctacaaagggggggaataatatggccccgggaaaactagccgacatgttattctgaacccactggtggggagaccatctaacgggcagggtaaaacacccaatccaaaggggggggaatgagagctcacaaatcccaccccgggaaaaaagtttgttttttcgggaaaaaaatttacct

SEQ ID NO: 1482 - DNA, 414 bp, Triticum aestivum
  Clone ID: LIB3280-034-P1-K1-C3
cccacgcgtccgctgacatggcgtgcaggccggccgtatccaacccctccgcactcacgccggcgccgcgccgacgcgtcgtccctggccgcagcagcactgggggacgcgttgactgccccctccgctccagctccacgggtgcggtcagactcggcgcgcgccgcgcccctgccgccgccttcgtcgtccgcgcggcggctgccgagggtgacttggatctccaggctaaggtgacgagcaaatgcttcttcgacgtcgagatcggcggggatcgcgcaggcaaggtggtactcgggctcttcggcgaggtcgtccccaagactgtcgataacttccgcgccttgtgcactggagacaaaggttatggatacaagggctgctccttccaccgaattatcaaggatttcatga

SEQ ID NO: 1483 - DNA, 413 bp, Triticum aestivum
  Clone ID: LIB3280-034-P1-K1-C4
ctcccccaagcaaacccaaatcggccgccgtcccctctcctcctccgtcctccgcccacccccgccgccggtgccgcctcctcgcgagatctcgaccatggagggcagcagcggcctcgacgcggcgatcgagtcgctcctgaacacggagaagcagtgccgcctcgccggagatgtggccggcacccggaaggccgccgtcgacatcgtcgagctctgcttcaaggacgccgcctggaagacgctcaatgaccagatcgtcgtcctctccaagcggaggggccagctcaagcaggctattactgctgtggttcagaaagcgatggagtacattgacgtgacaccagacgtggagacacgtattgagcttatcaaaacattgagcagcgtcgctgctggaaaaatatatgtgg

SEQ ID NO: 1484 - DNA, 403 bp, Triticum aestivum
  Clone ID: LIB3280-034-P1-K1-C5
cccacgcgtccgcccacgcgtccggccgcgcgtgggacctcaaggaggacgatgccggcaagctcgtctccagccagcctgcgtctggcattgtgaagctcactgctggacagaagctcccggtgccggtcgatgctgaccgcaaggacatggctcttaactgccttgaggccaagctggacgtggacatccccaacggtggccgcgtggtggtgctcaacaccgcgaacctgcctctggtcaaggaggttgggctcggtgccgaccttgtcaggatcgacgcccactccatgtgctccccgggcttctcctgtgactcggcctaccaggtgacctacatcgtccgcggcagcggccgtgttcaggttgtcggccctgatggcaagcgcgtgctggagacccg

SEQ ID NO: 1485 - DNA, 408 bp, Triticum aestivum
  Clone ID: LIB3280-034-P1-K1-C6
cactgacttaatcaaagagataatcaagaatgacaaggcctatgttgtagacggtgatgtttacttctccgtcgacaattttcccgaatatctcagtttatctggcaggatactggaccacaatcgtgctggttcacgggttgctgtcgatacaagaaagcggaaccctgcagactttgcattgtggaaggctgctaaggaaggtgagccttcttgggagagcccttggggtcagggaaggccaggatggcatattgaatgcagtgcaatgagtgctcactatttagggcatgtgtttgatattcatggtggagggaaagatttgatatttcctcatcatgagaatgagcttgcacaaagtcgagcagcttatccagaaagtgaggtcaaatgctggatgcataatgg

SEQ ID NO: 1486 - DNA, 356 bp, Triticum aestivum
  Clone ID: LIB3280-034-P1-K1-C7
ggtttcccggtgcaacgcacgggcccttttgctagttcattacttaaggatactgctgtgccagcaacggtttcaaccaacataacatggggactcgatagttttcaaaccaacacataggactgacacaaacgagaaaacagttcaaacgatcgacagggcaccaccaaccggacgaccaaggataaaccagcaggtacaacgccaggacaattactgaccaccacggaggcggagcaccaggtggagggtggactccttctggatgttgtagtccgcaagggtgcggccatcctccagctgcttgccggcgaagatcaggcgctgctggtccgggggaatgccctccttgtcct

SEQ ID NO: 1487 - DNA, 413 bp, Triticum aestivum
  Clone ID: LIB3280-034-P1-K1-C8
cggacgcgtgggcggacgcgtgggctcgcgcccgcaccccaggaaggtaagctcaagaggctgtcctgagaagctcaaatggctcccaaagttgctgttgccaagaagggcgatgccaaggcccaggctgccaaggttgccaaggctgtgaagtccgggtcaatcaagaagaccgcaaagaagatccgcacgtctgtgacatttcaccgccccaagaccctgtccaaggccagggaccccaagtaccccaggatcagcacccctggcaggaacaagttagaccagtaccagatactcaagtacccgcttaccactgagtctgcgatgaagaagattgaagacaacaacacccttgtcttcatcgtcgacctgaaggcagacaaaaaaaagatcaaggctgccgtgaaaaagat

SEQ ID NO: 1488 - DNA, 411 bp, Triticum aestivum
  Clone ID: LIB3280-034-P1-K1-C9
cccgccgcctccgcactgtgccgccgcagccgcagccatgggcgcgtacaagttcgtgtcggagctatggaggaggaagcagtcggacgtgatgaggttcgtgcagcgcgtgcgttgctgggagtacaggcagcagccggccatcgtgcgcatcaccaggcccacccgccccgacagggcacgccgtctcggcttcaaggccaagcaggggtatgtggtctaccgtatccgtgtcaggcgtggtggcaggaagaggccagtgcccaagggtattgtctatggtaagcccaagcaccagggtattacccagctcaagttccagaggaacaagaggtctgttgctgaagaaagagctgggcgcaggctgggtggtcttcgtgtgctcaactcctactgggtgaatgaggactc

SEQ ID NO: 1489 - DNA, 406 bp, Triticum aestivum
  Clone ID: LIB3280-034-P1-K1-D10
acgggattcaactgccgatgcggtaacatgtactgttcactgcatcgctattccgacaagcatgactgccagttcgactaccggactgcagctagggatgccatcgccaaggccaacccggtggtgaaggcagagaagctcgacaagatttaggtgtcctacagggaagaaatggttgcaatctgccaaggttcatcatccgtctttgctgtgccatccttgcacctccctttcttgttggctgccgcatttcctaaattgtacggcatcgtgatgcacactgcgtcgtggcggctgcaagaactcaatcctcagtattgtggtttgcgtgttgtgtaactttattcatggtggttttttcggtcagtattgtggcttctcattttagctagctctgttatgtact

SEQ ID NO: 1490 - DNA, 132 bp, Triticum aestivum
  Clone ID: LIB3280-034-P1-K1-D11
atctgtttctttagtagtagtttttgtattgtattatcaagctttttgtggaccttatctaatggccagaactagtctctagaagcaaatgttaagatctatgcatctgataccatgactaattattgctaa

SEQ ID NO: 1491 - DNA, 191 bp, Triticum aestivum
  Clone ID: LIB3280-034-P1-K1-D12
gtaccagctttccctatagtgtgtcgtattaatatttgaaaatattatatatattattgttatatgattgataaattttttttttgaaaattgttttctataaaccacaatttttatttaaattgataaaatttatatatttatatctaatattttttattaattatttaaaatatattaatattttaata

SEQ ID NO: 1492 - DNA, 233 bp, Triticum aestivum
  Clone ID: LIB3280-034-P1-K1-D2
ggtgggggtgacaggaaaacaattactattcattaattgtctgaacaagcaggttaggcacatgagactggcacatccggttagcacgtcggtccgtaccagaattgccaggcctctacactgcttggggacttctttgggaagtgcatggaagacccgcgccactggaacaagggcttgggacttacattaacacactattttaataacacacactggctacgttattttat

SEQ ID NO: 1493 - DNA, 411 bp, Triticum aestivum
  Clone ID: LIB3280-034-P1-K1-D3
cgcgcgcagggacagtgaagggatcctctgccatggcgagagcggcggcgcccttgctccccttcttcttcctcctgctgtcgtcaacatcgccggcggccgcccagaagaatctccttggccggactccccagatggggtggaatagctggaaccacttcggctgcaagatagatgaggtgataatccgaaaaatagctgatgccatggtggatactggtcttgcgaaactgggatatgagtatatcaacttagacgactgttgggcatctcatgacagagactcccagggcaatctagctgcaaatggaacagcatttccatcaggaatgagggccttagcagattatgtgcacgggaaagggctcaaacttggactctacggcgatgcaggactgcgaacttgcagca

SEQ ID NO: 1494 - DNA, 406 bp, Triticum aestivum
  Clone ID: LIB3280-034-P1-K1-D5
cggacgcgtgggcggacgcgtgggcagcgcggggcttgagtccctatggtcgctcctattcggcaccccggaggagatggagcccatgtggttgccgcccaggggactcgacgttggcgccgagtccgcctccgcggtgacgggggccaaaggggctcgtcgccggcgacgatctaggcgccatccccacccactgcggcgccggccttggcggagttcgaccccgccgcgccccattcctcgggaggcgccccagagcttgcaggtacacctccagattattggcgtcaaggtcaacgttgcgcaagaacagaacagtaagcagattggtccatgattagcggtgtatagagtagagaaacacgtaatgtaatgctcaagacaaaccggccaaccagggcagcca

SEQ ID NO: 1495 - DNA, 89 bp, Triticum aestivum
  Clone ID: LIB3280-034-P1-K1-D6
tctctgctgtcgttcctgctttacttatattgatgttttatttttttttttaatttttatttggtgttattcgtgttattttttttatg

SEQ ID NO: 1496 - DNA, 409 bp, Triticum aestivum
  Clone ID: LIB3280-034-P1-K1-D7
gccacactctccagcaccagcaggccggcggcaagcagcgcaagcacagcagcaaatggctaccatcagcgccgccgcggcgaccaccgtcgtcgcccgtgccgccatcgccaggccgcaggccctaggtctgccccagctgaggacgaggagcgagagggtgaggtgcagctactccaaggacgccaaggaggcgaccccggcggccgccgtccgcggggccggcgcgtccctgctcgccgcggcgggcgcggtgaccgcgtccgcggggccggcgctcgctctggtcgacgagcggatgtcgacggagggcaccgggctcagcctggggctgagcaacaacctgctggggtggatcctcctgggcgtcttcggcctcatctggtcgctctacaccgtctacaccttc

SEQ ID NO: 1497 - DNA, 409 bp, Triticum aestivum
  Clone ID: LIB3280-034-P1-K1-D8
agcctttgtgcagcctgctttctatgaggctttcggtcttactgtgatagaggccatgacatgtggccttccaacattcgccactgcatatggtggtccagctgagatcattgtgaatggtgtgtccggctaccacatcgatccttaccagaatgacaaggcctccgcactgcttgtggacttctttgggaagtgcaaggaagacccgagccactggaacaagatctcgcagggaggactccagcgcatcgaggagaagtacacctggaagctgtactctgagaggttgatgaccctttctggtgtctatggtttctggaagtacgtctccaacctcgacaggcgcgagactcgtcgctaccttgaaatgctctacgccctcaagtaccgcaaaatggctgaaactgtc

SEQ ID NO: 1498 - DNA, 412 bp, Triticum aestivum
  Clone ID: LIB3280-034-P1-K1-E1
gtcccgatcctcgatctgttctcaaccctccctccgtccgtcgcagctccagatttccttccccatggctccgatcaagatcggcatcaatggtttcggccggatcggcaggcttgtggccagggttgcgctccagagccccgatgtcgagctcgtcgccgttaacgaccccttcatcaccaccgactacatgacctacatgttcaagtatgacactgtccacggacagtggaagcaccatgaagttaaggtgaaggactccaagacccttctcttcggtgagaaggaggttgcggtgtttggctgcaggaacccagaggagatcccatgggctgctgctggtgctgagtacgttgttgagtccaccggtgttttcactgacaaggacaaggctgcagctcacattaagggt

SEQ ID NO: 1499 - DNA, 404 bp, Triticum aestivum
  Clone ID: LIB3280-034-P1-K1-E10
gcaactggttcgtcgtcgtcgcgtaccgaatctccaccatcccccgcgcgcgccggcgcctccgccgtcgacgatgggtgtctgggacgccatgtaccgcgtggtgatgcgccgtaacggcgtgtacgtcaccttcgtcgtcgccggcgccttcgctggcgagcggctggtggactacggcgtcaacaaggtctgggagatgaacaacgtcgggaaacggtatcaagacatatctgttctggggcaaaggccggttgaggagtgaagacattgaagcccagatttcccatgatcttttaagtgaaattaggcaccttataaagctccatgttttgacattttcctttggcacaataatattgtaaaactctcttgctgggtgttattcactccctttgagcact

SEQ ID NO: 1500 - DNA, 323 bp, Triticum aestivum
  Clone ID: LIB3280-034-P1-K1-E11
gtacagcaagatggcgcctagcactcgtagggccagtgtcatcctcgtcggggggatgctcctcgcgtctgccatggcagcggtggcggccgacgcagcggaggccgaggcggcggctgaggtgtcgtgcggggacgcggtgagcgcgctgatcccgtgcgggtcgttcctggtgggcgccgtcgccggggcgccgagcgagagctgctgccgcggcgcgcaggggctgcggaggatggcgggaacgccgggcgcgcgccgtgcgctctgcaggtgcctggagcagtccggcccgttcttttgcgtgctaccgggccgcgccc

SEQ ID NO: 1501 - DNA, 403 bp, Triticum aestivum
  Clone ID: LIB3280-034-P1-K1-E12
cggacgcgtgggcaacatacccggcggctagaacaacgaaactgggagatcttctcgtcgagtagataatcgatggcgtcggcgcttcgttccgcggcgagaaagatgtgcagccgcgtccttcagcgagcaccgcatccgtatttgtcggcgagcgcctcagcggccgtcaaggagggacagcggcggatcggccatgccgggagctcccttcgccgattttgctcctcaggatcacctaatcttgttaataacaccaagcatggagtgcaatcagccgcggaatcagcttcgttcatcagtaatgcggaatacacaccatggtggtcagataatcaccctaagtttctacgcaacatatttctgtatacagtcgcggtgtctacaggaaccgttgcaacgc

SEQ ID NO: 1502 - DNA, 413 bp, Triticum aestivum
  Clone ID: LIB3280-034-P1-K1-E3
cccacgcgtccgcgcgacttcctcccccctcttgcgaaggtctagggtttggctgcgtagaggagagaggctttccccctcgttcagtcgggagccgccatgagccgatcggggcagccgccggatctgaagaagtacatggacaagaagctccaaatcaagctgaatgcgaaccgtgttgtcattggcacgcttcgtggatttgatcagttcatgaatttggtggtggataacactgtggaggtcaatggagatgagaagaccgacatagggatggtggttctgagaggaaatagtgtggtgatgattgaagcccttgaaccaattgccaggtctcagtgatattttggcatacctgcttctggtttagtacttaatagtgtttggtcaaaaccgacgcttatggaatcagg

SEQ ID NO: 1503 - DNA, 413 bp, Triticum aestivum
  unsure (1)...(413): unsure at all n locations
  Clone ID: LIB3280-034-P1-K1-E6
gtggtgggttatccccaaccatattaaactctacatcgtatgaacaactacangaaaaaattgtaaaaaccaaatctgggattaataactaatnggtccgcataaaggggctgcaaggtgaaacttggccaagaatggaaggttaccatgaccaaacaattgacgtctttgcttcttctattcactgactgaagctctcatagcaacggacgtttacagcgacgcaagagatgttgtcttcgctccttctattcaccagttgctccgtcagatgcttcggaactgcctgtccgcccctctggtgtcattgatctcatcaacagccttttgattggtcatcacctgaattttcaacatacgtagaggtataactggtatagctacaacaagcaaacatctttcaaaacgccctt

SEQ ID NO: 1504 - DNA, 336 bp, Triticum aestivum
  Clone ID: LIB3280-034-P1-K1-F1
ggcgagaagattgaacttttggtgggaaagaccgaaaccttacagtcgcaggccgacaggttccataggcatggcagagagctcaggcgcaagatgtggcttcagaacctgaggtttaagctgatggtcggtggtggcatcgcgtttttgatcctcatcctctggctaatggtttgctggggcttcaagtgctagagagttcagagtcttcattcgccctttttttccttgtcatttgatgttctgtttacggtgtcatgtgcatataatgaccaccaaattatgcttcgctatgttccgaacaaaagttatgtggtgtgagacccttaattcctc

SEQ ID NO: 1505 - DNA, 402 bp, Triticum aestivum
  Clone ID: LIB3280-034-P1-K1-F10
aacttatcaagttacgaggggaactgaacccactgcaggaagcatctggtggaaagaagatatctattaacgaccttgttataaaggctgcagccttggctcttcgaaaggtccctgagtgcaacagttcttggatgaatgattttattcgccaataccacaatgtgaacataaatgtagctgtacaaactgagcatggattgtttgttccagtagttagggatgcagacaagaagggacttggtacaatcggtgaggaggtgaagcagttggctcaaagagcaagggataacagcttaaaaccacaagattacgagggtggcacgttcacagtatcaaacttgggaggtccttttggaattaaacagttctgtgctattataaatcctcctcagtcagcaa

SEQ ID NO: 1506 - DNA, 403 bp, Triticum aestivum
  Clone ID: LIB3280-034-P1-K1-F11
cccacgcgtccgcgcacgcttctcctccgcctcgagcagctcagggacgcgcgcagccatggcgacggagaccgagaccttcgccttccaggccgagatcaaccagctcctctcgctcatcatcaacaccttctactccaacaaggagatcttcctccgcgagctcatctccaactcctccgatgccttggacaagatcaggttcgagagcctcacggacaagagcaagctcgatgcgcagcccgagctcttcatccacatcatccccgacaaggcgaccagcacgctcacgatcgtcgacagcggcattggcatgaccaagtcggacctcgtcaacaacctcgggaccatcggcaggtcggggaccaaggagttcatggaggcactcgctgccggcgctgac

SEQ ID NO: 1507 - DNA, 272 bp, Triticum aestivum
  Clone ID: LIB3280-034-P1-K1-F12
ccagagcaactactacaggcctcaatgaaagaccatcttggtctggaggaacgatttgttctcttgatttttctcgcggatatgtgtgcttatggattccattcttgtgtatactggcatactagttacgagttccggtggagtaatgtcaattgtgctcgggttggttaggcggtagcctgtatgatatgtacgtgtaataatgcaattggcgtgccattgcttggcttcagtatttggattatggaaatgaggaacgattatttttttcc

SEQ ID NO: 1508 - DNA, 408 bp, Triticum aestivum
  Clone ID: LIB3280-034-P1-K1-F3
aaaccccctgtcgccagcgcgttcacctttccccgacacatccgtacactcagacgtcgctcgcgtgccccgtcgtcagcaagctacacaccttggcattcgccgctcgatatgccaaccgtcagcgtatgccgctaccgactattcagcgcactaagaacggtctacacgcaagacgaattctgggcactatgctttgattactgcttagaactctatgatgtgacctcagagaacgccatcatccggaaggagaagcacctggaggaagacgtcgaagcggacggatatgactaggtcatgtacaagattgaggttgactccaatagatatgatttgctatgtattgaaggaataacaagatctattctcattctcaccgggtgagaaataacccctatattcaaa

SEQ ID NO: 1509 - DNA, 400 bp, Triticum aestivum
  Clone ID: LIB3280-034-P1-K1-F5
gctttcctcacgagctcgaccgatcgatcgaatccttccgtcgcgttcgcgtttccggttcgtgcgtttagaccaagcttccaatggctcctctcggtgacgctgttgcccccgcggcggccgccgccgcccctggcctcgtcgtctctttcggcgagatgctgatcgacttcgtgcctgacgttgccggcgtttccctcgccgagtccggcggtttcgtcaaggcccccggcggcgcccccgccaacgtcgcctgcgccatctccaagctcggcggctcctccgccttcatcggaaagtttggcgacgacgagttcggccacatgctggtggagatcctgaagcagaacggcgtaaacgccgagggctgcctgttcgaccagcacgcgcgcaccgtgct

SEQ ID NO: 1510 - DNA, 409 bp, Triticum aestivum
  Clone ID: LIB3280-034-P1-K1-F6
gggtgataggcttcatgaacttaacgcttctcagaatgatccaaacaatgagagtgaagatcaacctaaggggaaaaccaaaaggaaagcagccgtgaagccagcggctaagggacagaagaaggcaaaggttgctaagaagggaacaaggaaaacccaaacaacaaagagagcgaagaaggcaaaaaaatagttacttgccgaagaactggggtattcactctgaactagtttgtgaaatagcaagggtgaggattcactctgaactgacacaacgaagcgatgccctataactgatccaggtttggatatagagtagctattgctgagcccacatgttatgtgatctgggcttattggtgtgccatgttgtacttttttaggaagacaaggggaaacacagtgttgt

SEQ ID NO: 1511 - DNA, 410 bp, Triticum aestivum
  Clone ID: LIB3280-034-P1-K1-F7
cccacgcgtccgcccacgcgtccgcccacgcgtccgcccacgcgtccgcatcgaccgatcaccacacacagcagcagcatggctaccaccagctgtgccctcctcgtcgccctcgtcgtcctggccggcctcgccgacctgcaggccgccgcagccgccccgaggcccgttcacgccgcggagcacttctccatggcggcaatgacggcggagcacccaatggcggacgaggcggacccggacctgaacgggatgatgcagtgcatgttcgggtgcttcacgtcggtgatgagctgcgcgttcgggtgcatgggcaagggccccgacctgccgctctgcgtcatcagctgcaaccagaagagcatcgtctgcatgatccgctgcggcctcacgccctcgccgccggctcc

SEQ ID NO: 1512 - DNA, 411 bp, Triticum aestivum
  Clone ID: LIB3280-034-P1-K1-F8
cggacgcgtggggagcgcggtcttactggcatggtttcgtatgctgagatcctggctggaggaattctaaggctacaagtttctgaagctgaggttaataatatcaatattcgctttctggacagaagaactggtgaaccaactactggaaaaacaaaaccagaaaccatactccagcagcttaccaccaagaagggtcaggcatacaatagagcacaagtgaaaagagatgttgaaacaatactcactatgggaattatggaggatgtcacaataattccgcagcccgtgggagattctaataaagtggatcttgtcatgaatcttgtcgaacgcaaatctggtggtttctctgctggtggtggcatttcgagtgggataacaaatgggcctctttctggattgattggc

SEQ ID NO: 1513 - DNA, 412 bp, Triticum aestivum
  Clone ID: LIB3280-034-P1-K1-F9
gcggccaaggccgggaaggcgatcgattgggacggcctggcgaagatgctcgtctccgacgaggcccgaaaggagtttgccaacctccgccgcaccttcgaggacgtcaaccaccagctccagaccaagttctcccaggaaccaaagccaattgactgggaatactacaaaaaaggaattggatcgaaagttgtggatatgtacaaggaggcttatgatagcattgagatcccaaagtatgttgacactgtcactcctgagtataagccaaagtttgatgctctgttaatcgaaatgaaggaagcagagaagacatctctgaaggaatcagagaggatagagaaggagattgctgaattgaaagagttgaagaaaaagatcagcacaatgacagcagacgagtactttgcga

SEQ ID NO: 1514 - DNA, 408 bp, Triticum aestivum
  Clone ID: LIB3280-034-P1-K1-G1
ctggccccaaatcttaaccagctccccccctccgcccccttcttcttcttcccctcctgccctcccctgtctcgcccgcagcttcaccggcagcgagggaaagagggaggatgagcgcgtccaggttcataaagtgcgtcaccgtgggggacggcgccgtcggcaagacttgcatgctcatctcctacacctccaacaccttccccaccgactatgtgccaacggtgtttgacaacttcagtgctaatgttgtggttgatggcaacactgtcaacctcgggctatgggatactgcaggtcaggaggactacaacagactgagaccgctgagttatcgtggagctgatgtcttccttctggccttctcgcttatcagcaaggccagctatgagaatgtttcaaagaagt

SEQ ID NO: 1515 - DNA, 402 bp, Triticum aestivum
  Clone ID: LIB3280-034-P1-K1-G10
gacagcaaagtagtagtcgaagatcgaagcatggccgtcgacttggagcaggcgggctaccatgccatccctgccgacccgcgcgacgacgaggcgccgccagtcctgggcaacgcgccggcggcgaagtccagccacatggacggacccacctttctaatcttgatgctactttcggttggagtgacagcgctcatgttaggccccatgtactacatggagggcgccaacgtggcgtccttctccgtcggtctcgccggctacgagggcatcgacccggccaggcccggccgcgtggtctcgccggcgttcaacctcacgctgcggatgaacaagacgtgcgccgaccgcgccgaggtggtcctgacctactccggcgtcgcgctcggctgggcgcgcgtg

SEQ ID NO: 1516 - DNA, 403 bp, Triticum aestivum
  Clone ID: LIB3280-034-P1-K1-G11
caggacattcttctaggagctgccaggattatcaagtcacatggcgttgaatttggaagcaccacacagtgctgctgattctgatgttttctcaaaactcaagtagggtgaacgtcgttagcctggaggagtacatacgcggagggttagaggagattttgcttggtgcgcgtgcgaaggcagggacctcttttggaaccaaggtgggacttttgttgcctgtcctcaatttggcaaacatacatcatctgttgccggagaatcttgcgttacatcattttgctacgtgcgctgatactgcttagcgagtagtttaccacgattcgtcagtgctcagtcgtggtaacttcaaacacatggagtggcatgatccaccggaggtctgcatctgggcccaggagtt

SEQ ID NO: 1517 - DNA, 403 bp, Triticum aestivum
  Clone ID: LIB3280-034-P1-K1-G12
gccaaactcactaatcatacacgtacgtgcttggcttaaacccttccggcgaagtcaagcacaatggcgtcgtccggcaagacctgcgccgcctccgtcctcctcctgctgctggccctcgccgtcgccacggcggccgacgcggcgaagaagagcatcacgtcggagcccaagtccatcttctcgaggccgtcgggacccatcatctcgaggccggcgtcggagcccgccatcccgaggccgtcggcggaggtggacgtgtcggcgacgtgcatggggtcgctgctggagctgagcccgtgcctggccttcttcagggacgcgggcacgtccaaggcgcccgcggggtgctgcaagggcctgggcaccatcgtccgagaccagcccgcgtgcctatgccaca

SEQ ID NO: 1518 - DNA, 412 bp, Triticum aestivum
  Clone ID: LIB3280-034-P1-K1-G2
cggacgcgtgggctggactctggagatggtgtcagccacactgtccccatctacgaaggatatgctctcccccatgctatccttcgtctcgacttggctgggcgtgatctcaccgatcacctcatgaagatcctgactgagcgtggttactcattcaccaccactgctgagcgggaaattgtgagggacgtgaaggagaagctgtcctacattgccctggactacgaccaggaaatggagacttccaagaccagctcttctgtggagaagagctatgagctgcctgatgggcaggttatcaccattggttctgagcgtttccgttgtcctgaggttctcttccagccatccttcattgggatggaagctgcaggtattcatgagactacctacaactccatcatgaagtgcg

SEQ ID NO: 1519 - DNA, 362 bp, Triticum aestivum
  Clone ID: LIB3280-034-P1-K1-G3
cagcagaacgaaattaatcaattttggtgccaacaggtcaatctgtgcactgactagaagaaaactgctagtaccactcactaaatacacaccaacagatcaatcatgcttcatctctatctcaaggaccaagagacacaaacatgaaaaacatcccatccatcagaagaacaaaaacctgcagattaactttttacagaccaacaatcaatgaatgattttttgtacggcgcaaaacggaatcgactggcggcgaaaacgaaacggcgcatcattagtataggaaccggccttcggcgggggcaggggacgcggtctcattcggctcggatgaagggggaggagctcatctcggtggtgct

SEQ ID NO: 1520 - DNA, 408 bp, Triticum aestivum
  Clone ID: LIB3280-034-P1-K1-G5
caaattcttcgcaccagcgccgtcgagcgagagagagatacagagatgacgtcggcgatgcgctccgctgcggcgctccgtcagcggcttccacgcctcctgtcctccgccacaagatctgtgccgcgagcgcttgaggaggagcggcgctttctgttccggcgcgccggcccgccggccatgggggatcctcgacttttcagctccagttccaccgggaagtcctacacgcatccttgtaaactcaacctgcggcacaaaaagcaatccctggaggacagcttggcataccttaacaggatggcgaagaaggaagctcgtgactggagagagatgaggcaacatcttgaagcatcggagcaaagacaaatagagctcgagaaagtgtacaagcgacaggatagggtg

SEQ ID NO: 1521 - DNA, 407 bp, Triticum aestivum
  Clone ID: LIB3280-034-P1-K1-G7
cccacgcgtccggctccactgttccacgtggaggctctgctcccgagctcgatcggacccaagatcgactccatcctccactcccacatctacccgcaggtaggtcacgtcttccgcgccgtcgccaggttcagggccctgctcgtcgacgtgatactcagcaagaagaggacggccgccgcgagagctggcagcggcgggtacggctactacggccgctcaacggcgaagaggagccgcggcaagaagcggacgagcaagatcgccggcttcgtgaagatgcattttgtcggctcctccgtcccggctcgggcgagggatcggctggacgccagccgcgcgccctgctattcgtcgtactcgtactacgagtactcggcggcgtggaacgctgtggttccagcgac

SEQ ID NO: 1522 - DNA, 411 bp, Triticum aestivum
  Clone ID: LIB3280-034-P1-K1-G9
cccacgcgtccgctagccgccgccgccgacgtggagcagagcatcagagcgacacgatgacgggggggaagatggcggcggcgacggcggcgaagtgggcggaggggtacccgtggaaggagaagctggccaagtacaagggggagctgagcaagggggtgtgggggtactgggagctgggcgcgtggaagccgctggggatcagcgggcggcagcgcgcgcggctccgcaaggaggtgctcctcgccggcgaggactgggcctacgacccgccccgcggcgagatgcgcaccaagcgcaagggccacaaggtcgaccgcatcggcgccgagaagcgtgccaacaccgttgagctgatgaagaaaattccccagatgctcctcgactacaagaaacgtaggtgggataaaa

SEQ ID NO: 1523 - DNA, 403 bp, Triticum aestivum
  Clone ID: LIB3280-034-P1-K1-H1
cccagcaccgcctccgccgcccgggaagcccaaaccaaaccctaagcctccgcgaccggccgccggcgatggcccgctacgaccgcgcgatcaccgtcttctcccccgacggccacctcttccaggtcgagtacgccctcgaggccgtccgcaagggcaacgctgccgtcggcgtccgcggcaccgacaccgtcgtcctcggcgtcgagaagaagttcacccccaagctccaggactccaggtccgtgcggaagatcgcgagcctggacacgcacgtcgcgctggcgtgcgcggggctcaaggcggacgcgcgggtgctcatcaaccgcgcccgcgtcgagtgccaaagccacccgctaaccgtcaagaccccgtcaccgtcgagtacatcactcgctacatc

SEQ ID NO: 1524 - DNA, 405 bp, Triticum aestivum
  Clone ID: LIB3280-034-P1-K1-H11
cctcgatccgccccaattaaaccgccgcggacccgcccacgggcagccgcagctatctataaccccgcgtcgtctcctccgcaccaccagagatccggccggcggcccaagaagaagaagcagcggagacgatggcggcggtgaagcgcgcctacctcgccgcctacaactgggccgtcttcttcggatgggcgcaggtgctctacttcgccgtggaggcgctgctccggtcggggcacgaggccgtgtacgccgccgtcgagcggccgctacagctcgcgcagaccgccgccgtcctcgagatccttcacgggctggtcgggctggtgaggtcgccggtgtcggccacgctgccgcagatcgggtcgcgcctcttcgtcacctggggcatcctctggagcttcc

SEQ ID NO: 1525 - DNA, 404 bp, Triticum aestivum
  Clone ID: LIB3280-034-P1-K1-H12
gcccgtggtcattacaccattggcaaggagattgttgatctgtgccttgaccgtatcaggaagctttcagacaactgcactggtctccagggattccttgtattcaacgctgttggaggtggaactggctctggccttggctcgcttctcctggagcgcctctctgttgactatggaaagaagtccaagcttgggttcacggtgtacccatctccccaggtctccacctctgttgttgagccatacaacagtgtcctgtccacccactcactccttgagcacactgatgtctctatccttcttgacaatgaggccatctatgacatctgccgccgctcccttgacattgagcgcccaacatacaccaacctcaacaggcttgtttctcaggtcatttcatcact

SEQ ID NO: 1526 - DNA, 414 bp, Triticum aestivum
  Clone ID: LIB3280-034-P1-K1-H2
tgcctggcccgtcccccacacagccgatggcgactccgccgtcctccacacggccgtgaacaaagactacacgacgccgcgacaacgtagaagctcctcccttagcagatgcgttcttcctctgcgccacctgtggaacagttcgtgcgcccagtgccgccgattcgatggtctgcagatgtttgatctaagatgcccgactgtactacatgtacatggaagaagaaagctcaatgaaccgaagctggggaaaaggaataaccaaggaggggaggggaggtcacatccttgaagccaacggcaaattaaggcatcaccttgaatttgtaactccagtaactaaatggagatccttttttaggtcgaacttgtgatccttcttattactgaaaccaagtatcaatctgagaatga

SEQ ID NO: 1527 - DNA, 272 bp, Triticum aestivum
  unsure (1)...(272): unsure at all n locations
  Clone ID: LIB3280-034-P1-K1-H3
ttaggtggacaacaccggtgcgattttcattatttatttattttcttataatacattcttttttattcctcatgaaattacatttttttaaactacaaaccgggggaaaaaaaattgtgttaaaaagtaactacacccaagggggggacagcaagcattgactaatggccacacatcttataccccacccacatacatgcaattttttgttgccacctcccgcacgttggaaaaattttncaccgagggcccgggatagaacacccccaaaa

SEQ ID NO: 1528 - DNA, 407 bp, Triticum aestivum
  Clone ID: LIB3280-034-P1-K1-H4
caacaaacagaggatttgtcacgcgcggccggcaggcatggcgccgttggccgcctccccgctcctcccctccccctcgccgccgtgccacctcctcctacgccgctgccccgacagtctctggctgccagcgcctcggtcaccgcgattgccgctccgtcgcctctcgcgtgacggcggcggcagcgagtgcctgtctcggctccggcatgtccggccgctccgagccgtgcccgtcatcgcgcccggcgaccagtggggcaactgggcgttcctcctctccgccgcggccttcggcacctgggcggaggagcggacggcgtggggcgcggcgctgagcggggcgctggtgagcatcctggcgggcctggcggcgtcgtcggcggggctggtggcgcccggcgcgc

SEQ ID NO: 1529 - DNA, 366 bp, Triticum aestivum
  Clone ID: LIB3280-034-P1-K1-H8
agaaaaaaaatcatgttttattcagagcaagcgtacatgaaagatttatgttactgataatacatccttttttatcccccacgaaattacatttcttcaaacttcttcttgcctgtaaaaattattcttctgctgtgggtctctgctgcttgtgaggatgatcgacttcgtttcacgcccgcctctactttgcagcatccttggacaggaagttgtgcgactggatatggcgcacgttggagagctcgtccaccgagtccccccgctcgaacacggccgccgcgcccatgccggacccgatgcacatggtcaccacgccgaatctgcagtccctgccccggcgcttcatttcgttcagaagggtcg

SEQ ID NO: 1530 - DNA, 335 bp, Triticum aestivum
  Clone ID: LIB3280-034-P1-K1-H9
acaatgtctacatcggaacaacaccggcgcgactacaagcagtacagaaggggggcttatacccggtgcccacacacccaacacccactaacagcacgcaccacaccagccactaccacatgaccccgccactaacaagctaactacatccacgcccacgcacagcatgcattgactaatggccacacaactcataccgtgcgcacgtgcatgcagctgtttggtgccagctcccgggggcgggttggccaagaccaaccggccatgaacaagattattggttacaatttcccttctaatcttgacacgggtgggcgtcgacgtcttcacccacc

SEQ ID NO: 1531 - DNA, 430 bp, Triticum aestivum
  Clone ID: LIB3280-043-P1-K1-A10
aggacatcacagaagtgattgcatcttgtatttttaagtttgccgctgtgccttggaggggtggtaccattggtgggggagctccatcttctgcatctgtggtggcgcagcacctgctgctgagtcaaagaaggaggagacggttgaagagaaggaagaatctgatgaagacatgggtttcagtctgttcgactaagcactttagtcactcccccctaccctctatttaccctagtatctgtcatctgtggcctgctacaacggcgcctgcataatctagagacctaaagtacatgctattttgcttgggacaatgtatatttctagtaccttcatatgcgagtaattgactgcttctgcagccttgagaagctgatcgataattcgctaggtgtacgtttcttgcatatatcttctgatgtttgtgatc

SEQ ID NO: 1532 - DNA, 391 bp, Triticum aestivum
  Clone ID: LIB3280-043-P1-K1-A11
tttgggtttgtttttttttttttttaaacacacaaagtacgtgcagctacacgttgatccacaacgtacaagtacacatgcatatctcgtccgatggacggacggacggacggatggctaaacacatttagcttccgggggcgaagttggtggcgaaggcccacgcgttgttgttgactgggtcggcgacgtggtcgaagaggttctcaacgggtccctttccggtgacgatggcctgcacgaagaagccgaacatggagaacatggcgaggcggccgttcttgagctccttcaccttgagctcggcggcggtgtcggggtcgtcggcgaggccaagtgggtcgaaagcgccgccggggtagatgatgtcgaggccctcgccgagggggcc

SEQ ID NO: 1533 - DNA, 448 bp, Triticum aestivum
  Clone ID: LIB3280-043-P1-K1-A12
caagtacttccaagtggtaagttcatcctatggaaacaacaacagttacgacaaatgccggcgaagatttgacctgggtgatgcagaatttcttaggtatcatggtatgcagcagtttgatcaggcaatgcagcatcttgaggaaaaatatggttttatgacatcagaccaccagtacgtatctcggaaacatgaggaagataaggtgatcgtgtttgaaaaaggggacttggtatttgtgttcaacttccactggagtagtagctatttcgactaccgggtcggctgtttaaagcctgggaagtacaaggtggtcttagactcggacgctggactctttggtggatttggtaggatccatcacactgcagagcacttcacttctgactgccaacatgacaacaggccccattcattctcagtgtacactcctagcagaacctgtgtt

SEQ ID NO: 1534 - DNA, 425 bp, Triticum aestivum
  Clone ID: LIB3280-043-P1-K1-A2
tgtctttcttctcggcggaggcggaggcgacatgaaggcgaacgacgaaccctagccgcgcgaggaacgcccagatccccaaggccggcgacgatggcgatggcggcggttcgctgcgccgcgaggaggctcggtggctccctgctccagccaacgcaggcggcggtcgcggaggagggacgccgcctcgtgccaagcaggttcatgcgctcccgccacctctccaccaagcatgctagcgagacctggatggaaaagaagatgcagaagttgagatctatgtgggcccagtacaaggcggacatagagagaaggatgagggaacctccagaagaggatgagtttaagttgcttgtcgagtcctacgcacgtacgattgatggtgtggtccatggaactgccaagatggcacttctctgcatcat

SEQ ID NO: 1535 - DNA, 445 bp, Triticum aestivum
  unsure (1)...(445): unsure at all n locations
  Clone ID: LIB3280-043-P1-K1-A3
cacgcgtnncagaggggagaggtctgggccgccgcgaagaattcatggtcgccgacgagaataacaaggacgcggagaacaccaaggtcatgtacgcccgcgccaaggagtacgccggggagtatgaggctcaggacaaggagctggtgcaacttaaacgtgaggcccggatgaagggtgggttctatgtcagtcctgaggcaaagctgctgtttgccgtccgtatccgtggtatcaatgctatgcacccaaagaccaagaagatcttgcaagttttgcgtttgaggcaaatttttaatggtgtggtccttaaggtcaacaaggccaacattaacatgctgggtggggttgaaccatatgttgcttacgggtacccttaacctaaaaagtgtcagggacctgtcctacaaaagaggttacggaaagctaaacaggcaaaggatcc

SEQ ID NO: 1536 - DNA, 372 bp, Triticum aestivum
  Clone ID: LIB3280-043-P1-K1-A4
aagaaaagcaaccttttattttgcatgcatcagcatgatgatacatcagtgttccacttacaccacacacacaaaagtatgatgaaacaacatgaaaaactcatgtgatcctgtgatgactcgaacaaataagaaaaaaatggactcctgtggtgacagcaaattgcatgcttgctatgctcttgtctattaccccgtcccaaattagttgtgtcaatttaagacaactaattcgggacggagggcgtatatttgaatatatgagatccttttggctactgatgacttgataagtttgccagctcctcctttgtcagtgccgacggggcgacttcaatctgctccaccacgaaaccagccttctggcacgcc

SEQ ID NO: 1537 - DNA, 447 bp, Triticum aestivum
  Clone ID: LIB3280-043-P1-K1-A5
gcgactgggtctacgagaacaacggcgggacctgcgtggccatcgccggcgcggactactgcgtggtcgccgccgacacccgcctctccgtcggatacaacatcctcacgcgcgagcactccaagatctgcgagctggccgataaatgtgtaatagcatcttctggcttccaaggtgacatcaaagctctacagaagaacttagctgccagggaactgctataccagcaccagcacaataaaaggatgagctgcccagcaatggcacaattgctctccaacaccctgtactacaagcgattcttcccatactatgctttcaacgtgcttggtgggcttgacagtgaagggaaaggatgtgtctactcatatgatgctgttgggtcctacgagaggaccggttacagtgctcagggatcaggatctaccttgatcatgccagtgctgg

SEQ ID NO: 1538 - DNA, 285 bp, Triticum aestivum
  unsure (1)...(285): unsure at all n locations
  Clone ID: LIB3280-043-P1-K1-A6
ccacgcnaccaactactccttctacaagaacatactcacaacttgtttttctatcaccgacancaaactacgcacgttttttatctacaacacgcgcctctccttataatacaacatcctcacacactatcacttcaagatcaacaaactgaccaataaatgtataatatcatttactgtctttcaaccaaacatcaaatctctaaaaaaaaacataaataccaaacaactgttaaaacaccaccatcacattaataccaaaatctcactaaaatagatacaatt

SEQ ID NO: 1539 - DNA, 321 bp, Triticum aestivum
  unsure (1)...(321): unsure at all n locations
  Clone ID: LIB3280-043-P1-K1-A7
ggaactcgtgagcttatgaatgagtgattcttatttatctaattgggaactagcggagcatgcanagtaaggggtgtgtctgctcntatagattggttggtcgattgcttaatccatataccctaaacatcataactttttattgggggggcctggttgatgccctgtctgatgtgaatcttttgggatgcgcgggtatatacttccaccactatatacaaaaatgagtactgcctttaacatgggcatgatattaaatttgagtgaatctaagggcctactgcgtgcataatctggggctatatgatttttagatttttt

SEQ ID NO: 1540 - DNA, 423 bp, Triticum aestivum
  Clone ID: LIB3280-043-P1-K1-A8
ggacgcgtgggtgcgtgtcgccttgtttggccgtccgctcgcgtcgagccatacctggacaccattgacgcgctcgtcgctgcctggctgccgggcaccgagggccacggcgtcgctgatgtgctcttcggggaccacggattctccggcaagctgcccaggacgtgggtcaggtccgtcgaccagctgcccatgaactacggcgacaagctctacgacccgctcttccccttcggattcggactcaccaccaagccggctgatcgcagctagctagcttagctagcccctcatcggatcgagtttggatttcatctttttccatagcattagcctcagattaatcccttagttaattagcccctgcatgcccctgagtgagaaatcgatcgatcgaaaataaatgagcaaggttttgatcgc

SEQ ID NO: 1541 - DNA, 317 bp, Triticum aestivum
  Clone ID: LIB3280-043-P1-K1-A9
aggacatcacagaagtgattgcatctggaaggtataagtttgccgctgtgccttcaggtgggggtgccattgctgtgggagctccagctgctgcatctgtggtggcgcagcacctgctgctgagtcaaagaaggaggagaaggttgaagagaaggaagaatctgatgaagacatgggtttcagtctgctcgactaagcacttcagtcactcccccctaccctctctttaccctagtatctgtcgcctgtggcctgctacaacggcgcctgcataatctaaagacctaaagttcatgctattttgcttgggacaatgt

SEQ ID NO: 1542 - DNA, 294 bp, Triticum aestivum
  Clone ID: LIB3280-043-P1-K1-B1
ataaaaatgacttaaagaacatgcagacattccaacagctaaatagaatgggggttaaggtaaacaatactcttagttccagcacaaaatcactatgtaataaagggcacatccgtccaacaaaaaagaaagaacttcaatagcatcaaagttccccacgttaacagcaaccataaatcttcgcatggaacgtgactaatcaacattgccatgagcctagaaagctgaatttgtggaccaattcaccttgactgagatgttagcgagctcatgctttatctgtcgactagaaca

SEQ ID NO: 1543 - DNA, 446 bp, Triticum aestivum
  Clone ID: LIB3280-043-P1-K1-B10
cccacgcgtccgcccacgcgtccgaaatctggaatgtctttcgagaactgttgatcagtgttgctataagtatttctcagagttttggttgcatggatgtacattagagtagcagaggttcttattttactttgtccagaagaggggcttttacttatttttgttcacaatttttatctaactttctatcagcaccaacgaccacaatgggatggatcaagcagccaagacttagagtgtggtcgggcagcgccatggggcagatctgtgcggcgcaaggggcggcagatgcgaaactgaagcttccctgaacttcggagcagtcaattgagaagatggacacgacgagtgaggattggtgctaccgcccctggtaggagcccaatgtcctaatcgaactactgtcatggagagggcaatacgtggatttgcttcaaatattggag

SEQ ID NO: 1544 - DNA, 406 bp, Triticum aestivum
  Clone ID: LIB3280-043-P1-K1-B12
attcgatgttgaccaaccaaggaatctggcgattagcgtgaccacccagtaagtagaggaaaaacatgcagagtcatagctcagaagtattcaggtatttcttctagaaaagaagaaagagtgctgtagccgtgaatatcgtgatagtgtatatttgaggaggttagcatcgtcggcagcctgttgatcagctcgttgtgaaaatgtatgaatgttattcgcgaaaaagaaagcaggttatctttaaaaaagaaaaaaacaaaagagaacataaacctataaccatgtttcgaataaacctagcctactccgtacctccgtaccaacaaggggtagtacatggaatattgacctgttgggcggtcgctactagtttcccactgttcctacgccgtgactcaccctc

SEQ ID NO: 1545 - DNA, 373 bp, Triticum aestivum
  Clone ID: LIB3280-043-P1-K1-B3
gaacaccattctgatggaagcaatacaaattatgtacagaattattcaggagttctttagccacatccaaatagcgtgtggcagacatgcatggcgtagcaaatttagcaaatgcataagttatacagaaagcattctattgcgacttcgcattttcgctgctgataccacaacgacgatggagcctagccgactactacgtattaaagtttgtttctagcgatacacacaccgaaaccaagatcgacaccaggagggccgccgatcagatcagatcagaccagagcctactcttccttggaggcgtgagtggcggacaccgtggagaccatggagtcgacgccacacttgttgcgcacgttcgagcccctgc

SEQ ID NO: 1546 - DNA, 354 bp, Triticum aestivum
  Clone ID: LIB3280-043-P1-K1-B4
gatgactgaactcaatgcagctatatatagcagctagtttctgtcaggaatccatgaaacaaaaatgagtagaagaagaagaatcaaagatgcattcatggatgatgatgatggactggatggatgaagatggctacttcttgaggaactggaggccgttggcctgggagtagcgctccatgaagcgcatgaagcggtcccagtccctgggggtgcgcatcacgtacttggcctccacggccgccggcttgccgttgacgaacttggcgctgacgtccacggagctcagcgtgccctcctcgtcgatcatgtagaaccccgtgatgtcgcccagctccgccgacgagtcgaaca

SEQ ID NO: 1547 - DNA, 454 bp, Triticum aestivum
  Clone ID: LIB3280-043-P1-K1-B6
ctcatactgctcgacctacacaatgcccattctgcaaaacccccaactatgctgtggagtatcgtggtgtaaagacaaaggaggaaaggagcatagagcaatttgaagaacagaaagtcattgaagcacagatgagggtgcggcagcaagcacttcaagacgaagaggataagatgaaaagaaaacagagtaggtgctcttctagcagaacaatcgctccaacaacagaagtggagtatcgagatatttgcagcacatcctattcagtgccatcgtaccaatgtacccagcaagaaactgaatgttgttcgtctgagccttcatgttctgctcaggctaacatgcggtctttccattctaggcatactcgtgatgataacatagacatgaacatagaggacatgatggttatggaagcgatttggcgttcaattcaggaggcaagaagtatagg

SEQ ID NO: 1548 - DNA, 348 bp, Triticum aestivum
  unsure (1)...(348): unsure at all n locations
  Clone ID: LIB3280-043-P1-K1-B9
aaaacacagatgggacattcaacaacacatactttatacatgcgcgcatgatttatacccagtttaggtagagctgagggattacttggtctagaggagttttataaactaaacaatggccatatggagcaatcatggggggcgccataatatagcccctttacttatacgggggggctaaaaatggcgggagttttatttggatgcatgcatgtgggcatagaccgccacacgaacaccaataactttttgtttgctcgaaggggatacaactagaactagaactaggngccggttacgggcacggggttttttgcttcgccttcggcaccggttttgggggggggg

SEQ ID NO: 1549 - DNA, 377 bp, Triticum aestivum
  Clone ID: LIB3280-043-P1-K1-C1
cccacgcgtccggccttgtcgagacatacaagtggtatgtggagaatgtcatcgccgacaagaagtaatggggtggtatcatgttctcctttgcctcttaaagtttgtatcttgatatcatgatcaatagtgtgtctattcttgttggatactggatcacacaagtaccaggtattagtgcaccaaagaaaagaggttgctacgtgttggttgaataatatattggtcaaattagtgtaccattagaatcttaattcatgctgagcatgttcttttattacagaaagtgtaacactttatacattggatggtaactggcctacactcgttctttgccaattcagcatgaaacagatattgaagagttcgcatgcttc

SEQ ID NO: 1550 - DNA, 340 bp, Triticum aestivum
  Clone ID: LIB3280-043-P1-K1-C10
gaccacgcgtccgccgcgctgctgggctacctcggcgacgttttgttcgtcgaccgcgtccccgcgtggatgccgttcgtctactccctggcctccttcgtcctcgggtcgctgctggtggcggacgcgtcggtcagcgacgaggagtgggacgagtgggtcggtcggcggcagcgcggcggcgacctctcgttcctcgagtcggaggaggtgctgaggcgcacggcgcggaggaagcccgagggcgggctctctagatcatccaagcatacattcgcgtgcatgcgacagttataactgtcttatagtaggacgtaaattcaatgcacttgacctgtga

SEQ ID NO: 1551 - DNA, 342 bp, Triticum aestivum
  unsure (1)...(342): unsure at all n locations
  Clone ID: LIB3280-043-P1-K1-C11
gacccacgcgtncgnacacgcgttaacaaatcccaaagcctttttttttagagctccaaaccctacgcggggggaggttcttcacagcggggggagagtccattcatcccaattcactctcgaaaagcgtacgtgcagcactactaccaaacgtacgactccaaccgtgctcagctggttaggctgtaccaatactaattcatgctcaccttctaggtctagaatttcgccagtcccgccatcatcacctgcaaactcgtatctctccccttccatcactgccagtacaaaaattaacacctttaactgccagtcctcgaagccccattgctaccgtcctct

SEQ ID NO: 1552 - DNA, 445 bp, Triticum aestivum
  Clone ID: LIB3280-043-P1-K1-C12
cggacgcgtgggcaacgcccaaagccttcgcattcagagctccaaaccctaggcgaggcgaggcgcggcgcagcggagggagaggccatggatcccgattcggtctcgaaggcgttcgtgcagcactactaccagacgttcgactccaaccgcgccgcgctggtggggctgtaccaggacggctccatgctcaccttcgagggcgagaagttcggcggccccgccgccatcgccggcaagctcggatctctccccttccagcagtgccagcacaagatcgacaccgtcgactgccagccctcggggccccagggcggcgtcctcgtcttcgtctccggcaccatcaccaccggccccggcgagcaccccctcaagttctcacagatgttccatttgctgccagctggagggagcttctacgtgcagaatgacatgttccgcctga

SEQ ID NO: 1553 - DNA, 218 bp, Triticum aestivum
  Clone ID: LIB3280-043-P1-K1-C3
ggccaggaggagtccgttacaacagattaatcaacgccccggccgaaaaagatttacactagccgccgcgggggggggcgtttaaaacgaggcaacggccggcgcgggggcgtcttaaatggcaacggggacggggtcttttttgcggcgcatttccagcactttgcggggggagttggagtgcaggttccccacaaacgtggggtttgcccccggcc

SEQ ID NO: 1554 - DNA, 316 bp, Triticum aestivum
  Clone ID: LIB3280-043-P1-K1-C4
cccaggaggggtccgttacaacagactaatcaacgccccggccgaaaaagatgtccactacccgccgggggggggggcggttaaaacgaggcaacggccggcgcgggggcggccttaatggcaacggggacgggttcttttttgcggcgcatttccagcaccttggggggggagttggagtgcaggttccccacaaacgtggggttgcacgccggccggtactccggaaggagccgccccaatttgaagcggaccccgaaggcgttgcacagggttttggccccttccggccccgaacgccattggggcttttttt

SEQ ID NO: 1555 - DNA, 451 bp, Triticum aestivum
  Clone ID: LIB3280-043-P1-K1-C5
ccacgcgtccgcccacgcgtccggtgccgctggtgcttcctcgctgttctttgtgtactcccttgactatgctaggacaaggctggccaatgacgcaaaggcatccaagggtggaggtgaaaggcaattcaatggcctggttgatgtctaccgcaagactctcaagtcagatggtattgctgggctttaccgtggattcaacatctcctgtgttggaatcattgtctaccgtggtctgtactttggactctatgattctctgaagccagttctcctcactggcactctccaggacaacttctttgccagctttgctcttggttggttgatcaccaatggtgcaggtcttgcatcttaccccattgacactgtccgcagaaggatgatgatgacctccggagaggccgtcaagtacaagagctccttggatgctttccagcagatcctgaag

SEQ ID NO: 1556 - DNA, 367 bp, Triticum aestivum
  Clone ID: LIB3280-043-P1-K1-C6
gcccacgcgtccgctcctccccggtcagtcctcggttcccggtccggttcggttccgttcggttcgttagggtttagtagcggggaagaggaaggcatggcggacgtcgagtaccgctgcttcgtgggcggcctcgcctgggccaccgacgaccagtccctccagaacgccttctccaagtacggcgacgtcatcgactccaagatcatcactgacagggagacgggccgttcccgcgggttcgggttcgtcaccttcgcgtcggacgaggcgatgcgccaggcgatcgaggccatgaacggccaggacctggacggccgcaacatcaccgtcaacgaggcccagtcccgccgctccggcggaggcg

SEQ ID NO: 1557 - DNA, 276 bp, Triticum aestivum
  Clone ID: LIB3280-043-P1-K1-C7
aatgtatcccgatatcatgatcaagagtgagtctatgcgaagaggataccataccacacaactaccaccgctgattccaccacagacaagacggggccaccgacgaccagaacaataaaaacgccaaatcaaagtaccatgacaataccaattcatgcagcaacacggccaggattacagaacgtcgcacactatatacattggacagcaactagcctacacacgttctctgccaactcagcatgaaacagacattgaagaccacgcatgcctcac

SEQ ID NO: 1558 - DNA, 401 bp, Triticum aestivum
  Clone ID: LIB3280-043-P1-K1-C8
gtcagtgaccaactcatcataacacacagagtaacacacatgtacacattctgaacttctccatgacacaacaacacggtgatctccctactgagtagtgactgatcagttcatcgatcagttcggcaattcagatggatcacgagttgatctacacaaacagtcagctagcagttaacaggttaggattcagcaatcgatgaaccgatcaggacgacaaggactgcgcgacggaggaagtggtgaggaggccggagaggaggccgacgatgagcgcgctgttgtacgtggtggcctcgttctgcatcacgttctgccgctcgtccacgaacgagtcgttcttgaaggggcccccgacgagcgcccccgtggccacgttcgggtggtgtcaggcgactcga

SEQ ID NO: 1559 - DNA, 180 bp, Triticum aestivum
  Clone ID: LIB3280-043-P1-K1-C9
acctgtctaccaaagtgttatcgctcgctcccgagtaccctagatctcgctccatcgcgtaggttccgagatgttctggctaccgttagatgtgacgccgctaccgttccgtgttacttgttaccgtccctgttccgttcgctatgaatgaaatgaaaaatcagagcaaaagtttgttcg

SEQ ID NO: 1560 - DNA, 333 bp, Triticum aestivum
  Clone ID: LIB3280-043-P1-K1-D1
gcggtggccgcgagccccgtggtccaggcctgtttttcgggccacggcgtacaagcacttctgcgccggggagaccgccgatgaggccgcggcccgggtgcagcgcctctggcgcggtggcatgggcgggatcctcgactacggaatggaggacgtcgaggacggctccgattggatccatgacgtcgccgtcttactcggtgttgctaacgtagccaagatcttgtcctcgggatcgcaggatgtggagctcaacatcgcgagcaagatcgtcggctgcatgctgtttgagggcgcccgacttggttgagttgttgcactattgtctacacc

SEQ ID NO: 1561 - DNA, 67 bp, Triticum aestivum
  Clone ID: LIB3280-043-P1-K1-D11
ccccccgcgacccacgcgtcccacacgacaaaacaaaacccaaacccctttttttatatcaccaaac

SEQ ID NO: 1562 - DNA, 443 bp, Triticum aestivum
  unsure (1)...(443): unsure at all n locations
  Clone ID: LIB3280-043-P1-K1-D12
caccgcacaaaccaaatcccgctcccacaattttcggaatagcaagcgcgccgccgccggtcgggttcgagatgttgcctagggttgcgccgtctccggccaccgccgccgccgcagcggttggccagctctccggggcggggctcaccgccggttcggtgaggttgccgggggccctgccgtctgcggcagggtcggcggtctgctgcagggccgcggcgaaggggaaggaggtgctcagcggtgtgatgttccagccgttcgaggagctcaagggggagctctcgctcgtgccgcagggcaaggaccagtcgctcgccaggcacaagttcgtcgacgagtgcgaggccgccctcaacgagcagatcaatgtggagtacaatgcctcgtacgcgtatcactccctctntgcatacttcgaccgcgacaacgttgctctcaag

SEQ ID NO: 1563 - DNA, 445 bp, Triticum aestivum
  Clone ID: LIB3280-043-P1-K1-D2
gtactatatccaactgatgatgcttctctgtatcacgtttatctatttggttgcatgccttgaaggagcagtatattgagcaccctgagataatcatcaagaagtttggtggaattttaaatgatttattaagcgaccttttatgattgaccattgtacgagagcatgttttagtactacttgaccgagttagaatgtatatattttcaactaaaaccaattttttcaaaaggcaaaatattttctgcatgatcacatatcatgattatctccatgaagaatgctttagacagtacaataatgaaaataagcatttttggccttcgaaacatatactattgttgggacatctgattggacctttctatgtagaaaatgagaagtgcttagtgtacagaaacctgcacttcatatttcttacatgcatgatttatcgtctatgata

SEQ ID NO: 1564 - DNA, 429 bp, Triticum aestivum
  Clone ID: LIB3280-043-P1-K1-D3
cggacgcgtgggtgcgtcgtcgtcctcgtctcgggccgtccgctcgtcgtcgagccatacctggacaccattgacgcgctcgtcgctgcctggctgccgggcaccgagggccacggcgtcgctgatgtgctcttcggggaccacggattctccggcaagctgcccaggacgtgggtcaggtccgtcgaccagctgcccatgaactacggcgacaagctctacgacccgctcttccccttcggattcggactcaccaccaagccggctgatcgcagctagctagcttagctagcccctcatcggatcgagtttggatttcatctttttccatagcattagcctcagattaatcccttagttaattagcccctgcatgcccctgagtgagaaatcgatcgatcgaaaataaatgagcaaggttttgatcgc

SEQ ID NO: 1565 - DNA, 447 bp, Triticum aestivum
  Clone ID: LIB3280-043-P1-K1-D4
gcttccttgagcttcaggttgatggtgaggaagcttaccagactttctcccgtgtcattgagaacgccaatgtcattatggcaacatatgaagatgcaaaacttggtgatgtccaagtctacccagagaagggaactgttgctttctctgctggtttacatggatgggcatttactctcaccaactttgctaagatgtatgcctccaagtttggagttgatgaaactaaaatgatggagaggctttggggtgagaacttctttgacacagccacgaaaaagtggaccaacaagaacacgggctctcctacttgcaagagaggttttgttcagttctgctatgatccaatcaagcaaataatcaacacctgcatgaatgaccagaaggataaattgtggcctatgttacagaagcttggtgtgaccatgaaggctgatgagaaagagc

SEQ ID NO: 1566 - DNA, 387 bp, Triticum aestivum
  Clone ID: LIB3280-043-P1-K1-D5
gtaacagacaactcgtcctcaatttgactccaaccagatcgttccagaacacaacgaacgctggctttatttccggcgtgtcaatgctaacaagaggccggcgaaaactaatcgtgcacatcgatcaaatcgtatcatgctttacaacaatatatcgcacggatgcagttcacgctatgccgcggcgcgtgcatatacttctcacagagcggtgctggccctggcctcctggcccttggcggcctgcttgtcgccgcagttgtcgacggcggcgtagaggcggtagggcgaggcgtcggtggcgagccactgctcgacggtgaagagctgctgcgcgcatcccatgtggggccccgtggccgtgacctcgacgtagttgcagtacca

SEQ ID NO: 1567 - DNA, 211 bp, Triticum aestivum
  Clone ID: LIB3280-043-P1-K1-D6
gacgccacgcgaccgagacgccggaaacaagatcgcgagcagccttcttttctaactatctagcgaaacagggagggcgtccacaagcggacggcaaccaaaacacacgaaaacacaaccaacgcacaattttttccagaaaaggaaaccctaacacgagccccccaaaaaccaaaccagcacacaactcaaatccactcagccaagacaa

SEQ ID NO: 1568 - DNA, 446 bp, Triticum aestivum
  Clone ID: LIB3280-043-P1-K1-D7
cccacgcgtccgcccacgcgtccggctgtatctgtcctcccgccgacgccggccgggggcttctcctcctgacgcgcttaaccaccccggccttccttccctggagtcgatcggtgcgcaatcaatctcttgcacgttttgatcggtcggtatcggagggcgctccgatccgatccatgtccaggcggcggcaatggagcccgcggagctagccaagatcatcttctcccgggtgcaggaggtggagccggacaacgtgagcaagatcgtcggctgcatcctgctgcgggagcccgacgaggatgagctggtgcacctcgcctacgccaccgacgccgcgctgcgcaacaccatctacgaggccaagggcacgctcgccgtcatctacgcccgcttttccgccttcctcggtcaccactaccaccagcccaacggcgtcggctacc

SEQ ID NO: 1569 - DNA, 276 bp, Triticum aestivum
  Clone ID: LIB3280-043-P1-K1-D8
ggggcgacgagaaatgggtgcatggcataccacacaacacaagagcggtgcagcaagtgtcagtggaacaagttacagaccacaaaaaaataatggacaattgagcgagcaaattatcgaggcactgtcgcaattgtgtgctcgtcatgctggcattcaacactaaaaacttttcagaaacaaaattgggaaacaagacaggtaattttgacaagcatcagctaaaagtatattataaggcgcgcctcgagagactaccaaggccctatgaatcat

SEQ ID NO: 1570 - DNA, 352 bp, Triticum aestivum
  unsure (1)...(352): unsure at all n locations
  Clone ID: LIB3280-043-P1-K1-D9
cccgcggcgacccacgcgtccggttagccacacggcagtcgtttggagattttttgtaaaccgtctaatcacggncgtgtggcactctcgcgccggcgagaatggcgcggccgggcacactcgtcctcgtcgccggcgccgtcctgctcctcctcctgtgcggcgcggcgatgggggcgaagcgggcggcgatcccggacgacctccgcgacgtggtggacgacgaggaggacgaggactggcggcgttggggcgccggctccgggacgcgggacgtccccgatcggccgccgtcggacctgtcgtggatggaccccgccgtgctccgggaggagatcctccgtggccacgg

SEQ ID NO: 1571 - DNA, 443 bp, Triticum aestivum
  Clone ID: LIB3280-043-P1-K1-E10
gcttgtgttccagcctgctgaagagggctacgccggtgcttactacattttagaggagggtgtcctcaacgatatctctgccatctttggcttgcatgtcttcccacatcttcctgtaggcatcgtcgcatcgcggccaggtccatttcttgcagctgcagctcggttcaccgcaacgatcactggaaaaggcgggcacgccggtaaccctcacgatgccgttgaccctgtcattgctgcttcctccgccattctcagccttcagcaacttgtcgcccgcgaaacagatccactcgagtcagttgtggtgtctgttacacagctgagaggaggtgatgcttacaatgtaattcccgaatctgcgtcgttcggcgggacctttcggagcatgactgatgaaggcctgtcatatctaatgaaaagggtgaaagagaccgtagaag

SEQ ID NO: 1572 - DNA, 294 bp, Triticum aestivum
  Clone ID: LIB3280-043-P1-K1-E11
gctacacctccatcctactcaatcggtcttcttttatcctaactacattctaaaggcggggtttctcaacgatggcgctgacttttcacacttgcctgacttcctacatcttcctgatcacatctcctcattgcgtcctactccacatcttgcagctgagatctaataccgcaacgctcactgcttaagagatccacacaattcactctgacaaagccataccccttgtcattgttgtttgctactacacactgcacctttaactacttttattacttgaacacagatccattc

SEQ ID NO: 1573 - DNA, 438 bp, Triticum aestivum
  Clone ID: LIB3280-043-P1-K1-E12
cccacgcgtccgcccaatcccatcgatctatatatagcacttgtgggctctcagtacttggatttacggcgatggcgagggataatggcgacgggctggcggcgattgccgggcggatcggcgtgctcgggtccgtcgtgctgaacatcgtggcgctggcgatctacctccgtggccgcgccgccgccgagaagcaggccagcaagaaggtgaagaaggcggcggctgtggcgccgtcgtctggcaagcctcccgtcgcgtgtgactcggtcatcaatttggaccacggtgatccaacgatgtttgagacgttttggcgcggaccgattggcgaaagcgctacgctggtgattccagggtatcagacgatgagttacttctctgacgtcggcaacctttgctggttcctcgagccaggcttcgagcgtgaggtgcgcc

SEQ ID NO: 1574 - DNA, 405 bp, Triticum aestivum
  Clone ID: LIB3280-043-P1-K1-E5
acgtatacatatatgtgtatataatgaacaatgtaacaaagattgatccctacgcttcatcacctgtgcagccactcaacacttttattgtccagtagtactgtttcgaaactgcttcgcgcgcactgccagtgccattttatctgcctgccatcctctcagtacgtgtctcctggcctctaacctagtagtagagtatatatcagtcaacgaatagaactgctttgctttagttggctttgcaattcttggtcagggaccaaagcccgtccctcccgtgtgcacctcgaagttaggcatcaaatgagcagaagcagcagcaagccgggccgccgccctgttgttaggaggagccgcctggctgctgtacccgattagtgctgcagcagttgggctgtagaaatc

SEQ ID NO: 1575 - DNA, 334 bp, Triticum aestivum
  Clone ID: LIB3280-043-P1-K1-E6
acggatacatatatgtgtagggggggaacaatgtagcaaggagggagccctacgcttcatcacctgagcagccactcaacacttgaatggcccaggaggacaggttcgaaactgctacgcgcgcacggccagcgccattacatctgccagccatcctcacagaacgtgactccaggcctctaacctaggagaggaggatatatcagccaacgaatagaactgctttgctcaagttgacactacaatcgttggccagggaccaaagcccgaccatcccgggtgcacctcgaagttaggcgataaaacgagcagaagcagcagcagccgcggacgc

SEQ ID NO: 1576 - DNA, 174 bp, Triticum aestivum
  Clone ID: LIB3280-043-P1-K1-E8
tgaggggttttttttttttttgtatggttttttttttttttttttataaaaattttttggaagaagaaaaaaccattgctaaaaccaaaatttaaaacttacaaaacccccaaagggcacaaaaaccaaacactattcccacattcaacaaccacctaaaaacccaaatcccac

SEQ ID NO: 1577 - DNA, 434 bp, Triticum aestivum
  Clone ID: LIB3280-043-P1-K1-F1
cccacgcgtccgttccagtgcacgccaatggccagcgtcgtcgtcctcgctgctgctgcttgctgctgcattctcctagcggcctcggtgtcgccggcgtcgtcggagcccgcggtgtacagcgtcggcgacgggagggggtgggcggtgcctgccggcaacggcaccgagacgtacaaccactgcgccaagaagaaccgcttccaagtgggcgacgtactggatgtcaagtacgcgggcaaggactcggtgctgctggtgaaccacgactactacaagatgtgcagcacggtgaccccactgacccggttcgcggacggcgacaccaagttgaagttcgaccggacgggcttcttcttattagacagcggcatgccggggcactgcgaggtggaccagccgatgatcgtcaacatcgcccggcactccacgct

SEQ ID NO: 1578 - DNA, 340 bp, Triticum aestivum
  Clone ID: LIB3280-043-P1-K1-F11
gtagtaccagttaaatacccaatcgatgttcttttagtaaagccggtggcagatgaccctcttttgtcaaagagatgcccagcatccacagatttcaaagtccctataagttctgtgggagatctcctgatggtctgggatttctgcatgtcttttgggaggcttttatgcttgtcgccgttttccttgtcagatctggagaatgcaatttgccacaaagaaaccaatcttgttcttcttgtggaaatacacactgcacttctcaatttgcttattaatgatgaaggcgaatattttgagtttatccagaacaagaacaggaaatcaaaggtatctctag

SEQ ID NO: 1579 - DNA, 446 bp, Triticum aestivum
  Clone ID: LIB3280-043-P1-K1-F7
gcagacggaaggaaagacgttgtttgaacttaagggtgataattccgatctagtcttgaacacgctcatcttcaattgctttgtgttctgccaggtgttcaacgaggtgagctccagagagatggagaggataaatgtattcaaaggcattctaaacaacaacgtgttcgtcgcggtgctcggcagcacggtcttattccagatcatcatagtacagttccttggcgatttcgcgaacaccacccctctgtcactcagggagtggttctcctgcatcgtcatcggcttcataggcatgcctatcgccgcgatagtcaagctcttcccagtgggttctcagtaggagacgacaactaatttgcagtcaggaactgaagtgaggtagtaggactacaggctgatggtgatgccaacgcagtttgtgcgctgtcgtgagcataagaaac

SEQ ID NO: 1580 - DNA, 448 bp, Triticum aestivum
  Clone ID: LIB3280-043-P1-K1-F9
cccacgcgtccgggtcaagagagtgcattttctaaaatagatgatatatcacaactggagggcaccaatgaaatgcaggatgctcagtgtaagggagatcaaactcctaaggatgatgatcaagcaattgaaatggaaggagattttgctgctgaattagctgatgtttctgagaatgaaagcaatgactcaggcagcgaggatgaagacaacttggatagtcagatgggtgacactggtgatgccagtgaaatggttgcgaagaaatcctgggacaaaaacgaagatgatgattctaagacgtctgaagagaagtatgagtcgggttcattagccaagggggcagatgagaatgatagggaattgcgtgctaaggacgaatgtcccatggagacagataccggggagacagatgataacgagcaaggcaagaataatgatatggatg

SEQ ID NO: 1581 - DNA, 417 bp, Triticum aestivum
  Clone ID: LIB3280-043-P1-K1-G1
acgcgtccgcacgcgtgtacgcccacgcgtccgcccacgcgtgtgtccacatccacgagacacacacagcgcagcttcggcgtaaagggaacaccagcaagatgtctcagctcgcccgcgccagcctgactgcgatggcgatgctccttctccttgccgctgctgcggcggcggcggcgccagcggccggcggcgcggctgtggcggacccagcaggctgccaggacgacgttgtggcgctcaacgaggcctgctacaagtacgtgcagaagggcgcgccgacagtgccgccgtcgcaggagtgctgcgacgccgtgaagagcgtggacgtgccctgcgtctgcagctacctgggcagccccggcgtgagggacaacatcagcatggagaaagtgttctacgtctcccagcagtgcg

SEQ ID NO: 1582 - DNA, 323 bp, Triticum aestivum
  Clone ID: LIB3280-043-P1-K1-G10
atgggccaatggcggacttccagtcgatcttctactacttggaattgatatctttttgccatataaagcgaatcaaaattgcaacttgtgtaaacatagagtccccccaggaacacaacaaattatttatcatctagtagagcttcaacgtgaaatattagcaagaatttaccgttagtaactcgtgctgccaatccaaaatcagctagtttcatcttgccagtcttggtgagcaaaatattctccggcttaatgtccctgtggatgacgcccatttcgggggagtacttgacgaccgacattaaatccttgatgacaagggc

SEQ ID NO: 1583 - DNA, 321 bp, Triticum aestivum
  Clone ID: LIB3280-043-P1-K1-G11
atgggccaatggcggacttccagtcgatcttctactacttggaattgatatctttttgccatataaagcgaatcaaaattgcaacttgtgtaaacatagagtacccccaggaacacaacaaattatttatcatctagtagagcttcaacgtgaaatattagcaagaatttaccgttagtaactcgtgctgccaatccaaaatcagctagtttcatcttgccagtcttggtgagcaaaatattctccggcttaatgtccctgtggatgacgcccatttcgtggcagtacttgacgaccgacattagatccttgatgacaagg

SEQ ID NO: 1584 - DNA, 348 bp, Triticum aestivum
  Clone ID: LIB3280-043-P1-K1-G12
ctattcttattggttggttttatggaccaatggcggacttccactcaattttctactacttgtaattgatatcttttcgccatataaagcgaattaaaattgcaacttgtggaaacatagagtcccctccggaacacaacaaattatttatcatctagtagagcttcaacgtgaaatattgccaagaatttaccgttagtaactcgcgctgccaatccaaaatcagcttgtttaatcttgccagtcttggtgggcaaaatattctccggcttaatgtccctgagggtgacccccatttcgtggcagaacttgactcccgacattagatccttgatgacaagggcggcc

SEQ ID NO: 1585 - DNA, 449 bp, Triticum aestivum
  Clone ID: LIB3280-043-P1-K1-G2
taagggtatcatcagtgataagcaacagccctatcatcatgaatgtggactgtgatatggactccaacaacaacgatgcggtcagagatgcactgtgcttcttccttgacgaagaaatgggtcacaagattggatttgtgcagtaccctcagaactataacaatctgagcaagaatgatatatatgggaactccctccatgtcatcaatgaggtggagatgggtggtatggacagtttgggtggccctctgtatattggcaccggatgtttccacagaagggagatcctttgcggcaggaagttcacaaaagactaccaggaagactggaatgcaggaatcaaggacaaattacaagagagcatagatgagactgaagagaaagccaagtctttagcagcctgcacatatgaacatggcacacagtggggagatgagattggggtaaaa

SEQ ID NO: 1586 - DNA, 454 bp, Triticum aestivum
  Clone ID: LIB3280-043-P1-K1-G3
taagggtattatcagtgataagcaacagcccttttattattaatgtggactgagatatgggctgcaacaacaacgatgcgggcagagatgcactgtgcttcttacttagacgaagaaatgggtcacaagattggatttgtgcagtaccctcagaactataacaatctgagcaagaatgatatatatggcaactccctccatgtcatcaatgaggtggagatgggtcggtatggacagtttgggtggccctctgtatatcggcaccggatgtttccacagaagggagatcctttgcggcaggaagttcacataagactaccaggaagactggaatgcaggaatcaaggtcaaattacaagagagcatagatgagactgaagagaaagccaagtctttagcagcctgcacatatgaacatggtacacaacggggagatgagattgtggtaaaatat

SEQ ID NO: 1587 - DNA, 400 bp, Triticum aestivum
  Clone ID: LIB3280-043-P1-K1-G5
aacaatctcctctccgtatttcatttcactgatcaaagtattaatcccgatgtgcctcataatccggccacatttagaagggactgttgatctacaggactatacaagaacgcacttggagctatcaagtgcagaaataatggctatctatagctacacatacaccctactaggagtatgtccatgactagatagaggctctaacttgtcctcacgtaagcctgtgggaacatccttgggaagtaagtgcgcttcgccttgacaaccagccaatacgcagagaagcacgggacgtgagcgacggccatggcgaggtaccatagcggagccccgggcgatgcaaggtcgagaaacgggtaaggccaccaggataaagctccggaagcatgaatgacccact

SEQ ID NO: 1588 - DNA, 443 bp, Triticum aestivum
  Clone ID: LIB3280-043-P1-K1-G6
cccacgcgtccgcccacgcgtccgcggacgcgtgggtccaattccaaaaccgagaggtaggtatccttggaggagggggagggggatcctcctcgccgctccggtttccatggcggccgcccccgcccccgccccttcgccgccggaagcgtccccgccgcccctcgacgcctctgcctccgcctccgacgacgagtgggatgcggatggatttgttattcctgatgtgactattcaagatgatgatgatgatgttactacacacagtgtccccaaagcaagggatcctgaacctcagcaggctaaagaggagaagatatacctgggacctcatggggcgccaccatcaggagcaaagcagcaacaacttaacacagttggccgtaagcagagtgtcagaaacaagctgaaggaagcagataggaaatccagtggcaatgctc

SEQ ID NO: 1589 - DNA, 392 bp, Triticum aestivum
  Clone ID: LIB3280-043-P1-K1-G7
aagtttgcaacagttgcaatgtctggaaactggggcaggatccactctacattgacactgcattaattaatcccctcgaaaacagaaagaaaaaatgactaaactggcactgcatttgggcatgtatgcggacaggtacacaagaactcaaaacagtgagatcccattctattctgtcgcgcggtctattggcaatagacacttgttttcagctgacagagagcttgctgcatcctcatctgctgaaatctgcatcctcccttcactagtcgatgggcacttccacctccatcttcaagccagggtggtcgatgatcgttacaaaatcttctaatgatagagtggaatcccgtgtgtacccagcttcttacaacacctttgttagtacttgc

SEQ ID NO: 1590 - DNA, 399 bp, Triticum aestivum
  Clone ID: LIB3280-043-P1-K1-G8
gcacatctagccacatctcattcgttcccgagttggaaaattatttacagtgagctgcatatctaacaaagtatgtgactacacacacgcgcggagtactgcatggatgcgccagcagaccatgatcagtaactgcaataaaatgccaacagagctacaacaatgcggtggtggaacccgtgctccgattaaacacacatagagggagcaccgaagtgcacgcgtggggtggactctgtgtggccaccctcggctaggctggaggcagcagacccgcatagccagtcgtgtgaccatcgttctcctcttcaagaaaaaaataccactgatgagatgcacgcctggaggcgcaggggcgtgtccccttgacgcagaactgaactgcacgctcgtcgaatc

SEQ ID NO: 1591 - DNA, 447 bp, Triticum aestivum
  Clone ID: LIB3280-043-P1-K1-G9
cccacgcgtccggtataatacatgtagttcactataagtaaaggatgaaatccatttgtatttttcgcaaaaaaataaatatataaatccgtgtgtacggccggagagaacacggacagttcagcagactgaaactcgaccggtcccaatattgtgactgcgacaatgtgttggagacaaattaccagactatatatgaccacatgctaaaaacgattatttatccttccaaccctgcggtctgaccaaggtgttaagagtaaagactcatctccaaataatgtctttatatgccatggacgtgacatttctaaacaaggcatactcgaattgttgcatattattttatacataaatccttccgattttaacctcttggacaggacgcatgagtttgctatgtttctcttatttcctaccgaaagaaacaaatagcattgctaacag

SEQ ID NO: 1592 - DNA, 377 bp, Triticum aestivum
  Clone ID: LIB3280-043-P1-K1-H1
aacctccacatacagaggggagattcttccaaacatgcatagcatggttccgaaatatcaaaactgcatccaccatccagttcctaatgcaaagcatgcttcacacacaaaacatctaccgaatccaagagatcatggatgatcaacctactatatcctccagacgagctggatgatgtatttctcgcggaagccggcgttgccaccctcgacgtaggggttcctattcttcttgaggccttccatcggcgccttaagcttgaagggccacaggaagttgtcggcctccttggagtgaggaccgacggtcaagatctcatgcacaaggtcctcaatgcagatgatggtatgctttccaagaccctccttgaatacct

SEQ ID NO: 1593 - DNA, 353 bp, Triticum aestivum
  Clone ID: LIB3280-043-P1-K1-H10
gttaacaacatacagacagtatttgatgtgtttatggctggcagcaacaccaacaccgacgagtgtacatgcagaatgtctacaaactttcaatataacacctatacaaatggtaccaggggcctaaccactcatgctgctgctcatcctatccaaccgtaatataatatatataatatatagcagtcctgtaattaactcaaactcggctagagatttcgcttgccaaaattgtcctggtaccaaaagaatattaactggaacaaccgatgacgcagatatacaccttggaagatacctctctgggatagatattcatgattcttccctccctttgcgtcaactcaaatact

SEQ ID NO: 1594 - DNA, 421 bp, Triticum aestivum
  Clone ID: LIB3280-043-P1-K1-H11
ctcatggaacacatcaaactcttctccacccgtctcaacattcctaagcttatccgtgcttgtgatgaacaacagcactggaaagagcttacatacctatacattcaatatgatgaatttgacaatgctgctaccactatcatgaaccattctccagatgcatgggatcacatgcaatttaaggatgtttgtgttaaagttgcaaatgttgagatttattacaaggcagtgcatttctatttgcaagagcaccctgatctcatcaatgatcttagcaatgtgctggcacttcgaacggatcataccagagttgtagatataatgcgcaaggctggtcagatgcatcttgtgaaaccatacatggttgcagatcagagcaacaatgtctgtgatgtcaatgaaagctttgatgagctatatg

SEQ ID NO: 1595 - DNA, 327 bp, Triticum aestivum
  Clone ID: LIB3280-043-P1-K1-H12
gtttatggaacacataaaacgcttctccactctttttaacattcctaagcttatccgagcgtgagatgaacaacagcactgggaagagcttacatacttatacattcaatatgatgaatttgacaatgctgttaccactatcatgaaccattcttcagatgcatgggatcacatgcaatttaaggttgtttgtgttatatgtgcatatgttgagatttattacaaggcagtgcatttatatttgcaagagcaccttgatcttatcaatgtatttgtcaatgttcttgcacttttgtttggattatactccgagttgctttatatata

SEQ ID NO: 1596 - DNA, 386 bp, Triticum aestivum
  unsure (1)...(386): unsure at all n locations
  Clone ID: LIB3280-043-P1-K1-H2
ttcttttcctactctggctttggacgctggctactctggctttctcatgtttactcatccaaagcatgccaagcaagatacccccgattgaccagatgacaagaaaagtggaaacctgtggcctgctaataccacttccttttcttctactacttgatggatacttcacttgattgcttaatgatgacaccccttgctactttgcttgactcgacttaatgtactgaatactcatggtagctaggtgtatggatgcgcgtgtaattcgctaaaaaggagctctagtataacttgtgaacgaaattgcttacaagctgcatttcttcccttgtgttagtcaagctttntgttacaanaaaacatanattaaacttaaaaaaaaaaca

SEQ ID NO: 1597 - DNA, 410 bp, Triticum aestivum
  Clone ID: LIB3280-043-P1-K1-H3
gacgatggaatgggatgcatagatagcatcttctccaattaaataaaattgaagtgagaaaagaaaacatgatttatgtagaaagattggcaagaaagaaaaagaaagggaaacaagaaaaaaaggatcatcgatggcgatcggacgggcgccccggcagcagtagtagtgatgatcccatgcatcgtcggcgcgcctttacttttgttttgtttggtgatgatgataagataagataatgacgatggaatggggtggatatatgcatgagtatctagaagcatttccggtggacgatggatggtccggattcgtcgtactcggccttggcgatccacatctgctggaaggtgctgagggaggcgaagatggagccttcgatccacacactgtacttcctttcgggcggg

SEQ ID NO: 1598 - DNA, 335 bp, Triticum aestivum
  Clone ID: LIB3280-043-P1-K1-H4
aactgcaaatcaaactgaaatggactttatttaggactgcagtatgtatgagtatctgcattaggatacactgtacagtgcgcgcttcatcaagagctaaacatagttactgacaacgttccggatatcgcatatcacgcctcatgtatcgatcggggtatcacgtgtggctagactcgtgtatcggcttcacatcttcgtgacaagctcggactgaagaagcgcatggtcaaacgaagagaaggactgggcaacgagtgtgacctgcatctggaccgggatgttgcgcaggtggctcgtcacaggcacgaccttaggcacgttactgaaagaat

SEQ ID NO: 1599 - DNA, 309 bp, Triticum aestivum
  Clone ID: LIB3280-043-P1-K1-H5
gctcgtttaacgactataaagggccagcctattggtcgctacgatgatatgtgggctggatggtgcgtcaaggtcatctgcgaccacttgagccttggagtgaagactggcctgccatacctgtggcacagcaaggctagcaacccatttgtcaacttgaagaaagagtacaagggcatcttctggcaggaggacatcatccccttcttccagaacgccaccctctccaaggagtgtgacacagtccagaagtgctacatctcactctcggagcaggtcaaggagaagctcggcaagattgacccttac

SEQ ID NO: 1600 - DNA, 342 bp, Triticum aestivum
  Clone ID: LIB3280-043-P1-K1-H6
gctaactcaaggagaagcataaaatctcagggtgtctcctttgttctcgtgagagttgtgtgaggcagcagcctaaaatcccagggagaagcataaaatcctgtgagaggaaggcatggagagcgcccataagaaggcactcggcatcgtgacgctactggtggttctgcagctgctcgtggcggccatggctcgctcaccaccagaggagatggaaacggaggcggcgagatcagaaaagatagcgattgagcgcctcgtcctgaaaggcgccgcgggagacgcgaaatgcgccgacgaaacatgctatactggtttttgcttcgtcgtcgctggttgcag

SEQ ID NO: 1601 - DNA, 449 bp, Triticum aestivum
  Clone ID: LIB3280-043-P1-K1-H7
ggctgaacaacagaaaagccaagcttgctcgtatcgcgaaagaaagaggagtgccatacgatggcgagggtgccgacaagtcatctacaccagctacttctcagttgggcgactcctcagagagtgccggcgaggagagctatctgccgccttcaagggtgctgaatgctctaggcttatccaactccaagggcagcagcaggctcgttaccccagactcgagcgagcaaagtacacaagacatgatgatgagccgcccgttcacaagatcattgtcattcgagcctggccgccccgttctgctgatggacaacgaagggagcgaagttggcaggggcgagatcttccaggtcgagggcagggcgcaggggaagagcctggcagagagccacatctgcatcatcgacgtcaccgagctcaaggtcgagaagtggagggagcttccccac

SEQ ID NO: 1602 - DNA, 399 bp, Triticum aestivum
  Clone ID: LIB3280-043-P1-K1-H9
cgacaaaagaacagcatgcgtagattttatcttctgcaagggaataaaattgaattgacaaaacaaaacatgattcatacaaaaagattgccacgaaagaaaaagaaagggcaacacgaaaaaaaggatcatctatggcgatcggacacccgccccgccaccacaattagtgataatcccatacatcgtcggcgcgcccttacttttattttgtttggtgatcatgataacataacacaatcacgacgaacaaatgtggatatatactacatgatttacaagcatcatcccccggacgacgattgatcctccgtattcgtcctactccgcctcgacccaccacatctgctaaaagctgctgaaggagacgaggattcatcctacgaaccacacactgta

SEQ ID NO: 1603 - DNA, 425 bp, Triticum aestivum
  Clone ID: LIB3280-012-P1-K1-A1
cggacgcgtggggtcatcgcctagcctcccgccgccgtcgccgacgccgccgccgccacaagcgaacaagagagttaagaagatggctgaagttgaaaccttcctcttcacatccgagtctgtcaacgaggggcaccctgacaagctctgcgaccagatatctgatgctgtgctagatgcatgcctggctgaagaccctgacagcaaggttgcttgtgagacatgcaccaagaccaacatggtcatggttttcggtgagatcactaccaaggccaatgttgactatgagaagattgtgagggatacttgccgtggcatcggttttgtgtccaatgatgtagggcttgatgctgaccactgcaaggtacttgtcaacattgagcagcagtcccctgacatcgcgcagggtgtccatggtcacttta

SEQ ID NO: 1604 - DNA, 382 bp, Triticum aestivum
  Clone ID: LIB3280-012-P1-K1-A10
aagttcaccataattaacgctgggtaacactgttttctatacaatgcagaatatagttcgataaaggatgatttacggaaggtgctataaaagtttacagccgaacaaaaagccttctgccttactttgtgacagagaaacatttacctcgagagtaatctagccaaagacttcataaaacttctcaactacaagcaagcccgagtcgatcgattcgagcgggtctttacggagccgatgcctcaaacagttggggatcacagtggcaatgtcctccactgtcacaatgtcccttcctttcaaggcagccaacgccttggcagccctgttagagacaatgtcttctctcagcccatccacattcagctcagaacacacctgg

SEQ ID NO: 1605 - DNA, 261 bp, Triticum aestivum
  Clone ID: LIB3280-012-P1-K1-A11
aagttcaccatatttaaggcggggtaacactgttttctatacaatgcacaatataattcgataaaagatgatttacagaaggtgctataaaagtttacagcctaacaaaaagcctcctgccttactttgtgacagagaaacatttacctcgagagtaatctatccaaaaacttcataaaacttctcaactacaagcaagccctagtcgatcgatttgaacagctctttacggagccgatgcctcatacagtttgggatcac

SEQ ID NO: 1606 - DNA, 306 bp, Triticum aestivum
  Clone ID: LIB3280-012-P1-K1-A12
tcgctctatatatcagagagcaaactcaccctttcttcttatttttataacaatcacccatttttaaggaagagggcacacacatctttatctatacaacttctcttatatacattctaattaaatgtcactatttacaaaaactgcgactataaaacgcttatcagctctaacaataaacgcctctctcatcttaactttgctcacaaattaaacattatacctcgtacagtaactctatctcaaaacacttcattaaaactatctcaactacatatcaaaccctttgtccatcatattttaaca

SEQ ID NO: 1607 - DNA, 462 bp, Triticum aestivum
  Clone ID: LIB3280-012-P1-K1-A2
cgcacgcacctgacctcatcccactaactcgcctcttccaccggtcacgcctcgctcccctcgaaacgacactaggagccagactgtcgcatgaggtcgaaacctctctttccacacgggagtgacccaaacaggggcactctgacaagctctgcgaccagatatctgatgctgtgctagatgcatgcctggctgaagaccctgacagcaaggttgcttgtgagacatgcaccaagaccaacatggtcatggttttcggagagatcactaccaaggccaatgttgactatgagaagattgtgagggatacttgccgtggcatcggttttgtgttcaatgatgtaaggcttgatgctgaccactgcaaggtacttgtcaacattgagcagcagtcctctgacatcgcgcagggggttcatggtcactttaccaaccggcctgaggagattggcgctggtgacc

SEQ ID NO: 1608 - DNA, 457 bp, Triticum aestivum
  Clone ID: LIB3280-012-P1-K1-A3
gcgtcccacgggacttccattgccgtcaatgggggagataatggcgcaactgacagtatactttttggtggaagactatatgaactactggctccatcggctgtcgcacacaaaatggggttacgaaaagatccaccatgttcaccatgagttcacggcgcctatggcgtatgccgcatggtatggacactgggctgagatgctcattcttgccgtaccctgcttggctgagcctgctctcgtcccatgccatgttaccacgctgaggatctggtttgctgcgcagtgggctgagagcctcatcatacatatcggatagaagttgccattcaatgctgagaagtatataccgttctatggaggggcagagcaccatgactaccatcactgcataggaggacagagcaagagcaacttcgctcctgttttcacctactgtgattatatttatggaacg

SEQ ID NO: 1609 - DNA, 452 bp, Triticum aestivum
  Clone ID: LIB3280-012-P1-K1-A5
cccacgcgtccggggctgggaaaatagacaatgtagtctcttgttccaccgaggaggagagcctcttggcaaagcaccagctggtcttctccttggttgcgtgtgtgtgtagagtttcatatgtgggtgtgtgtgttcttgtgagaagaagatagagagaaacaaccagagaaagatagagggagctgtgagaggcagcaccaaggtagaagaagaagcggcgctgcgagaggcggcgccaataattggcatcggagccttgttgatccgtggcggcgacgacggtgccggcggctatggtggccgctgtggtgctgggcggaggcaacggctgcgacggtggtgacgcggtggactccatgtgaggtggaggacgtcggtgcgaggtgatggctggcagcggtgcggtaccagtgatggccggtttcggtgcgatgcctcgaggtgattat

SEQ ID NO: 1610 - DNA, 65 bp, Triticum aestivum
  Clone ID: LIB3280-012-P1-K1-A6
cagaggcgctatgcctggctgataagactttgctgcattttgtctatgtgattgtgattgtgatg

SEQ ID NO: 1611 - DNA, 441 bp, Triticum aestivum
  Clone ID: LIB3280-012-P1-K1-A8
cggacgcgtggggctgacgttcgacaacgccgggatgtggaacttgaggtccaatctgagggagaggtactacctgggcgagcagctatacgtgagctgcacctcgccggccaggtcgctcagggacgagtacaacatgcccgacaacgccctccgctgcggcaaggtcgtcggcatgccgctgccgccgccctacaccatcgcataaaccactctcccccagctccattaattccactccactccactccatgagagcacgcttgcatggtgctgtacacactacgtacgtacaacgacaacaacaggaagagcaggagagttttttcgtttcttcttttttttcgtacgcccccacgtcggctgttcttcttgtcaggttcactctctcttttcgaggaaaataaaacaacaacaaaaaagggggcctcatcgtcatgt

SEQ ID NO: 1612 - DNA, 463 bp, Triticum aestivum
  Clone ID: LIB3280-012-P1-K1-B1
gcggcttgctccagctggctgccactggctcggtccctccggcgccccctccggcgccggtgctggagccccaggacatcctgcaacagcagctgccggtgtgccccaacgaccccatgttccggaccttccgctgccgcctggggcccaaggagacgccgacggggaaacctgagtacaacatcaatatggctagcctagatgactaggttccttgtggtggaaccagcccatccgggttcaagtcctaaacttgacatggatgctctcatagaaggtgtgtgctgccgacgggtgaagaaatgccaagacggacatcatcttgttgcaaataccccaccccactctttgcgagtttcgctaagttcgttgtgcattacatactggaattaatgcgttagttacctagttacgtggcactagaacaacatcgtgtactgagtattcggacaagtttgctttt

SEQ ID NO: 1613 - DNA, 54 bp, Triticum aestivum
  Clone ID: LIB3280-012-P1-K1-B10
cgtactcaacgaaaaaccatagcattccaccaaccaattccacttcctaatcac

SEQ ID NO: 1614 - DNA, 353 bp, Triticum aestivum
  unsure (1)...(353): unsure at all n locations
  Clone ID: LIB3280-012-P1-K1-B11
cacagatcggaaacctcaccgcacgccacagccttccccgcccgccccatccgccaccgtcgccatgggcagaggccgaggaggccgcaaccgcaagccccgcaactccgccaccttccgcctctgcccgcgccccggcgccgccgacccctccgaccgcgtcctcgtccgcgtcgacggcaaccagtaccacgtccccggcctcgacgacgacgacgacgcctgctacttcgagggcgccttaggggacgacggcgccgagccctcgtcctccccatctggggccagccctcccgaccacgtncgncgngcgatcctcgagctcgagcctcccgacgacagctacaactacc

SEQ ID NO: 1615 - DNA, 421 bp, Triticum aestivum
  Clone ID: LIB3280-012-P1-K1-B2
gctaaacaatctctaggtgcgggagcgctagttccttgtacaacattagtcaaatgaaccaataactacttgattaaaaaaaacaatcattaccatctgaggacaaaaatgacccccacatcaaaacactggaccagaactaatacctctagtcataactacttagatcgtcagaccaaaccaagataaaatttatggacagactaaacaaagagatatattcctctcatacaacacttttgacaaaagcatcatacaagcgcacagtcttgctatgccgctgcatattataagtgagcggcactcatctagctttcttaagaaatcttctgtgtctttcgtagtggaacctatgaagcagtaacattattacaacatagttgcacaacaagccatacgggtactttaatcgcggtcacaa

SEQ ID NO: 1616 - DNA, 457 bp, Triticum aestivum
  Clone ID: LIB3280-012-P1-K1-B4
ctcctccctctaaaatccgcctcccccttcccccattccctttcctcctccccaagaaacaaccgaagctcgcacatcatctcacctcggcgcctcgccccctagcctctacgcacctcgactcccgcgccatctcgctgcattcgcgatgtaccgtgcggccgccagcctcgcctccaaggctcggcaagccgggagcagcgctcgccaggtgagaggattcgccctgctcgaatttctgtttgcggtcgcctggtgttctagcttggtagttctaggtcgagtagcgtcgctgggttcaagtggagattcggtcgcgttatttagtgggtttggtagcgcgtgcgagagcgagaccatgtggtggtctgtgcggggttcagtcgaatctaggcaagcttgaattgcttaggatccagcggattgggttcaatgacaagtaatggattaatgatct

SEQ ID NO: 1617 - DNA, 222 bp, Triticum aestivum
  Clone ID: LIB3280-012-P1-K1-B5
ttctccttaaaatctccgatttaacatatcgtgaaaacattctataaactctataagagtcggaatttgactttaaaagacttaatctcctactaaaatttcatatactctcctcttaatgtcctccatttaacatattgtgctatacacttttcttattctatacatgtctaccccactggactatcttgttccacgtctcgcacattgaaattatctctt

SEQ ID NO: 1618 - DNA, 328 bp, Triticum aestivum
  unsure (1)...(328): unsure at all n locations
  Clone ID: LIB3280-012-P1-K1-B6
ggacaaatgtagaagacgcttttcagtgcattgtaaaggatgctctgaagaatgaaccagaagaagaattgtacattcctgacactgtcgatgtggtgggtggcaaccgcacccaaagatcatcaggctgctgctaagccatgccacgccatggccgtagcaaccattgaacatgctgtctttcctgcctgtataatatcatgttattctgtattccatttgtgacttgaccaatcaccccttcggtacgaaatcaaggatcgatgatctgtcctgttctgtctgtcatcttgtatgttgtgtagtttgttgtgaatgcggcggtntg

SEQ ID NO: 1619 - DNA, 457 bp, Triticum aestivum
  Clone ID: LIB3280-012-P1-K1-B8
cggacgcgtgggcttagatatcatggtatgcaagagttcgatcaggcaatgcagcatctggaggaaaaatatgggtttatgacatctgagcaccagtatgtttcacggaaacatgaggaagataaggtgatcatcttcgaaagaggagatttggtatttgttttcaacttccactggagcaatagcttttttgactaccgtgttgggtgttccaggcctgggaagtacaaggtggccttagactccgacgatgcactctttggtggattcagcaggcttgatcatgatgtcgactacttcacaaccgaacatccgcatgacaacaggccgcgctctttctcggtgtacactccgagcagaactgcggtcgtgtatgcccttacagagtaagaaccagcagctgcttgttacaaggcaaagagagaactccagagagctcgtggatcgtgagcgaagc

SEQ ID NO: 1620 - DNA, 459 bp, Triticum aestivum
  Clone ID: LIB3280-012-P1-K1-B9
cgttttgaacgaaaaaccatagcattccaccaaccaattccaattccgaatcacggcaacagctcatcatcactaacagctcaacggtttctcccttaacttgccttgccttgccttcccttcccttccaaaaggataaggatgaggctaggtaaggaaaggtagggtagggaacacgcacgacaacataaggatatagtagatagcctaacacaggacaggagcataacgataatctcataggaggcagccagccagcatcctcctcttttaatctacttggcctcatgcttggccttggagtgcgaagctagagcgccctcactgttgaatgtcttgctgcacgacttgcacgcgaccgaccctccagacttgggcgacttctcactggttgctggggtcttgcctgccttcttggccgggtgcggagtcgccacatggacagctcccttcttgtca

SEQ ID NO: 1621 - DNA, 306 bp, Triticum aestivum
  Clone ID: LIB3280-012-P1-K1-C1
gttcgttggagagcgtagaggacatcaggatggcgcctatcactcgtagggccaatgccagtcctggtcgtggggatgctcctcgcggctgccatggcagctgtggcgaccgacgtggcggagcctgaggcggcggccgaggtgtcgtgcggggacgcggtgagcgcgctgatcccgtgcgggtcgttcctggtgggcgccgacgccggggcgccgagcgagagctgctgcctcggcacgcaagggctgcggaggatggcgggcacgccggccgcacgggtcgcgctctggaggtgcctggagcag

SEQ ID NO: 1622 - DNA, 377 bp, Triticum aestivum
  Clone ID: LIB3280-012-P1-K1-C10
ttccaatctaaaggctgctgcatccgaatttattgttccccactgaaactccctgaggagggtgaatcatccattttctatcaccatatagtttaagattcagtcctgtagtcgaacatctcaccgagaggcgatctggactaattacacttattcatgaagtagaccccatctatgtggactgattcaaaaatggaaaatcctgcaggtacgatgggaagatggcacatactgttatatccaaactacactatctccatactatatccagatatttgctggctcgccctctattgctcagtctctatcagcatacagttctaaaccaactacactgtgccctgagggcactgtgaacgctccaactctgtctggaa

SEQ ID NO: 1623 - DNA, 389 bp, Triticum aestivum
  Clone ID: LIB3280-012-P1-K1-C11
cggacgcgtgggtgcgtgggcgagatcgccggccggggtttcaccttcacgggctacagggtctgagcgccttccttccatgagtaccttcacgcggtcgtcgtcgattaagagctgaagactctgttagccaatcagtttctcgtgatgcgcggtgcgaagttttggttttctgaaaaaaaaatactattcttgatgctggtgaaaaaagtactcgtcgatgaggtctaataatttgtcgcacgcttagtttactgatgaagcctggacagatgaaatgtctgatgtttgccttgcttgcttgctaagttcagggcaagaaatgatgaaatgaatttcacttggtgatgaggtagtataataatgatctccccatttcacttggttgg

SEQ ID NO: 1624 - DNA, 466 bp, Triticum aestivum
  Clone ID: LIB3280-012-P1-K1-C3
cccacgcgtccggccgaaacccactcttcgctcaaccgtctcggagcagaggctctcccttcacgcttcgtcttcctccctctcggcagttcgacctttgcatggcagcagtggctagctccaaggggcgggtgatcgctgggagcctcgtggcgcgcgtcctcgccggcaaggccaacgcctccccgaggagggcggtgcacgcgtcggcctacgacaagaacgtggacgagcaggtgcgcccggccttcgtgccggacgatgtgatcggcggcgccgggagcccagacaagtactggggccctcacccaaccaccggcgtcttcggccccgccgcggtcgaccccaagctggccgccagcctcgcgccggccagcgccgccaagggcggcccctccgtgctggaccagaaggtgtggttccgtccgctcgaggacgtcgagaagccccccgtcgcctgatcgcc

SEQ ID NO: 1625 - DNA, 445 bp, Triticum aestivum
  Clone ID: LIB3280-012-P1-K1-C4
cccacgcgtccgggcgggggcgctcctcttgccgtgtgcaggcgaggacgaccgcgacgacaccggggaagtggacggaggcggtccggcaggctgggtgaagtagacgacggcaacggcgggagctgctagggttctgggagcagagaggtgggagagggaggtggaggcgaggcgtgccagccgggatcccgatccaactccagccggccagccctatcgtcgccggcgagaccaccccaccccagggcgcctacctcctgctatcctccctccgcatcttctcttctgcagggacgcatcaatggggatcgagagatcggggaaacgagcagccggccgccggagcgaggcccacccccaccatcgaaaccctagcaggggaaatcgatgggggtgaccgcatgaggcgaggaaaagtagatcgacgcggtgaaactagtag

SEQ ID NO: 1626 - DNA, 421 bp, Triticum aestivum
  Clone ID: LIB3280-012-P1-K1-C5
ccacttgacgattaagattcagttggacaagtgatgaccactgaccacgataggtttttcttgttgtcgcaaacataaccactgaccgaacatgttcaccgacaccacctcatagactccaggataattacaacccattacgacagacataaagaagagcgctgaaatgcagacatgacgaatactaagcgttgttcgttcattcaacgcggcggcggcatcgcctgcctagatgctcctttactcaaaggcccactggttctccctgcggatctcctcctcctcctagggcgtaaagtcgttcttgatgttgaaggtcttgcggatctcctctggggtcttgcccttgatcatgtcagcaaaagtctggcaggtcaggtccagcagccccttgatgttcaggtagttggcaaccaggatg

SEQ ID NO: 1627 - DNA, 417 bp, Triticum aestivum
  Clone ID: LIB3280-012-P1-K1-C7
gttaaatgggcagaaagattttcaataagtattaccacatagggcaagcttaaccaataccttattaaactagttcaaccactactttaacttgcattttttttttgttctatcatgccaacagaagaaatagagtagaacaggtcatgctgaaatttggcttacatcagtaaaagcctgacctatgaattttatttttcagtccagtcttccactttcacactccttttcttctgatattgattcttcctcatcagtttcagatgatagtacttccgatgatagttggacttccgcccgagctcaacaagcttgatagcctccttcaccctcgatgcatttaccaatgcattcactacatcctgcagcacaccacactcgactccacagcactttttactagcaaagatttcataa

SEQ ID NO: 1628 - DNA, 458 bp, Triticum aestivum
  Clone ID: LIB3280-012-P1-K1-C8
cgctccacttcttctgcctccctctgtttctcccccgctccaacgaggcaccatctgataggaggaagagaaaggtccggtcaccgcatcgcgtcgcgtgatggcatttgggctgccccgcgccgcggcggcggtggtgacgctggtgctcggcctcgccgcggcgtcggccgtggcggacgacgtggagatggtgttcctgaaaagcgcggtggccaaaggagcagtgtgcctggatgggagcgccccggtgtaccacttctccccgggctccggctccggcgccaacaactggattgttcacatggagggaggaaggtggtgcaagacccctgaggagtgtgtgatccggaagggcaacttcaggggctcctccaagttcatgaagccactctccttctcaggaatcctaggaggcagccagcaattcaatcccgatttctacaactggaacagag

SEQ ID NO: 1629 - DNA, 457 bp, Triticum aestivum
  Clone ID: LIB3280-012-P1-K1-C9
ttacaatccaagggctgctgcatccgaatttattgttccgtactggaagttcctgaagagcctgaatcgtccattttgtattggaatgaggtttaagattcagtacgggagtgaagatgttaatgagaggcgatctggaataattacaggtattaatgaagtagaccccattaggtggactggttcaaaatggaaaagcctgcaagtaagatgggaggatggcacatactgtaatagccaaaatagactatctccatgggatatcgagatagttggtggctcggtctctattgctcagtctctgtcagcatccagttctaaacgaactaaactgtgccctcagggcaatgtggacgtcccaactctgtatggaaatggtcgtccggactccgtgggagctgataagctccccagggtcttgcaaggtcaagaattgatgggttctggaactcatcgt

SEQ ID NO: 1630 - DNA, 446 bp, Triticum aestivum
  Clone ID: LIB3280-012-P1-K1-D10
actaggtctagaccgccagcgccccccccgtcttttgttacaaccactcctcgccggggggccttgccttctccgcccagggttatgtccttgggctcacgggattccttccttgtgtaatcgtgctagaaaggaagtggctcgatttccgtctgaattcagatcccaagcggactccaaaaggaactctatttatttattagtagcaaagtttgtttgtgacccgagatattgttagtaatcattaggatgtgatctagtcctcctattcgtatgctgccctagttagcagactagccacagcagatttcgactcctttgatccatctataataaggccaattggtcattttgccggagatggaaaacaataataaagtcgatgcccaacttgacagttttagctagctgccggatcaccttctactcaacatattggagagggt

SEQ ID NO: 1631 - DNA, 54 bp, Triticum aestivum
  Clone ID: LIB3280-012-P1-K1-D11
aactactcctagatccccaccacccactctttttttttttacaaccactacttt

SEQ ID NO: 1632 - DNA, 128 bp, Triticum aestivum
  Clone ID: LIB3280-012-P1-K1-D12
ccgagtttatggatgaaaaggtgtgtaaagttgcattggttttaacctagtaagaaatatggagtaattgggattatcatctgtgttggcgacattcatgttctgctctataaaacatgcattggtac

SEQ ID NO: 1633 - DNA, 462 bp, Triticum aestivum
  Clone ID: LIB3280-012-P1-K1-D2
cagggctctcaacaacttgcaaagcatttgtatgacatcaaagttcaaccgtcaacgttgcttccaaaacaaattggtaacatgtatactgcatctctgtatgctgcattggcatctgtaatctacaacaagcatgctagtctgaccggccaacgaattgtcatgttctcttatggcagtggcttgacatccactatgttttcattcaaactaaatgagggtcaacatccctttaatttagcaaacattgcttctgtgcttgatgtgacggcaaagcttgaatcaagacatgtgacttcacctgagaagttcattgacacactgaagctgatggagcaccgatatggagcaaaagattttgaaacaagcaaagacataagcttgttgccaccaggaacgttctaccttacaaaagttgactcaatgtacaggaggttctatgaaaagaaaaccgatggcatt

SEQ ID NO: 1634 - DNA, 359 bp, Triticum aestivum
  Clone ID: LIB3280-012-P1-K1-D3
gagatgagcaagatggcttcgacccaggcattgatgcaggctcagcatctcaagcaagcagccatggggatgggtgtaggtgcgagtcaagcgatgtacgatggtactttccagaacgtcggtacctcacagcagcagcaacagcagcagcagctcatgtattattaattccagtcttggagggagctcacctttgtaatttaaccctgattttatgttttcttttctatcttcgtcgtgtctatatgcagtgtgacactatatgttggtgttgccgtctggctgtgttggtagtgcaccgaatctgtgtctgtagtgatgccagttgaccggttaatatcgaattttatgttattttc

SEQ ID NO: 1635 - DNA, 454 bp, Triticum aestivum
  Clone ID: LIB3280-012-P1-K1-D4
ggatcctctgccatggccagagcggcggcacccttgctccccttcttcttcctcctgctgtcctcgacatcgccggcggcggcccagaagaatcgccttggccggactccccagatggggtggaatagctggaaccacttcggctgcaagatagacgaggtgataatccgaaaaatagctgatgccatggtggatactggtcttgcgaaactggggtatgagtatgtcaacttagacgactgttgggcatctcatgacagagactcccagggcaatctagctgcaaatggaacaacatttccatcaggaatgagggccttggcagattatgtgcatgggaaagggctcaaactcggagtctacggcgatgcaggactgcgaacttgcagcaggctgcagcccggttcgctaggatacgaagaccaagatgcgagaactttggcagcttggggga

SEQ ID NO: 1636 - DNA, 465 bp, Triticum aestivum
  Clone ID: LIB3280-012-P1-K1-D5
gaatcctctaccatggccagagcgcaggcacccttgctccccttcttcttcctcctgctggccgcgacatcgccggcggcagcccataagaatcgtcttgaccggactccccagatggggtggaatagctggaaccacttcagctgcaagatagacgaggtgattatccgcaaaatagctgatgcgcatggcggatactggtctcgcgaaactggggtatgagtatgtcaacttagacgactgttgtgcatctcatgacagagactcccagggcaatctagctgcaaatggaacaacatttccatcaggaatgagggccttggcagattatgtgcatgggaaagggctcaaactcggagtctacggcgatgcaggactgcgaacttgcagcaagctgcagcccggttcgctaggatacgaacaccaagatgcgagaactttggcagcttagaggattgactactt

SEQ ID NO: 1637 - DNA, 420 bp, Triticum aestivum
  Clone ID: LIB3280-012-P1-K1-D6
cttttccccattctctccctcctcagtccagttctcctcccaaacagagcaagagcagacaaatagggcggctggaaaacacccaagaagaagaagaagaaggcaatggcggaagcgaactcgtacgaggagcagcgccggcggcagattgaggagaaccgccggaagctggacgagctgcgcctgcaccacctctccgccgccgtccgcgaggccgccgccaggcccaagcccaaccccaagcccaggccgaagcgcaaggccccggagcccggcgagctccggcggtccggccgcgtcgccggcctcccggaacagcccaaatacgtcgagggcgcagagcagcgcggctaccgtggagtgtacgaggcatacgctgtttggaaaggaccgaccgacgaggagagggccggcgccatc

SEQ ID NO: 1638 - DNA, 385 bp, Triticum aestivum
  Clone ID: LIB3280-012-P1-K1-D7
gcggttagccatatgaactaccttctgactcgactcgtcttctcaccaccatctcgagcggacgacgacggcggccgccatgtggcagcgcgccagcttcctgctgctcggccgccggacggccctcacgatgcgaagcgcccccgggatatcgagatccaccgtgggcaccagcacgagctcgccctgcatattctctaccctcaaagcagagcaggcgaagacacccgtagaggaagtgaagcctatcgccacggtgcacgagcccgaagagatcgaagcccagcttgagagaacgaatcggtttgacatggacacacccgaaggtccatgcgggcccaaagaagatccagttctgtttcacgcacactgtcacaaaagggtt

SEQ ID NO: 1639 - DNA, 456 bp, Triticum aestivum
  Clone ID: LIB3280-012-P1-K1-D8
cctttgggcaggccgccgccgccgccgccgccggcggcgacaaccactccccgccgccggcccttgcctcctccgtccaggggtatgtccttgggctcacgggattccttccttgtgtaatcgtgctagaaaggaagtggctcgatttccgtctggattcagatcccaagcggactccaaaaggaactctatttatttattagtagcaaagtttgtttgtgacccgagatattgttagtaatcattaggatgtgatcgagtcctcctattcgtgtgctgcccttgttagcggactagccgcagcagatttcgacttctttgatccatctataataaggccaattggagattttgcggagatggaaaacaataataaagccgaagcccaacttgacagtcttagcaagctgccggatcaccttctacttcaacatatggagagggtgaaacgctaga

SEQ ID NO: 1640 - DNA, 316 bp, Triticum aestivum
  Clone ID: LIB3280-012-P1-K1-D9
catctactagaaaggaagagactaaatatctctatgcattcaaatacaaagcacactccaaaaagaactatatttatttattaagagcaaacattaaccagcacccgatatattaccaaaaaatattacgatgtaatcgagtcctcctattcgtgcgctgccctcgatagcgaactaatcccaagacatttccacttttttgatccatctataataaagccaattggagattttgcctagatgcgaaaacaattataaagccttagcccaacttgacaattttagcaagctgacgcatcaccttctactcaacata

SEQ ID NO: 1641 - DNA, 469 bp, Triticum aestivum
  Clone ID: LIB3280-012-P1-K1-E1
cccccacgcacaaaccacaatctcatcgtctcgtcaacaatggtgcagcgcagctccaacgccgaggtcatgtccatggacctgtcgcccaagaagccggccaaggcctacggcagcgacggcggcgcctactacgactggtccccggccgacctgcccatgctcggcgcggcctccatcggcgccgccaagctgcacctctcctccggcggcctcgccctccccagctactccgactccgccaaggtcgcctacgtgctccagggcgccggcgcctgcggcctcgtcctcccggaggcggccaaggagaaggtcatccccgtcaaggagggtgacgccctcgcgctccccttcggtgccgtcacctggtggcacaacgccgagggctcctctgctgagctcgtcgttctcttcctcggcgacacccccaagggccacacccccggccgcttcaccaacttccagctca

SEQ ID NO: 1642 - DNA, 92 bp, Triticum aestivum
  Clone ID: LIB3280-012-P1-K1-E10
ccaaatcttactcccaagcatccggctttcttttgctttttccccaccaattccaagaagattcatatagaagttccatctttttaaggaca

SEQ ID NO: 1643 - DNA, 464 bp, Triticum aestivum
  Clone ID: LIB3280-012-P1-K1-E11
cccacgcgtccggcagcgtggcagcgtatcaacatttgatttcaatgttgaggcaatgtgcatctgaaaatgaagccattcacagaagtgcgagatgggttgggtttggaagacaggttagcagacaatataaaggttccattaacgctgtgtgcaggtacggaaggtacacagattaccatccgcgatggtgactgcaactccgcaaacgaatctggaaatgtcctagcaaccttattgctgccagcaaagtgtgaccagccaaaaatgctccaaggcctgggatggtcgaattcagggaaacacagattcggaggcgtcagttaaccagggagatgatcgtgtccttgcgagaagtgggagctcagtggtttccttgctgtctctgcaggtaagcggtggtcacgatggcgaagcacatggattacaagaactacatggtgcacatgaggagcaagcttacg

SEQ ID NO: 1644 - DNA, 471 bp, Triticum aestivum
  Clone ID: LIB3280-012-P1-K1-E12
caagttcgtcgaggacaagcacaaggcgcacctcccggccaacttccgcaagattctgtgggtgcagctcaagaagctggtcgcctccggcaagctgaccaaggtcaaggcctcgtacaagctgtcggccgccgcggccaagcccaagccggcggcgaagaagaagcccgcggcgaagaagaaggcgccagccaagaagaccgccaccaagaccaaggccaaggcgcccgccaagaaggccgccgcgaagcccaaggccaaggcgcccgccaagcccaaggccgccgcgaagcccaaggccgccgcgaagcccaaggccaaggccgccgcgaagcccaaggctgccgccaagcccaagggccgccccgccaaggctgccaagacctcggccaaggacgcgccagggaagaaggcccctgccgtcgcggcgcccaagaaggccgccgccaggaagccgcccaccaagagatc

SEQ ID NO: 1645 - DNA, 439 bp, Triticum aestivum
  Clone ID: LIB3280-012-P1-K1-E2
cccacacgtacaaaccacaatgtgatggcgccgtcaacaatggtgcagcgcacctccaacgccgaggtcatgtccatggacctgtcgcccaaaaagccggccaaggcctacagcagcgacggcggcgcctactacgactggtccccggccgacctgcccatgctcggcgcggactacatcggcgccgccaagctgcacctctcctccggcgggcttacccttcacagctactacgactccgccaaggtcgtctacatgctccaaggcgccggcgcctgcagccttgtcctcccggaggcggtcaaagagaaggtcattcccgtcaaggagggtgacgccctcgcgctccccttcggtgccgtcacctggtggcacaacgccgagggctcctctgctgagctcgtcgatctcttgctcggcgacaccctcaagggccaca

SEQ ID NO: 1646 - DNA, 362 bp, Triticum aestivum
  Clone ID: LIB3280-012-P1-K1-E3
ctttgttagcgtggacaaagttttcggctggcctatcggttaccgttttctcctattcaaagactgtaatatctattcctacttgtgcttctcacttgtgattttggacacatatgttcggtttattcaatcaaatttaatcagatgcctggtgaggctactagagaaatacgggcggtgttccgattttgtcatgtgtcacctcaatcttgttaaatgaataatatgaagtctcttgatcctaaaaaaaaaaaaaaaaaaaaaaaaaaaaaaaaaaaaaaaaaaaaaaaaaaaaaaaaaaaaaaaaaaaaaaaggaagacaaaaaaaagagaggcaaagcggaaaaaaaaaggcaggggac

SEQ ID NO: 1647 - DNA, 453 bp, Triticum aestivum
  Clone ID: LIB3280-012-P1-K1-E4
ctccccacagacttcccagccacgccaccggcgatgaccccccggtgctagtctagtccagtcgtggagaggcccggagcgatgggcgagatggagtcgacctcgccgccgccggcgggagcgggcggcgcggtgctgcaagtggtgttcgtggacggctagcggagcgtggacctgggcacggtcaccgtgcacccgtcgctgggcgtgcggaggctgcaagcggtggtggcggaccgcgtgggcgtcgcgccgcagcagatctcggcgtcgctcgcccggccgcggcgccagcgccgcgtgccgctcgacgagggcgccgacctcgccgccgtcgtggcccgcgagggcgccggctgctacgtgctcgccgggctccgtcgctcgcgccaggaccgtcgcggtggccgctccaggcgcgaccggaagggcgcgggggcggggccttatcag

SEQ ID NO: 1648 - DNA, 469 bp, Triticum aestivum
  Clone ID: LIB3280-012-P1-K1-E5
ccagacggcaggtaagggaggaggagagcggcggcgaagatggtgtcgctgaagctgcagaagcgcctggcctcgagcgtcctcaagtgcggcaagggcaaggtctggctcgaccccaatgaggtcaacgagatctccatggccaactcccggcagaacatccggaagctggtaaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctgaggcgccttctgcgcaagtaccgtgaggccaagaagatcgacaagcacatgtaccatgacatgtacctgaaggtcaagggtaacatgttcaagaacaagagggtcctcatggagagtatccaca

SEQ ID NO: 1649 - DNA, 469 bp, Triticum aestivum
  Clone ID: LIB3280-012-P1-K1-E6
cccacgcgtccgcccacgcgtccggctaggacctagagggtcgagttaacccaagaaccgcacacccgcaggatcgacgtaccaagcagctagcagcagacatgcgccgcctgtccctcctcctcctggccgcggccgccctcctcgccgccgcggtggcagtagtgcgcgccgggccggaaatgccccaagcggcgtcggtggcaggaatgggcgccgggccgggagtgccccaagcggcggcggcggcaggaatgggcgccgggacgcaagtgcccaaagcggcggcggcggcaggaatgggcgccgggacgcaagtgccccaagcggcggcggcaggagtgctcgccgggccgggagtgccccaggcggcggcggggggcccgccgggcaagctgtcgcccgatttctacagccagacgtgcccacgggcagagcggatcatcgcagaggtggtccagtcgaagca

SEQ ID NO: 1650 - DNA, 417 bp, Triticum aestivum
  Clone ID: LIB3280-012-P1-K1-E7
cgaaagaaacatactacggctagtttccttttgttatttattccaagaagaaaagggtgaaagaaacagtggaccgacgcatgggaaataaaaagatggcgccaaaacaaactccggcgaaactaaacggcgacgagacgcccgacgacctcgctacgaccatgagtaacacgatacaacaccggcagcagctgccgcttgctggctggtaaagtaaacatcgccggccggttggaccggcgacagatacaggagagtataagctcgccgtggtcacacggtgagcccgcgcatgaactcccactcctcgtcatcatcctcggcggagcccgccgccgacccctccgagtcgctgctcatgccgttcgactccgcgccgctcatggccgaggcctcctcggtgtcgaacgacaggta

SEQ ID NO: 1651 - DNA, 464 bp, Triticum aestivum
  Clone ID: LIB3280-012-P1-K1-E8
gcagatcgaatccgagagcatcggcgttggttaggcgtcgccaccaccaccaccagcaccagcaccatggcagcgcccccctcctccgtctccgtcagggccggcgcgtccgtctcggcgaagctgaccccttcgcgggccgccagggttgggttcggtggcagggtcagcgtcggctcgggcaggaagtgcggcggtcccgtgcgggcgtcgctcttctcgcccaagcccgcggtggccatggacgcgaggccaaccaaggtgcaggagctgcacgtctacgagctcaacgagcacgaccgcgagagccccggctacctccggctgagcgccaagcagagccagaacgcgctcggagacctcgtccccttcaccaacaaggtgtacaacgggagcctggacacgcggatcgggatcacggctgagatctgcatcctgatccagcacgtgccggagcgcaacgg

SEQ ID NO: 1652 - DNA, 451 bp, Triticum aestivum
  Clone ID: LIB3280-012-P1-K1-E9
cccacgcgtccgcccacgcgtccggctttctgcagcggttgccgcgcgactcggggcgggatccatggagaggtacgagctgctcaaggacatcggcgccggcaacttcagcgtcgcgcggctgatgcggaacaaggagaccaaggagctcgtcgccatgaagtacatcccacggggcctcaagattgacgagaatgtggcgagggagatcataaaccaccggtcgctgcggcaccccaacataatccgattcaaggaggtggtggtcacgccgacgcacctggcgattgtgatggagtacgcggccggcggcgagctcttcgaccggatctgcaacgccgggaggttcagcgaggacgaggccaggtacttcttccagcagctcatctgcggcgtgagctactgccacttcatgcaaatttgccaccgggacctgaagctggagaacact

SEQ ID NO: 1653 - DNA, 470 bp, Triticum aestivum
  Clone ID: LIB3280-012-P1-K1-F1
ggctgttgatcagttaactgtttatttgagagatgacaatgctattgagttgccctacagggttgagaatcgtgaaaaggcccctgttgagaaagacagcgatggcgaggattcagtcactcctgccatgacaaaacttacctcagaagaatctcagcactcaatgtctctcaagcccgaggaagcctgtggggttctgtatgttgaccttggcatgactgctgcagtgcagggagagcttgagcaggccaattacctggtgagccgtggttttgcaatgttgcccaacagccctagggcactgctagcatccatctatgtggatcttctgcaagggaaggtgcaagaagctatcggcaagttgagaaggtgcagaaacgtgagatttaagaccagtagtgtagcagccagcagataagacttgcctcgttttgatgatttatctatagttgataattgccatttcttgg

SEQ ID NO: 1654 - DNA, 408 bp, Triticum aestivum
  Clone ID: LIB3280-012-P1-K1-F10
ggggaggcaaattatttatgacaatccattaagcgaattacctatgataatctgaaccaatgaaattacaagtattgaccaggtgtactggatgcaaagcatctacactgtttagtctcaaaaggcaaaaatattgaacatactaacagaagtgtagcatttataaatctagttgaagcactacaaacttgaatcaactttcaaaatgatttgcacttcccacttgtgtggcaaacaaggccagccagccaggggacagaaacaataactgaaacaggggcttctattcattgctttgctttcaaggggatactacctttcgtgtagcacccgcgcaggtgacattggacggctcgacgaatgttcttcttccgccggcgaactcggcaacgacactggatgtgtcgt

SEQ ID NO: 1655 - DNA, 468 bp, Triticum aestivum
  Clone ID: LIB3280-012-P1-K1-F11
ccaggaaccgtgttcttgttgatgtttcagctatggtacccggaggcatcaggatgggaacccccgcacttacatcaagaggatttgttgaggaggacttcgccaaggttgctgacttcttcgattcggcagtgaacttggccttgaaggttaaagctgcagcagcaggtaccaaactgaaggactttgttgccacattgcaatccgacagcaacatccaagctgaaattgcaaagcttcgccacgatgtggaggaatatgcgaaacaattcccaacaattggattcgagaaggagaccatgaagtacaagaactaagaactgctatgtttcaacagcaaggtgtgccctgagaaacaaattatctctcccccagtccttaagaaacacgtacaataatatcgattcagttgtcatcaggagaaggaatccccttgactgtctcgtttgctccagtcctaggttgttt

SEQ ID NO: 1656 - DNA, 462 bp, Triticum aestivum
  Clone ID: LIB3280-012-P1-K1-F2
ggctgttgatcagttaactgtttatttgagagatgacaatgctattgagttgccctacagggtggggaatcgtgaaaaggcccctgttgataaagacagcgatggcgaggattcagtcactcctgccatgacaaaacttacctcataagaatctcagcactcaatgtctctcaagcccgaagaagcctgtggggttctgtatgttgaccttggcatgactgctgcagcgcagggagagcttgagcaggccaattacctggtgagccgtggttttgcaatgttgcccaacagccctagggcactgctagcatccatctatgtggatcttctgcaagggaaggtgctagaagctatcggcaagttgagaaggtgcataaacgtgagatttaagaccagttgtgtagcatccagcagataagacttagccttgtttgatgatttatctatagttgataatcgcca

SEQ ID NO: 1657 - DNA, 463 bp, Triticum aestivum
  Clone ID: LIB3280-012-P1-K1-F3
agctcgcaccaccagctacatacacataacagcaatcaaatctcttggatcaaccgagaagatggcctcctcctcgaggatgctcacggtggtggtgctggcggcgctgttcgccggcgcgatggccgtgaaagtgaagttgacggtgcagaaggggtccgacaaaaagaagttggcgctgaagatcgactacacaaggccaaacgacagcctgtcagaggtggagctccggcagcacggctcagaggagtggcagcccttgaccaagaagggcgacgtgtgggaggtctcgtgctccaagccgctggttggccccttcaacttccgcttcttgtccaagaatggcatgaagaacgtcttcgacgaggtcttctccaccgatttcaagatcggcaaaacctaccaaccggaatattgatccacaccggccaagtttcagttgatcaaaatcgtcgtaattaat

SEQ ID NO: 1658 - DNA, 347 bp, Triticum aestivum
  Clone ID: LIB3280-012-P1-K1-F4
accacgcgtccgcacacgcatacacataggacctatagggtctagttaacccaacaaccggacaggctcatgatcgacgtaccaaacagctatcatcatacatgcgctgtctgtccctcctactgctggccagagccaccctcctcgccgtcaaggtggcagtagtagcgcagccgggccctaaatgccccaagcggagtgcgtggcaagaatgggcgccaggccgagagtgccccaagcggctgcggcgactggaatgggctccccaacacaagtgcccaaagcgacggctgctgctggaatgggctccgggacgcaagtaccctaagctgctgtggcaggagtgc

SEQ ID NO: 1659 - DNA, 442 bp, Triticum aestivum
  Clone ID: LIB3280-012-P1-K1-F5
accactcgtacacaacctaaaacacacaattactattacttatctctgcacacccaacaagaaaaactttatatataaatcctaactatatttttcatctatcacatgctttcaagcactattcccattcaaaaatataattccatcttactatacttccataattaatattttttatcttaaaaaggtctaatttttgctcaattctcactattatataaaatctattaatctacttaaacccttcaaacttataaaaactttcaaaaataataatctatagtaagttctcatacttcaaacctttagtcacccacggcacaaaaacatttactaaaacaggggcttttattcattgctccacttcaataaattcactaattcaaaaatgaaattatctattacttttaataaaatccaaaaatttttttttactttaaaa

SEQ ID NO: 1660 - DNA, 466 bp, Triticum aestivum
  Clone ID: LIB3280-012-P1-K1-F6
atcgactgctacaccgaggcgatagcgctgtgccccggcgtcgcggtctactgggtgaaccggggcctctgccacttccgccgcaaggactgggccagggtcgaggaggacagcaggagggcgctcgcgctcgacgacgcctccgtcaaggggcactatctgctagggtgcgcgctgctcgagaaggaggactgcgctctcgccgtcaaggagttcgagaaggctttggatctcttgaagtcttcaaattcaagggacaaaatggcggaggacatttggcaggttcttgccaaggccaagtaccaagactgggaaaagcactccactcagcgggtttggaagatgcaaagtttaagggaagcttgtgaaaatgctctgcaggagcatcactttcttagcggtactctttcagaagactctgaggggacaaccaatgagtatccagagcaatgcaaattgttatccg

SEQ ID NO: 1661 - DNA, 432 bp, Triticum aestivum
  Clone ID: LIB3280-012-P1-K1-F7
atcgcctgctacaccgaggcgattgcgctgtgccccggcgtcacggtctactgggggaagagggtcctctgccacttcctcctcaaggactggaccatggtcgaggaggacagcaagagggcgctcgcactcgacaacgcctccatcaaggggcactatctgctaatggacgcgctgctcgagaaggaggactgcgctctcaccgtcaaagagttcgaaaaggctttggatctgttgaagtcttcaaattcaaaggacataatggcggaggacatttggctagttcttgccaaggccaagttccaagactgggaaaagcactccactcagcggtttcggaagatgctaagtttcagggaagcttgtgaaaatgctctgcatgagcatcactttcttagcggcactctctcataatactttgatgggacaacc

SEQ ID NO: 1662 - DNA, 353 bp, Triticum aestivum
  Clone ID: LIB3280-012-P1-K1-F8
gctggcaacttgaggattttgagtagtgatatttgatacagtaaagatacaaggttatctcagtgacctcctttgataagtgccctatttgtgtgattgcatgtttgcaatcgggacctcaaggagtagtgctagttgggaagaacgataatgtctccatgttgtgaactgtatggatacttgtgcttatgctaaccaggctggctgagtacaacgaacgcctgacagaatcatgtcgggacaaccctggcgtccgcgatgatcgggctccgcaccacgtgatcttcagacacccagcgtaggctcccctctgccagctgcccggcgtcggcgtcgcctcccctgctgctcac

SEQ ID NO: 1663 - DNA, 334 bp, Triticum aestivum
  Clone ID: LIB3280-012-P1-K1-F9
ggagaaaagagagggaaggaattatgcaccctgtctgatctgatctactacagcttttccatggcggctctgatttcatgatccggcggcgacccgtttcacgcgaagaagacctgcacggtgccggtgacggggcagcggcacgtggggcaggccgcggcggcggcgagggaggccgaggcgccggggtcgcacgcgtcgcacacgcagaggtgcctgcacgggagcagcacggtggtggccggccggagccggcacccgcggcacggcctagccggtggcggggccaccacctccaccaccctgtcagggtcgatgaacccggactcggtgt

SEQ ID NO: 1664 - DNA, 438 bp, Triticum aestivum
  Clone ID: LIB3280-012-P1-K1-G1
gcgaactttaagaaccagcctaataatggagctgatgttctttcggcccagtctctctgtgatctgtacaaagaattcgtcaaggatttccctattgtatcaattgaggatccttttgatcaagatgattggagctcatgggcttcgttgcaatcctcggttgatatccaaattgtcggcgatgatttgcttgtcacaaacccaaaacgtatagtagaggctattgacaagaaggcctgcaacgctctgttacttaaggttaatcagatcggtacggtcacggaatctattcaagctgctctggattcaaaggctgctggttggggcgtgatggtcagccacaggagtggtgaaacagaagacaatttcatcgcggatctagctgttggtttagcgagcgggcagatcaaaactggagctccgtgcagaagcgagaga

SEQ ID NO: 1665 - DNA, 124 bp, Triticum aestivum
  Clone ID: LIB3280-012-P1-K1-G10
ccaatcttacctactcttaaagaaagactttatatctcttctatccttccacctatattcaatttactgacccttaattttacaacgtctatactaccaaaactcctatcaaacccaacttaat

SEQ ID NO: 1666 - DNA, 392 bp, Triticum aestivum
  Clone ID: LIB3280-012-P1-K1-G11
acttacatcaaacattatttgttgaaataagacttcaccaaagattctaacttattctattctgatactaaaccttccctaaaaagttaaatctacactatcatgatccaaactaaaagacattagttccacattgcaatcctacagcaacatccaaactcatattgtaaatctttccctccatttcaaataatatatctaaacattctcccaacaattacattctttaattaaaccattaaattcatcaactaataactactttttttcaacaataagatgtcctctctaaaacaaattatttctccaccattccttaaaaaacacatacaataatatcgatttaattttcatcattacaaagaatccctttaactctcttatttagctcc

SEQ ID NO: 1667 - DNA, 325 bp, Triticum aestivum
  Clone ID: LIB3280-012-P1-K1-G2
tccgcgaactttaagaaccagcctaataatggagcgggtgggctttctgcccagtctctctgtgatctgtacaaagaattcgtcaaggatttccctattgtatcaattgaggatccttttgatcaacatgattggagcttatgggcttcgttgcaatccttggttgatatccaaattgtcggccatgatttgcttgtcacaaacccaaaacgtatagtagaggctattgacaagaaggcctgcaacgctcttttacttaaggctaatcatatcggttccggcacggaatctattcaagctgttctggattcaaatgctgctgttt

SEQ ID NO: 1668 - DNA, 466 bp, Triticum aestivum
  Clone ID: LIB3280-012-P1-K1-G3
acgcttccacctccccctccacgaggcaaggaaggaaaccctaggcaacgaccatggcgctgctcccgcgcacggcccggctggccctcctctccgcgtcgccgcggacgtactccgccgccgccgccgcgggcgcctccccgaccccaccggcgccctacgcgggcgtgcctccgccggcggcggggtccaaggcggccgagttcgtcgtctccaaggtggacgacctcatgaactgggcgcgaaggggctcgatctggcccatgaccttcgggctcgcctgctgcgccgtcgagatgatgcacgctggcgccgcccgctacgacttcgaccgattcggcgtcatcttccgcccgtccccgcgccagtccgactgcatgattgtcgccggcacgctcaccaacaagatggcgcccgccctccgcaaggtttatgatcagatgcccgagccacgttgggtcatttc

SEQ ID NO: 1669 - DNA, 468 bp, Triticum aestivum
  Clone ID: LIB3280-012-P1-K1-G4
agaactcgatgactgccgtgagttaactgaagctgttactgatgctgacagcagcagcagccactgcgagagagagaagcccgaggaagatggggacaacgatgacatgcttggaggggttttcgccttcagtgaagaaggttgaacttactatactgctttacttgggatagataatggtaaacagttgccacaacaatcagtgtgcaatattatgtagaaaatggtggaattctagtaggcttccgtggaataaagtcgtgccgcgtcgataatctaatgtttggtacatacttggaaggtgtagcttgcgctccatgtttatttgccagaagagctctggagtttgagtcgaagacccctcctggcaatttactaatccacggaaggaagggagtttggtgtttgtcgagaagctgccactgcctgccgcgacacttggcccaccctttttctgtttgctttgta

SEQ ID NO: 1670 - DNA, 418 bp, Triticum aestivum
  Clone ID: LIB3280-012-P1-K1-G5
cccacgcgtccgcaacctaggacacgagagttgccaacgtacaccgttgcgaaatcaggggggatctctggattgtctctgctgactgtattctggtttaacaacagaatgcgttggcatccatgaactccaggttccatggtgaaacctatacgctctttatatagccaagaatcggtcgctcggacaaaccaatcaagtgctcatagaacaacttaccaacactccggtgacacatctcataaggcagtatcatcccctattgccatatatcaaccaatgtcaatgcctggcatgccaaacgggttcacatgagccaaccttctagcatatcataggccgtttgcttagacccaggcggctgcaggtcacatagctgaccacaacggactggctggccaggtatacgggtggatac

SEQ ID NO: 1671 - DNA, 464 bp, Triticum aestivum
  Clone ID: LIB3280-012-P1-K1-G6
ggccgagttgcagctcgtgacggtcggtggcgatggagaagctgctgctcttggcggtggcgtctcacgatcacgagacggtcctggggcggtgcccgttcctcctaccgcacggcgccacccgtgcccgtgtcgctgcaccgtcatcagacctctcgggcggccgtgacgaggtccgtcggaccgtgctccgcgccggcaaggtgttcggcttctttcaggtggtcaaccaccgtagtgccggagcggaccatgcgtgaactggggacggcgtgcggagagttcttccgccttcccgcggcggacaaggcggccttgtactcggagtcggaggacacggagcgaaccaaccggctcttctccagtaccatgtgcgtgtccggcggccagacctactggcgccactgtctccgcctcgcctgccaccccgtggagagcaccaagcccggctggcccgagaagcc

SEQ ID NO: 1672 - DNA, 340 bp, Triticum aestivum
  Clone ID: LIB3280-012-P1-K1-G7
agcacatattcacaaccctgcacactaggttatataactgtcctacttacagtgagggagagagttcctacaaatgagaaccatcttatcaatatcctcaactcacaaatgaatccaattgcttccacacatacaacactcaatttcagccaccttctacggagaagagtttgagagcttactgtggttgctaaggctcaggcacccgatgacctacttgtgcaaaacccaccaccattgtcgttggctctcgcacaacaagactggcgacgctttgcaccttacaagcaaggctcatcctacgggcacttaatgatttcaacctattaataattcaaat

SEQ ID NO: 1673 - DNA, 413 bp, Triticum aestivum
  Clone ID: LIB3280-012-P1-K1-G8
tccaaagcctgcgtcttgcggcggcggcgaggagacggagcccaggccggaggaggccccggaccccgattccgcgcgcagtcggcccggcgagagaggcggcagagctactatgcctggagcagatgaggcgtttccggcagagtcgaggacgacggtgttctttggggctgtgacatctaagtctgagccgctgacctttgaagagtccctcagatttgtcaagaaagtgaaggctcgcaactacatgctgtacctgtcgctgttcgacatcctcggcaggacggagctgtcccagctggaggcctaccaaacactgcagctgctgttccgcgaccacccggacctgcacgaggggctggagaagttcaagcccccgatgcccacgaagcacgccgcggcgaacagcaacc

SEQ ID NO: 1674 - DNA, 355 bp, Triticum aestivum
  Clone ID: LIB3280-012-P1-K1-G9
aaaaaaaaaaaaaaaataaaaaaaaaattttaaaaaaaaaaaaaaaaaaacataaaaggggggattattaaaaattaaatcacacaacttcactcaatggccgcccttttttctacttccccccttccttacgcgttctttcccagccttacttcttctatccgtccccttaatttcaattacctgccctcctttttccatcttcttgtctgagaaaaccatttctttccccaacttaattgtctttcattactttctttttttgtcagttggtttaatacttaattggccttatccattcctccctttcaaacaattattcactttttttggtgattcgttccctccctttttt

SEQ ID NO: 1675 - DNA, 265 bp, Triticum aestivum
  Clone ID: LIB3280-012-P1-K1-H1
cggacgcgtgggcgcagccgcctctctcccgaccaaaagccctagctagctagacccacggcatagcgatgagcgaccatccccaccaccggctccgcctccctcctccggggctccgccagcctccatagggacgggaggtcaaccaggccgtcgtctagcggccaggccgttgacggggcgacacgcgcgctcgttgacggtcgtgcgcgcctccgtcaaggacatcggcttcgaccaggcgtcttagcttcgcccttcacgc

SEQ ID NO: 1676 - DNA, 62 bp, Triticum aestivum
  Clone ID: LIB3280-012-P1-K1-H11
ctagtctagatgcgggcggtccctcgtcatctctctcttatagtgtcacctaaaggcagggg

SEQ ID NO: 1677 - DNA, 368 bp, Triticum aestivum
  Clone ID: LIB3280-012-P1-K1-H12
agtgcgtccacgcgttcgcccacgcgtgcgcttggcaagggtggacatgagctgagcaagagcactggaaacgctggtgcacgtgttgcttgcggaatcatcgggctccagggctaagatgtcatcttcgccgaccaacgtcgcacagatatgggaaccttttcagaatgcagatttgcaatctctattctaaataagcacatgatctttgatcacttgttagtgtgcaccagtcgtgtcaattcctatgtgttactctgaactttatcgctgtcatttggctatcgagatgtgtgactggaacagttctgtcaagtgcttggggatctgttgttcgctactagctctagacgtgtttacagaaaacg

SEQ ID NO: 1678 - DNA, 401 bp, Triticum aestivum
  Clone ID: LIB3280-012-P1-K1-H2
tttctgcggccaacatggggcgtatgtattgcaaagtaccatttataaaaagcatgaaagagtgctctaggaacataactagtgttgcttggaactgtggaaatttaaaacgggagtaaatatattgtcgcctagatggggatgcatgtttgtgtgatatacataccgaattctcaacagtttgttgatgattcagtgatctaatacacaattacaatacaaattctcacccaagagggaacaaaaaccaagttatgaacatatcaaataatactccggcagctggttattccgcgggcgggtggtactccagtagctgattcagatgattgataacctggcgaagcacgaaccacgatgatggatcctcgacccctagtgccaggatggcgcacctgcat

SEQ ID NO: 1679 - DNA, 471 bp, Triticum aestivum
  Clone ID: LIB3280-012-P1-K1-H4
aaaataaggagaatgagttagtgcagagcagtcgaaatgagtacctcaaactgaaagcacgagtggagaatttgcagagaacccaacgaaatttgcttggtgaagatctcgggtcactcggcatcaaagatctggagcagctcgaaaagcaacttgattcatccttaaggcacataagatccacaaggacacagcatatgcttgaccagctcactgatctccaaaggaaggaacaaatgctgtgtgaagcaaataggtgccttcgaagaaaactggaggagagcagccagcagatgcagggccaaatgtgggagcagcacgccgccaacttgctcggctacgaccaactgcgacagtccccgcatcagcagcaggccacacaccacggcggcaacggcttctttcaccccctggaccctaccactgagcccacacttcagatagggtatactcaggagcagataaacaacg

SEQ ID NO: 1680 - DNA, 148 bp, Triticum aestivum
  Clone ID: LIB3280-012-P1-K1-H6
agcgcatattacaaatgctgcaaattggtaaaagtagtgtccaacctactgtgagggacaaagttcctcgatatgagaaacatattatcagtatcttgaactcacaaaggaagccagtgcaccacaatacaacacaattcagcactca

SEQ ID NO: 1681 - DNA, 287 bp, Triticum aestivum
  Clone ID: LIB3280-012-P1-K1-H7
cccaaccaaaccgagaccgtaaccaagacagcgagccaagatctgcagagtcacaggcgaccacacaccggcgaccatggccgtggacctcatgggctgctacacccctcgccgcgccgacgaccagctcgccatccaggaggccgccaccggcggcctccgcagcctggagctcctggtctcctccctctccggcgcggcgccgtccaaggcgccgcagcagcaccagcaacagccgttcggcgagatcgccgaccaggcgcgtctgcaagttccgcaaggtgatc

SEQ ID NO: 1682 - DNA, 442 bp, Triticum aestivum
  Clone ID: LIB3280-012-P1-K1-H8
cggacgcgtggggctgacgttcgacaacgccgggatgtggaacttgaggtccaatctgagggagaggtactacctgggcgagcagctatacgtgagctgcacctcgccggccaggtcgctcagggacgagtacaacatgcccgacaacgccctccgctgcggcaaggtcgtcggcatgccgctgccgccgccctacaccatcgcataaaccactctcccccagctccattaattccactccactccactccatgagagcacgcttgcatggtgctgtacacactacgtacgtacaacgacaacaacaggaagagcaggagagttttttcgtttcttcttttttttcgtacgcccccacgtcagctgttcttcttgtcaggttcactctctcttttcgaggaaaataaaacaacaacaaaaaaggggggccttatcgtcatgt

SEQ ID NO: 1683 - DNA, 453 bp, Triticum aestivum
  Clone ID: LIB3280-012-P1-K1-H9
cagcagaaaaaaggaaaaagcagaggacccagctcccctgcccccttcctccgccaacggggcaagaagcataggagggcaagccggcggagcagagcagaacatagggacaggggagatggcggcaccgcgcccacagccgctgctgctcctgctcctcgtcgcgctgctggctgcctccgcgccccgccgcgccgacgcctggggcaaggagggccacatcatggtctgcaagatcgtcgagaggtacctgtcagaggaggcggcggtggcggtgcacgacctgctgccggagtcggccggcggggagctgtcgacgatgtgcccgtgggcggacaccatgcgcttccgctaccactgggccaggccgctccactacgccaacacctctaacgtctagaacttcaacttctcccgggattgccacaactcttggggggagcaggggatgtg

SEQ ID NO: 1684 - DNA, 281 bp, Triticum aestivum
  Clone ID: LIB3280-014-P1-K1-A1
aatataaagaatttttttatttttttttttatttattaaacccaacaaaattcttaaaaaaaacccaaaaaaaaaaaaattttcaataaaaaaaaccagaactaaattaaaaaatatttttaaaaacaaaaaaataaaaattttcaaaaaaaaaaaaaacttcccttaacttgcaacccaaaaaaaaaaatttttaaaaaaaatctcaaacctttacttatattcatcaaaaaaaataaacaaaaccccctttaccaaaaaatttaaaattttaccaaaaa

SEQ ID NO: 1685 - DNA, 338 bp, Triticum aestivum
  Clone ID: LIB3280-014-P1-K1-A10
gggtgggggccaaatgtgggcaaccaaattttcatttcttccttgacagggaataacaattcaaccggaaaggaactacattacacttagcagttcaaactacaagaacgcccattacaagatgacacgaggcgtttaaagcaaaacaatgcaacaccccattgaccaacccatttaatccaagtccatacaaacacatgacatggccgcaggccaacacatccttattgctcttcttcttcatgatcttcttcttcttcattaaccttcaggcgccgagctttaattaacaacagcccttaacagcctctccaaatcccaattcggagagcttgagg

SEQ ID NO: 1686 - DNA, 382 bp, Triticum aestivum
  Clone ID: LIB3280-014-P1-K1-A11
ctccacccagatctgacgacggccgccgcgcacgagagaggcagcgaaaacccgaccggaagcggcctccccggcggatcgcgatgggcgtggagtgccggtacgaggtcgcgcaggcggcgtacgtgaagctcgcgctgcacgcgctcaagcacccggcggcggccgtcaacgggctcctcgtcggccgcctggcggacccggccgcctccccggccgtcgtctcggtcgccgacgccgtgccgctctcccaccagccgcaccacctcccgctgctcccaacgctcgagctcgcgctaaccctcgtcgaggaccacttccaggcgcagggcctcgccgtcgtcggttactacaacgccaacgcgcgcggggacgacgccga

SEQ ID NO: 1687 - DNA, 156 bp, Triticum aestivum
  Clone ID: LIB3280-014-P1-K1-A12
ctccacccatatcttactacctccgccttgctctatagaggcagctaaaaccctagcggagtcgttcttcccggcggatcgcgattgtcgtttatttccattactaggtcacgcaggctgcatacgtgaagctcgcgcttcacgctctcaatcacc

SEQ ID NO: 1688 - DNA, 423 bp, Triticum aestivum
  Clone ID: LIB3280-014-P1-K1-A2
ctcgactcaaaaaatggttctctgcaacataatgctgcgtttgctctttatggagttgccgacaatgaggattatgtctctgacttcgttaaagtaggaggtgtccaaaagttgcaggatggcgaatttattgtccaggctacaaaggactgtgtagctaagacattgaagaggctggaggagaagataaatggacgagtattaaaacacttggtttatctcatgagagtaggagaaaagtctgtgcagaggcgtgttgctctggctcttgcacacctctgtgcccctgaagatcagcgaacaatttttattgataataatggtctcgacttgcttcttgatcttctggtttcgggcagctcgaaacatcaacaggatggttcggtagcactatacatattagccaacaaagctgcagcactc

SEQ ID NO: 1689 - DNA, 387 bp, Triticum aestivum
  Clone ID: LIB3280-014-P1-K1-A3
catcagtggtcctcgcaggcctcttggcggccctgaagatgatcggtggaggccttgtggatcagacctacctcttccttggtgctggagaggctggaactggcattgcagagctcattgctcttgagatgtcgaaacacactgaactcccggtggacgactgccgcaagaagatctggctggtggactccaagggtctgcttgttgagtccagaaaagagtctctgcagcacttcaagaagccgttcgctcatgagcacgaagaactgaagaccctgctggaggccgtccagtccatcaagccaaccgtgctgatcggaacctccggcgtcgggaagaccttcacccaagaagtgatcgaggccatggcctccttcaacgagaaac

SEQ ID NO: 1690 - DNA, 251 bp, Triticum aestivum
  Clone ID: LIB3280-014-P1-K1-A4
ctttattactcctcccaaccctctcaccataccttaatacaaccattgtaaacattctggaggagaacctaactctcactatgtcctcccacaactagaactagcattaaacacctcattgctcttaatatgtctaatcacacctaactcccgatcgtctactgcactataaatatctttcttatgtactccaaacatcttataaaacatttcagatatcaatatctgcaccactctaaaatacctctctc

SEQ ID NO: 1691 - DNA, 344 bp, Triticum aestivum
  Clone ID: LIB3280-014-P1-K1-A5
ctctcttactcctcctgacctgtccaccgtagccgccgccagccatcggaaagagccgtgaggctcactaacgcccatgaagggctcccactcgcagtcccaggcggcaagccgtcggcggcgctgtgggtggctgctcccgcttctcgttggtgctgcttttgtcggcgagatcgcgttcctcggtcgcctcgacatgtcgaagaacgttgcggcggtcgagagctggaccacctccttctaccgcctctcttcgacctggggcgcggacgcacctccgggtagcggggacgacggcgacgactgcgaggagcggctcgagagggaggacgccgtgccctacg

SEQ ID NO: 1692 - DNA, 386 bp, Triticum aestivum
  Clone ID: LIB3280-014-P1-K1-A6
gaaagactgatcaatagtaaccacaccaaatttcaggttcgcacaatgccttgtgaattaagaagcaggtcattgcctcctttatgcagattatatgccctataagctatataaccaaataaaatgtactgcttagaagacggtagaaatgaaatgggtttctgaaacattggcactgctagaactaggttgctaattttattccacgcggtttcgaaatttcctgtgcaaccaaaatgaccgtcttgaaccgtgccgcgcaaaacagcaagttcagtcaaattccaaaggtggatgttgtataaaatccagtgaatgatcgttgggagaaactgatgggccttgagctgcgctctgtagtagagcatcaaggaatttgatgaggc

SEQ ID NO: 1693 - DNA, 169 bp, Triticum aestivum
  Clone ID: LIB3280-014-P1-K1-A8
gtccccctctctcgctcgcatcacaacaaacgcgctctcgcccagcttccggaacgctcggcccgtccccgtcgccaccggcatggcctccgccgtctccctcgccgccttctctcgcccttgcgcttgccgcactgcctgcgcggggcgggccacacctcgcgcggcg

SEQ ID NO: 1694 - DNA, 456 bp, Triticum aestivum
  unsure (1)...(456): unsure at all n locations
  Clone ID: LIB3280-014-P1-K1-A9
gccaagcggcacttcgcttccttcatcttcccggccggtgcggtgcgtacggcgcagccggatctcacggcgaggccgagctaaccgcctccgaggatccgcacaaacccccaaccaccgtacgcaccgcagcagcggcggcggaggggcatggagagctcgtcgccttcggtgccgttcccgctgctgcaggcgccagtggagagcacgtaccgtgcctgcaccataccctaccgcttcccctccgacaacccccgcaaggccacccccgtcgagatccagtggatcgacctcttcctgaagtccgtgccatccttcaggcagcgggcggagaatgaccccacggtgccggatgcccccgccaaggccgagaagtttgctcagaggtacactgatatgctngaggagttgaagaagaacccagagagccatggaggacctcctgatggcatactt

SEQ ID NO: 1695 - DNA, 200 bp, Triticum aestivum
  Clone ID: LIB3280-014-P1-K1-B10
atcgaatcgatcgctcttatcgcctcgaacgtatcgaagcccaggagaggagagcggagcagccgacgagccgccgatcgacatgggtctcaaggaggagtttgaggagcacgcggagaatgccaagacgctgcccgacaccaccaccaacgagagcaagctctgcctctacggcctctacaagcaagccaccgtcggcc

SEQ ID NO: 1696 - DNA, 386 bp, Triticum aestivum
  Clone ID: LIB3280-014-P1-K1-B11
aagaaagagaatgctgaccggggtgctttctgctttgatgtccacaatcggagactcaactgcatcccgcgccacactgatcagttcaggtccatttacctccccattggcgacaagctctttgcattgggaacttctctttggaaatccttgacctgcagccgctggtgggcctaagcagccagttggatgcctcatcgtggcacaagctcaaagatgtgcccattgactctatgtctgtgatctcccacgctgtcctccctgacagtcgaaccatatttgtcagcagcgatatagctacccacaccacccacagccttaacatgggagacgacggaagcttcaagtggacaaacaatggtgagtggttactgccgtttgatggc

SEQ ID NO: 1697 - DNA, 310 bp, Triticum aestivum
  Clone ID: LIB3280-014-P1-K1-B12
gctcttttgttcatattgtcaaaaaggaaaaatacatacaaaaccaacgtcttccaggttgattaatacatgtcccttgtttccacgcaaaaagaaaatgctactagtatggtaccctttgcaaatcttgaccatgcattgcaccatcttatgatacaccgatttaccatgcttacactaacataaggaggaactttaggacaactctcgaagaaattcataatgtagattgtatccgctatcaagttggctgcattgatttacatctggaatcagagggatgtcgcagctggcaaaaattcaattgctg

SEQ ID NO: 1698 - DNA, 179 bp, Triticum aestivum
  Clone ID: LIB3280-014-P1-K1-B2
ttctcccacacttcccattactcacaatatattctcttcatcatacttctttcttcctctttatctaattaccgacaagtttattatatctcttactctcccaaaattcaatttattcaaaactatcattaaaactaatttatactccatactacaaattactatttaatctaacacat

SEQ ID NO: 1699 - DNA, 355 bp, Triticum aestivum
  Clone ID: LIB3280-014-P1-K1-B4
ggggagcgggcggggaggccgttgcgtttcccgctatttcctccttgcccaccgctccctgatacgtgctccgcggcggctgcgtcgccttccccccgccgccggcgccgacccctccacgcgccgcgccggcgccttcgtgcaggccggcggcgcctcgccctcctccgcgcccggccagaacaagccgccggccgccatcggccccgtgctcggccgccccatggaggacgtgcgcatcatctacaccgtcggcaaggagctcggccgaggccagttcggggtcaccagcctctgcacgcacaatgccacgggccagaagttcgcctgcaagaccatcgccaagcgcaagctg

SEQ ID NO: 1700 - DNA, 456 bp, Triticum aestivum
  Clone ID: LIB3280-014-P1-K1-B6
ggttcccagggagtctctcttgtttataattccggcatttggaggaactgtttcgtgggaaggagaaggagctccatttgatgaaacagatcaagatatcacccatcagattgttgacaggccaacccagagccatgttttcctctccaggcattatgttcaaccacaatggatttttgattgcgtaaacattctcaaagtaattcccacagatgactatattgttggaagggtgcctccaccacatatatctccttttgtggacaacgataaagagggtcatatacctgactatgcagtgaccttggagggatataaatctgctggtcaaaaccaagttatgcctctgccaggtttaggtgatgaagatctgggcaattcgatagtagaggcaaaatctgagcataatgaatttgctaaaaagaagaaggagttggagatgcaagagaagaaata

SEQ ID NO: 1701 - DNA, 405 bp, Triticum aestivum
  Clone ID: LIB3280-014-P1-K1-B7
ccagccattgctattctaagctcagggtagctgctggcagtgtgggcagtgacccactaggtagtttctacaggcaaaagttgcatcgtgctaatgtgcaattcttgtccaagccggttaaagatgggactactgggactgtgattgttctaacaactccagatgcacaacgaactatgcttgcataccagggtacatcttcaactttggcttacgattcagacttggctgagatagtatccaagtcaaatctactgatagtggaagggtacctattcgagtttagtcatacaattgaagccatcaaacaggcatgtgaagatgctaagaagaatggtgcacttattgctgtttcagcatcagatgtgtcatgcattaagcgttgccacagtgatttttgggata

SEQ ID NO: 1702 - DNA, 199 bp, Triticum aestivum
  Clone ID: LIB3280-014-P1-K1-B8
ctactcttattctccttttttttccttctctcttttccttcttttctctgttctcttttttcttctccttttttcctttctcgttctttctttctttctttcttccttttcttttttttctttttttttccttttccttcttctttcttcattttcttttttttacttttttttcttttttctttttttcttttttttt

SEQ ID NO: 1703 - DNA, 183 bp, Triticum aestivum
  Clone ID: LIB3280-014-P1-K1-B9
cataatacccgtcccgacccacacttcctcttaccctactaccttaaccactacatttatacttccactctacttactaaatccaaagaaattttatcccccatactccccaaatcaaaccattcctcatcaatcaaataaatcacaacccaaaccacatccaacaacctcaactcaaccaat

SEQ ID NO: 1704 - DNA, 240 bp, Triticum aestivum
  Clone ID: LIB3280-014-P1-K1-C1
ctcatcgcactctcctctcctgcccccggcacttccagaaccgggatcgatcgtagctcgtgttccctctccttttcgcggcgatggcggtggatctgaccccgaggcagccggcgaaggcgtacggcggcgagggcggcgcctactacgagtggagcccagccgagctgcccatgctcggtgtcgcctccatcggcgcagccaagctctcgctcgcccgcggcggcatgtccctcccca

SEQ ID NO: 1705 - DNA, 439 bp, Triticum aestivum
  Clone ID: LIB3280-014-P1-K1-C10
cggacgcgtgggcggacgcgtgggcgcacttgcgcagcccatctctcttcctcccgtcaggcccctcctgcctactctctcgatccccactgtcgccgcctcgttcgccgaccgattccggccgctccggcgagctttggtgccacccaacacacacacagctgctcctggacgagctctactagcttcaccgcgtcgatctacttttcctcgcctcatgcggtcacccccatcgatttcccctgctagggtttcgatggtgggggtgggcctcgctccggcggccggctgctcgtttccccgatctctcgatccccattgatgcgtccctgcagaagagaagatgcggagggaggataggaggaggtaggcgccctggggtggggtggtcctcgccgcgacaatagggctggccggctggagttggatcgggatcccg

SEQ ID NO: 1706 - DNA, 427 bp, Triticum aestivum
  Clone ID: LIB3280-014-P1-K1-C11
gttgtttgtcatgtgagttggatctgtattatgttgggacatgaatgggtaaaaaacccgacaaatctgccatctgtctttaaacttatctataattgcttgttgttgatgacttgtttgcttgagcagtatttgtatggcagccatgtgcatccatcctcactttggatccagcattggctacctcttgctctcgagcaatcgagctgtacattttcggttacttgctgctgaggtgcaacaactgtgatttcctggtatggtttgctgttcttgttggctgtacgagggcaagttttgctacttgatttttcaaccggtaccatttgtaatattcattggcggtgcatttgccgagttacaaatgtgtcggtgacccgtttttactctgagaatttcacaacatatatcaaaaccatctgctagt

SEQ ID NO: 1707 - DNA, 331 bp, Triticum aestivum
  Clone ID: LIB3280-014-P1-K1-C6
gggggataaaatcattttgtaaagcacataatagcaagctgtgttttttcactagtcatcacttgagcatacaagctcgcgtgcgtttagtggaacgggtcgagtgaaaccttttagtacaactgatttttttcattcatacctgagaggggcccggccggggtggaatgtctatgcaatatgcttgattgcccgtgaatgcattttttttgcatgcggggcgtttgcgttgatacatttttttgatgtcatacagattggggcttttttttgttcatcgctggccggatgggttgatccatggattgattggggtcacaccccctgggtg

SEQ ID NO: 1708 - DNA, 394 bp, Triticum aestivum
  Clone ID: LIB3280-014-P1-K1-C8
gaatggtagtcagagccgagtagtattattcttctcaaaatgtacaaagtttgctactactacttactcagaggccagcaatcggcatctcccttatgcccccacacaaacaaacaaaaagaaaacgaaatcttctaagcagcaccaagaaacaacaaaatcgtctaggaaacatcaaccaatcaaaactagaggaagaagaagaagaagaagaagaagaaaaaggaggaggaagaagatcgagcataaaaatggccggcgtagtatgtctatacgcacggctttgggtacatgtagccgacgtactttgccttggcgttctcgcacttggacgatgtggtgccggcgcccttgaacttgaggtcgaggtcctggagcacgacgccctggcacg

SEQ ID NO: 1709 - DNA, 441 bp, Triticum aestivum
  Clone ID: LIB3280-014-P1-K1-C9
cttacatcctggccttttcgatattgttaagaattgcacatatgttggagttgccgatgaagttttcgctttgatacaacacaataccctcttataccttgtcaatgtggtaaatgttagcaaagaactcatgtaccaacaagccttgtgccgttttgggaacttcaatgctatacagctcagtgaaccagctccgcttctggagttgctgacaatggcactgaaagatgacgagtcaatgagtgatgtaaatgagaaggagaaactagaaattgcagaagtgaacactgagatactgaaagaaaatgctgagatgattaatgagtacttctctattcacattgatcaaggtggcaaccttaccagacttcctgttgtacttgatcagtacacccctgatatggatcgccttccagagttcatgttgactctaggaaatga

SEQ ID NO: 1710 - DNA, 319 bp, Triticum aestivum
  Clone ID: LIB3280-014-P1-K1-D1
caactttgtcctctttagttagtttatttaacttggagggcaaagattggcttagttgtgtgtgtgtcttttcgggcgattgttacccagatagtactgtgccagcttagcttcttgtttatcctgggttaccatttaacgtgagtgccgaggagaccaactaaaagtttcatttggtcttcccatttggatattccatttcggggacattttcttggcaacaatcttccctggaaaaaatattctttgctcttaattggtttcctttggggtaatggtacctattggggggaggaaggccaatttttcattttcccac

SEQ ID NO: 1711 - DNA, 316 bp, Triticum aestivum
  Clone ID: LIB3280-014-P1-K1-D10
aaaacaaaaaaaaaaagttttgattgattcattctgaccccacctatccctactcataattattatttttttacctaccgtattggcccttttcttcccacaaggccccaaactcaacttgtttacaggcagaccataccaaaccccacaacatggaaaaaaataaaccccccccccaacgggagtcaccaaacaaaatccacagggggggagggcccccttcccgtgcgttttccaaactttttgccttgaaagaaaaaaaaaaacttcttcaccaaccaaccggtgttgtaccacggcctattaatcaaatcca

SEQ ID NO: 1712 - DNA, 448 bp, Triticum aestivum
  Clone ID: LIB3280-014-P1-K1-D11
cggacgcgtgggccagtgtcttctactgtcagttctaagcttacttcatagagtgccatagttaaaaccaaacacacgtattggagcacggactgcaggagcctaatcttcaagacatatagaaggcacacatatttgactgaagaataaggcatttgtctgattcagtactgacaggtgggacaggagcgctacggacgttagggtgccgtcgactgataggagcaaagccgtggctcaagacgtctccgcggtcctgatccgtggttcagaactgatgctttccgttaagttgcacaactaacgagtaatgccggtatgggtagatcggagcggctgtctcctacctaacgaacatggagctttcctttctgaagagcggtgatccggcggagcgaccatatctgaggaggcaacttcggcagcaggagaagatggagttcttgat

SEQ ID NO: 1713 - DNA, 299 bp, Triticum aestivum
  unsure (1)...(299): unsure at all n locations
  Clone ID: LIB3280-014-P1-K1-D12
cccacgcgtccgcaaagtctggggcttccatgaagtgtgccggctgccaaggtgctggttgcaaggtgcagataaggcagctgggaccaggaatgattcagcaaatgcagcagccttgcaacgagtgcaggggaagtggggagaccatcagcgataaggatcgctgcgggcagtgcaaaagtgagaaggtggggcacgaaaagaaaagtccggaagggggttgtcgagaaagggaatgcaccatggaacagagatcanccttcccgggcgaagcggatgaagcgcctgataccggtact

SEQ ID NO: 1714 - DNA, 354 bp, Triticum aestivum
  Clone ID: LIB3280-014-P1-K1-D4
aagactttcaagtcccagctaataaaaccgtcatcaataatcccccgccaccccgccgatctcgagcgcaccaccgtccgtccgaaatggagatgaagaagatcgccttcgccgccctcctcgcggccgcctcggccaccgccgtcatggcctccgaggctgcccctgccaccagcgacgcctccgaggtggcaatcgccccggccgccctcgtcgcctccctcgtcgcatatttcctctactgaagcagcggacagtaggggaggagttaattactagcattcattggccgcttgtgtgtatacatgcgaatgatgcggtgtaatttttatggttttcgtcttgatgagcacg

SEQ ID NO: 1715 - DNA, 189 bp, Triticum aestivum
  Clone ID: LIB3280-014-P1-K1-D5
gaaacgaaaaagaccaccaaccctccataaaaaattttaaaaattacccaaaaaattctccaattcacaactgaaatccactaaaaattctctaaaggttttacaaaacctttttctatccctacttaatccaaaaatcccgacttttccatgaacctgatacctggtaccccaacctttgctttccct

SEQ ID NO: 1716 - DNA, 466 bp, Triticum aestivum
  unsure (1)...(466): unsure at all n locations
  Clone ID: LIB3280-014-P1-K1-D8
tcagacatnnntgatcatantnatgtcacttgagacagggagagcttnngctgagagttttctttcaaacctgnntggtcannagtaggtagattaggccagtattctgnntggtagatccaaaaccctcagtganntgcgttttgctttttatttcgagttcgcccganntgatgtcggtgcaaagagcatgctctaanctcttggtggaacccattcttggtttttatcctgtcagagttctgccatctaagactgcaattttgcctgtgaaccccaaatttcttcctcgaacagaggacgagaaagaaatggtatccaggactgtgtactgtactaacattgacaaaaatgttccagaggatgttgtgaagaatttctttgagggaatttgtggagaggttgctcgactgaggctgcttggtgattacgtgcatgccacgtgcattgcctttgttgagtttgt

SEQ ID NO: 1717 - DNA, 448 bp, Triticum aestivum
  unsure (1)...(448): unsure at all n locations
  Clone ID: LIB3280-014-P1-K1-D9
gtgggctctcagtacttggatttacggcgatggcgagggataatggcgacgggctggcggcgattgccgggcggatcggcgtgctcgggtccgtcgtgctgaacatcgtggcgctggcgatctacctccgtggccgcgccgccgccgagaagcaggccagcaagaaggtgaagaaggcggcggctgtggcgccgtcgtctggcaagcctcccgtcgcgtgtgactcggtcatcaatttggaccacggtgatccaacgatgtttgagacgttttggcgcggaccgattggcgaaagcgctacgctggtgattccagggtatcagacgatgagttacttctctgacgtcggcaacctttgctggttcctcgagccaggcttcgagcgtgaggtgcgccgnctncaccgnctcgtcggcaatgccgccatcgagggctaccacgtcctcgt

SEQ ID NO: 1718 - DNA, 143 bp, Triticum aestivum
  Clone ID: LIB3280-014-P1-K1-E1
cttcctatcccccatccatacaattttttttaatacatacctactccatcctaaggaagatttcctataattctatccccaatcccaacaccactcctacctctatccatactatcataccccacaaatttactaaaccccac

SEQ ID NO: 1719 - DNA, 166 bp, Triticum aestivum
  unsure (1)...(166): unsure at all n locations
  Clone ID: LIB3280-014-P1-K1-E10
cccactcttacncaaagcctctttcttccattttttgtgccttcttccaatattctggtagcatttttcatataaagcatctttcaccataaatgattcatcaaatgcaacatcctttctactaatgcatactaagtgactataccatcatctattaggatctctc

SEQ ID NO: 1720 - DNA, 453 bp, Triticum aestivum
  Clone ID: LIB3280-014-P1-K1-E11
cggcgccgtgcacaagggtatgccgcacaagttctaccacggccgcaccggacgcgtgtggaacgtcaccaagcgcgccatcggcgttgagatcaacaagcaggttggaaaccgcattatcaggaaaaggatccatgtccgtgttgagcatgtgcagccatccaggtgtgctgaggagttccgcctgaggaaagtgaagaacgaccagctcaaggcggaagccaaggcgcgcggtgaggtcatcagcaccaagaggcagccgctcggccctaaacctgggttcatggtcgagggtaccacaattgagactgtcactcccattccctacgatgtggtcaatgatctcaagggtggttactagggtgtttgggttatctgcctgcacaaccagttcaaatctatggtgctcttatgagtaggatttgctctctgaactgtagtctgggttgggtc

SEQ ID NO: 1721 - DNA, 238 bp, Triticum aestivum
  Clone ID: LIB3280-014-P1-K1-E12
gtgacggccggtgctgtaagccacaccgaatggatgttattgttgctttttgtaatagagagtgcaccgaatatatgacagtcaaccgttgagttgggttgcttggttaccttccggcgttgagagttttgtttcttaggctggcaacgtgaacatcaagcgttgctgaatatgtgcctgcggctgctgttgtatgtagtagccacacattataattatatgggatgttccagtgtct

SEQ ID NO: 1722 - DNA, 451 bp, Triticum aestivum
  Clone ID: LIB3280-014-P1-K1-E2
ctcttgaatgttctcgtggatacccatccgatatagctgccaatcgaattgttaatgaagcaaccctacctcgaggactacgagatgatactacctgcatcgtggtggacatactacctccagaaaaactagctcctagtcctccaacaaagtggcagggaaaaaccgtgctcaataatatgttccgcgttgatctgaaaaataacatgttccgccgaaaaaattcagatgcatctttcaaaatagatagagaatatgctgagccggatgtggtggaagaaatatttgaggacgggtctgccatgctttcacgaaggcttagtacaggatacgcacttcggaacatgtttgaaccctccagctgtgcgatttgccagtttagactgaaatctggtcaggggatttccatacatgctaacccactgcaacaggaaaaaatgcaaggttggca

SEQ ID NO: 1723 - DNA, 409 bp, Triticum aestivum
  Clone ID: LIB3280-014-P1-K1-E3
aacctgaattactccggggttggccgataacattacccaacacgttgatatgtacaggataacaggggatgactgggacagctggaaagatgttcgccgcattttgatgttgccagatcatttccgatgcgaataagatcggcgccactggattgcaaggaaggtcttggcctgacttggacatgcttccgttcggcaggcttactgatgcatgtgttaaccagggccctcacagaagcactaaccttacatttgacaaacaattaacacagatgctactttggtcgatggccaaatcccccctgatgtttggaggtgacctgaagcatctcaacgatgatacattggatctaatcacccaccctactctactgaagattaatcaccacactaaaaacaacatggagtt

SEQ ID NO: 1724 - DNA, 273 bp, Triticum aestivum
  Clone ID: LIB3280-014-P1-K1-E4
aagaatgaatcaagtcttataatgactaggggaaaaacatggagtaattaacaggaaggaaaggaaaggaaaaaaaagcaatatcatggatgatcctagtagtatttcacttggctactaatcttttaattaacaacaatggcggctcccgcctctagccgcccgcccgtccgtccaccgccgcactccggcagggtcttcgtcttcttcgtcaacttcaacttcacgacccgttcacaaaacccaacccaaaaccaaaaaaccaacctcaac

SEQ ID NO: 1725 - DNA, 456 bp, Triticum aestivum
  Clone ID: LIB3280-014-P1-K1-E6
ggaacttatgacctcaagaaaattgtggaatatgcaaataacagagagttcacttcagtgatgggtgtccacacaaatcgacgggaacctgatgcgctgctgatcatcaacctacctgagggccctactgcacattttaagctatccaagctcgttctgcggaaggatataaagaaccatgggaaccctacaagtcataagccagagttggtgttgaacaattttactacgcgccttggtcatcgtgttgggaggatgatccaatctctcttccctcaagacccaaatttccgcggccgccgagttgtgaccttccacaatcagcgagactatatatttttccgtcatcacaggtacatctttgaggagaaagaaaagaaaatcgtttcgaaggacaagaaatcgaagggtgaaaccaaaactgagaagcaaataaactgtcgccttcaggaatgc

SEQ ID NO: 1726 - DNA, 79 bp, Triticum aestivum
  Clone ID: LIB3280-014-P1-K1-E7
taatactagtctggctatgttccaggactgagttttatgtaatgtgaggattatatgtgggtgtgactgaattttatgc

SEQ ID NO: 1727 - DNA, 458 bp, Triticum aestivum
  Clone ID: LIB3280-014-P1-K1-F1
cccacgcgtccgcccacgcgtccgcaagactgaagcatttttctgcaatgaacaagctcaagaagatggcattgagggttattgctgaaagcctatctgaggaagagattggaggtctaagggagctgttcaaaatgattgatgccgacaatagtggaactataacatttgatgagctgaaagatggcttgaaaagggtgggctcagagctaaccgaacatgaaatccaggctttaatggatgcggcggacatcgacaacagcggaacgattgattatggtgaattcatcgcagctacattgcacatgaataaactagagagggaggagaacttggtgtcagcattctcgttttttgacaaggatggaagtggattcatcaccatcgatgagctatcacatgcatgccgcaaatttggtctggatgatgttcaccttgaggatatgatcaaagatgtc

SEQ ID NO: 1728 - DNA, 260 bp, Triticum aestivum
  Clone ID: LIB3280-014-P1-K1-F10
aaaaaaaaatccaatttttttaatttccccaccaattaataaaattttttgaaaaaataatttttttttcccttaaaaaaaaaaatttttttctttaaaaaaaaaaattttttttataaaacttttttttttttttaaaaaagtgttttttttattatacaaaattttttatttttttggcatttgaaacaaatttaaaaatttttttctttaacccttttttttttaaaaattttatatttttttaaaccctttttttt

SEQ ID NO: 1729 - DNA, 58 bp, Triticum aestivum
  Clone ID: LIB3280-014-P1-K1-F11
aataatatctctttctctcaaccctcctatttttcatcatcatctacctccatccgga

SEQ ID NO: 1730 - DNA, 397 bp, Triticum aestivum
  Clone ID: LIB3280-014-P1-K1-F12
gagtaatgatatactgaaaatttcctttctttgttgttttcgaatatacatcgaggcactcaggttgtactcatatccacaacccattgaacaaatggagattgctatatggtggactacctacagattactaactttacaaaatccctcgcatcctctcaatttctaatcctatggaaatcattgtcattaggcaccttttgaccattatatccagaatcgaacggtttggggtatgccagagggtttaagaatctcctgagaagcgccaaatgctttatttcactccagttttcatcatgaccatcaaatcctgatcatgcagtcaacaatgccatgcctttggtgcctttgttgcacaaaggcagaggatatgcatccctcagttatgtatgct

SEQ ID NO: 1731 - DNA, 405 bp, Triticum aestivum
  Clone ID: LIB3280-014-P1-K1-F2
aagatgggtcacacatcgatataaagaagagaacggattacattattttggagcgcatattactcttattcatatacatctggtgcactccattcggaagcgcatatgcaaacctatttatgcttgctacataaaaagtagccacaaacacaaatctggtccaaagaagggaaaaagccaacacacacaattgtagagcattaagtcaactcaagagctccttcccgaaaagcccagcaatggctcgcccaggatcttcttccttgatcagggactctcctaccaaaacagcagaaactccagcactatgcacatatgcaacatcatcgggagtgaacaggccagattcaccaacaaccaatattcccttctcctttatgatatcaccgcgcttctccatcaaca

SEQ ID NO: 1732 - DNA, 432 bp, Triticum aestivum
  Clone ID: LIB3280-014-P1-K1-F3
atggaccgcgagtggggctccaagcccggcagcggcggcgccgccaccgcccagaatgaggccatcgaccggcgggagcgcctgcgccgcctcgcgctcgagaccatcgacctcgccaaggacccctacttcatgcgaaaccatctcggcagctatgagtgcaagctctgcctgacgctccacaacaacgaggggaactacctcgcgcacacgcaggggaagcggcaccagaccaacctcgccaagcgtgccgcccgcgaggccaaggacgcgcccgcgcagccccagccaaacaagcgcaagctcgcgccccgcatatctgttaagattggcagacctggatatacagtaactaaacagtatgatcccgacacgaagcaacactcatttctctttgagattgagtatcctgaaatcgaagataatagcaag

SEQ ID NO: 1733 - DNA, 460 bp, Triticum aestivum
  Clone ID: LIB3280-014-P1-K1-F4
gtgtctgtatctgcaatccgcagcttactttgggggaggaggagtgccacccatggattggtccttcgctggcagggccggggccgcgccggctgtcatgtccttcaggtcggctgcgagggaggagcagcagggcgagctcgcgtaccccaagcagcaggcctcccgcgtcctgacgccacagagatcgtttggtgctgagacccatggcagcgtgcagtacgccgccgccgcgcgtgcggcttacggtgtgcagccttcgcagcagcagcatgctcctaatggtgctagggtgattccaatgtcgtcgccgttcaatcccaacaatcccatgttcagggttcggagttcgcctaacctcccgaatggcggtgctgctggtagcccgtttaaacaaccgtcttttgccatgaacaatgcggtggctgcttctacccgtggtgtctataaatcaagggac

SEQ ID NO: 1734 - DNA, 375 bp, Triticum aestivum
  Clone ID: LIB3280-014-P1-K1-F6
ttttctggcgcggggcgcggtcacctcggtgaccatcgacatgggcttccttgtcgagtcccagtccgaggaggagctgcccgaaaagctcttcggcgcggtgcgcatcgcgcagatggagatgggttcggccaagtacgtggagacggcgtctgatgagcccgagaccgccggcaaggcagcgccggggttcagggttggctcggcgagggtggccaacgatagccgccaccaggaacgcaccatcggcaaggccagcaggtcgatgagctgccaagaacgcctgggcggaggaaaataggcgcggaacacgcgaggatggatgctgtataaaccatgagttggagaaaaacgattcttcagttggcgaaccgg

SEQ ID NO: 1735 - DNA, 412 bp, Triticum aestivum
  unsure (1)...(412): unsure at all n locations
  Clone ID: LIB3280-014-P1-K1-F7
tcgcccacgcgtnccgacctaattagctntggacttgtacaagaacaacgtttcggggactatacctccaacacttgggaagttgaagtcccttgtgttcttgcggctcaacggcaatcgtttgactggaccaattccaagggagctggccggaatatccagcctcaaagttgttgatgtttctggtaataatctgtgtggaacaattcccacgactggaccatttgagcacattcctctcagcaacttcgagaggaacccacgcttggaaggaccagaactacaaggcctggctgtatatgaaaccaactgctaaacggccacgggaaggtggaaaatgcttaggaagtaacgggcgtacaaggtttaccggagatcggggtgatatagattgttaggtccgaagtttgcc

SEQ ID NO: 1736 - DNA, 204 bp, Triticum aestivum
  Clone ID: LIB3280-014-P1-K1-G1
gtgtgtgatagcgtgagagtgcatatgaaatcgtatcttttcagcgtgtagaccattcatggcggtctcttctcagccatccgatggccccgtttggagctttgcttgttcctgtggaaaataagtcgattcttgtgaaattctcgtgttcgaaacgcgcccggatggctgggttacatcgagcctcgatctcctgttgtgttc

SEQ ID NO: 1737 - DNA, 446 bp, Triticum aestivum
  Clone ID: LIB3280-014-P1-K1-G10
cccacgcgttcgcccacgcgtccgcgctcctctcccccgccgccaccccttccccgcatcggctcccacgccaagaccgccgccgttcgtcaagatggtgctgcagaacgacatcgacctcctcaacccgccggcggagctcgagaagctcaagcacaagaagaagcgcctcgtgcagtcccccaactccttcttcatggatgtcaagtgccagggctgcttcaacataacgactgtgttcagccactctcagaccgtggtggtgtgccctggctgccagactgtgctctgccaacccaccggaggaaaggcgaggctcaccgagggatcctccttccgccggaagggcgactaagctgcacgcctgtgtatgggaaaaatgaagccccgctgaaccttacttttcaagtaactagttatccccgttgtgtcctggtcaatttttt

SEQ ID NO: 1738 - DNA, 262 bp, Triticum aestivum
  Clone ID: LIB3280-014-P1-K1-G11
cctaattctaaacccccaaaccaaaggaaattcactccaatccaatccccacagagaggcggatttcaaaaccctatcccatcccatcccatcaagattaccaacccaagtttgttcttctacatgaccgtcttctgttctccatccggactcatctacatagatctttacaatgacgcgttgccgttgatcttatatatctttctcgctctcttcacctacttaatggtcttctgcaagaacatcaagcctctgcactaca

SEQ ID NO: 1739 - DNA, 293 bp, Triticum aestivum
  Clone ID: LIB3280-014-P1-K1-G12
aaacatgaactttaacaacacactgattaaaatcttatttttactgctaaacacccttaaacttcattggccatttcttcaattcctcctgaaagcaccaaatttttttttttaaaaacaatgtgttttatactaaaaacattaagggcctttcccgggttgcttttaattttccccaccaccccttgggggccaaccaaaacaactttaaaatgggttttttttccccaaaatttatttttatttttaagcccacccaaatttttttttaaatgccctcgctcccctttttt

SEQ ID NO: 1740 - DNA, 368 bp, Triticum aestivum
  Clone ID: LIB3280-014-P1-K1-G3
ggcgctaaggcctcttttttttttttctctaaggcctcttttctctctttttccgggctgcaagccctctttttctttttctcagtctgttgtccccgtagaggttgttccagctggaaccaccggaggcgggaagaaggctttcatcgctgcttaagcccaggctctgattcatgagtagttcatagtcagacgttttaagcacttaaacctaccaggctgctgctgttttgcgatttgattcctgtgttttctgtcaaaccgaagaatgtcgtgatctgaacatgtcttgtggaatctatctatcattaatagtttcgcttaaaattgtactcagttttttctttggtgctgaatttgttttgccc

SEQ ID NO: 1741 - DNA, 139 bp, Triticum aestivum
  unsure (1)...(139): unsure at all n locations
  Clone ID: LIB3280-014-P1-K1-G4
tcggctatttttatatcactagtcaccgctctttttttttgtttgggattaataatagggtagagttttcttttaagggttgntttctaatatacatcgaggcacatgatgttgtacttatatccacaacccattgaac

SEQ ID NO: 1742 - DNA, 374 bp, Triticum aestivum
  Clone ID: LIB3280-014-P1-K1-G5
gattaacataacaggcattgtttcttgtgccattttaggccgacatttcacagttgtgtagctttggaaaccctaggtgaaacaaacgatttaacaaaatagtacagccgagtcacagggcaatccaataatccacctcttcatgggaaactcagtccaaagatgaagaaaaaagaggcaaacaaatcacacaatcctctccaattccctcgcgtagccaagggtctggttgatgaccggcgccgccgggatctccttgcagggctgggactccttcgccttctggaacaagacccggccgtccttgacatcccactcggggtgctcctctgcgatgtactgttgcagttccttgtcggagctgaacttaaaca

SEQ ID NO: 1743 - DNA, 293 bp, Triticum aestivum
  Clone ID: LIB3280-014-P1-K1-G6
cttggtcgaggcaggccgcatcaataaatctaggtccggagtcgactccgtttccccccgttgggagtaccattccgaccggcgaacccattcaataacagccccgttcgtccgtcacattctgttctttcaccggtggtctgatcttgctctgagcatcgtccgtcccaagccccccgtcgtactctcgtgatccgacccatcccgttctcgtccacatgtccctcaacctgtcccaccataccggcgctgcggtcatcgctgccacccccgctccggtcgcccgcgctttt

SEQ ID NO: 1744 - DNA, 428 bp, Triticum aestivum
  Clone ID: LIB3280-014-P1-K1-G7
cgtgagatcgggttcgggcaggccgccgagtcgtcgtcgtcgtcgagctcgatccggaccggaccccaccacccgccccgcgccggcgcgcccccggagatcggagcaggatcccggcctcgccatgaatccggagtatgactatctctttaagcttctgcttatcggagactcaggtgttggcaagtcatgccttctcttaagatttgccgatgactcatacctggagagttatatcagtactattggtgttgatttcaaaatacgtaccgtggagcaagatggaaagactatgaagctgcaaatctgggacactgctgggcaagaacgcttcagaactattactagcagctactatcgaggggctcacgggatcattattgtctatgacgtgacagaccaggacagcttcaacaatgtgaagcagt

SEQ ID NO: 1745 - DNA, 443 bp, Triticum aestivum
  unsure (1)...(443): unsure at all n locations
  Clone ID: LIB3280-014-P1-K1-G8
ccctgtcagagatgtgggagcttgaggcagcctctcgtgctgagatagagaatggaatggaggaaggcctgggagactcctcagacgagccgcccattgccttcccccaagagctgcagcatatggaagtggacctggaccgtgccactatccacacaccagcgacggctggccggagacgagcagatcagatggtgcctagcatcacctcttccttggtcagagctgaaacagaaacagaactttccgcagcttttgaaagccaagtgactaggccggaggtgccatcacaggtgcatntccagcctcagactcggacggaaatcagggatgaagttgccagctacggcactgctgccagatacaacggcgtccagcagcagcagcagcagtataccctacaccatcaccgtgtgcaggtgcgcatagcaccatccacttca

SEQ ID NO: 1746 - DNA, 203 bp, Triticum aestivum
  Clone ID: LIB3280-014-P1-K1-G9
ggggaaaaaatcattttgtaaagcacataatagcaagctgggttttttcactagtcatcacttgagcatacaaactcgcgtgcgtttagtggaacgggtcgagtgaaaccttttattacaactgatttttttcattcatacctgaaaggggcccggcccgggtggaatgtctatacaatttgcttgattgcccgtgaatgcat

SEQ ID NO: 1747 - DNA, 110 bp, Triticum aestivum
  Clone ID: LIB3280-014-P1-K1-H1
cggacgcgtgggtatataaactatatatagactgctgagaccctactacttttgtatctgggggggatatctctagaatatgaggacctgtatatctgaaccttaagcta

SEQ ID NO: 1748 - DNA, 244 bp, Triticum aestivum
  Clone ID: LIB3280-014-P1-K1-H10
acttacaaatcatccaggttctttacaagtctggtagaaaaaaaaagcagagcctcataaggctgtagtgggtatttacaggacaaaaaggggaggcacacgcctcagtctagatattcagcagtcttcttctaacccactgctacgagttgccaaaggcagttacgtacgagaccacgacggtgatgtcgtccagcttcccgccgtagtaccggtacccatcgtcttgggccgcggtcgaaaa

SEQ ID NO: 1749 - DNA, 312 bp, Triticum aestivum
  Clone ID: LIB3280-014-P1-K1-H11
gccggcgccagagtactgagtggtggcgacctctgcacatgctttgcctgcatgcacgcgagaccccaccaggcacatgacacagtaaatagttattagtggtgaccgtggaataagatgggactaatgctagtactacagttaatcgcgttcttgggtttattatctgacacagtgctctgattagacgtgcgagcaagaaggttttatcgatcttggagcttgttgcctgcagctaccttcggcaaaattacttacatgtgttgtaaaactaagacaatgatctcggatttcttcttcttcttcggaagt

SEQ ID NO: 1750 - DNA, 173 bp, Triticum aestivum
  Clone ID: LIB3280-014-P1-K1-H12
ctgccagcaacaacctccctcccaacacagctcttcagccgccgcgccctccctccggcccgatcctctcaatggcggctgcgcccccccatcccgcctcgcccgcccccgtaagcggatgccactcattccgcctgcacttcatcaacgcgcggcacctgccctagagcatc

SEQ ID NO: 1751 - DNA, 203 bp, Triticum aestivum
  Clone ID: LIB3280-014-P1-K1-H2
cagaaaatatgttgcaacttcggaaatcaattgaaaatgatggttctgatgttaatggccaggaggacgcaataggctcgttgtgataatttatcagaagaaagagcataagaaaatggagaggatgctgaaatgactcaaatagaactaggaaatctttgtgtgagcaacctaggcaggatagtttctgattcaaatcattt

SEQ ID NO: 1752 - DNA, 250 bp, Triticum aestivum
  Clone ID: LIB3280-014-P1-K1-H3
ctagatgcgagcggccccccggtgttggatttgaagatgtttgacgccttgctagtttggcgttgcctccttagttctaggcttggtgggtttagttgtgtctttttcctgttcgggttgagcatcccttgtctctctgctctgggttccatgctcattccttcttgcgttcatgtcatgttttgtaaccctcctctgtactcaattctctttcttctatcaatgaaatgatacacaagctttgcgtatt

SEQ ID NO: 1753 - DNA, 142 bp, Triticum aestivum
  Clone ID: LIB3280-014-P1-K1-H4
aatcataacaatctcacataagattcttattacaaataattaaatactaaaaaaaaaactcttttccccaacaatttcatctctttcattcccaaaatttataaatccttctccatacatcttatcttatcttctaacctac

SEQ ID NO: 1754 - DNA, 400 bp, Triticum aestivum
  Clone ID: LIB3280-014-P1-K1-H5
cgaccgggctatggtgaacctcccctaccatgaccgctcgcgcttgtgtgcgcgtgatccacctggtgttcatcccgacgcactttccatttttagccccaagataaaccttaccccgcagccagggccagtcgtcaacgtggttgtgtccttcacccttgccaaggaccaactttccactctcaagcgcatatccggtggcgatggcgtgagcaccttcagtgccatgagcgcccacctgtggcaatgcatgtgtttagcccggcagctacccccggatgctacgacgcatcttatgttctcggccaacatccgccgcatcatgaggccacctctcccaggcggctacttcggcaacgccataataaaccctaatgtcggcgacaaagcgtatgccatc

SEQ ID NO: 1755 - DNA, 429 bp, Triticum aestivum
  Clone ID: LIB3280-014-P1-K1-H6
ggagcaattagttgtgcatagaaaagagctcacctaaattaatgacatgttcatcttatgggcgagtaaaaaaatttgccccctaatattcagttctactgagagttgtagaaggcaaaaatccagcaaattaactcaagtaagtgtttttgttatttcccaatgtaattaaaaattttcttctcaaaatacgacatggtcattgtcggaaaagaatatttagcatgaatgtaggtgctttcatatgaagctggacatgtttacaatgatcgaccggataccgttacacgtgtcctgaatatgaagtttaatgatttctgagaagatgttaaaagtggacatttgtttcgtccaattcaagcttgtaagttatttacatactgattttatccggcttggtttaaatctttcaattaatataatctaact

SEQ ID NO: 1756 - DNA, 442 bp, Triticum aestivum
  Clone ID: LIB3280-014-P1-K1-H7
gactagttctagagcccgaagccaaaggaaatccactccaatccaatccccacagaaatcggcatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtggagaacttccgcgcgctctgcaccggcgagaagggcgtcggcaagagcggcaagccactgcactacaagggcagctcgttccaccgcgtgatccccgacttcatgtgccagggcggcgacttcaccaagggcaacggcaccggcggcgagtccatctacggcgagaagttcgccgacgagaagttcgtccacaagcacaccaagcccgggatcctctccatggccaacgcgggccccaacaccaac

SEQ ID NO: 1757 - DNA, 453 bp, Triticum aestivum
  Clone ID: LIB3280-014-P1-K1-H8
aacactagagattgatccatccatgggttccctattctcttcccccgccggccgcgactgtctcccagtctccaaaaagtacattggccgctctattaggtcaaaagaagaggacgtcgccctccgaatttctactcttgtcgacatcgccatcgaacattacaactccaacaatccaggtgccgagtttgagtatcctgagtatcctccccagtcgaccacggagatgaaggctgcctgcatcggttttaggggaactttctggtaccacctttgcttttcggctcaccccatggatgccaccaccgagacgcagcactttttcgctgagctatattttgatagacagtaccttgaactagccgttgaaacatgcatcatcttagaaaagccgttgtgccgctttagcagctcgtgtgcattttgtccagacgaatccaatatcttgcaccc

SEQ ID NO: 1758 - DNA, 450 bp, Triticum aestivum
  Clone ID: LIB3280-014-P1-K1-H9
ttctggtccagcgctgaagaagcggaaaaccccaggcgcccaacgaccttccttccggcgggaccatcctccgactcctccctcatctccctgctcgccgaggctcagctcaggataaaccatgggtggcgttttgggtttagtgcaggttgatcagtcaactgttgctatcaaagaaacttttgggaagtttaatgaggtcctggagcctggttgccacttcttgccttggtgcatagggcaacggattgttggttacctctcactgcgtgtgaaacagctagacgtccgatgtgaaaccaaaacaaaggataatgtctttgtgactgttgttgcttctgtccaataccgtgcccttgttgataaggcatctgatgccttctacaaactgagcaacacatagcaacaaatccagtcgtacgtctttgatgttattagagccactgtccc

SEQ ID NO: 1759 - DNA, 447 bp, Triticum aestivum
  unsure (1)...(447): unsure at all n locations
  Clone ID: LIB3280-015-P1-K1-A1
cttctcctccccactcagtcctcggttcccggtccggtcccgttccgttcgttagggtttagtagtagcggggaagaggaaggaatggcggacgtctagtaccgctgcttcgtcaggcgcctcgcctgggccaccgacaaccagtccctgcagaacgccttctccaagtacagagacatcatacactacaagatcacacactgacagggagacgggccgatcccgcgggttcgggttcggaccttcacgtatgtcgaggcgatgcgccatgggatagatggttcagaaccccagggtgcagaagaagctgcaagaggagctggacagcgtggtccctcctctccggctgatgangcagacccagtttcagaagctgccctacctgataggcgtggagaaagagttctttcgtctgcacccgccgacgccgctcatgctgccccacaa

SEQ ID NO: 1760 - DNA, 301 bp, Triticum aestivum
  Clone ID: LIB3280-015-P1-K1-A10
gaagttgtgtgttgttacagtcgtgatcagtatgccaaggttagatgctatatcatagaccagtctctttgtgtaaacttaagtaatcatggttgtaggaactgtttttatatgatatcatgatgctctaggttggaggacttgtaccaaagcgctgtaggaatgacttccttaggttcaggaaacacaccgagcagaaaggaaccacgcaagacaatattgagaaagagaggctgaaacatatgatcctgattaggggtggagaacttgaacttacacattaagaatacaaatgtagctg

SEQ ID NO: 1761 - DNA, 314 bp, Triticum aestivum
  Clone ID: LIB3280-015-P1-K1-A11
aaagctcaattcaaggagttgcactatatttatagaagctgctgaaaattcatccccaatcataatgccaatgttaatgcatctatcataaccactcacctttgcgtaaacccaagtacacatgctcgcatgaactatctttatatgctcacataaagccctagtaaataggatctgcaacaaaacgctaaatcaatgactcacttacgtacagacaacacaccaagcaggaagacccctccctcaacatattttagaaagctagcttccaataaattattgtttattagattcaagaactaatacctacacat

SEQ ID NO: 1762 - DNA, 444 bp, Triticum aestivum
  unsure (1)...(444): unsure at all n locations
  Clone ID: LIB3280-015-P1-K1-A2
cgcctccngtaccgatttccaggtttgaggggcgggtccgatcgtctctagaacaccggtgctcccggcagccgtgccgctcgatccacctcacctacgacagggctagcaggtcccggccatggatgccagagcacgagctccctcttactagttgcacgcatcacccgacggagtcgcccctgtcggcgccttgccaagtcttcgtgccggcggtgaccttcgcgtcgagatgccggagttcacgcccccctgcacctgcatcgagcctattgcgcctttgcattgaagcagctgcagaggaggatgagcaccttgaacccccttgtatcgctcgtgttgaccgcgccagcacgtgggttacgccaggcccagcgccccttccgacctgctggttgcttctacacccaccgggtcaggcccactgggcccgcctttgagggg

SEQ ID NO: 1763 - DNA, 446 bp, Triticum aestivum
  Clone ID: LIB3280-015-P1-K1-A3
atcgtctctcgcaacaccggcgctcccggcagccgcgccgctcgatccacctcaccgacgacagcactagcaggtcccggccatggatgccagagcacgagctccctcctcctcgttgcacgcatcacccgtcggagtcgccccggtcgccgcctcgccaagctccgtcgccgccggtgaccttcgcgtcgagatgccggagttcacgcccccctgcacctgcatcgtgcctcttccgtcctctgcattgaagcagttgcagaggaggatgagcacctcgaacccccttgtatcgctcgcgttgaccgcgccagcgcgtgggtcacgccaggcccagcgccccttccgacctgctgcttcctcctccacccaccgggtcaggcccactgggcccgcctctgtgtcggggttgtgtctacctcctcatttggtagctacgcggcgac

SEQ ID NO: 1764 - DNA, 435 bp, Triticum aestivum
  Clone ID: LIB3280-015-P1-K1-A4
gcggcgggatgatctaccggagctggtcgctgctctcgtcgacggtggcgatctggggcggtgccgccgccgcagggctcgccgtcgtctccctctctggcggcaaggaaaagtttcaggactacctgtgccgcgaaggcgataggctgaggcggcaggacagggccaccatggccagcgccaactgatggaccatgaaagaaagcgccgcggagacgaagaaacgagcatttcatcatatatccgcatccgtgaaggcgtcgtcttggtccaataatccttgtttgccgtgctttaaacatggtgtggtctggtgtcctcatcgaatccaataatctttgctcgacatgatgtggaacttggtacggcctgatgagcttcgctttccggcttgccaagtggctcgaaacgttgtcttcgcaacaatttttttgt

SEQ ID NO: 1765 - DNA, 435 bp, Triticum aestivum
  Clone ID: LIB3280-015-P1-K1-A5
aatacattgatcgtaggtctatccatgcccgtgtaagctttaaccctgtgtgaatctgtagcctacattcctatttttctcaaggtaacccagatttactttttgcatgcccaatatgtttgtatccatgtccaataattgtcctttttagacgggtaaagtcaaatttataattgtaaccttgggtcataatctctaaccttcaccactatgaaacctttatgagctggtttttatgcaagcagctaaggtccattcaatggtatgaacatgaatgtttgtcagttgttagattttttttttgagttagaacatatgcgtcttatactgatctcttgcgaaaaatgagttctatgttgtactctctgttagatttatcctgctatcacatgccatttttatttgatttgaaaactcccatgtagaagctggaat

SEQ ID NO: 1766 - DNA, 438 bp, Triticum aestivum
  Clone ID: LIB3280-015-P1-K1-A6
cagcaatgcagagtaccgttacaaagaggtcatcttgcctgcgttagggctgaatcagggctcggagtgggacttcggggtgttctcaggcatcgtcggcgttgagaaacctgacccaaaaatctacaagatcgcgctggagatggcggggaacgtcgcaccggaagaggcgctccacatcggcgacagctaccgcaaggactacgtccccgcacggagcatcgggatgcacgcgctgctcctggaccggttcaagaccgccgacgccgagagctggaggaagtccggcgcgccggtgctccctgacctcgaggccgcgcaggcatggctcaccaagaacccgaccgaggagccactaggggccgcgctgctgcgcaggatggccgagaagctctgaatctcgccccctgggatagttcctgttgtgctcttgctggg

SEQ ID NO: 1767 - DNA, 441 bp, Triticum aestivum
  Clone ID: LIB3280-015-P1-K1-A7
gaatacatttggtacttgagatggctgtgtccacttaatgaggagctttacaatacccacaatgagagaagggatcgtctgaccaagaagatcattgaagagcatgcacaggccctcagggagagtggtgccaaacagcactttgtggatgctctgttcactctcagagagaagtatgaccttagtgatgacacagttttcggacttctatgggacatgatcaccgccggaatggacacgacagtcatatcagtcgaatgggccatggcagagctggtccggaaccccagggtgcagaagaagctgcaagaggagctggacagcgtggtcggccgcgaccgcgtcatgtccgagaccgacttccagaacctgccctacctgatggccgtcgagaaggagtcccttcgcctgcacccgccgacgccgttcatgctgccccac

SEQ ID NO: 1768 - DNA, 393 bp, Triticum aestivum
  Clone ID: LIB3280-015-P1-K1-A8
acaaattcgtcgatgtacctatcgtggagatgcgtatcggctacgaccgcctgcatcttcgccgcgcctgccacgaagctcctcctggcctcttcgtcaaccatgacggcccggacggcggtcgagacgccatggcggtcgaacgacccgtcgtcctcgttcctcgccacctgcagccccacctgcttcgcctccatctgccgcgcgttcggcccttggtcgccgtagatgggcagcatgaccagagggtgcccgaacaggaggctctcgatcagcgagttccgcccgcagtgcgtcaggaacccgcccacggccgcgtgcgccaggatgttcatctggggcacccaccccgtggtcaccaggccgcggccactggtgcggtcctggaaaccg

SEQ ID NO: 1769 - DNA, 444 bp, Triticum aestivum
  Clone ID: LIB3280-015-P1-K1-A9
agaacatcccgtaccttccgtagtggatagagtacaatcaacaaagacggccagagagtgagagatagcgtcaaaggagaggaagggaatcaggacatgcacatacctgctattgttcccaaagtaccgggacgattctactacctttttggcaaaccaatcaaaatggaagggatgaacaatgttctgacggacagggagagcgcaaataaagtgtatttacatatcaaatcagaagtcgagaacgcaatggcatacttacagaggaagagggaggaagacccttacaggagtatagctcagcgtgctgtgtaccaggcaactcaaggtgtttctgctcaagtcccaacttttgaaccatgaagactaggtgcaaatatattcctgtgatagtgtgactgcacattggcagatagtaggtatccattatagcagagtataaca

SEQ ID NO: 1770 - DNA, 340 bp, Triticum aestivum
  Clone ID: LIB3280-015-P1-K1-B1
gggaagccgcgaaccgcccatataagattataaaggtcgcccgatcatttgcatgatacaaccctgggcaaaacaccggggcagagttttacaaccccttatataatccggggtttattataaagataaaagcaaatggtcctcttcatccaaactttgtatatagttaatattggactgggggactttttatccaaactttgtagaggatgccggccgtcctaacctacttggccacgacggcctttttgccgtaggaagccgcggccttggccttgccgtcgtcctgttttttgaaggcggagacggggaaggtcctccccagccctgtgggcgtttt

SEQ ID NO: 1771 - DNA, 273 bp, Triticum aestivum
  Clone ID: LIB3280-015-P1-K1-B10
cttagttagcactcttatcacatgaatgtgatgaactccatgagaaatagccaggtgcattaggctcacctaagtcttctttgtttccgaacatggtcgccctttagtacaggtctgaagattcgggtaatgcaccatgtaaacaatctacttattggtctgaacatttttattttagaagtacgtcttattgcttattatgtcttggtagtactgattagttgtatttactatcaaaattgttgtatggactaatgtatatgatgttatacc

SEQ ID NO: 1772 - DNA, 366 bp, Triticum aestivum
  Clone ID: LIB3280-015-P1-K1-B11
cttaatcggcagcggccgcacattgattgtgatgaactccatgagaaatatccatttgcagtaggctcacctaagacttctttgtttccgaacatggtcaccctttagtacaggtctgaagattcggtgtgatgcaccatgtaaacaatctacttataggtctgaacattgttattttagaagttcgtcttattggttattatgtcttggtagtactgattagtcgaatttactatcaaacttgatgtatggactaatgtatatgatgttctaccaaaaaataaaaaaaaaggctgtctctctagaggatccatgcttacttccgctcgcatacgaatatataactcttctatatgggtttttaaa

SEQ ID NO: 1773 - DNA, 437 bp, Triticum aestivum
  Clone ID: LIB3280-015-P1-K1-B12
gcattcacccccaggccattcagcctccgccgaggcagaacattcaccggaggtagaggggaaacgcgcaacagccatggcctcgctccgtatcctttcagtgatcgctgtggtcgccatctttgccctcgccggcaccgccgtcgccaatgacctccccgactacattgttcagggacgggtctactgcgacacgtgccgtgccgggttcgagacaaatgtgaccgagtacatcaagggtgccaaggtgaggctggagtgcaagcgcttcggcactgagaaagttgagcgctcgatcgacggcgtaaccgacgagactggcacttacaaaatcgagctcaaggacagccatccggaggatatctgcgagatggttcttgtccagagccccctcccaaactgcaacgagattcaggaactcagggaccgcgccgaga

SEQ ID NO: 1774 - DNA, 363 bp, Triticum aestivum
  unsure (1)...(363): unsure at all n locations
  Clone ID: LIB3280-015-P1-K1-B3
ttggtttttttttttttttttttttttttttttttttttttttttttttttttttttttttttttttttaaatttttttttttttttttttttttttttttttttttttttttttttttttttttttttttttttttttttttttttttttttttttttttttngnngggaaaaaaaaaaaagggggggtggattaattttttgtttaaggttgagagggtaaaaaaatatttatttttttatttaataaattgagggttgaaaaaattattttttttttttttaggtgaaaaaaaaaatttgagggggtgtgtggttttttttagtgagtaattggtaaaagttttgtttttttttattaaa

SEQ ID NO: 1775 - DNA, 438 bp, Triticum aestivum
  Clone ID: LIB3280-015-P1-K1-B4
tttgatcatagcaggaagaacgtggttgaagttaccattatccaggaaatcttgcaaaatctccgaagagcttgttctaagactatgaagaaggtcacagttggtgtcatatgcccatactctgctcaagttctagcaattcaagaaaaactgaggaaaatgaagtttggccccttgtcagtaaaaattagttctgttgatggcttccaaggtggggaggaagacataatcattttatcaactgtcaggtccaactctgatggggtggtagggttgtttcagaccgacaacgtacaaacgtagctttgacaagagcaagacattgcctttggattttgggaaatgctgcaaccctatccaggagtggttctatctgggcagatctagtgcgcaatgccaaggaacggcagtgtttcttcaatgcaaaaagtgatgggg

SEQ ID NO: 1776 - DNA, 293 bp, Triticum aestivum
  Clone ID: LIB3280-015-P1-K1-B5
cttgatcatagcaggaagaacgtggtggaagttaccattatccaggatatcttgcaaaatgggggaagagcttgttctaagactattaataatgttacagttggtgttatatgcccatactctgttcaagttctagcaattcaagaaaaactgaggaaaatgaagtttggccccttgtcagtaaaaattacttctgttgatggctgccaaggtggtgaggaagacattattatattatcaactgtcaggatcagctctgatggggaggtagggtttgtttcataccgatatcg

SEQ ID NO: 1777 - DNA, 327 bp, Triticum aestivum
  Clone ID: LIB3280-015-P1-K1-B7
gtacgacacgcgagcgggcgcccttggtgaaaggtttagagtctctcatgttttggggggaggcgcatcaaactaagcagcctttgtatttcatttggctagcaattgcaaaaacaaaatgtaaagctgaataaggccgtcaaacctgaaataagaatactagatcattaacacaaagaccgcctcataaattctcatgtaccaaggttcgagacaggttttaaagaaaaacggcttatctctattcctcagctcgtcaatagggcaagaacggatgatccgttgttgcattctaactaaatagcgagtggccagttttagagaatt

SEQ ID NO: 1778 - DNA, 371 bp, Triticum aestivum
  Clone ID: LIB3280-015-P1-K1-B8
gtagactaaattcagggctcacttattcataacctgcagaacgacataagtttcagatccaaccgataacactgcatcacagtactgtagaaacaaagacaccaacagcagaaccagacgagtccaccctccacctggagcttaggctccggggtggcatgcaaatcttcgtcaagaccctcactggcaagaccatcacactggaggttgagtcgtctgacaccattgacaatgtcaaggcgaagatccaggacaaggagggtatcccgccggaccagcagcgccttatctttgccggcaagcagcttgaggatggccgcacccttgcagactacaacatccagaaggagtccacccttcacttggtgctc

SEQ ID NO: 1779 - DNA, 273 bp, Triticum aestivum; identical to SEQ ID NO: 1771
  Clone ID: LIB3280-015-P1-K1-B9

SEQ ID NO: 1780 - DNA, 446 bp, Triticum aestivum
  Clone ID: LIB3280-015-P1-K1-C1
ctaccgtggtctgtactttggactctatgattctctgaagccagttctcctcactggcactctccaggacaacttctttgccagctttgctcttggttggttgatcaccaatggtgcaggtcttgcatcttaccccattgacactgtccgcagaaggatgatgatgacctccggagaggccgtcaagtacaagagctccttggatgctttccagcagatcctgaagaaggagggtgccaagtccctcttcaagggggctggtgccaacatcctccgtgccattgctggtgctggtgtgctctccggctatgatcagctccagatcctcttcttcggcaagaagtacggctcaagcggtgcctagaggggacgaaatgatgacgaacaagagaagtttgttcccagtcctacccttcgaggatctggtgaacttttatctttttaac

SEQ ID NO: 1781 - DNA, 436 bp, Triticum aestivum
  Clone ID: LIB3280-015-P1-K1-C10
cttagcaggtggatcagctcaaggagaggagccaacaaatgaacatggtgctgggcatgaccacccaaaaccttgtggcgctgcaagcacagaactcggtgatgcagacacagaagatggagctggagagcaggctgtgcgccctgagcgagatcatctgctgcatgaactctatcactagcacagcgaaccccgtcgccgtcatgggcgccacaacaagcagtgcctatgacatttttggcgccggcagcacatggagccagcccatagacttgtaccagtgcttctaaggaagaagaagaatggatggttgatgttgtcatagctggtagggcctctatgaaggcatcaagttctgtatcaatcatgtagggccttcgtgtcaccattgatgcgagcccccctctctctctctctctctctctctctctctctc

SEQ ID NO: 1782 - DNA, 430 bp, Triticum aestivum
  Clone ID: LIB3280-015-P1-K1-C11
ctagcaggtggatcagctcaaggagaggagccaacaaatgaacatggtgctgggcatgagcacccaaaaccttgtggcgctgcaagcacagaactcggtgatgcagacacagaagatggagctggagagcaggctgtgcgccctgggcgagatcatctgctgcatgaactctatcactagcacagcgaaccccgtcgccgtcatgggcgccacaacaagcagtgcctatgacatttttggcgccggctgtacatggagccagcccatatacttgtaccagtgcttctaaggaagaagaagaatggatggttgatgttgtcatagctggtagggcctctatgaaggcatcaagttctgtatcaatcatgtagggccttcgtgtcaccatagatgcgtgcccccctctctctctctctctatctctctctct

SEQ ID NO: 1783 - DNA, 437 bp, Triticum aestivum
  Clone ID: LIB3280-015-P1-K1-C12
cccacgcgtccgcccacgcgtccggtccttcgtgtgggtgcggctgcggtatgtgccgagcccgagttcgtgctcaatgaaaaattaggctgttcgtgcggccgaggcgccgttcgtgcggcggagcgtatgtgcgccggaaatatttgtgtcctctccctttctcttgtttcttccttatctccggtgatcgccatggttcagtgagtaggctagacaacaacaagggccacaaatcagacttgaaaccagacttgtcaactgaatccggctcgtctctggagatcaactcgcacgccgtcttgaggttgggaacgatgcctgatatggtgggccggtccttcctggcaaacttcacgcagcatcgtgcaatctgcgccacatgcttcaatgcgtgcagctgtcatgacgttggctccggtacaggtcgtctatcc

SEQ ID NO: 1784 - DNA, 406 bp, Triticum aestivum
  Clone ID: LIB3280-015-P1-K1-C2
gtagtagaacgtgagcagccgctgtagaagatgcaagatgactacctcctccatgctgcgacataattcttctataatagcaccaaaaaacaataaactactcgccgttgtacaacaacgtgactgctaaaacaacggcgtcaccaaacataataatcttgtagcacatcatccttttgtcagctggtgtcataacaaagaagagggcaccaatcgtcgttcttaacaacagctcagcctgcatgatgaatgatacgccccctgttgcagcgcatcaatcaccgcgggtgttgtggttactcccagcatgaccactactatagtcagcagcgtagtacccgctgcttccgctgctttccctcccttcctcgtcacgatggtcggctgttctcgtcaagcagtaaaa

SEQ ID NO: 1785 - DNA, 413 bp, Triticum aestivum
  Clone ID: LIB3280-015-P1-K1-C3
ctagtagaacaccagcagccgctctagaagatgcaagctgactacctcctccttcctgcgacaaggttgttctataatagcacctacaaacaataatctgcccgccgttgtacaacatcgtgactgctaaaaccacgccgtcaccacactaaataatcttgtagcacatcatccttttttcagctggtgtaataataaagaggagggcaccaatcgtcgttcttaacagcagcgcagcctgcttggcgaatgatacgccccctgtagcagcgcatcattcaccgcggctgttgtggtgactcccagcatgacggctacactagtcagcagcttaccagcggctcctcccgataatttctcttctttcttagccaccacggtcggcttttctcgtcaagctgtttttagggggc

SEQ ID NO: 1786 - DNA, 441 bp, Triticum aestivum
  Clone ID: LIB3280-015-P1-K1-C4
ccgcccccctcgcgcagcccacgtacaaaaccaaacaaaaaagcgccgagcaacgcagcgccgcagatagaatcgttgcgtgcgtccaccgctctcgcggcggccatggaggccacggcgcccgactactacgcccgcgacaagaagggctccgacctcttcgtcgtcgacgacctcctcgcgctgccgtgcgacgacgaggaggaggaggaggaaggggtgggcgacgcgccgttcctgccggccaacgccgcctccgccgccgcagtcgtcgtcaagcaggaggccgggttcgggaacgcgtcggccgactcgtccaccgtcacggccctcgacagctgcagcaactccttctccggcctcgccgacggcgacttctccggcggcctctgcgagccgtacgatcagctggcggagctggaatggctgtccaactacatg

SEQ ID NO: 1787 - DNA, 438 bp, Triticum aestivum
  Clone ID: LIB3280-015-P1-K1-C5
gtttgagggtttacttgagaagactcccactgaagtaaatgctttcctgtcaaatcctactacatacataattgcagcaagaactgctggtgatgcacaggctagagatcagcttgaacgtgttattgagtgtcttgacagagacaagtgcgagacgttccaggattctattacctgggcccgtcttaagtttgaggattacttctccaaccgtgtgaagcagctgacgttcactttcccagaagactcactgaccagctctggtgctcctttctggtctgcgccaaagcggttcccacgacctgtggacttctcgtccagtgatccaagtcagcttagctttattttggctgctgcaatattgagggcagaaacttttggaatacccatacctgagtgggccaaaaccccaaacaagctggctgctgaagctgtcta

SEQ ID NO: 1788 - DNA, 435 bp, Triticum aestivum
  Clone ID: LIB3280-015-P1-K1-C6
ggcaaagcttgaaacatcaactggcagtcctgagtttgcttgcatggtggtttccttgctaggcctttctcagggcttcacactgctcttgtctaaaggctcgctttcgctcggcaacgacatggcgtattatcaatattctgctggatttagtggagtgctgcttggcatgaatgttgtgctgaatgcccgagaaggcgatgttgtctggcatggggtgaccgctcctgcaaagtatgcggcattgcttgaactactactcgtccatgctttcaatccggaggcacacttgatttgcaatgttggtgggatacttgctggcctggcctaccttttgctgaggcacggtccagaacggctcgctcccatgttttcaggaattgcagacgttgtgagtcagccggcgagatttgctaagaaacttctgaggtcagc

SEQ ID NO: 1789 - DNA, 214 bp, Triticum aestivum
  Clone ID: LIB3280-015-P1-K1-C7
aaaaaaaaaaaaaaaattttaaaaaattttttaaaaaaaaaaaaaaaattttttttaaaaaaaatggccgggaaaaaaattttattttttttttaagggccccctcctttcaaaaaaaagggaaaattttggaaaaaaggggaaaaaaaccccaacccccgtggcaagtgttttaaaaaatttaacacccttgtttacaaaaaaagaggaaaac

SEQ ID NO: 1790 - DNA, 137 bp, Triticum aestivum
  Clone ID: LIB3280-015-P1-K1-C8
aagagaaagattttttttattttattaaattctttaattcattcttttatttttactaattaaattatctttaatttaatttttccttttttctttatatttttaatcaaataatcaataaataaattaataaataa

SEQ ID NO: 1791 - DNA, 324 bp, Triticum aestivum
  Clone ID: LIB3280-015-P1-K1-C9
gcactaaaaacgagtattccacaaatatacaaactcattcacaccatggtacaggtacagttctcttacacacaaaacccccacaacctgcaagcacaacacacgtaccgaagatcgggtgatcatatatatacaaacgactatcgctaccatcatcaattggataatctcgagggtcgtggcttgtggtccactatacaatcgtgtgtatggcatctgaatcatcttcgcaatttccctcagccttcctcagtttcgccaccagggtccatatatttgcgagctcgccctccaggaacgcctccttctgcttcgactcctcga

SEQ ID NO: 1792 - DNA, 368 bp, Triticum aestivum
  Clone ID: LIB3280-015-P1-K1-D1
atgaaactacaacagtcaagctcatcatcatcattcacacaggaaacgggaacgtttcctgcagggaacaagttaattcacacacaagggctactttgacaagagcaaatgacagtacaattcccgatttccttctcgccgatacctagattgcaggaaacgctcccgagatacagcagcaaacataatttcaatcctacagttaaatagcctagctcatctcatgcactgtacaacgccacgtttttttctgcaccagcaatggagggctgacgccataaacagtgcatctcctcaccggggatggtttttgttgaagcgattaccatttccgccttttcggctcaaccttagaatcagaacttggt

SEQ ID NO: 1793 - DNA, 338 bp, Triticum aestivum
  Clone ID: LIB3280-015-P1-K1-D10
gatgcggacgtgatcttcgtccccttcttcgtgtccctcagctacaaccgtcaggggaaggccgtgccgacggagaaggttagcatagacacgttcctacaggagaagctcgtcaggtatctggaggcgcaaccggagtggaagaggtccggagatgccaaccatgtgatcttcgctcaccaccataacagcttgttccacttccgatcagcgctgttcccagcagagatcgtgctgtctgactttgagaggttccaccctagggtcgtcagtttgtagaaggatcttattgtgccatacctacttaaggcgaagacagttctgaaagacacagccgg

SEQ ID NO: 1794 - DNA, 162 bp, Triticum aestivum
  Clone ID: LIB3280-015-P1-K1-D11
ccagccccaaaccatccttctcggacatgctttaccttttcctccacataaatccttaagagaatttcatccagagagacaatacccactcgccaatcgatcgattaacccatatcggcatgagcttccacaacctgtatgccataaacgcgatccttccaa

SEQ ID NO: 1795 - DNA, 339 bp, Triticum aestivum
  unsure (1)...(339): unsure at all n locations
  Clone ID: LIB3280-015-P1-K1-D12
natgcacacacaactcctttctattaatatttttcaaaaaattcaatcttctaaaggaagagatccatatacgcaatatactactcctccttcacacaacatctatacagaatcctacaaaaactcatcagaaaccatactctatacattgcaaacacttcaaacaaaaactttatatcctcacaacattactaaacacctacacaacccttacatccatttgtttcaataaccatatatccttacttactaaaaagatatgattcttctttaattttcaatacatccataagtactacctttcattataccacacttactgtttttaactttgtaact

SEQ ID NO: 1796 - DNA, 444 bp, Triticum aestivum
  Clone ID: LIB3280-015-P1-K1-D2
cgacgacaaagaagggttctattacatctgtccaggctatttatgtgcctgctgatgatttgacggatcctgctcctgctaccacctttgcccatcttgacgctactactgtgttgtcacgacagatttctgagctgggcatttaccctgctgtcgatcctttggactcgacatcaagaatgctttctccccacgttctgggtgtggatcactacaacactgcccgtggtgtccagaaggttcttcagaactataagaatcttcaggatatcattgccattttgggtatggatgagctcagtgaagatgataagatgacggttgctcgtgcaaggaagatccagaagttcctgagccagcctttccacgttgccgaagttttcactggtgctccagggaagtatgtggatcttaaggagggtgttcaaagtttccagggtgttt

SEQ ID NO: 1797 - DNA, 379 bp, Triticum aestivum
  Clone ID: LIB3280-015-P1-K1-D4
aaatgtcgaaaaaaacctctatacattcaattcttttactattccgatcttaactattgctaagactccatttctcatcaagaacaactcaaaggattcttaccatgccagcagattttccacattttaccacataagacttgccaaactttacgaccgtcgcggattttttctatgatccttatgatagaatccatactactacaatcttttcattagacttcaatagagaccatgtattgccttatttaacaaatagattcaaatatttctgggttatattctgagagcagaagacactacgaacaagaaatggagacttaccactttacggcatccgagacattcgtagagagacttaagtctgtaataatcaata

SEQ ID NO: 1798 - DNA, 444 bp, Triticum aestivum
  Clone ID: LIB3280-015-P1-K1-D6
cccacgcgtccggctgatgagcctgctgctgatgttgaggaaaaaagtgaaactcctgaggtgaaagagccagaagcggaagaaactgttcctgctgcagaggaaagcgatgcggctcctgaggaaactgaagagaaaccagaaattgtgattgagacggctccagcagattttcgtttccccacaacaaatcaaacaagacattgcttcacacgctatgttgaataccataggtgcgtagctgcaaaaggagatgatgctcctgagtgtgaaaagtttgcaaagtactaccgatcactatgcccaagtgaatgggttgaacgttggaacgagcaacgggggaatggtacgttccctggacccctgtaagcttcagtggcgctggaaggacaaacatgccatcatccccacctccctggtgactggacaaagttactttgtgcc

SEQ ID NO: 1799 - DNA, 143 bp, Triticum aestivum
  Clone ID: LIB3280-015-P1-K1-D7
cccacgcgtgcgcaatatcagcacgagcatgctgatgaggacagatgttacaaagggggggagcttttaccataatcgctgaaagctgcaactgcatcacaggaaatatatgcatctccagatgaaacttcaaagaaactaca

SEQ ID NO: 1800 - DNA, 437 bp, Triticum aestivum
  Clone ID: LIB3280-015-P1-K1-D8
cccacgcgtccggaccaaacacctttggctgctcccaagcccaacaccaagaaagaaaattttcaggttaaatctggcatatgggctgactctttgagccgtggattaattgatctgaacataactggaccaaagaaggtgaacctagccgatgttggggtcgtcggcggcctcagtgatgggttcgacgacaaggctcaaccctcatggaacatgggtgcagggggatctggccaaccctcatggaacatgggtgcaggggggtctggcctaggaatgtctggaattcctccgtctacgcaaggcggtggcatcgagagcttggcaaactacaacaagtatcagtttggtggcttcaaatgagctccataggagaacatttctagcacctggtgtttgttgcttttttgctggactgcgcctttgggctcttatta

SEQ ID NO: 1801 - DNA, 438 bp, Triticum aestivum
  Clone ID: LIB3280-015-P1-K1-D9
gatgcggacgtgatcttcgtccccttcttcgcgtccctcagctacaaccgccactccaaggccgtgccgccggagaaggtaagcagagacacgtccctacaggagaagctcgtcaggtatctggtggcgcagccggagtggaagaggtccggcggtgccgaccatgtcgtcgtcgcgcaccaccccaacagcttgctccacgcccgatcggcgctgttcccagcagtgttcgtgctgtctgacttcgggaggtaccaccccagggttgccagcttggagaaggatctcattgcgccataccgacatatggcgaagacatttttgaatgacacagccgggtttgatgatcggccgacattgttatacttccggggagccatttacaggaaggagggaggaaacattcggcaggaactgtataatatgctcaaagatgag

SEQ ID NO: 1802 - DNA, 443 bp, Triticum aestivum
  Clone ID: LIB3280-015-P1-K1-E1
gcgaggtcgagggttccgccgtgctcgcggcggcgtcctggctctcccaccactcccttatcttcgctgccgtgttcacccccgttgccttgattctcgtcggcgccaccggagtgcgctccgcgtacaacaccaggaaggatatcaaagaccccccgaaaactcttcaccaggttgcgcagatgatgctcaaggatcctgtcattgttggagcgcttgttttgctggtcttcctcccgctcataagtcatgaagatttggtggtcggtctgttgcctgtgaaagaatctcagagggaacatgttcgttcagtattgacggatgtagggtcattgggtgtcagcgcagtattttgtttcatcatgttgcccactacggtgctgaggcagtggaggatgaagtagtagagggttatgttgatgtgctgttgaggtatatacctg

SEQ ID NO: 1803 - DNA, 372 bp, Triticum aestivum
  unsure (1)...(372): unsure at all n locations
  Clone ID: LIB3280-015-P1-K1-E10
ggttgtttttttttttttttttttttggggcacaagctttattatttattcactacgaagtaaatgcagtgagcagggtacatagagaagttgtaacagaaaaacacctacgcgcgatccttattctactagttgggcatgtgaaacgccaaccacgcactaaatctccatgcaagggcctcgatcagtacttctcgatcagcggggggaagctttgctcattcctgaagaagtcctgaggatctaccttgcccttggtaaaggcgagcctttggaagttgctcttgaagtacttctcgccccacaccttgccgctgctgtaggttgagatgtcnttcaccaccttattcctgccgaggtcgatgtccctgt

SEQ ID NO: 1804 - DNA, 440 bp, Triticum aestivum
  Clone ID: LIB3280-015-P1-K1-E11
ccagccccaaaccccccttctcggccggccgcgacctcttcctccacaaaaatcctccccggaatttcgtcgagtcgccgatagccggccgccgatcggtcgattcgcggggggcgggatgagcttccaggacctggaggccgggaacggcgtccgcgggacgccgcggaggaacggccgggcggcgggggccggcgccggctcgtcgcaagccgtcgcgtcgggcgtcttccagatcaacacggcggtcgccaccttccagcgcctcgtcaacacgctcggcacgcccaaggacacgcccgacctccgcgacaggatacataagacacgagcacacataacacaactggtgaaggatacatcggaaaagcttaagcaagctagtgaggcggatcatcgtcttgaagccacccctaccaaaaagattgctgatgctaagc

SEQ ID NO: 1805 - DNA, 382 bp, Triticum aestivum
  Clone ID: LIB3280-015-P1-K1-E12
cccacgcgtccgaaaaattatagatcagacagcaacctaaacatccacaaaaattcgtagagggaattaattcacgtacagctagatgcagccgcctacctttctattcgtgccacgcaaaatgagcttacaggacctggatttccatcactgtgtccgcgaaacaccgtatgagaccgaccttactgttctagccagagacctctcaaagcacagctgcccttaaagcgaatagcccatcaccacatcgccccttccaacagcagcgcatctctgaataggctaatggcacccgccctctcgcggcacattaagcgcagcttatgtggtagttacccgcaccttgtccattacatttaccagacctctaacacccgatcct

SEQ ID NO: 1806 - DNA, 131 bp, Triticum aestivum
  Clone ID: LIB3280-015-P1-K1-E2
tagactagttgtatatcatcatgcagcgagcaaggtatatgttttttgcgccattacaggaggagaggtgttcgataacggcccggacccattgaactcacaccgcctgcgcaactgtcgctgcgagccaa

SEQ ID NO: 1807 - DNA, 427 bp, Triticum aestivum
  Clone ID: LIB3280-015-P1-K1-E3
gttgaacatcagataatggtggatcacagcactgggcgttcaagaggttttggttttgtcacttttgaaagtgaggattctgtcgaaagggtcatatctgagggaagaatgcgtgatcttggtgggaagcaggttgaaataaagaaggctgaaccaaagaaacatggaggtgatcacagtagcaatgggagatctagtcactctggtggtggtggttaccgtagttcttaccgtagtggtggagctgctggtggcggcggcagtagcagtggtggtggtggtggcggctatggctatggtgctggtcatcgatctgctgctgcaggaagttattatgatagcacgggatatggttatggtagaggaggctatggtgccgcagccgctgccgccgcctatggaggcaatgctggatatgggtctggtt

SEQ ID NO: 1808 - DNA, 403 bp, Triticum aestivum
  Clone ID: LIB3280-015-P1-K1-E7
ggttcgtccacacactcccgccgccaccaccgccgcgaaccggagagcgaggccgacaccgccgccgcgatgagggccaagtggaagaagaagaggatgaggaggctcaagaggaagcgccgaaagatgaggcagcgatccaagtaggcggtaagcatcatcttgcatccaggcagcggaactctgaggggtgatggcattgtctagtgattcttgatttgttctgttgttttggctgtggaagttgcttttacctgtgtttggtcaaatttagttgtttaatactagtctggctatgttccaggactgagttttatgtaatgtgaggattatatgtgtttgtgacctaattttatgcacctattatccttgaggtactctgaaatgtgccttttggccctgc

SEQ ID NO: 1809 - DNA, 379 bp, Triticum aestivum
  Clone ID: LIB3280-015-P1-K1-E8
ggatcaaatattacactgtccacaaatgcaacagtaccacttaacatacaccacctaagcaacagtaccacttagcatacaccaagcaacagctagtcagctaccacatcataacataagtagagcagatctcggctaccactacatcataacacaagtacagcaggccaaatgagttcagatctcctgtcagcatcagcctttcaaggtcagaatcgacgacggaatagggaccaggcaacactcacttccataatacatgagccaaccttcagcacaacaggacttataccggccatctcaggttttaaggctacctcggtactgtcagcaacttcatcatcgttaataggatatgccatggcagagactttgagca

SEQ ID NO: 1810 - DNA, 433 bp, Triticum aestivum
  Clone ID: LIB3280-015-P1-K1-E9
cgccgtcactccccgccgctccaactcgcaccccgctgcccgcctccgcctccgttgctgctgctccgccggcgatccggcggcgatggtgaaggccatcagggtccacgagctcggcggccccgaggcgctgcggtgggaggaggtggaggtgggcgagcccggtgacggcgagatccggatccggaacaccgccatcggcgtcaacttcatcgacgtctacttccgcaagggcgtctaccccgctcccctccccttcacccccggtatggaagctgttggcgtggtgactgccgtggggcccggactgaccggcaggaaagtcggggatgtcgtcgcgtacgcaggcaagcctatgggttcttatgctgaagaacaaattatttcaaccgatgtcgctgttcctgtcccgcctaaggtggatcacaagaca

SEQ ID NO: 1811 - DNA, 417 bp, Triticum aestivum
  Clone ID: LIB3280-015-P1-K1-F1
cgagtagccgtcccaatcctcgatctgttctcagaccctcctccgtccgtcgcagctccagatgtccttccccatggctccgatcaagatcggtatcaacggtttcggccggatcggcaggcttgtggccagggttgcgctccagagccccgatgtcgagctcgtcgccgtcaacgaccccttcatcaccaccgactacatgacctacatgttcaagtatgacactgtccacggacagtggaagcaccatgaagttaaggtgaaggactccaagacccttctcttcggtgagaaggaggttgctgtgtttggctgcaggaaccctgaggagatcccatgggctgctgctggtgctgagtacgttgttgagtccaccggtgttttcaccgacaaggacaaggctgcagctcacattaa

SEQ ID NO: 1812 - DNA, 391 bp, Triticum aestivum
  Clone ID: LIB3280-015-P1-K1-F10
gcagcaaaatccacattgctcaagggttcaaattacagagacaaccgcacccgcttacacaactgttaaaatttgttcttttcataacgcgcatacaacacgtttttgcacagcaatatcgctagtacatggatgtcatgatcttacatgtcaaacataccaagtccaccacatgagtatcctactcacacattgctttgcttgtacagcttcgtgtccagcacttgcttgccacacatcgcacacaccccttttgaataggcacaggtgtggcagtatttaccgtcctggtgcacctgttgcttacagattatgcatttggtatttccataaggagtccacctgctcttcttggagaggagcttgttctcgttgatcttgcggccgctct

SEQ ID NO: 1813 - DNA, 347 bp, Triticum aestivum
  Clone ID: LIB3280-015-P1-K1-F11
ccagcaaactggagagggattaatgtttcaaattacagatacatcctgcccctcttacacaactgataaaatttattcttttcataacgcgcatacaacacttttttgcacaataatatctctagtacatggatgtcatgatcttacatgtcaaacataccaagttcagcacatgagtatgctactcacacattgctttgcttgtacagctttgtgtccagcacttgcttaccacacattttacacaccccttttaaataggcacaggtgtggcagtatttaccgtcctggtgcacctgttgctaacaaattatgcatttagtatttccataaagagtccaccttct

SEQ ID NO: 1814 - DNA, 444 bp, Triticum aestivum
  Clone ID: LIB3280-015-P1-K1-F12
cccacgcgtccggaaagacacgccgcattcgtaacgctagctcccgtgttgcctagcgcggtactgattaccgagccgttgggagctgagagctactcggtgcagctgagtgctcctctgtcctctccactcctcccctctcctctctctcgcacgagaaggatagatagacctcacctctccctctccccccaccgtgctcttggggtagaggcgccgagatggagcatatcgcgaggttcttcttcggggtctctggcaatgttatcgctctgttcctcttcctgtcgccggtcgtcaccttctggaggatcatcaagaggaagtcgacggaggacttctccggcgtgccatacaacatgacgctgctcaactgcctcctatccgcatggtacgggctgccgttcgtgtccccgaacaacatcctggtgacgacgatcaacg

SEQ ID NO: 1815 - DNA, 225 bp, Triticum aestivum
  Clone ID: LIB3280-015-P1-K1-F2
gattcgacgagaagtgatgaacagtgtgtgatgtggcatactgactagagtaggtacatagcaattcaaaacggaaatcctaaaaatccgacatcagattttaggcatggcaaatcgaaagttttcatgccaatttatgttgtcgcaggaatagcaattttctactcccttcgttcctaaatatttgtctttctagaggtttcaacaaacgactacatacggagc

SEQ ID NO: 1816 - DNA, 226 bp, Triticum aestivum
  Clone ID: LIB3280-015-P1-K1-F3
gattcgacgagaagtgaggagcgagtgtgtgatgtggcatactgactagagtaggtacatagcaattcaaaacggaaatcctaaaaatccgacatcagattttaggcatggcaaatcgaaagttttcatgccaatttatgttgtcgcaggaatagcaattttctactcccttcgttcctaaatatttgtctttctagaggtttcaacaaacgactacatacggagc

SEQ ID NO: 1817 - DNA, 446 bp, Triticum aestivum
  Clone ID: LIB3280-015-P1-K1-F6
tccacgcgtccgtgattcctaacaagccgagcagaatcgcgggcgcacagtgcccggagaggagcgtggtcagtggagcagaccacgctgcagccatgtcggtgcaggagtacctagagaagcacctgctcccgcgcaagatcgaggaggccgtgaacgcggccgttcgcgccaaggccgccgacccggtgctcttcatctccacccacatgcggcgggcggcgccggccgtgatcacgcgggtgtgcgcgcggcagatcctggacagccgcggcgcccccgcggtggaggtcgacctgcacaccaacaaggccgtgcaccgcgcgtccgcggcagggccgggagcccccgagggcgtcgaggtcgacgccacgagggacgtcgagaagcggaggctcctcgccaaggcggtcgccgactcggtgcggctgatcaacggcaaggtg

SEQ ID NO: 1818 - DNA, 437 bp, Triticum aestivum
  Clone ID: LIB3280-015-P1-K1-F8
atctcacaccatgcccatcgcaatgccttccatgccggctccggcactagccctggcactgctcggtgctttcggcctcgccatcgccccggctgttcagtcggcccccaccatcgaggccatccaagctacatgcgccaagacaatacagccagactcttgcaaacacgtcctgctcgccaacatggccgccggctcaccggaggtgaacagtgtccccctaatgtccctgcaagtcgcggcaaagctcgccaagatggccaacggcttcgccaatgccaggctcaccacggacccgcaccccgccaaatgcctcgcaaactgcatcgaagaccttcatagggtggccaaggcatttgaggggatcccagtggaggcggttaagcctggcgacgaggcgggggggctgtccttcagctcggagttcaagccgacat

SEQ ID NO: 1819 - DNA, 410 bp, Triticum aestivum
  Clone ID: LIB3280-015-P1-K1-F9
atctcacactatcccaataaaaagagagtagcgagcgagatagaccgctagagagagagagtgtgcggaggtgcttgtctttccatcggcgttcatggttattaacgccataccctctacgtcagctacatttcctgcaccatggctgcacggggagaaatgcgcagacactactttttccaagaaatgggcaaccgactcacacagagggtgtccgcgtgcgagaaatcgccttgctaggtgggagatctgtcgaaagcaatctcatcgcattgtttcatacgctcattacctcggtctttctcctaccctatcactgacatcactatagtcctaagcttctactacgtccccacccattacaggtgtctccttcctcagcctcttttttacttgacttggccactcta

SEQ ID NO: 1820 - DNA, 437 bp, Triticum aestivum
  Clone ID: LIB3280-015-P1-K1-G1
gcagatggtcagcctcacgctccgcgtcctcgcccgccccgatgtggaacgccttcctgaaatcttcaccaacctcggcctcgactatgacgacaaggtgctcccctccatcggcaacgaggtgctcaaggccgtcgtcgcccagttcaacgcagaccagctcctcaccgatcgtccccacgtctctgccctcgtccgtgaagccctcgtccgccgcgccggcgagttcaacatcgtgctcgatgacgtcgccatcacccacctcgcctacgggaacgacttcgcccaggccgttgagaagaagcaggtcgcacagcaggaggctgagcgctccaggttcctcgttgtgcgtgcagagcaggagaggcgtgctgctattgttcgcgcggagggagagagtgactccgcacggctcatctcagatgccaccgctcttg

SEQ ID NO: 1821 - DNA, 348 bp, Triticum aestivum
  Clone ID: LIB3280-015-P1-K1-G10
tgatgaagtagcactctaggatggatcagatagatactaaaatgtccataccttctttagatgctagaaatagatccttttagctcacagaacacacatctacgaaggtatggacattttagtatctatctgatgaagtagcactctaggatggatcagtttcttactgagacatgatggtatatatctagtgatgtaatactggacatatgaacctacaaatgtatgcctatgtatatatctagacacgatggattgttgtccttttggatgtgatgtagtactggacttgtgaacctacaaagtgtataccaatgtatgtatgcagacatgatgtattgttgagat

SEQ ID NO: 1822 - DNA, 441 bp, Triticum aestivum
  Clone ID: LIB3280-015-P1-K1-G11
cggacgcgtgggggactgcagcctcgctggggctctcggattgatgaggatcctcatatacaaggtctacgtcgatggcacaaccaccatgtcgacccatgagaggaaagccagcatcaaggaattctatgctgtaatatttccttctttgctgcaactgcaaagagggatcactgatatggaggacaagaagcagaaagccgtgtgtatggagaggtacagaaggagagatgaagacgaaacaagcagcttatctgatgttgatgctgagagggaggaggaatgtgggatctgcatggagatgaacagcaaagttgtgttgcccaactgcacacatgcgatgtgtctcagatgctatcaggactggaactcgaggtcacagtcctgcccattctgccgcgacaactagaagaagactgaccctggtgactagtggattac

SEQ ID NO: 1823 - DNA, 257 bp, Triticum aestivum
  Clone ID: LIB3280-015-P1-K1-G12
tgggagggaagcgttgcgtgcgcctcacacgtgcggtaagacaccctggattcgtaacgctagactgccgcgttattctggcgtggaactgattaccgagccgttgggagctgatagctactcagtgcagctgagtgctcctctgtgctttccactcctccctttttctttctttgctacgagaaggataaatggaccctacttttccggtcacgaccaacaagctcttggggttgaggcgctccaatgggacatat

SEQ ID NO: 1824 - DNA, 439 bp, Triticum aestivum
  Clone ID: LIB3280-015-P1-K1-G2
ccttgcaaagcaaattatagaagcaaaatatcaggagtcaagtgaaggcaatgacaatcctgatctgaaagaatctatatttagagaggtcacttctcctattttggcaacagctaaacggcatgaagggtaccaaacgttgtggcagatttgctatgatatcagtgatacggttctcctccgcaatcttatgcatgatagtataggacctcaggggggattcagtttctacgtttttaaacagctaatcaacagccggagttccgctaagctgttaaggctgggagaagaattccaggaagagctagctaattttctgaaagaccgtagcgatcttttgtggctgcacgagatatgcttaaatcagttctcaactgcttcagagactcttcatacctgtgctctgctttcaagtcctggagaagatgctgacctaaca

SEQ ID NO: 1825 - DNA, 320 bp, Triticum aestivum
  Clone ID: LIB3280-015-P1-K1-G3
aattttaggagttaagtgaaggtcttgtctttccggaactgaccattctcttttaaccgagggcatttttactaccgagcgactgctgaattgaatctaggcaattaaacgttctggccgttcttcattattgtcaccgatacataactactgggcgatgaactacctcgtacgcttataccacctacgggattaaatgtctacgattttttgccggtaaacttcgacctgaggggccttacgctcttgccgatgctagaaaagttctagccaacgccctgtctgccggtgtaagccttttccgagtagacgccgctctt

SEQ ID NO: 1826 - DNA, 420 bp, Triticum aestivum
  Clone ID: LIB3280-015-P1-K1-G4
cagctaataaaaccgtcatcaataatcccccgccaccccgccgatctccaccgcaccaccgtccgtccgaaatggagatgaagaagatcgccttcgccgccctcctcgcggccgcctcggccaccgccgtcatggcctccgaggctgcccctgccaccagcgacgcctccgaggtggcaatcgccccggccgccctcgtcgcctccctcgtcgcatatttcctctactgaagcagcggacagtaggggaggagttaattactagcattcattggccgcttgtgtgtatacatgcgaatgatgcggtgtaatttttattgttttcgtcttgatgagcacggttaaccgctgataggtacgtgatacatgtacttgtatcgggtggatgcttaaccgtgctgaacatgttcattttctcttt

SEQ ID NO: 1827 - DNA, 444 bp, Triticum aestivum
  Clone ID: LIB3280-015-P1-K1-G6
gcggcctcgacgaccgcttccagcacgccgtgccacacatgaccagcgggcgccttcccaccttcatcaagctccgcgcctttcttcagctcgaggagcaacggctcgcccgtcaggcacgcgtcgccgcccgctccgcccttctggcgcaggcgcacgcgttctacgccgctcgccctccagcaccggccccctccttccacatggcggcgcccggtgttcaaccggcaggtgcggggccctccgctggttctccagggtcgcgcggtcgcaagaagcgcaagcacaactcgtcttcgggcgccggctcctcctccggcgggggcgtgcccgctctcggtcaccatggcgctggctcacgccctcctgctcccactactgttgccgggacgttccagggcatcctcggggcgcgacctcctgctcccgcgacccaccacgcgc

SEQ ID NO: 1828 - DNA, 434 bp, Triticum aestivum
  Clone ID: LIB3280-015-P1-K1-G7
gtaccacgcccattggacatctcatcatctggtgcatggttgagagagttatgatgtacttgatccactgtacataaagaaatgtgcacaccctcctagcagggaacgcgatgaggccatcgcttggaagctccatggtgctctgttcaattgctcgacagaattctacgctggctggccaacaagcaatgaggagtctggatcttgtgtggttcatattgcctgccactgtgaccgcgacaaacttatgctgccccttacaaagatgtactcgccgtccaaagtgggaatctctacacgagtgcctgaagctcaagggaaacttctctttcggcaccatgcactatatatggaacattcttgcgccgttggactctgcgttcgacctctcatccattcctactaccgcaacatgtccggttgtcctgattcag

SEQ ID NO: 1829 - DNA, 437 bp, Triticum aestivum
  Clone ID: LIB3280-015-P1-K1-G8
cgcacctccacattctgcctcccacctctccggcgagatctccctcctccccgcgccggagccagccatggacgccgtggactccgtggtcgacccgctccgggagttcgccaaggacagcgttcgcctcgtcaagcgctgccacaagcccgaccgaaaggagttcaccaaggtggccattcggacggccatcgggttcgtcgtcatgggcttcgtcgggttcttcgtcaagctcatcttcatccccatcaacaacatcatcgtcgggtccggctgatctcgtctccgcaggtgaggtgcggcaggactagaggatgttgtccattcatgggggcggcaaaccaattcatttaagacttcattgtagaggacattttcccttgtgttttcatttgaaacagttgtacctggagcagttttgaacctgatactggcta

SEQ ID NO: 1830 - DNA, 457 bp, Triticum aestivum
  Clone ID: LIB3280-015-P1-K1-H10
ccacgcgtccgggccgagaaaaatcgccgccccaagcccccaacactcctgccgcgataggggtctccggagtaggaagagctgcagcccgcggcggctcttctcccctgcaccccgagctccaatggcctcactctgggagccgaagcagtcaaggcgtggtggtctcaagcacagcgacgccgatcctgatagcgccctggccacgacgccgacggcacgccctcacgacggtcatgcacatgagcgataggagagggtggcaccaactatggctgcggcaccgatgagttcgcaagacgagccctgctgcatcgacgagccctgcgcggcatcggcaagaccggtataggttgccgcaccggcgagctctgtggtacatgcgaccatgccggcgcagttcctcaaaattggatgtgtgcactcttgcaggctggtgatgacaaccatcttggac

SEQ ID NO: 1831 - DNA, 446 bp, Triticum aestivum
  Clone ID: LIB3280-015-P1-K1-H11
gtatcatgtgtttccccaggaaggaaatgctaggataactgaaaagaagcttgcactcagcatgattcaacagaaggtggagaacctcaagatttcgcttgaacatttttgcaacattaaaggtgatattagtgaagtcctcagggttgctgaagagcaattgaagatgagaaatcagtgtcgtatcatcaaccagcaagcatcgctctgggagttgaaagacattgttaaaagggaaaataagcgtgatgtcattctcaactatcgcaatttgctcttacaaaggatcatcttaaaccttagtgatatgtcaaccatatttgtgagtaactcactgatgggaaccaaaatagaaaaggcatttcccaatttgaaagcaactgtggcattcaatttcgttttcaaagctgaggagaatcaaagacttagtgacttacgatccttgc

SEQ ID NO: 1832 - DNA, 386 bp, Triticum aestivum
  Clone ID: LIB3280-015-P1-K1-H12
ggggggtgatacaattgatggtggagaacctgattatttcggtagaacattttttcaacatttaaggtgatattagtgaagtgctcacggttgctgaagagcaattgaagatgagaaatcagtgttgtatcattaaccaggaagcatcgttcttggagttgaatgacattggtaaaagggaaaattagcgtgatgtcattttcaactattgcaatttgcttttacttaggatcatcttaaaccttagtgatgtggcaaccatattttggagtaacttactgattggaaccaaaataaaaaaggcttttcccaatttgaaagcaactgtggcatttattttgtgtgtaaagttggggatattaaaaatttattgactttacattctt

SEQ ID NO: 1833 - DNA, 323 bp, Triticum aestivum
  Clone ID: LIB3280-015-P1-K1-H2
gggaagcacggggatcattttctccatacaatgtacagtaaatttttttaacactccatacaatgtgctggtgtctgcatacggagacacgaacttactagccttatttaaccgctttggtgctggtaaaccgtcgatcagtccttcagctgcaggctgggcatggtgtattcgccgcacttgtagccgatggggcggtcggccaggtcgcagcgcttggggatggtgatggccacctccggtttgaccccgacccggcgcacgatcttggagagcagcaccgcgcaaaggcacgcggggctcctttccccgatctccttcac

SEQ ID NO: 1834 - DNA, 343 bp, Triticum aestivum
  Clone ID: LIB3280-015-P1-K1-H3
acaccaaagtacgagttgccattacaagacctcccagtcaaactgggaacacatgctcaggtgaaacagctacaaccaaagattaagagtttcatgacaacagccgtgcttcaatctttaacaacagtccgcaggattttcacttcattgatgggcctatcatttttgtcggtctgaatacaaacggaagccagggtctctatcactcttgcaccttgtcattcactggatggttagcacacaatttttgggagaagttgcagcggaatggaagttcgacagcgccttgtaagtattgagaccgaaaaaaatgatcgtgttatcaatgaagtgaaaatcctgc

SEQ ID NO: 1835 - DNA, 139 bp, Triticum aestivum
  Clone ID: LIB3280-015-P1-K1-H4
aaaaaggaaattaatatattctcaaattaatttcattacaaaatacgtacatacataggtggggacatttagtacacatgatttatagtttccccaatttagttggggccgggggatttactttttatttataaagtaa

SEQ ID NO: 1836 - DNA, 392 bp, Triticum aestivum
  Clone ID: LIB3280-015-P1-K1-H5
cggacgcgtgggtgcgccttctcgccagccttcctcgcgcgtcgtcgggcgaccggcgccgccgccagcgaccatccaggtcacgccaccgccccctgccttctctctttcctctctctctaatctcctcatatctccttctccgcaggagctcagcgctagcgccatggatgcccagtcctcgagctcaccttggaggttcgaacgccgccactggacctccaccggccagatccggcgcctctctccccggatccgcgcgccctccaccttctctacctgatctggcgccccacccacctttccacgacgccccgcgcgccgtcagccgccttctgccccatcccgcctcaatacgcgccgtcgggcacctcatgcctcccaatcccatc

SEQ ID NO: 1837 - DNA, 175 bp, Triticum aestivum
  Clone ID: LIB3280-015-P1-K1-H6
cccacgcgtccgcggacgcgtgggcatccacagagagcaaggcaggcaatcgcgtcgcgcgtcaccaccgtcgatccccccgtccgtcgaggtatgagacaggaggccgccaacctggtgatcacccacgaagacgacggcagcaccacacaccgccgcgctccgagggagagag

SEQ ID NO: 1838 - DNA, 402 bp, Triticum aestivum
  Clone ID: LIB3280-015-P1-K1-H7
cccacgcgtccggtgggtcgaaaactcccgaaccccctagaacaggacacgcccccaccgaccggcggcgaggaagaggaggaggacatggcggcggcgcgggggcaaaaggcgctggcgacgctggtgaggtcgctgcggagcgattccatctccaactccaacgctcccaggctcaggcacctcccgtctctcaagaggaccttctcgctctacgaccagatcaacctcatcgacaccgtccccgaagaccagctccgcttccaaacttacgatgacactggattcaagattaacaatgtaaagtatgaagggagcttgctgatagtagaaaacaagataatgacctggacacccaaaacatttgcggatataactgctgaaagtttatcaatcttcaaa

SEQ ID NO: 1839 - DNA, 389 bp, Triticum aestivum
  Clone ID: LIB3280-015-P1-K1-H8
ccgcagagcacgccatcgaatcgaatcgagcgaaccaaagccaagaagagtttcctggttgctagcgccgccgagcagacgacgacgtcggcgatgggcaagatcaagatgccggccctgttccgccgccgctcctcctccaagtcgcggtccgcctcgccgccgccgccgcaggacgagcagcaggagggcacccggcctgcgtcgggcgcggggtccccggcgcggtcggcggaggaggagatggagcgggtgttccgcaagttcgacgccaacggcgacggccggatctcgcggccggagctggccgccctcttcgacagcctgggccacgcggccacggaggacgagctgacccgcatgatggccgaagcggacgcggacggcga

SEQ ID NO: 1840 - DNA, 57 bp, Triticum aestivum
  Clone ID: LIB3280-015-P1-K1-H9
attcccgcccgacccacccatccaaatacaaccctccataacaataacttattcttt

SEQ ID NO: 1841 - DNA, 261 bp, Triticum aestivum
  Clone ID: LIB3280-018-P1-K1-A1
gtctcgtccagtgaccccttcttataaaaatgtaaacctgtttttcttattctttaaaccccttatatagattgtagtagttgttatacttgtacatataataacaaacaactgaaataatgagaaaccacgacgatatggttgtttcaaaaaaaaaagaggactccattatacacaaaaagcataaacgggccgtaggtgtagagaaggaagttttcttcacccgcgacggcgcctcaacccttttcatctgcggaaaac

SEQ ID NO: 1842 - DNA, 232 bp, Triticum aestivum
  Clone ID: LIB3280-018-P1-K1-A10
gatccccctcccggcgccgcctccagcctagggtttcctcccgccgcccgtccggcccacccgtcgtcatggcccggcgcagcggaggaggaaggtcttcccgccctgcttcacgtgctgctccagtgagaaacccaccagctccagcccgtgcagctccttcacctgctaccacccatagtattggtgttggtatcatgagcgtggatgtgtccacctttgttcagggcat

SEQ ID NO: 1843 - DNA, 361 bp, Triticum aestivum
  Clone ID: LIB3280-018-P1-K1-A11
aacacaaaataacactggcggattcaagatgctgcaatacatttttagggcagccaattggattccaggaacgcaaagcaattccaggtcatgttgtaaccatcaatttgctgccccttgactactcccaagtttggtcctagtctcaccatgtacatcaatatgggtgtatgctataacattaggatctattattagaatatgcactagaatttatccaaaagcaaagacaagctaacatcaagtgctttatttggctgaagaaagggaccccatgccatgaggccatgacttgctttgtcataagcccgctgtttgaaccgcaagatatgaccaggtgttgtgtgatccagattcttaa

SEQ ID NO: 1844 - DNA, 435 bp, Triticum aestivum
  unsure (1)...(435): unsure at all n locations
  Clone ID: LIB3280-018-P1-K1-A12
gacccacgcgtccgcccatccgcgccgcccgccgccgcatcctgctgncgggaccagcganggcccctgccgggctcatgaccgcggcggcgacagctgcgangatatcgacctatgccaacaagatcaccgtggtcgcaggcgctgcaaccagcgccggcacgattggatggatggccgccgactatttcaggaaggtgccctgcccttcatgcaccaagatggtcagggtgcgggacttcatggatcacgcgaggggccacaccttccagtgcccctcgtgccaagagcatgtcaagttctctgatctggagaagcatgcgcaacaccatggtttccgctgcccagcctgctacgacgttgtcccgctcgccgactttgggccttacctggaacggcacaggcgccaggctgacgatgagagagcaaggcaag

SEQ ID NO: 1845 - DNA, 343 bp, Triticum aestivum
  Clone ID: LIB3280-018-P1-K1-A2
cgatcatctccacaaccacaacagcaggatggctaacaccaccagctccaccgccctcctgatcgtcctcgtcgtcctggccggcctcgccgacttgcacgctgccacagccgacccgaggcccgttcacgcctcggaactctcggtgccggcatgggtgaccgggcagccaatgacggccccggagctggaagggatgatggagtgcatgatggggtgctggacgacggtgatgggttgcgtattcgggtgcgtggccaagccccccgccgacatgccgctctgctggttcgcctgcgaccagacctacgttatgggcatggtcaaatgcgccttcacgccc

SEQ ID NO: 1846 - DNA, 363 bp, Triticum aestivum
  Clone ID: LIB3280-018-P1-K1-A3
actaaacatcctaatcaagatcatgatgaaggtgatcgtggtggaggccctcgtgttcgccacctatggaggcatctatggagggattctctagaggtttaatatcagctttataattgagtctgtagggagggcgctacttaatgtacatcttaaggtacatgttaaggagatgccccagatgagggccacattgtgttgtacatggtgttgcggatggatgtgcgcactcatgtaggaactagtctagtagctattatggtggctgcagaggtgggcgaatagggcagccattcgaacggtcatgactcaggtgtggacgaaagtgtatttggagtgataatgaggatgacgacgacgatg

SEQ ID NO: 1847 - DNA, 438 bp, Triticum aestivum
  Clone ID: LIB3280-018-P1-K1-A4
gcgagccgaaacgtcttggaagcggggcggcgtgccatcggtgtcgatctccacttgcatggattcgaagcgcggcagcgtggttgtggacgaggggcgcgacgtccatggcgctcaagctttggcgaccatgctgataaaactggcccatcttcgtcccccacatagctgacttgtgctgcaaagactggattccctcaaaggaaaaaaaaaattgagactgatggtggcagaatgacgaagaagcttggtcatctctcttctgttactattgctggcattaggcctcgagcgtcaggatcatgagtagggtgtggaggctgtcgggctgcagtcccatggagttctatgcctccatatataggaagtggatatagttgaagcgccatatccaattcatcgacctcgccatgatgagggaggaaggtggtgaccaat

SEQ ID NO: 1848 - DNA, 221 bp, Triticum aestivum
  Clone ID: LIB3280-018-P1-K1-A5
ggtttgtgttttttttttttttttttttggttttttttttttttttttatttttttttttttttttttcggaacaaaaaaacttttctttcaacaataaaaacaaagcccacctattccccagggtgttggtttcttacaaaaaaaaaaaaaaacttgtttaccccggataaacctccccccgtcccaggcccttgtttcccgtcccttatcggggggtaa

SEQ ID NO: 1849 - DNA, 441 bp, Triticum aestivum
  Clone ID: LIB3280-018-P1-K1-A6
gaagatgtctggcgtttcctggttcaacttggtggacaggtgctgatcgtcgtcaggctgcgggggcgcgtcaaggttttcaagtacgacgacgccgagcccgtgcccgtcgagagcatcggcaggcatgccatcttcgtcgggcaccacaggtgcctcgccgtggacgccgacaggttcccgtccgtcgaggcagactgcgtctactacattgatcgacggggtttgtcagcccacatctgcgtgtacagcctcagggacgggaaagaggagagggtctctgctggggccgtcgatttcgtgaagccgcacaagctgttcgtcctcgtcgccgaccgccctttcaccgtcatccagcttctctgcagctacaccatcaacgcccgggattctcagctgcctttgaaagaagacgctggcaacgttgacaaaaaatggttt

SEQ ID NO: 1850 - DNA, 365 bp, Triticum aestivum
  Clone ID: LIB3280-018-P1-K1-A8
gcgtcacggtcgacactcctcgctctctctccgatctccaatcctccacctcgcacacgcgcgcgcaaccgggcacgatgcgggcgatctcgtcggcggcgggagggatgctgcgggcgcggctgcgcgcggcggtgcgcctccgcggcgggcacggcgacggcgggggccgctggacgacgcccggccacgaggtgcggcccaaggggtacccgatgaaccgcacgccgccgccgccgggcgagtcgcgcaagtgggaggactgggagctcccctgctacgtcaccttcttgcttaccgtcgtcatccttggcgtcgggctcaacgccaagcccgacctcactcttgagaccttggcgcaccac

SEQ ID NO: 1851 - DNA, 410 bp, Triticum aestivum
  Clone ID: LIB3280-018-P1-K1-B12
gaggcgagcatggctgcacggagcagggccacctgccggcgaccgaccgccgtggccgggaggaggacgcccctccccattccgcgccgccattccccttctccgaagcagcgctcgagatgaagaagaagcagaagctggtgcagcagccctcgccggagatccccgacagtgcgctcgtcgagatcctgtcgcgggtgccctacaggtcgctctgccgcttcaagtgcgtgtccaagccatggctcgccctctgttccgacccggacatccgcaggaggtgcccgcagaccctgtccggcttcttctacaaccggagcggctgtggcctcagctttcgcaatctgtccgggagaggcccccctctggtcgacccttcgctcccgttcctacgagggcgctacgagcgc

SEQ ID NO: 1852 - DNA, 120 bp, Triticum aestivum
  Clone ID: LIB3280-018-P1-K1-B2
acgcgtaaggacaggtcctcggaggccatcatgctggccgggctggccttcaagaggaagtggcggaacaagatgaaggccagggggaaaggcaaagatctgcgacgaactttgctgacc

SEQ ID NO: 1853 - DNA, 250 bp, Triticum aestivum
  Clone ID: LIB3280-018-P1-K1-B3
cagggataaaaacatgtatttagtgctccggatcagggtggacgtcgacattgacacagaggtgttcgtgcacgcgtaatcggagatgagcacgctccgcatgttcagctatatgcggacgaggatcttgttgccctcttggacctgaacactgactaccttgtccatatgttacccggtcacgcccgcagattgtgcacgaggggtatgaagagcaagcccatggcgctcgaaaagaagctgcgcatgg

SEQ ID NO: 1854 - DNA, 133 bp, Triticum aestivum
  Clone ID: LIB3280-018-P1-K1-B4
cccaatttggtaagacccacgcgtccggccaaagccaataccgccagccgccttccttttttgttttgttttactaaaacaaataccggctgggtttatgtcatctgcggagacaactgtgattatgtttaac

SEQ ID NO: 1855 - DNA, 430 bp, Triticum aestivum
  Clone ID: LIB3280-018-P1-K1-B6
cgcgcagcgccgacgcctccgcgtccgccgggatccacggcctggcggtgctggccacgaggatcggcgtggaccacgccgccagcacggaggccaagatcgaggacctggcggagctcgaggccgaggccggcgccgaccgcgcccggttcgaccactgcctggagcagtacggcggcgccgccgacctgctccgcgacgcgctggacaacctgcaggccaacgtgtacggcctcgccatgcagcagctcatggcggcgctgggcgcgtcccggagctgcgaggacgcctggaggggcgccccggcgcgcgcctgtcccgtcgccgcccacgaccgcgagtaccagcgcctcgcccacatagtcatcggctttacccacgccgccgtcaaatgattatgcattgtcgccgccatggaccggatcgtcgt

SEQ ID NO: 1856 - DNA, 344 bp, Triticum aestivum
  Clone ID: LIB3280-018-P1-K1-B7
gaaatcataagcctgatcaggacagcgtgcctcctgtatatatttacaaggctcttggatggtacatggtggagctccagttggaaaggcaaagttctgtgacgaactttgttgacccaagcccttgtcttacaccagatcatttgtttccaacagctcagcgctgatcattgccaactgcattggctcgaaaacccttgctgtgaagtggacgtaccgtgtctgagtcgaacattactgtgatgtatgtattccagtgaaatctgaaaccattagggacataactacgctgtcacagaaatgcctgtcgtgaagtgacaatgtatcgaaggtaagcctgtctt

SEQ ID NO: 1857 - DNA, 307 bp, Triticum aestivum
  Clone ID: LIB3280-018-P1-K1-B8
caataaagctctgaaagaatcaccatttgctttccaaccacataaggttcaaattgaacagccaatcttttcgtacacaggtaatacacctcacactccacattatgaccacactttgcttataataaacctgtaaaagctcggttgtgttactactagtaagtatgcgacggcgtgcgcgacacagactaacagcagaatgcatctaccaacacatacaaaccacgcacggtagaatatatattgtacaaacaaactcggcagtagaagctgtagttgtatgtttttccatgagaggaagataata

SEQ ID NO: 1858 - DNA, 425 bp, Triticum aestivum
  Clone ID: LIB3280-018-P1-K1-B9
tagaagccgcagcttcccattcctcgccgccgccgctccgtacccgctcgaagccaacccgaccatggcggacgtcgacgttgacacggaggtggccgcgggcgcgcagccgaagaagaggacgttccgcaagttcagctatcgcggcgtggatctcgatgccctcttcgacatgtccaccgacgaccttgtccagatgttccccgctcgcgcccgcagaaggttcaagaggggtctcaagaggaagcccatggcgctcgtcaagaagctgcgcaaggcgaaaaaggacgctcctgctggtgagaagcctgagccagtgaggacacatctccgtaacatgatcattgtccctgagatgattggcagccttatcggtgtctacaatggcaagaccttcaaccaggttgagattaagcctgagatga

SEQ ID NO: 1859 - DNA, 436 bp, Triticum aestivum
  Clone ID: LIB3280-018-P1-K1-C1
gtgagctgctgcgacgacggcggcgagatgtacgtgaccagtggtgtgatgccgctgaagaacatgcaagtggagatcgatggtgcagcatggtgaagctgcagcgtgaggcaaggtggtgtggtcttggcgctgcaaagtcttggcaagtggttgtgggtgatctgcgttgatgataggagaatcaagattagggggtgaatgttagacttaatcttgattccatgtatctgcatatttagtttgctttcgttgtgcatgtaggataggttagagagtagctagtccggtgaagcttcagcggaggcacgcggagaagatgagatgtcaggctgccgtgcgacgcggcgagcacgaggagatgtcgatattgctatgcgataaggcaacgccgtgtgatgcggcaagatgcgaccgtggctggagcgtgacgggc

SEQ ID NO: 1860 - DNA, 369 bp, Triticum aestivum
  Clone ID: LIB3280-018-P1-K1-C10
gccggtggccgttcggcggctgggcggaggtggtggtggcgccgagaggtgcaaggaggtcagggcggaggcgcgggcgatggggcgggtgcggcaccccaacgtggtgcggctgcgcgcttactactggtcaccggactgagaagctcgtcgtcaccgactttgtcggtaacggcaacctcgccaccgcgctgcgtggtaagtaaaagtaacaccggtcacttctttttttttaacaaacactcggcaacttgcttactgctctttcgtttagaacgagactttttactgcttttggtagcataacttgaagccaaactcggttagattagttaatcattttaataaagggtgtgtttaagttctttt

SEQ ID NO: 1861 - DNA, 438 bp, Triticum aestivum
  Clone ID: LIB3280-018-P1-K1-C12
cggacgcgtgggtatttctcatctgatccgtccctcccgttcctctccgtcgtttcttccgcatgcgtctccatctgagcacgccgtcaacattgccgcctctaatccctgacttcttcacccagattgaacctgttgcaccacatgcttccttcccaccttgttgccggccacactatccactgcatggctcagatccaaatcgaaacacatgcgtgaccggctccatgatgcggccccgacgacctcgtcggcacggcatccctgcaggaggcggctccgcggctgtgcccaccacctctccaccgctgcatcaccaggttgcacggaggctgtagggtgtgcccaccatctccaccacccctcggctagtgaacgagcagttgtctttgatatgttctttctttttgttctttgatttgaatacaatttcacttg

SEQ ID NO: 1862 - DNA, 438 bp, Triticum aestivum
  Clone ID: LIB3280-018-P1-K1-C3
aacctagccgcgttctcctctgcggcacgcaacctttgtccccctctagatatagaacaacacgcctcgtccacccatacctctacaagtcagatctaggcctgacctgtagtttcctgaccgtgctcgcctcgatctcggggtaagctgaattcggcgtccatgatttgttccgatcacccgtttgttatctgattcccaggtttgtccttctgatcggcgagttggggcttgcggcgatcttggagaaaagacgggaggcaagctggatctgcccacggaagcttccgatctgcccggctggcgtctcagatctgttgctgttctgatgcttcacggcggatctggtttttcccggcggtctcaagtcggcgcagcggctggcggcgagttttccggcaagcacgtgggatcccgtctgctcctctacctcgtgcg

SEQ ID NO: 1863 - DNA, 293 bp, Triticum aestivum
  Clone ID: LIB3280-018-P1-K1-C5
ggggaataacacatggctttttattattctttccgagactcaggaagaaagagcagtttggggaactccccaacaaaaaatttgaaaggggaaagtgacagagcgactaacagagcaaactgcacattactcaggagtttcagcgactcaaaagggaagggttaaatttttgaaatggcattaagaaacttagccctgactaccatacaacaagaccagggtagagcgtcgcttaaaggtctaatgctttttcccacttcccaggagcaacatgatcccgttttgacaaactt

SEQ ID NO: 1864 - DNA, 430 bp, Triticum aestivum
  Clone ID: LIB3280-018-P1-K1-C6
ggcaccatcagcaacatggtgacgcaggcggcggtggtgcacatgctggccgagtgcgtggggctgagctggttcgaggactggggcaccaagacgctggccgagctgggcctccccctcatgaagaccagccggctcgtcaaggtctgcgaggacgacccggcgctcaaggcgttccggcagatgaggcggcgcggcgtcggcggcatcccggtggtggacggcgccggcaagcccgtgggcagcatcatgatcaaggacgtcaagcacctcctcacggcctccgagtccaccggacactacaggacgctgacggcgagggagttcatcgcgagcgcgcggcagagctcgggggagaagcagatgagcatcatcacgtgcaggagggaggacaacatgaaggagatcatcctgaagctggacgcggaga

SEQ ID NO: 1865 - DNA, 270 bp, Triticum aestivum
  Clone ID: LIB3280-018-P1-K1-C7
attttttttttttttttttttttttatttattttttttatttttttttttattttttttattttgaccttttgatacattaatgaatggggatataaaattaaaaaaaaaaaatgcaaaaaaaatcccgtttggaggggggaaaaaaaaaaaaaaaaaaaaaagtaaaaaggttttaaaaaaaaaaaaggggaatcccccccaggtctccggggggtcaggggcaaaaaaaaaaaccaaaagagaacccacggaaaattttggggccaag

SEQ ID NO: 1866 - DNA, 416 bp, Triticum aestivum
  Clone ID: LIB3280-018-P1-K1-C8
gattctagctttgaaaggggtgacccgattgaatttgaattgggcactggtcaagtgatcaaaggatgggaccagggtattttgggcatgtgcattggtgagaagaggaagctgaagatcccttcaaagctcggctatggggatcagggatcaccacctaccattccaggcggagcaactctcatattcgacacagagcttgtcgctgtcaatggcgagccatctagcaaatcagacgaggatgacgctgatctgtaggcagctcggcgcagcacgatctcccagttatcaaatcgaataggactatgtatgggaaacttactcttgtagggcagacacaatgaggcaggaacattgtcttaccatgatcaaacagaggagtcttagttcttaaaatcgaatagatcaagtgactt

SEQ ID NO: 1867 - DNA, 370 bp, Triticum aestivum
  Clone ID: LIB3280-018-P1-K1-C9
cccacgcgtccgcccacgcgtccggctgaaatttacggtgatttcttcaaaccatcatcatacttggaggagagagcgaaaagcggccgaccactgggcgcgccgaagacggctcagcaagctccgacgaggtcacgcatgtgaggttcagcatacgaggcacttggcacggtttttgcttgaacagcgtcaacactgccttcggcacatatgtggtggtactcagaaggacctccagggctgatacaacaatcagaataaataaatgtctaagcatactgttctgattgtagttccataactgtaaatctgtaactatatggtaatgtgattctgtcgcaagtagaataaagaccccgtgtatgctgtt

SEQ ID NO: 1868 - DNA, 399 bp, Triticum aestivum
  Clone ID: LIB3280-018-P1-K1-D1
aaaagaaacgtcattcacagatctagcaacgcattcatcagagaaaaagaagtggcccaacaagaaaaaaaatctttaaaaacccaccctctatgaccaaaccagaaagaaacatgctaaaggattcatgaatactgtttccgccggatcagctctcatggtaaggtgcttgtgtctgcttcctggcagatgaaatgctcccatttctcagctgtcatttgtggatcttgcttgtctcccccttggcatccgagctgacagagcagaaccaacctgcggccatccacgccttccactgcttctggagatggttagagcgcgacgctggacattttgccttggtcttgccccacttgtcctgtaagctctgcgaaccactcttcgtaatgatcggatatc

SEQ ID NO: 1869 - DNA, 172 bp, Triticum aestivum
  Clone ID: LIB3280-018-P1-K1-D10
gtatttaatatttggggtggtgtttaatttaattggtttatttaattattaatattttttttttttttttttttttttattatttttttttattttagggtaacttaaatataattttttttatatacaatgtgttaaataacttttttttatatatatttttgtctaatta

SEQ ID NO: 1870 - DNA, 416 bp, Triticum aestivum
  Clone ID: LIB3280-018-P1-K1-D11
agaagcagcaagcaaacaaagcaagcagccactcacacattagccaggagcaagagcaccagttcaggagcaggctagcgatggagaagtcgaccaagatggcggcgatgctcgtcctcgccgtgctggccgcggcgaccagcgccgaggcgaggaacatcaagacgacggaggcggcagccgccagcaaggacgcggtcctgcagccgacgaccttcccgcccttcgaccgcctcggcagcgggtcaccggcattcagcggcggcagcagcatgccgggattcagcctccccggcagcagcggcgccacctcgggcttcggcggcatcggcagcatgcccttcctcggcggcagctcccccggcctcggcggctcccccggtctcggcggcttcggcggcatgccggggtccccc

SEQ ID NO: 1871 - DNA, 167 bp, Triticum aestivum
  Clone ID: LIB3280-018-P1-K1-D12
gggggtgaaaacccctaaaaggatgcatttttaatttttgggggactgatttgaagatttgcccccaaaccccaaattttaatatgtgggttggttttggaaaaaaaaattctccttccaaaaaaaaaaaacattaaaaacctgggggggcctttttagagggtcaa

SEQ ID NO: 1872 - DNA, 426 bp, Triticum aestivum
  Clone ID: LIB3280-018-P1-K1-D2
cccacgcgtccagggatacgcttcattgcgcacaccccaggctagagtaatctcacactgaggtattgtaacgactcaattgaagaaaaagaattctcccaccaagaaaaaaaacctttaaaaacccaccctgtatcaccaaaccagaacgaaacatgctaaaggattcatgaatactgtctccgacgcatcagctcttatggtaaggtgcttgtttctgtttactggcagataaaatgctcccatttcttagatgttatttgtggatttttcttgtttcccacttgtcattcaagctgacagaacataaccaacctgcggtcatccactctttacattgttttttgagatgattataagctcgactctgtacattttgtcttgatcttgccccacttgttctttaagctttatgtaccacttttt

SEQ ID NO: 1873 - DNA, 405 bp, Triticum aestivum
  Clone ID: LIB3280-018-P1-K1-D4
gctgggctcatcacatcaggacctatctcctctggacagttgaactcatctggtgctctacggaaagtatcaggcactcttgattctactgtttcgatgaagatgcgtgccacctcttctgcttacaacccggctgttacaaatattaatgagcaaaatagctactcaattaaggccagtttgccaaagccaatactatgggcggctattctgctctttgcgatggggttcatagcaggtggcttcattctagctgctgttcataattcaattttgctggtagttgttgtggtgatatttggatttgttgctgcgctcttggtttggaacatttgctggggaacaagaggcatgactaggtttgtcagtcgctatcctgatgctgatcttagaattgcgaaagat

SEQ ID NO: 1874 - DNA, 442 bp, Triticum aestivum
  Clone ID: LIB3280-018-P1-K1-D5
cgagtacccaagcacaaaagcgcactcggacttcgactccggagccaacggagaaggtcgccaagcaacccaaggtggccccttcgaagcctcagaagaccttgcccaagatcaagatggacgttcctgttacctctggcgctgcaacttctacgacttccatggacgttgacaaggtccgaggtgatgaggaggccgatgacgcaaccacttccaaagctgctccgcgggacgtcattgaacttccggctgatgaagaagaagttcctctgaggaagagaaggaggaggggcagggcctcaatattggggaacgtagtaatttcaaaaaaaattcctacgcacacgcaatatcatggtgatgacatagcaacgagaggggagagtgttgtccacgtacccttgtagaccgtaagcggaagcgttatgacaacgcggttgat

SEQ ID NO: 1875 - DNA, 444 bp, Triticum aestivum
  Clone ID: LIB3280-018-P1-K1-D6
caaccatccacgacacacacagcacggcagcggcgtaaagggaaaactcccgcaagatgtctcagctcgcccgcgctagcctgactgcggtggcgatgctcctcctccttgccgctgctgcggcggcggaggggccagcaggctgccaggacgacgttgtggcgctcaacgaggcctgctaccagtacgtgcagaagggcgcgccgacggtgccgccgtcgcaggagtgctgcgacgccgtgcggcgcgtggacgtgccctgcgtctgcagctacctgggcagccccggcgtgagggacaacatcagcatggagaaggtgttctacgtctcccagcagtgcggcgtcagcatccctggcaactgcggaggatcgaaggtctgaagcaggaacaggccagctgaatggcaagcttggataacgtaagcagcgcagttcgcactgc

SEQ ID NO: 1876 - DNA, 272 bp, Triticum aestivum
  Clone ID: LIB3280-018-P1-K1-D7
cggacgcgtggcttcctgcgccactgtcactttcggacttccgcccgccatggggcggggccccacgtatcagatcctggtgcgtcttctcgacgggcgcaccatatgtcttttattatccacgcccaccgtcttcggcgccgtgctcctccaaactgactcgtctatacttttcgtccccgaaatcgtcctttgcatagttaccggtcgcttctacttttcgtacataaacgtacttctctttaacttttgattttcagttccttttcgtc

SEQ ID NO: 1877 - DNA, 413 bp, Triticum aestivum
  Clone ID: LIB3280-018-P1-K1-D8
gctgtgcctatacgtgagcttcagtgccgagtgagccatagtagcctagcctagctgactcccgcgatgagctagctggtggtgggagggcgcggtgggcgccgtcaagaagagccaggaggagcgcaccgagctctccttccagagcgtcgccctcgtcatcggatccaccggcatcgtcggcacatcgctcgtcgacatactcccgcgcgacgacacccccggcgggccctggaaggtgtacgccgtctcccgtcgcccgctccctccctggtccccgcagccctcccccgccgtcacgcatctgctcctggacctggccgaccctgtcgccgtggcggaggccctcaagccgctcaccgacatcacccatgtcttctacgctgcgtggtccaaccacccgacggaggctc

SEQ ID NO: 1878 - DNA, 344 bp, Triticum aestivum
  Clone ID: LIB3280-018-P1-K1-E1
cggacgcgtggggaggaagacctgatggacaagtttgcttctggtgtttccatggttgcctcactgtccctggcgatctcataccccaacatggctgctgcgccgcacatgttcctcaacgcatacaagaatgttgttgcggttgctttgtggacacactactcatatgaccatgccgataagagcaaggagtactctcaggacccgagcgagtttgccgctgctgcccctgctagtgctgcctccggtggtgctgccgacgctgcccctaatgaggaggagaagaaggacgagcccgatgaggaattagatggcgagattggattcagcctgttcgacaacta

SEQ ID NO: 1879 - DNA, 409 bp, Triticum aestivum
  Clone ID: LIB3280-018-P1-K1-E10
tcggagagcgataaccctttatttatttttttttgattaacgtatacagttattaaagactggtgtaaagacttgatgaagaacacgacagatactctgctccttacagacacaccgccgcaaaaagaaccaaccatgtgctttaataacaaagcgggggaggactcatacatattggacaaagccaaggacctcaataagtagtttatggttacactagcagtccagcactgactgctactaatgaacaaggtaagctccatatacctgtgactctatacacttcttttgctgatgagccaaagaccacgagttcggcaacaacaacaccccgatggctgttatttggactagaatatcattctcgatgtgtataataactatatattgttctacaactactactatt

SEQ ID NO: 1880 - DNA, 437 bp, Triticum aestivum
  Clone ID: LIB3280-018-P1-K1-E12
aaaccgttgagctgattgaaacatttatgaattatcaggagaacatccggagatgcgtgtgtatcgtgtatgacccatctaggtctagtcaaggagtgctagctcttaaagccctgaagctcacagactcttttatggatctgtaccgcaacaatggtttaactggagagaagctaagggaaaagaaattgtcatgggttgatattttcgaggagataccgattaaagtgtccaactcagcgcttgtcagtgccttcatgaaggagctggaacctgagtcacctgtttcacagtgtgactttgaccgtcttaaattgtcgactgcgccctttatggaaaggaacctagaatttatgattgggtgcatggatggtctttcatcagagcaaaacaagttccaatattactatcgcaacctaggaaggcaacagtcacag

SEQ ID NO: 1881 - DNA, 426 bp, Triticum aestivum
  Clone ID: LIB3280-018-P1-K1-E3
tggatcggaatgttgatgatcatcttcagtttgtattgggaacagaatcaggaatgatcacttcgattgttgctgctgtccggcaattatttgactcctatgaatcttccaaagaaggtgctagcattgaagtagaaattgtgttccctgtttcgtcagacgcaatttctaagacatctattgatgattcccatcatttcggctcttcagtagcgaatgatttagaacagattaatattgtgcctggtgtgttttctggtgaagggtgctctatccatggtggctgtgcatcatgcccttacatgaagatgaattctcttgagtcgctacttaaaatctgccagcagcttcctggtgaagacaacagtttatctgtttatcaggctagtcgattgaatgctaagacttcccttgggaaattggttg

SEQ ID NO: 1882 - DNA, 441 bp, Triticum aestivum
  Clone ID: LIB3280-018-P1-K1-E4
cttgatcactggtgcaattactgcctccagaagctgtaatctaaagccttctataagaatatcatcatggagtagatcaaaaagttggagcgacgagataacagtactcattgattctgatatgctgaaaagtttgccaaagttgagtcgccaggaacttgaagtagcatgtgaggattttagcaacattattggctcaactccggagactgtagtctacaaaggaacaatgaaggatgggcctgaggtttctgtcatatcattatgcgcctttgaaggtcattggactagccagcatgagctcttttaccaaagcaaggttattgatctggcaaggctgaatcatgagaacatagcaaagtttctgggctattgcagagagagtgacccattctccaggatgttagtctttgagtacgcatcaaacgggaccctgtacga

SEQ ID NO: 1883 - DNA, 438 bp, Triticum aestivum
  Clone ID: LIB3280-018-P1-K1-E5
cttgatcactggtgcaattactgcctccagaagctgtaatctaaagccttctataagaatatcatcatggagtagatcaaaaagttggagcgacgagataacagtactcattgattctgatatgctgaaaagtttgccaaagttgagtcgccaggaacttgaagtagcatgtgaggattttagcaacattattggctcaactccggagactgtagtctacaaaggaacaatgaaggatgggcctgaggtttctgtcatatcattatgcgcctttgaaggtcattggactagccagcatgagctcttttaccaaagcaaggttattgatctggcaaggctgaatcatgagaacatagcaaagtttctgggctattgcagagagagtgacccattctccaggatgttagtctttgagtacgcatcaaacgggaccctgta

SEQ ID NO: 1884 - DNA, 362 bp, Triticum aestivum
  Clone ID: LIB3280-018-P1-K1-E7
gtgaatcctaagggcgcgcacaggccgtccatttacgaggagctcaaatagatgcgggacgccatccccatcgaggtgcagcgggaggcgccccaagtccagcagctcatgtccaacaggtccatgggttctgtctcgatcaacaccgacaacagtgtggatttggagcacaatgcgtcgtttgatgaaatgctcatgcggccgggcctcagatagaatcaggattcaccaaagtcgcttttcgtgtaagcaaggaggagaggttcatgtgttagttaggctttctgtttgctggtaattatttgaaagctgtggatgacattagtttagcttggaagtacaaacttggaatttgatggtgt

SEQ ID NO: 1885 - DNA, 400 bp, Triticum aestivum
  Clone ID: LIB3280-018-P1-K1-E9
gatgaacttgtccattcattaaagactctgataaagtttgggtgaaggctacaacaatcagtagcctccttacacaaagaccgcaaccaaaatcaccacacatgcttgctttttattaagcgcccacgaggtcacacacacttgactcacgaactaaactcaattcatccctaataataataataaaagtgcagctaaaactcctaagattcaaccccgatggcgcgacacaatgagtctctagttactgcccttgctgatgagctccagggcggtggcggtggtgggcagcgccgggatggctcccttcttggtggtgcagatggcgccgcaagcgttcgagaactgcagcaccttcctcagcttggcctcattgtagaagatggagtcgtccttggag

SEQ ID NO: 1886 - DNA, 191 bp, Triticum aestivum
  Clone ID: LIB3280-018-P1-K1-F1
gagttatcctaaggaggcactcactgagaaggttcttttccagaactccgatcctgcttacattgaggtacatttagcgcgccagaataacaataaaacaccagtttacgattcagatacatagcacctagtcggcaaccaagaaaatctcagagaaggtcgtaaagacgtctcatatcatgataacagga

SEQ ID NO: 1887 - DNA, 154 bp, Triticum aestivum
  Clone ID: LIB3280-018-P1-K1-F10
cttattataactctaaatatagagccgggagctatctttcatatgtataattataaaataaaaaagtgtactaatacttttacaattacaaacacattcaacttattcaataggcataatcatgggaatataaaaggaataatgatggtgtttc

SEQ ID NO: 1888 - DNA, 438 bp, Triticum aestivum
  Clone ID: LIB3280-018-P1-K1-F11
caccgctgctgttaagcctccagcgatgtctgcgaccaatgctatccaagccatgcttacgcggtcgctctcactacagagcacttctgtagcaaatggacaacctcaggctgttgcggatcctggctcgatttgcaagcttcaggctgatcttcccatcgccaggagacactcccttcagcgcttcctggagaagcgccgtgacagggtggtgagcaaagctccttacggcgccgggaagccatccgaaggcctgggagcatcttctgggatggaagcggtcgcggagggcaaggcccagtaacactgaaagaagaaagacggccctgcccctgatgtttggaaggaaaggggcgtgtgttagctgatgtgatgttacaccgtagagttacaccgtagaatcatcgttcgtgacgataataatgatccgaccagaac

SEQ ID NO: 1889 - DNA, 431 bp, Triticum aestivum
  Clone ID: LIB3280-018-P1-K1-F12
ctacttcgccagcgccgacctcggacactgcaacgccggcgagaggctggtaattaacgggcgcgctgcctccccgccggcgccggcatcagcatcatcgccggcacaggcccccacggcaccgtcgtcttcacgaccgccgtcgtcatcgccgttctctccggcgccaggtccggccccgtcgatggagtattcatccgccgcgggtgggccattcgtggcgtccctcgctcgcgccatggcacaagctgtgacattggtcctggcctgctttatctgagcaagcctaagtaggttacgtaatttgttagtcagttaattagtgtgtgatgtgcgtgtcataatcagggaccgctcgatttagtatcacagttcgttttgatgtatcgtgcgccggcttctcatgtgtcagtaacaacaactatattttt

SEQ ID NO: 1890 - DNA, 170 bp, Triticum aestivum
  Clone ID: LIB3280-018-P1-K1-F2
cggcgggacccacgcgtccgaacctttgtttcatacgtttccctgtgcaagattaagagaattgcaagctattatcgggggtgtggtgtttattcggatggcttcatcacatacatcgacgtgtgctctcattccgtgcctgtatcatacaatggcgtcacctacactct

SEQ ID NO: 1891 - DNA, 438 bp, Triticum aestivum
  Clone ID: LIB3280-018-P1-K1-F4
aagagatcttagtatgctttaaagaagcagcagcacatacattggttgttttcgacaaaatagttaagatgatgcaaaatattgaaattccagaaagaaacgagtcttactctgaagcagagaaatattcagatcctgacatagaggatgaagaggaagctaatatggaaacatcgtcttatgccattgtcaagatgaagaaccatatgtctctgcaactcgtaattgttcaggtacttcaaaccttgtgccagtttaattcgatgctgatcgatttgtatatcacgtcttcctttgtaaattttgttcaatactccgctttaattgcacacccaaataaaataggaattagaacaaataaaatacaacaagaattttgccttcatgttttgtgttctgacatgccaatagttatattaagatcacactcaccattct

SEQ ID NO: 1892 - DNA, 397 bp, Triticum aestivum
  Clone ID: LIB3280-018-P1-K1-F5
gatgataaatagacgtatacaccgagagctaatgaactgacactgacaggctaacagacaactcgtcctcaatttgactccaaccagatcgttccagaacacaacgaacgctggctttatttccggcgtgtcaatgctaacaagaggccggcgaaaactaatcgtgcacatcgatcaaatcgtatcatgctttacaacaatatatcgcacggatgcagttcacgctatgccgcggcgcgtgcatatacttctcacagagcggtgctggccctggcctcctggcccttggcggcctgcttgtcgccgcagttgtcgacggcggcgtaaaggcggtagggcgaggcgtctgtggcgagccactgctcgacggtgaagagctgctgcgcgcatcccatgt

SEQ ID NO: 1893 - DNA, 104 bp, Triticum aestivum
  Clone ID: LIB3280-018-P1-K1-F6
gttgaaaaatacacatatccacctgggggagatgcactaacactgtcagcctactagacaacatgtttatctatatggcttctaccagttcgttccagaacaca

SEQ ID NO: 1894 - DNA, 424 bp, Triticum aestivum
  Clone ID: LIB3280-018-P1-K1-F7
cgtcgatcctctcatcggacctgacaccgtctctacgatgcccgaccaagctctggacgcgttcatcgaccacggcacagttgctaggacaatcgacgctaacgtgtcagaagctgagggcatatacagtgccctggagaagctgggcatcgactgggaagaggttggcaagcagctggagcacgagggggtgagctccttcaaggggagcttcgacagcctgctcacgagcttggaggagaagggcaacgccctcaagactgccgccaacctgtaggcgctaaaattatcggatagaatggtttggtaccggcgctggccatcaaacgattaccgaataaaaatgccagcttgctggctctctccttccatttggaaatgaaatgctcccagttatctgggtgagcttgcttcttgtattcta

SEQ ID NO: 1895 - DNA, 428 bp, Triticum aestivum
  Clone ID: LIB3280-018-P1-K1-F8
gagtaatcctacaactggagagattgctgttccttacggcctggctgtttggggcactggaattggaacccgtcccataattatggatttcatgaagcaagttggtcaggcaaacaggcgtgtgctagcaactgatgagtggcttagggttcttggatgtgacaatgtatatgcacttggtgactgtgcaactataagtcaaagaaaagtgatggaggatgttgattcaatcttccgggtagcagacaaggataattctggcactctgtctgtaaagaacataaaaaatgttcttggcgacatctatcaaaggtacccacaggtggagttgtatcttaaaaccaaccaaatgaggggcttccatgacctactgaaagacaaggagacagaagaactgaacattgaaaaattcaagaaagcccttgctc

SEQ ID NO: 1896 - DNA, 170 bp, Triticum aestivum
  Clone ID: LIB3280-018-P1-K1-F9
ccagagcccagagccgtcccccctccccatccctgggatcaccaactcctctccccctgcgtccccccgccgccgccgccatggagcccgcccccgcgtcgcccgatccggcgccccgctccccggcgccgtcgccggccaagaggtccgcctggaagcagccctccccc

SEQ ID NO: 1897 - DNA, 429 bp, Triticum aestivum
  Clone ID: LIB3280-018-P1-K1-G1
cccacgcgtccggacgaacctcggcgagaagctcaccgacgaggaggtggacgagatgatccgtgaagccgacgtcgacggtgatggccagatcaactacgaggagttcgtcaaggtcatgatggccaaatgagcaccgtgctccgtgctcccaagcaggaggagaattgtgcattgcatattagtttaagatgcaactcttatttgatcgatttccagttaagcatcctacctagctgtagctgctaaagcggatcggacgacgcaattcctgctatgttctccagtgtgtttccagacctcttgtgttttatgtgaacttgtgtcctccctggtgtatcctgattgctgttgggccccgtttgtagtatattttttcatcaacttttgcttcactcttctagtattaatggaaaagccgtgttttgt

SEQ ID NO: 1898 - DNA, 438 bp, Triticum aestivum
  Clone ID: LIB3280-018-P1-K1-G10
ggaccctaccactgagcccacacttcagatagggtatactcaggagcagataaacaacgcatgcgtggcggcgtcgttcatgccgacatggctgccctgaagatcgacgacccaaccagctaataaatgtgcgatggtgcttgcacagccgtcgcattctacctaggtacgtacgtatattccggggccgggagcgactactatcgcgttcgcgtacgtcccatagttctgtgtctgttgtgtccttgtgtgaaaaacttttgtgatcgataatgatcgacgtgtatgtcaagactgtctggtacaaagggctgtccgtgcgtcgccgttactataggctggctagctgcagcataaaagacgtgcctgtacgtttcataatttccagtgcagctacatgtagctgtatgcatgatgatgtgatgttatcaactgagt

SEQ ID NO: 1899 - DNA, 361 bp, Triticum aestivum
  Clone ID: LIB3280-018-P1-K1-G11
attagaactgacttattctgaactaaatacaattatttcatggtcctatatataagcaacaagaaacaacaaaacgtctagaaaacgctaactatagaagaagaaaaaggaaacccaattggccgtacgtctagatgcatggctctgggtgctggtagccaacataggtggcattggcgttctcgcagtgtgacaaggtgcctgcctgtccgttgtagctgaggtcgacgttctgcagcacgacgtcgcggcacggcacgccgcaccggagcagcacggccacgggcaacgtcgatgttcccttgatgttcttgaacttgatgtcctcgattgtgaccccggagacgtacctgtgctcgca

SEQ ID NO: 1900 - DNA, 271 bp, Triticum aestivum
  unsure (1)...(271): unsure at all n locations
  Clone ID: LIB3280-018-P1-K1-G12
gannnannnnnaggacgaagcgcaaatgnaaaggaaacaaacacagcccngcagaagcagcacaacaaaaacaagcgccgcacaggagaccaacaggagggcagaacaacagaagacgcaggnggaaacagagagnaggagcaggacaacgaacnaagngccggcgagaccacagagcngcccgggccggccacgccggcgagcgaancacgggccnggcccagaaaaagcgcccgcacggcacgaggcggcagaccggcgcgccaccagg

SEQ ID NO: 1901 - DNA, 435 bp, Triticum aestivum
  Clone ID: LIB3280-018-P1-K1-G2
cagttaacatctgcaggtgcgccctctccctgcgcgccgcgtgcatgtcgcgccatttgcgggagtgtggggcaagccatgtgcttgaaatcccaatcccctcgcccgcacgccggacgccacacccctccctggctccctcctcgaactctcttcctcgccagtcttcatgaaaccaccaaccccatcctctgcctctcccttgcgtatgaccatgactgcgctgggtcggccagaggaagaaggccatggggattctgctggctgcgtgcggaagcagcatcgggtcatggagtggagtgagtccaccttccgtcattctagccacagccttcgcgccaccttctgttcctccttctaattcgaggaacttcaatgaggtttctcaccaatgagctggaaggttttttatcctgggtacctgcagctcacttt

SEQ ID NO: 1902 - DNA, 350 bp, Triticum aestivum
  Clone ID: LIB3280-018-P1-K1-G4
caaaaaagcatttccccttcctctcgggtcgcacgcgcgtgcggctccggaggacctccgaaccctagaaaaaaggccccgatctccttccctcggccgctgccgccgccggcgccggcggtggcggccacgcccggccgtcgaaggcggcgggtgttggcggcgcgccccgacgggcccccttcgcgcggaggcgggacgtcacaggggctgcggtgatgtggccagaggcgcgagatcttggtggagctcggtggctcacggcgggagcgcggaggagcgccggtgcccggcggggtaggcatcatagaggaggagcagggtggtgtgtcttctcgagctagtggcgg

SEQ ID NO: 1903 - DNA, 437 bp, Triticum aestivum
  unsure (1)...(437): unsure at all n locations
  Clone ID: LIB3280-018-P1-K1-G5
gactgttagggggcgctgtgtggattttaatctcatgttcagctcctaacttcgattttgagctggcaacctcgtgcattatattttccacaatttgcaacagcagaacagtgtgagaatgtggtaaaaactgcgaaggcacggcttaggccatcaacattggccttaaggaaaggagaaagcgaggagactacaaaaggaataaggacaagctcaggcacattccttagcgccgaagaagatccaactggagcccttgcagaaattgaaacgaagattgcaaaggctaccatgatgccgagaagtcatggagagccctttaatgtccttcggtatgagattggacagaagtatgcttcacactatgatngcattgacccggctcaatatggtccacagaaaagccaaagggtggcatctttcttgctctatctcac

SEQ ID NO: 1904 - DNA, 421 bp, Triticum aestivum
  Clone ID: LIB3280-018-P1-K1-G7
cttccacctcgggatccctcccgatccatttcacccaatccgatcgcagcgggcaccactgctctcgttccccatccgtccttcccgcagctcctcgcagtcatctccctcgagcccgaggccatgcctcctctgctcgatctcccctgcccagcgcctcctcaaccctccttctcctgccggagccctgcctcgttcccctcgtcgcgagccagggagaggagctccctgcgttcgcccacctcgtgccgtccccgccgtctaccaccacaaccagcagctaagctacgtcgccccccttcccttcttgccgcacctccgctctctctccccctcctgaccttgttttccctttcatggtccaacagagcaggagtcctgccatggccgtccgaaccccgctgctgcatcgcgctgccgt

SEQ ID NO: 1905 - DNA, 274 bp, Triticum aestivum
  Clone ID: LIB3280-018-P1-K1-G9
aaaacccaaaaaaaattcttaaaaaagaaaaaaaattttaaaaacccttaaaaaaaaaaaatttataatttacaaaaaaaaaaaaaaatactataaaattttaatcattttatactaaaaaaaaattatacatataaaaatggttacttttttataaaataatatataaggtagggaagtaataataatataaccaaaaaaatatttttataattataaaaatagtttatgaaataataaaaaatatattatataatatatatataattattta

SEQ ID NO: 1906 - DNA, 373 bp, Triticum aestivum
  Clone ID: LIB3280-018-P1-K1-H11
cggacgcgtggctccgaaagcgaggagcaccggtcgctcctggaaaagattggcgacaagatcggcgacaagatccatgagttcaagaaggattcgtcgtcctcgtcctcggacgacgacgacgacaagaagtcgcataaatccaagaagaagcacctgtttggcaggaagcatccgctccacaacgtccttggcggaggcaaagctgctgatcttgtgatgtggagggacaagcagaagtccgggagcattctgggcggggtgaccgtcatctggttgctggagcagggcatctggtaaaaaaacctgatgctgctctgtcgcttaactataagtgccgttaaagcgagctagccctgaaacggcgttagat

SEQ ID NO: 1907 - DNA, 404 bp, Triticum aestivum
  Clone ID: LIB3280-018-P1-K1-H12
ccaacgcgtaaaaaaaggcagcaactagtgcggagccaaaactcctgtgtgctcttcttctatcttgggtgcgtgagttcatgtggagtgggcgaggttcgacgcggcgcggctgccgcaaggcccttgtgtgtggaggtccggttctctgtcgaggtcaagctgcgtcacgatcgaaggaggacatgctgcccgataagttgtgccaccggcggcaaggagttcgccatccatgccggagtcgtcgacaaggtgtgtcgccggcaaccatgatgtggtgaaggcgttggaggtgcgcctcttattgaagccaacggcgaaggcggcaatcagcgtgacaagacggcatcggcggtcgtctacgtgttgcgccgacgacatcaacgaccattggcttcaagaga

SEQ ID NO: 1908 - DNA, 271 bp, Triticum aestivum
  Clone ID: LIB3280-018-P1-K1-H2
cgcgtccggaaaagcagcagtccatgggactgcacatcctaagcgaaaccccgactccgtcgtgcgaggactctaccggcgcgtgcacggccacgaccagagtccccctccagaagcaccgtgcggaataccgtcctgagctcccgccctggctccagggcgaccgaggctaatgtggagtactgacacaccgcgatcgctgctgactgcgctgacgcgcatgtgatccgccgcgcgttcccgtacactctatgggcagcggctgtcgcat

SEQ ID NO: 1909 - DNA, 414 bp, Triticum aestivum
  Clone ID: LIB3280-018-P1-K1-H3
cggaggtggccgcgggcgcgcagccgaagaagaggacgttccgcaagttcagctaccgtggcgtggatctcgatgccctcctcgacatgtccactgacgaccttgtccagatgttccccgctcgcgcccgcagaaggttcaagaggggtctcaagaggaagcccatggcgctcgtcaagaagctgcgcaaggcgaaaaaggatgctcctgctggtgagaagcctgagccagtgaggacacatctccgcaacatgatcattgtccctgagatgattggcagccttatcggtgtctacaatggcaagaccttcaaccaggttgagattaagcctgagatgattggccattaccttgcagagttctctatctcctacaagccagtgaagcacggtaggcccggtatcggtgccacac

SEQ ID NO: 1910 - DNA, 321 bp, Triticum aestivum
  unsure (1)...(321): unsure at all n locations
  Clone ID: LIB3280-018-P1-K1-H4
cgcggaggnggcctcggccgcgcagccgttgaatatgacgttccgcaagttcaactaccggggggtgtgtgttgatgcccttctagacatgtccactgacaacctttttcagatgttccccgctcgcgcccgcagaaggttcaagaggggtcttaagaggaagcccatggcgctcgtcaagaagctgtgcaaggcgaaaaaggatgctcctgctggtgagaagcctgatccagtgaggacacattttcgcaacatgatcattgtccctgagatgattggcagccttatcggtgtctacaatggcaagaccttcaaccaggt

SEQ ID NO: 1911 - DNA, 480 bp, Triticum aestivum
  Clone ID: LIB3280-018-P1-K1-H5
ggccccggtttcgggattcgacgccacgcgtccgcccacgcgtccgcgagggcaaagaactctagtacatacgtaagtgtagctagcctcctcctgtaccgcacaccatggcggtcctgaagaagaacacgagctccctgagcttcgtcgtggccgccctcatggtggtcatggctgccacccttctcctctcctcgtgcgacgcccgcaaagtgaaggataagcccatcgctttccccgtgccggggaagtgctacgcgaggtttttcccgaactgcaccgagccgcggtgcaaaaagttctgcgtccagccgctccccggagcagtctgcctcgacaaaaaacctgctgctgccctgttgcttaactataagtgccgctgaagcgatcgagccaagaaacggtgaaagatgacaataagcaatcttggtacacctccaaatacatagtccttatttgttaacgttgtccctatttatg

SEQ ID NO: 1912 - DNA, 462 bp, Triticum aestivum
  Clone ID: LIB3280-018-P1-K1-H6
cgactcacgcgtccgcaaacgccgaagaagagaggagacgaaaggggatcgccgccgccgccgccgccgaggatgacgtcgatgctgtccgcgttctcgtcgtggttcgtgaacccgcgccgcaacccgctggcccgcatccacatgctcaccatctccaaccgcctcaagaactacggcctgaggtacgacgacctgtacgacccctacttcgatctggacatcaaggaggcgctcggcaggctgccccgggaggtggtcgacgcccgccaccagcgcctcaagcgcgccatggacctctccatgaagcaccagtacctccccgacgacgtccgggcactgcagacaccattcaaaagctatttgagcgacatgctggctctggtgaaaaaggaggcagcaaagcgtaaagcactgggagcccttcccctctacgagagaacccttccttgaagacatttt

SEQ ID NO: 1913 - DNA, 434 bp, Triticum aestivum
  Clone ID: LIB3280-018-P1-K1-H7
acgcgtccgctagttctagagcggtcgttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccactcctaagtactcgaaggctcgttatgaggaaattgtcaaggaagtctcttcgtacctgaagaaggttggctacaaccctgacaaggttcc

SEQ ID NO: 1914 - DNA, 411 bp, Triticum aestivum
  Clone ID: LIB3280-018-P1-K1-H8
gaaaagcagcagtccatgggactgcagatcctcagctccacgccggagcactcggcccagcactctaccggcgcgtccacggccacgaccgagtcgggtgccgccggccggctgccgacgccgctgggcctacctgtcgccatccccgacgaggccgtgacctcgcgctcggcgtcggcatcggcgcagtcggcgtcgtcgcggttcaagggcgtggtgccgcagcccaacgggcggtggggcgcccagatctacgatcgccacgcgcgcgtctggatcggcacgttccccgacgaggacgccgcggcgcgcgcctacgacgtggccgcgctccgctaccgtggcctcgacgccggcaccaactttccgggcacggccgggtcgacggagcttggctttctggcggcgcac

SEQ ID NO: 1915 - DNA, 431 bp, Triticum aestivum
  Clone ID: LIB3280-018-P1-K1-H9
gagacgcccccctcgtggatcgactccatcgtcgacatcgacgaggattaccgcattttcctgcaccacacgtgcgtggtgaataaccgcctgaagctccagatggggggcgtcgttgtggactacgagccggacccggacgccgcgcaatctggaggcagcagcggggtcgaggagcaatcggagaaagacgcggccgttgctttctcggagggagaggagcaggtggtcgactcagatgtgccggttgtaattatgccggagccgaacgcctacgactggcgtgcggatccagcccctcgtcaaaggatgcagggtcaggaagatattgggcacaaggatgctcagcctcgcgttgcttcgtcacatagatcaggtgctatatggcccccacatatcaaccggtggccagattcagactttaagcgaag

SEQ ID NO: 1916 - DNA, 211 bp, Triticum aestivum
  Clone ID: LIB3280-020-P1-K1-A1
ctggaaacgtgcatgcagcagtccagctagctacttagatgcagcgtattatatgcatagtgtgtgttaccttgtcatgtttaaattaggccaaagaaatattcgtgtgtttgtggatgttgctcgatcagtttgtgataattaaagaggatcaatgcctaaatggaggttctctctttagatatttgtgggaatgtcagtttggtaacct

SEQ ID NO: 1917 - DNA, 263 bp, Triticum aestivum
  Clone ID: LIB3280-020-P1-K1-A10
gtagtacgaattcatactccgaattcatgacaaataatttcagataacctttttcaaacaggaaaaggagccacggaatccagcaaatttgctcttaaacgtgacatgagtagcaattagcaaagctacgtactgtgataattaattatacttatggtagaacaggttttgagcctggaactccgcaaaactatcagactactgcggcatggagaagcagagagtccatatatacgatgtgcaccaaacaaactggactgatt

SEQ ID NO: 1918 - DNA, 270 bp, Triticum aestivum
  Clone ID: LIB3280-020-P1-K1-A12
tctacctgctgtccttcgaccggcctgggtatggtgagagcgaccctgacccggcagcgtccgagaagagcatcaccctcgacatcgaggagctggccgacaacctgcagctgggctccaaattccacctcatcggcttctctatgggcggcgaaatcatgtggagctgcctcaagtacatccctcacaggctctccggggtggccattctcgggccggtgggcaactactggtggtccggcttgccgtcgaacgtgtcatgggacgcct

SEQ ID NO: 1919 - DNA, 359 bp, Triticum aestivum
  Clone ID: LIB3280-020-P1-K1-A2
atgcggccacgcgttcggaaaatggaacaagagaaacgggagaagctcccacgcaagggtcccagggcaagagagcaagctccgtccaccccaagcgccgcagcagccgatgtgagttcgaccgcgtcggcattcgcagcaggcacgtccaccgacaagaacaggaactacgccgtgctggctggcaccctcgccggactgagcgccctgggctggtacctcctgtccaagcccaagaagacggaggaggtcgtcgactgatcggccggtctccgtcccgccctgggttttactttcttactgcacatggacctgcctgtgggtggtgtgcgatgatgatgattataataataagtttc

SEQ ID NO: 1920 - DNA, 269 bp, Triticum aestivum
  Clone ID: LIB3280-020-P1-K1-A3
gtcggcggtaaatcacatgcaagacttaagataagactattttatcaaccattgtacatgcccttagttagctggaaggtccgagaattccctgcaatgagcccatcgatgtagcatttttggctacaaaactctatcgattaaaaagaacgctcgccgccgcgcggctgtcagtgcacatggactatcatgcgacggatggcatgtccctgagccactggtcaagcggcttgccaatggcgtagacgatgaacccgatgtcccggagc

SEQ ID NO: 1921 - DNA, 175 bp, Triticum aestivum
  Clone ID: LIB3280-020-P1-K1-A4
caatgattcatagggatgtattttcttcttcgagagagaggactgtgcaatcagaagtacaatatgtgatcatcaagtgtaagagatggcaagaatatgtggtatgtatttcagtctgcgtattaatgaaatgtattgaccgttcatgctgctataataagctcgatgatttcct

SEQ ID NO: 1922 - DNA, 331 bp, Triticum aestivum
  Clone ID: LIB3280-020-P1-K1-A5
cccacgcgtccgggcataagagaggcaatccatcctcctctccggcggccgcgcgagagagagcgatctccggccacgagaggcgggcgggaccacgagagcctccgccgcccaccaaagccgtggagaaccgcaccggacgccttgtatctccgcccatcttctcaaaggtcttgaaacatggtggccatgtcaacgcttgccgctggatcgttgccgggaactgtggtccccaatggtcttctaacaaggaggtttcaaggctcacaatttcagacaactcaagttaaccgcatctcatttgagcgggaagtttctactaaagcaacac

SEQ ID NO: 1923 - DNA, 165 bp, Triticum aestivum
  Clone ID: LIB3280-020-P1-K1-A6
ggagccgaggaaagctctccccccctccccaaatttcatcttcgttcttccgctcctctcctcgcctcgcctcgcctcgcccggaccccggccggattctcgtcaaggaggaggaggaggaggagggggaggggatggggagggacgacaggttctcggtctggg

SEQ ID NO: 1924 - DNA, 299 bp, Triticum aestivum
  Clone ID: LIB3280-020-P1-K1-A7
aacaccatctcacatattatatattcaaacgtagtttcaatgaaagatgaccagaaaacaatcaggcccaccaaatgcatcggaccaaacatttagtcgttcgtttacctgactcattccagaaataaccaaaaactcaatggtgcaaccaccaggcttttccggaaagttaaaaaacaacgcctgacttttataccactcataaaacccactcggtggaaggggggtagggaatcgaacaattgcttttaactcgttgatttaaaattcggggttttgaacccattcaacaacgggtt

SEQ ID NO: 1925 - DNA, 155 bp, Triticum aestivum
  Clone ID: LIB3280-020-P1-K1-A8
tcagtctgaggatgacaatggtgtgatatcagatgaacgtgccatgtcactcttgtcttataaaccatctaaaccaggacagttcgatcccatgcatgctgctgcaactcgaatacaaaacaaattccggggatgggagggaagaaaagaatttt

SEQ ID NO: 1926 - DNA, 142 bp, Triticum aestivum
  Clone ID: LIB3280-020-P1-K1-A9
gtcggctctaaatcacatgcaagacttaagataagactattttatcaaccattgtacatgcccttaattagctggaaggtccgtgaattccctgcaatgagcccatcgatggagcatttttggcttcaaaactttatcgatt

SEQ ID NO: 1927 - DNA, 282 bp, Triticum aestivum
  Clone ID: LIB3280-020-P1-K1-B1
cccacgcgtgcgcagaggcaaaggccttattcctctgaggctgttgatttggcacttcagggctggtctggtatttcagatcccataagagtagaagcagttcttattccttgtgcgatggaggatgaacctaagatggtaagccttaatatatcagagaatgaacattacatgggtgatatagcattgaagctctctgcaaccgactcatctcatgtgcttgtttcaagaacagatgacaaagcatcctctgagatgagggtttatttcccagctccggat

SEQ ID NO: 1928 - DNA, 350 bp, Triticum aestivum
  unsure (1)...(350): unsure at all n locations
  Clone ID: LIB3280-020-P1-K1-B10
cccacgcgtccgcaccaaaaattgcaattattgatcatgagaagaaaagaacatttgtgctcaggaaagatggtcttccagatgctgttgtatggaacccatgggagaggaggtcaaaaaccattcttgattttggtgatgaagaatataagcacatgttgtgtgtggaacctgcagctgtggagaagcccattaccttgaagcctggtgaagagtggaaaggaaggttggagctctcagctgttccttccaattactataagggccagttagatccaaacaaggttcttcatggttgaaaatccttacttggtgcatctcgtacaagaacacttcanggcactttatat

SEQ ID NO: 1929 - DNA, 336 bp, Triticum aestivum
  unsure (1)...(336): unsure at all n locations
  Clone ID: LIB3280-020-P1-K1-B11
aggaaaagcggtcacatttcattctcagaaacacaaggatcaaggatcgagatcgccgtgacatgtgtcccgctggtgtcggggtatgtacacccgccccagctaggcctgcccgacgtacgcgatgcgaatatcagctgcaatacggcaggtccccacctggtgtgcgtgcttcctcccactctcagcacctactactgcataccggctngattcatgagccatctccgtgccattacgttagctacttatagaggccaccatttgagatacaaggtgttctgtttttgcctggaagctattcttttttctataggttacatgcacggtgtatat

SEQ ID NO: 1930 - DNA, 423 bp, Triticum aestivum
  Clone ID: LIB3280-020-P1-K1-B2
cccacgcgtacgcccacgcgtacgtctgaaatgtgccgcctgtggcttcctttcggatggggacatgagggacaagctcactacattcatcctgaaaaacccaccagaggcgaaaaaaggaggcaaggacaagaaagctatgaggagggctgacaaggagcgtctgaaagaaggtgaagcagctgatgaggagatgaagaaactcaagaaggatgggaagaagaaaggtgcttcgtccaagaagagtactgcaaaaggtgttgccacaaagaagaagggtgctggcggctctgatgaacaacatatcttatcaccaagagatgctgactttgcggctgctgcatatgatgatgatgatgacgatgatgatgtacagtgggcgactgacacgtcagcagaagctgcaagaaagcgtatggagga

SEQ ID NO: 1931 - DNA, 202 bp, Triticum aestivum
  Clone ID: LIB3280-020-P1-K1-B4
cctcatttccccttcaatagatactgtgttcctaaagctgccccgttcctcaaccacatgtccctctccggtgcttcaactataactaaccactattgaaaaactccatctactctacatctcacatttaaacactcactacttgctctttaccctttttttcaccaatatgcattccatgatgctctccttattgcacgac

SEQ ID NO: 1932 - DNA, 396 bp, Triticum aestivum
  Clone ID: LIB3280-020-P1-K1-B5
agggggggttgccgtagcgaggttcagattctcctcttcattgttttctaagaaccatcggtgattaaccttgttccttttttttactactataaacaggttgatccagatcttaaccttgtgaaagggcggggtggagcccttctccgggagaagatggtcgaagctgcatcaggaaagtttgttgttgtcgttgatgagacgaaactagttactggcctaggagggagcggtcttgccatgcctgtggaagttgtgcagttctgctggaagtacaatcaagtaagactgcagggtctgttcaatgaaaaaggttgcgaggcaaagctgagatttgatgaggatgacaagccctattttactgacaactcggactacatcggagatttattactt

SEQ ID NO: 1933 - DNA, 393 bp, Triticum aestivum
  Clone ID: LIB3280-020-P1-K1-B6
caccaaccacccttctcccgccgccgccccgcgaagcaaagcaggaggagaaggatgccggcgggccacggtctgcggtcgcggacgcgcgacctgttcgcgcgcccgttccggaagaagggttacatcccgctcaccacctacctgcgcacctacaaggtcggcgagtacgtcgacgtcaaggtgaacggcgccgtgcacaagggtatgccgcacaagttctaccacggccgcaccggacgcgtgtggaacgtcaccaagcgcgccatcggcgtcgagatcaacaagcaggttggaaaccgcattatcaggaaaaggatccatgtccgggttgagcatgtgcagccatccaagtgtgctgaggagttccggctggagaaagtgaaaaacgac

SEQ ID NO: 1934 - DNA, 401 bp, Triticum aestivum
  Clone ID: LIB3280-020-P1-K1-B7
ttgggggttttttttttggaaatgagaatttttttcaaaattgatcaaattcatccgaataaaatgggaggcaggaactggggaaatccttgcggggggcttcttttttttttttaacaaaacggaattaaatgggcagctttttgtcgtaataataatggatccatggcgcccccccgtgcgggggtttccactttattaaaacttgacgtcctttaaaacctttcccacttgttccagggtaacaaaaaaaccaaagttaaaggccccttggccccaccccgggggattaaaccctttttggagggaattaccccttttaaccaaaccttttttgagcccccattaaaagggcccccgttttggaaggggccgcgcccccccccccctttttttttttt

SEQ ID NO: 1935 - DNA, 454 bp, Triticum aestivum
  Clone ID: LIB3280-020-P1-K1-B8
cctgcatcgcgccgccgagagagacggtgtgcctcgagctgccccgttcctcggccgcaggtccccgtcccctcctccaactagaactcggtgctgttgtagaggtggatctatcctccagctcgcatttagtcctcgcctacgtgctcttccgcctcttcttgaccaagatgggttccagatgctctccttattgcacgacctcgagcggcggcgaccgccgccatggtcgtctcggcgctggccccgtgccagtttgtggagccatgtcgcgcctttgctgcgagaagcagctgcctgcgaccgtgcccctgccctctttctccccagcgtgctcctatttactcctatcccctgtcagccgcaagagtgttgcccatcaacaacaaagccgccagatcatctacgggttcttgtaggtgagtttccctctctccattgatacccgttcatt

SEQ ID NO: 1936 - DNA, 347 bp, Triticum aestivum
  Clone ID: LIB3280-020-P1-K1-B9
ttttagaaattttgggtttttttttggttttcacaggaaacttgggatgttttataaaataaataaataaatgatgcaacagggatcatcactagttactactaggagcaaaagaattgatcaaacaaatttagggccggcctcaggtgaagctgaggctggatcgggaccggagtaggtagttgcatgaaattgatatacaaagccgtacgtaaatggatcggctcctggaacggacgggtgaggtgaaatgaactgattcaaaaaaccttggcgacgtccttcatgacccccgggttggcgttgcaaaaggagatgaactcgctgaagtcgatgaacccgtcacc

SEQ ID NO: 1937 - DNA, 349 bp, Triticum aestivum
  Clone ID: LIB3280-020-P1-K1-C1
ttgcggcaacatgtaagtcccatgccatgatcaaatcgccgccaccgatcgatgactttgcgtttcgggctttaatctctacgtggtcgatgatgcacgcgcaaaagatgtggactactctggcggggcaaaggcagagccacacgaggctcatcgagtggaccgtggaagccaaggcggcgaagcggctcaaggccaaggatgaggacattgagcggatcaggagcatgaactgggcgctcgaggagcgtcttcggaacctcctcatggaggctcatatgtggcgcgatgtcgcgcagtcccatgaggccacggtcaacgtgcttcgcggagacctacagcgggcgct

SEQ ID NO: 1938 - DNA, 321 bp, Triticum aestivum
  Clone ID: LIB3280-020-P1-K1-C10
cccacgcgtccggtgggtttcccgcgggcgcgcgccctcccaccaccgtggccggcaccttccagggcatccttggagctcgcccgcccgctccggctgtgcctcatgctcatcacgccacgaccgcggccacgccctcaccacactgggaccaagccgccctcatcgctgcactcaaccagatggctctgcatcctccttccgcgcctggtggtgaatgggtcttcgacagcggcgcctcgtcccacatgagctccggttccggatctggccaccaagacggtgcttctccgatgtgactcccccggcgatctttacacc

SEQ ID NO: 1939 - DNA, 423 bp, Triticum aestivum
  Clone ID: LIB3280-020-P1-K1-C11
gcaataagtcggtctgttcgccgtgctcgtgtgggcctcaagagccccaacagaccaattgcgagcttcatttttgcaggtcccactggtgttgggaaatcagagcttgcaaagactctggcatcatattacttcggctctgaagaagccatgatccggctggatatgagtgagttcatggagaggcacactgtgtccaagttgatcggttcaccaccaggctatgtgggatacactgaaggtgggcagctgacggaggcggttcgacggcggccatacagcgttgtgctttttgatgagattgagaaggcacatccggatgtgttcaacatgatgcttcagatcctggaagacggaaggttaaccgacagcaaggggagaacagtggacttcaagaacacgctcctgataatgacatcaaat

SEQ ID NO: 1940 - DNA, 453 bp, Triticum aestivum
  Clone ID: LIB3280-020-P1-K1-C12
aaacaattcaagttcttttcctttgtcaagtttaaatatttgaactctgtttccgggttggagtttatctctggccaggtgagggctgaggcagcttggcgttgccggagcacaggacagaggcactaggcgcaggcctggggcatacctctctggcctcctcgcctgcccccttgccaatgggccctgtgtccagtagacggaagaggacggagttgcccatggtgacctcgtcgcctcctaaagttgcattcactagatttcttccaagtccatgacctctgtatgttgattgttttagatggttttccccggtgagaacattttgaaggttatctctttaggttcttgtatttggctcacgactccaacttttcttgaagggaaactcaagacatgtgtgtgcgaggaagggaagaggagagaaactttgaccattttcataactttctt

SEQ ID NO: 1941 - DNA, 433 bp, Triticum aestivum
  unsure (1)...(433): unsure at all n locations
  Clone ID: LIB3280-020-P1-K1-C3
ctcgtgatgctgctcttcgagacctccctgctcacctccggcttcagcctggaggaccccaacaccttcggcaccaggatccaccgcatgctcaagcttggcctgagcattgatgaggatgacgaggcgccagagaacgacaccgacatgccgcccctggaggacgacgccggcgagagcaagatggaggaggtcgactaagcgccaaggctgcctgtcggctgtcgtcgtcagatgtccatgccctgcaccgactagttgtttttatcttagtgtcgacgttggatggttttggcacgttttagctgtatcggttttgtcttttggctggccaaacattaagcgcggttagctgtttgtggtactcgtggaacagttcgttattggtggttctacaatatgngttaagtattatatttctatattcgctgct

SEQ ID NO: 1942 - DNA, 390 bp, Triticum aestivum
  unsure (1)...(390): unsure at all n locations
  Clone ID: LIB3280-020-P1-K1-C4
gcgtccgcatctcccgcacctcacacactagggaagaagcatggtctccatggcggcggccaagatcgccgtcctcgtggccgcgacgacgctcttcgccgcggcaggggcggcggacccccaacctcccctacccggaaatgaaacccagtgctggcagtgctactccacctgcatgcacaagtgcgacaacagcagctgcggcgacgtccagaagtacttccagtgcaagaagtcatgcatcctggattgctacaaagaactgccgccggtgtgcttcaagatgtgcatatnccagacctgcctcaccctgccaccaggtgcctgtgccacaccgtccagaaatgcaacacgcattttacttgctcatacgtacataaccagcacgac

SEQ ID NO: 1943 - DNA, 187 bp, Triticum aestivum
  unsure (1)...(187): unsure at all n locations
  Clone ID: LIB3280-020-P1-K1-C5
cgccaccaccacacaagccaatcaagctctcaactccttccgagctccgcggtttccagcaagcaagccgaagcactagatcctcgatggctcgcgtggcactgctcgccgtgttcgccgtgctcgcggcactggctgtggcggagatggcgtncgggcggtgacctgcggcgacgtgacgccgcat

SEQ ID NO: 1944 - DNA, 448 bp, Triticum aestivum
  Clone ID: LIB3280-020-P1-K1-C6
aaacaattcaagttcttttcctttgtcaagtttaaatatttgaactctgtttccgggttggagtttatctctggccaggtgagggctgaggcagcttggcgttgccggagcacaggacagaggcactaggcgcaggcctggggcatacctctctggcctcctcgcctgcccccttgccaatgggccctgtgtccagtagacggaagaggacggagttgcccatggtgacctcgtcgcctcctaaagttgcattcactagatttcttccaagtccatgacctctgtatgttgattgatttagatggttttccccggtgagaacattttgaaggttatctctttaggttcttgtatttggcttacgactccaacttttcttggagggaactcaagacatgtgtttgcgaggaagggagaggagaaaaacttgactttttcataacttttt

SEQ ID NO: 1945 - DNA, 167 bp, Triticum aestivum
  Clone ID: LIB3280-020-P1-K1-C7
cggacgcgtgggggcagctgcagcaaggtctctttgtcgaggcatcgggcgatccatttgggtgatttctctgcttcctgccttgtgattatctcgtgtgactgacaagtcgtggcaatttaggtaacttgcttagtagacggtatttcccgtgtttgagaccccgt

SEQ ID NO: 1946 - DNA, 366 bp, Triticum aestivum
  Clone ID: LIB3280-020-P1-K1-C8
aacagaacaaagatcacacttatttatagtagattttatacaagcaagcaggttagtttgtacatgagcagcagcatatcccgtcacacgcagaaaccgaacaggcaggcgttctctaaccaaggcagcaaaaaaagcccagaaagaaaaaaaggagaagaaaaaagatagctgctagagccaaaccctggctggctcctcggcactctggatttatacaaactgtggtgctactacttcgcacactctcggcgcatatacaaagacgctagacacgttgtcttcacgggaagagtcgacgtacgtgggcctgctacgggttcttaggttggctggaccgacttttgggcgcccccttcggttacg

SEQ ID NO: 1947 - DNA, 273 bp, Triticum aestivum
  Clone ID: LIB3280-020-P1-K1-C9
ggggggaaaaaacattaacgggacatggcaatggaatttttctatccactcggccagaaaaattgtttttttaccccaaattggggggcggctaaactaccccgcgggggtattcaccccctacggggggggttaacatgaaaccccccaaaccccgcccaaaaaaaaaaggggggggggaagggaaaaaacatttttaagccaatccccccccaggaggttcattcacattgccgtttaggtcccctaccacccaaataaaccccccccccc

SEQ ID NO: 1948 - DNA, 188 bp, Triticum aestivum
  unsure (1)...(188): unsure at all n locations
  Clone ID: LIB3280-020-P1-K1-D1
atttgttattttttgggttttttttatatattatttttttttttttttttttttttataaaaaattttaaaaaatttttttttttataatttaaattaattttnnnnnnaggccccaatatctccccccttttgtgggggtcaaaaaattaaaaaaaaaaaaataaaaaatttttttttttttttaaa

SEQ ID NO: 1949 - DNA, 431 bp, Triticum aestivum
  Clone ID: LIB3280-020-P1-K1-D10
attgaacatttgaaatgagcacatgtaaaggccagtctcacacttaagacggggaaaggaaaaggaaaaaagggactgagtagctcaactcagcgaccagcgatggggccctaccgacgtattgctcgctattaaccaacgagcaacaaaaagaagtttcccaatgttttcttttctactgtaccattccttctctctactctaccattccgcgctgcttgaaaagttcgaacatggttgaaccgatcttaactggtgactcgacaacagtaaccccagcatccctgagtgccttgatcttgtcttgggcggtaccctttccccctgacacaattgctccagcatggcccatacgacggcccgggggtgcagtaagtccagctatgaatgcaacgacgggcttttctgttttgctctcctggataaaggct

SEQ ID NO: 1950 - DNA, 383 bp, Triticum aestivum
  Clone ID: LIB3280-020-P1-K1-D11
cgagtttatttctaatgagtttgttgatgcttttgcttgactctaacccctgcacagctctctcatggaggaacaatagtttagtggatgatattggtataccatgtccagtttctccgcatccgtttactatgtgcaagtcagaggcagaagcttacggctatccatgtgaagatcacaaggtcacaactgaagatggatatattcttagcttaaaaaggattcctcatggccatgatactgataactcaaccggggatgagaagacaaggcaaccaatactgctattccacgggctttttgtggatggcgtttcttggctactgggtacaccagaccaatcacttggctttattttggcaaacggtgggtttgatgtttgg

SEQ ID NO: 1951 - DNA, 392 bp, Triticum aestivum
  Clone ID: LIB3280-020-P1-K1-D2
ggatgaacttggccattcattaaagactctgataaagtttgggtgaaggctacaacaatcagtagcctccttacacaaagaccgcaaccaaaatcaccacacatgcttgctttttattaagcgcccacgaggtcacacacacttgactcacgaactaaactcaattcatccctaataataataataaaagtgcagctaaaactcctaagattcaaccccgatggcgcgacacaatgagtctctagttactgcccttgctgatgagctccagggcggtggcggtggtgggcagcgccgggatggctcccttcttggtggtgcagatggcgccgcaggcgttcgagaactgcagcacctccctcagcttggcctcattgtagaagatggagtcg

SEQ ID NO: 1952 - DNA, 440 bp, Triticum aestivum
  Clone ID: LIB3280-020-P1-K1-D3
caataacgaagtcttagcatattggctctcaaatgcttcaacgctgttgcttttgcttcagcggacgctgaaagcgagtggatcaacaggaatggctccacagcgtcgacggtcgtcctctgctactctttttggaaggatgacacagagcttcagagggactccacaaggtgtaaatcttgctctaataaatggaagcatggttagtggagtagagacactgagacaagtggaagccaagtatcccgctttactgtttaaacagcaacttacggcatatgtagagaagatatatggaatgatacgggataatttgaagaaagagatctctcctttgctcggattgtgcattcaggccccaagaacatcaagagcaagcatgatgaaaggatcttctcgttcaaacacaaatacagctgcacagcaagctttgattgctc

SEQ ID NO: 1953 - DNA, 415 bp, Triticum aestivum
  Clone ID: LIB3280-020-P1-K1-D4
aaacaattcaagttcttttcctttgtcaagtttaaatatttgaactctgtttccgggttggagtttatctctggccaggtgagggctgaggcagcttggcgttgccggagcacaggacagaggcactaggcgcaggcctggggcatacctctctggcctcctcgcctgcccccttgccaatgggccctgtgtccagtaaacggaagaggacggagttgcccatggtgacctcgtcgcctcctaaaattgcattcactagatttcttccaagtccatgacctctgtatgttgaatgtaatagatggttttccccggggagaacattttgaaagttatccctttaaggtcttggatttggctcacgactccaacttttcttgaaaggaaactcaagacatgtgtgtgccaagaatgg

SEQ ID NO: 1954 - DNA, 410 bp, Triticum aestivum
  Clone ID: LIB3280-020-P1-K1-D5
acgcatcattttactatttctcatccatcatattccatatgacagttgctgcaacaaaatgccataagattgtggctcagtgcaaatggactagggagatcctcctccggatgcatagttgttatcatcatgttctcaccgtcatattgcaaactcgagtgttgccattggcgatgtgatcatccatagcatcgtcaaagaggacatattacgaatcatcttcccagaaaaatagccagaggacttgaatctgtttgactggtagaaatccaactatgaaaccatccagctatgattctcactcgtctgttccggactcattgtctcctgaaagcagggcatacacttcatattctgaagcagcttgcaaggaacaagagtcaacatcttcacgtgttcacatgcctaca

SEQ ID NO: 1955 - DNA, 341 bp, Triticum aestivum
  Clone ID: LIB3280-020-P1-K1-D6
atatatacatatatattgcatgaatagtataagtacaatcaccgtgggtcatacatgacattgtttctactgtaataacataaatctaaatatattttttgaggggcgtaaatctagatatataagtgttgaaatccagctataagttatggatcgagcactatctatatatccgggtacctccatgatatatgtggcttcttctttagttaattcgcataccatattactggcatcatgcatgcatggcaattgtcggcgtacgtctagggggaggtctcggtgttttgacgggcgtatggcggccggccgggtgcaagcttggggggtgccggcttggg

SEQ ID NO: 1956 - DNA, 450 bp, Triticum aestivum
  Clone ID: LIB3280-020-P1-K1-D7
gacctctttgccggggcgctcctgccggcaaacacccggctgggctacgtcagacgcacgagttcaccaggcccagtcatttcaagtactacaagcccagtaccacccttcaggtacagcagtttcgagaaaatcttgaagttttacaatgtaacccacggctccaagcaagcagggaggatctcggagactctccagttctgcgaggaggcaggagacaaggaaccacacgtgtgcgcaacgtctgtggcagccgcgagagagttcgccgccaccgttttgggcaccaaggagccgcgcgcggtcacttcaacccttcacgggcgcacagaacccctccgctacgtggtggcgcccaacggaatcgccagcgtcggcggcgacgcggtggtgccatgccacccccttgcgtaccctggtgaggtcttttactgccacacccccagcaac

SEQ ID NO: 1957 - DNA, 454 bp, Triticum aestivum
  Clone ID: LIB3280-020-P1-K1-D8
agcagaggcagtgattttcatctagtgatttcgagaaagagagctagaaaagagaggaaaatgtcaatgtggaagagctttaatggggagcatgcatctgctgttactcatggtccaaatgaaaaatacactggccgctcttctaggcagatgattaaggaactcaacactaaggagtggtctcatagaccagatcaggttggtagcatacagcctcagcatggggttgcgttgaaacgctccatcaagaatttcatccataggaggagtaatgaagttccacttaagaactttgaaacaggagcaagtcacaaccattttacaagtccaaaggaaaacatcaatagcaaatcaaatggtgattttgacaaagagcagaacattgatttaaacaaaaagctacccaatgctgtgtactgcaatgagtcaagttcttgtgagatgttatcaaatt

SEQ ID NO: 1958 - DNA, 444 bp, Triticum aestivum
  Clone ID: LIB3280-020-P1-K1-D9
accgcaataacgaagggttagcatatatggatgaaataatgggtaaccgccagggttttgctgctgtggtcgtcgacctcgtgggcactaacagcagcggcggcggtgcccatccggctacgccggtgaaggcgccgttcagcaggcacagcttccccaaggggttcgtcttcggcaccggctccgcagcctaccagtacgaaggcgccgtcaaggaaggtggccggggaccgacggtgtgggacaagttcgcccatactccaggcaagatcgcagacggtggcaatggagacgtagcgctagatttttaccatcgctacaaggaggatctgaagttggtgggggacatgaacatggatgccttcaggttctctatcgcgtggagcaagatactgccaactggttctttgagtggaggagttaacagccacgggattgcatttt

SEQ ID NO: 1959 - DNA, 395 bp, Triticum aestivum
  unsure (1)...(395): unsure at all n locations
  Clone ID: LIB3280-020-P1-K1-E1
acccacgcgtccgcggacgcgtgggcggcgccgcctcgttacagacagcgggagcgaaagagcgagcggtgagagaactccgggagagggcggcgagatggtgcagcggctgacataccgaaagcgccacagctacgccacgaagtcgaaccagactcgcgtcgtcaagaccccaggtgggaggcttgtgtaccagtacaccaagaagcgggcgagtgggccaaaatgcccggttaccggcaagaagatccaaggaattccacacctgaggcctactgagtacaagaggtccagattgtcaaggaacaggaggactgtgaaccgtccttatggtggtgttctgtctggtcctgcagtcagggagaggatcatcanggcgtttttggtggaggagc

SEQ ID NO: 1960 - DNA, 424 bp, Triticum aestivum
  Clone ID: LIB3280-020-P1-K1-E10
gctccgtcctcccctcccctcctctcctctcctagggttcgaagccacagccggccagtagcaatggcaacaaagtgcatcatcggcgcgttggttggatcccttggcgttgcatacgtctgcgacacgatcgtttctgacaagaagatctttggaggcactgtttgcaagaccgcgaccgacagggagtggtttcaggccacagacgccaagttccaggcctggcctcgcaccgctgggccgccggtcatcatgaaccccatcagccgccagaacttcatcgtcaagaacccttgataggtggcacgagcggcatctcgctcccaccatgggatcccaagtttcttttctaaggttttgaagttcctaataaaagggacttgaaagttggggtatactcttttgctttatgaatttcaagttc

SEQ ID NO: 1961 - DNA, 203 bp, Triticum aestivum
  Clone ID: LIB3280-020-P1-K1-E11
agaataaggcatatgcatttccattaacataatgatctatgcatgcttccgagttacataatactactaaccatcatgcagtaatctaaaccggcgtcatattattcgcagccttcttggggctttcatcgaagtcgacgtcgtcgctggcgtgggcgtcatcaccggacttcttgaacctgtaccacctcgcacatgccatg

SEQ ID NO: 1962 - DNA, 433 bp, Triticum aestivum
  unsure (1)...(433): unsure at all n locations
  Clone ID: LIB3280-020-P1-K1-E12
accccctaccgacgcggcgcctgagcactcctgccccctcgtggcggcgagatccaggcggggcccggccgccgccggcgcatggcctccgtcgacgccgcgggtgaccccctccgctccttcgcctctgcgacgtccctccttttccggacccttggccctgccgcggcctccgcatccccctccagggcccctggggcgctgctcggcggatccctgaaacgctccaaggagctgatggagcaggccagcctggtcttgaaggagcggggggacatccagaagctctatcaggaggatcgagtggatggcaagaacaaccagcagggtagaaggcctgggctggaccgcaagcgggctcagttctctctcaagcccacccaaagcaacccagtgaatgttgatttctcccaggcgcttancattgacgatc

SEQ ID NO: 1963 - DNA, 444 bp, Triticum aestivum
  Clone ID: LIB3280-020-P1-K1-E2
gcggacccacagcgttacgcagaaacgctattcttctcccacgccgtcctaacttgtacggccagctagcttcctctcataccttgctgccgcgcggagaacgagccgaatgcgtgccttcccaccaccgtgcgacaagaagaacccacggcttgccctcgtctgctctgctctgacactgcctcgcatggtcgtggtatctgaccggcgaggaggcgatgaataccgcaggggcggcgaccgcgaaagaggcggcggcggtggggcaagtgaaggcagagctggacgacgcggtgaaggcggccgggcgcacggtggctgtggccgccgcgcctgcgctgagcccgctgagcgagacgctgtggcagaagaacgcggcggtggatttcctcggggacgtgtcgatgcggctggcgtggctggacctcacggtcaccgtcgcgc

SEQ ID NO: 1964 - DNA, 396 bp, Triticum aestivum
  Clone ID: LIB3280-020-P1-K1-E3
attcccccctcccccgccgtctcgtcccagctcgccctccagaggttttagtcttcctccatggcggccctcatcaagctcggaagccttcttaggcagagtgctgtggctagcagtgcctccaccggctcggctcctgccctgttcaacgctgcccgcttcatgtgcgccggccagcctgctgatggctccaagcttttcgtcggtggtctcgcctgggctactgatgatcattcgctgaaggaggcgtttcaatgctttggtgaggtcgttgaagctcgtgttatcactgacagagagactggaaggtctagagggtttggttttgtgagcttcgccagcggcgaggatgcaaagagtgctgcagaaaacatggacggcaaggagcttgcgggg

SEQ ID NO: 1965 - DNA, 446 bp, Triticum aestivum
  Clone ID: LIB3280-020-P1-K1-E4
cggacgcgtggggcgccaactgtttcccgcgagcgattacgcaaaccctagttttcgctcgcgcacccggttccccagatctcgagtttgcccggcgatccggcgcgcgcatattgacgaagatgtcaccgatcatggcggcgcgcgggcaggggctgggccagggccagggccatcaggtgcagcaagatttcgacttcttcttggtggtggacttcgaggcgacatgcgagaaggacgcgcggatctacccgcaagagatcatcgagttcccggccgtgctcgtcgacggcgccaccggcctcatcgcatccgcgttccgcaggtacgttcgccccagacaccggcctgtgctgacccagttttgcagggacctcaccggcatccggcaggaggacgtagacggcggcgtggatctcggcgaggcgctctggctacacgacgct

SEQ ID NO: 1966 - DNA, 290 bp, Triticum aestivum
  Clone ID: LIB3280-020-P1-K1-E5
gagggtggaaaaacaaaaatttggcaataccccccccccaaataaaagcacaccatagacgtgtacccccttttttttaaaaaaaaaaagaaaagggccccttcactctttttttatttaaagggaaaaagatttcggggaattttttttgtcaaaaaggtcaaaaaaaaaaattggggaaaaattttttataattgttaaaaaattaaaaaaactccccccccgagtttttaaaaaacaaaaaaaatttttttttgtgtgaaaagtgaaaaaaaaaaattttttttttt

SEQ ID NO: 1967 - DNA, 398 bp, Triticum aestivum
  Clone ID: LIB3280-020-P1-K1-E6
ggccctggcaccgaacctatatctcgccctcctcctcccccccctctccccacccaccattcgcctgcgctgtccgcttccctcccgccgccgccttcccccggtcttctcgcttcagaccagttaacataaatggctgacgcggaggacattcagccccttgtctgcgacaatggaaccggaatggtcaaggctggctttgccggagacgatgctccacgtgctgttttccctagtattgttggcccgccacgccacactggtgttatggtagggatggggcagaaggatgcttatgttggtgatgaggcccaatccaagaggggtatcctgactttgaagtaccccattgagcacggaatcgtaagcaactgggatgacatggagaaaatttggca

SEQ ID NO: 1968 - DNA, 432 bp, Triticum aestivum
  Clone ID: LIB3280-020-P1-K1-E7
cgcgcccgcaagtaccggtccgacctacccggtgtcgacgcacacacaggcaaaatcgctgggtcgactccatgaaacccaggcgtatattgagaacaagggaaagagcagattaccgcagtgtattcaggagaaggaaaacggcagttgtccaacttttctccagcctaatgctttgagcaaaaggaattggtactcactttggcaaacagagagaaaggaatatgtttttttgttgctattggagctccatcactcactgtcaagtattgcaagcaagcaactgaagcaactacagtggccaataatgcatatatgaagattgatttacaacaacagctccaacatttgtacataatcttgcatattgtgtctctcttcgaatccctgttagtgtgtttatatacattaatgtcatatcaagatgtgtcc

SEQ ID NO: 1969 - DNA, 408 bp, Triticum aestivum
  Clone ID: LIB3280-020-P1-K1-E8
agcgttacgcggaaacgctattcttggcccaaacggtcctaatttgactgcttggtagctgcctctgaggcctttggagcgcacgagatggcggaagaagccccgacaccagttgttgccccagtagaggcacctaccctggttcttggtgagccaatggacttgatgactgctctacagcttgtcatgaaaaagtcaagtgctcatgatggccttgtgaaggggctccgtgaggctgccaagtccattgagaagcatgctgctcaactttgtgtgctggctgaggattgtgaccagcctgattacgtgaagctcgttaaggcactatgcgctgagcacaatgttcacctggttactgtgcccagtgctaaaacttttggagagtgggcagggctttgcaagattgac

SEQ ID NO: 1970 - DNA, 409 bp, Triticum aestivum
  Clone ID: LIB3280-020-P1-K1-E9
tcttaaacccgagcgcgcacgccctttccccattcccccctcccccgccgtctcgttccagcttgccctccataggttttagtctttctccatggcggccctcatcaagctcggaagacttcttaggcaaaccgctgtctttagcattgcctccaccgactagggtgctgccctcatcaacgctgcccacttgatgtgcgcctggaatcctgctgatggctccaagcttttcttcggtggccgcgcctgggctaccggggagaataattttttcgccacccccggggggtgggcggaggccaaaaataaccccctttttaaaataccacccccggccccttttttttttttttttggggcccaaacatgggtggccccccccttcaccgaaaaaattaacctcccccca

SEQ ID NO: 1971 - DNA, 355 bp, Triticum aestivum
  Clone ID: LIB3280-020-P1-K1-F1
gatacgtgcgttcccccactcgtactaaaaaaaaagcccaatgccgagaagcgcgtgcccggcaaggacggcggggccgacaagaagaagaagaaggccaagaagagcgtcgagacgtacaagatctacatcttcaaggtgctcaagcaggtgcaccccgacatcggcatctcctccaaggccatgtccatcatgaactccttcatcaacgacatcttcgagaagctcgccggcgagtcggccaagctggcgcgctacaacaagaagcccaccatcacctgccgggagatccagaccgccgtgcgcctcgtcctccccggcgagctcgccaagcacgccgtctccgaaggcacca

SEQ ID NO: 1972 - DNA, 361 bp, Triticum aestivum
  Clone ID: LIB3280-020-P1-K1-F10
ccgagaagaggcggacggcggcgatgggcggcggaggcgcgcacggcggcacgacgtacaagggctacaccatcccccacaacaagcgctggcacaccatcgccggcaagggcctctgcgccaccatgtggttttggattttctacagggctaagcaggacggcgctgtgcccttgggtatgcgtcatccttgggatggccatgatgatcacgcgcatggtcatggacatgcacacgagcatgaggcttcatcgtcgtcatcgccgtcccattgagctcaacgctgaaagcggctgacagagaccctgacacgtcgcatgtttcgacgcaagtctctgctaataaaaaacaatcacaacta

SEQ ID NO: 1973 - DNA, 321 bp, Triticum aestivum
  Clone ID: LIB3280-020-P1-K1-F11
gattttatggtgctcttggacgacgtcaactggatagtggaagaaacaccggacaatggcgatgactacatgaacgagggtcttatttatcttgaaacactagtatcaacggcttcggagattttaccacttgaagctctgtacaaggttgtctctggtgcagtgggccacatcttggactcgataatgacaacccttttgagcgacggggtgaaaagggtaacgatgagtgccggtttaagcctcgacatggacctgaaaatgctgggggcatttgctgatgagaaattccacattaccgggctggcagatatggggaaa

SEQ ID NO: 1974 - DNA, 149 bp, Triticum aestivum
  Clone ID: LIB3280-020-P1-K1-F12
accacgcgtccgcttgttgtacatgctaaggtgacctttaaaatctataacagaacaaggggtggctgcatgcgctggggtattaatgctctcaagacattactacttacaaagactgtatcatcatataaatcatgcgctagcaaaag

SEQ ID NO: 1975 - DNA, 381 bp, Triticum aestivum
  Clone ID: LIB3280-020-P1-K1-F2
cccgcggcgaaaccctagcgaccggagcgctcggcggcggcagccatggcggacgacgacgtataatgaagttgacatggggtacgaggatgagcctccagaggctgatattgaggaaggggttgaagaagatcctgagaacaacgaggatgcccctgatgacgtggtagggggtgaaggtgaagaaaaggaacaggaaaagactgcccgtccacgcaatacaacaaaatatatgaccaagtatgagcgggcacgcatccttggcacacgtgctttgcagataagcatgaatgccccagttatggttgagcttgagggtgaaactgatcctcttgagattgccatgaaagaactgagagcacggtagatccccttcacgat

SEQ ID NO: 1976 - DNA, 191 bp, Triticum aestivum
  Clone ID: LIB3280-020-P1-K1-F3
gactgaacaatactgaaattatgatcataaacactgaacattttacaaatacactgattcatcggccgtcttttagactactgaaaaaaataaaatgaaacaagatacaagaacgtaatgtatgtcgatcgatggatcgagctatgatcacttcctcttgttcttgctgccgacgagcagcacgacgtaaa

SEQ ID NO: 1977 - DNA, 296 bp, Triticum aestivum
  unsure (1)...(296): unsure at all n locations
  Clone ID: LIB3280-020-P1-K1-F4
cccacgcgtccgatgatgtagcctctgggtgtgtatgtgcgctcacggtggggtggtgtgtgtggcaaagttcgagctcgccggaaatacaaggggctgttcgtgcggccggaggcgtttgtgcgccgggaaatctcgtgtcctctctctcctgttttttccttgtctccggtgatcgccgtggttcagtgagtaggctagacaacaacaattggtatcagagcttantgtcttgggcgtgcttgccatgccggaagcgtgggagcgatggcggcgctcgcaggaggctgcgcgtt

SEQ ID NO: 1978 - DNA, 431 bp, Triticum aestivum
  Clone ID: LIB3280-020-P1-K1-F5
gccgcggcagaggagccggaagcaccggccgtcgccgaggaggcactggctgcaccggaggaggcgcccgcggccggctcctctgccgcggtggccagcgtcagcgtgtgaggcgccggcgcgcgcggaggaggagctggccgggtcagcttccacggcggcggccgtgtgctcctacgtggcacggcgtgatgctgagtcagccagtggagtggagtggaatgatactttttactaggtgtggagtgggagtgctatgcgcggggtcgcgtgacgtgggctaaataaaagtgttgtcgggtcgggtcgacgcccagtgtcggtcagcagcgagcgacgcagtgccactctcgccggcctgcgtctgcgtctgcttagctggagccttgttacggtgtgtgtcacagtgtcagttccacctatgatcgatc

SEQ ID NO: 1979 - DNA, 390 bp, Triticum aestivum
  unsure (1)...(390): unsure at all n locations
  Clone ID: LIB3280-020-P1-K1-F6
gcgaaccaagcctaaaagatcactacgcacagcagcagcaccagcaccgccaggaagtgcagtagtcgacgcagctgagccatggcccgccgcacggccctaatcctcgccgcgctcctcctcgtcgccctggccgtcgcgccgttggccaacgccaagaagggccgccaggacaaggaggagaaggcctncgacgccctctcggncgacgcgccggccgncgactcgcccgcggaggggccctccgatggaccggcggctgcccccgggcctgagggcatcgccggcctctcgcccgacaacgacgacaacgacgacaagtgacccgaggcatgcctctggaggatcgtcgtgctacaatcgccgatggtttagttcagcatatatact

SEQ ID NO: 1980 - DNA, 212 bp, Triticum aestivum
  Clone ID: LIB3280-020-P1-K1-F7
tccgtgcgttcgcccactcgtcactaaaaaaaaatcccaatgccgagaagcgcgtaccgggaacggacggatgggccaacacgatgaagaagaaggccaacatgtgcgtgcagacgtacaagatctacatattagaggtgctaaatctcgtgcatgtggacatcggcatgtgctccaatgccatgtctatcatgaactcctgctttaacaat

SEQ ID NO: 1981 - DNA, 288 bp, Triticum aestivum
  Clone ID: LIB3280-020-P1-K1-F8
tgccacaaaactcatgccatttatttcggaagaaaggttcagcagtacatgacaaactacatttattcaccactacaaaggccggcgcacagatttatcctgatggaacagatccaggtcctcgaaccagctcaattacatcttagttagccggagctttgtaccatccccacggcgcatcagatgtgtactccgtgacttgcttgatgctcaggtagttatcaatgcccccttctccgagctcgcgcccaaagccgctgcgcttgttcccgccccacggagcttggc

SEQ ID NO: 1982 - DNA, 341 bp, Triticum aestivum
  Clone ID: LIB3280-020-P1-K1-F9
cagatcgttttttcagatcagggggagaaaaggagagaagtgggggagagatgaaggaggcgacggcgtcggggggcggcgcggcggcggggccgaacgacccgaggcagccggggacggcgaggccgtacgcgccgccgaagctgtcgtcgcaggacctgcccgtcgactacgcgggcttcctcgccgtcgtcttcggcgtcgtcggcgtcatgctccacgtacgttccagccaaccaggcagtctcggccacgcgttgctcgccctcgcgcctcctatccgactacgcccccgcctgcgccccagtctacgccccagtattttcgacctctcgtcgtct

SEQ ID NO: 1983 - DNA, 69 bp, Triticum aestivum
  Clone ID: LIB3280-020-P1-K1-G1
cccacgcgtccgctgtattatctacctagaatcatcatactggagtactaaccaattgatgtgtcgctc

SEQ ID NO: 1984 - DNA, 319 bp, Triticum aestivum
  Clone ID: LIB3280-020-P1-K1-G10
ggccctcaaaccctaactttggatcgcagagcagttaaaagcattgtttataacccataaaacataaagaacgagagtgtagccaagctaaccaaggcagaatgcaccatatgaggtcagcccaggccagcttggtgggaacatacataactaagcacacaaaacgaatgctaaacttaaaacgaacacttactggaagaaacttctaaaaagaacaacaaatgagccaacacatgccgaaaaagaactcggtatggccaaaaattatttcttcacgttaagcccgaaaacttggatcagcaaaccaggctgtgctttt

SEQ ID NO: 1985 - DNA, 316 bp, Triticum aestivum
  Clone ID: LIB3280-020-P1-K1-G11
catacggtgccgctctcggactacaccacatggatagttgaagaaacaccgtacaatgggcgagactccatgaacggcgctcctatttatctctaaacactagtatcaacggttgcggacattataccacttgcagatatccccaaggtggcctctgatgcatgttgcaaaatctcggactcgataataacaacgctagtgagcgacggagagaaaaggttaacgatgagggccggttgaggcctccttatgcacctgaaaatgctggacgcatgttctgatgagaaattacacatcaccgcgctggcagatatgg

SEQ ID NO: 1986 - DNA, 349 bp, Triticum aestivum
  Clone ID: LIB3280-020-P1-K1-G2
cgccctcctctcctgctcccggaactcccagagcctcgctcgatcaatcgtagctcgtgttccctctccttttcgcggcgatggcggtggatctcaccccgaggcagccggcgaaggcgtacggcggcgagggcggcgcctactacgagtggagcccagccgagttgcccatgctcggcgtcgcctccatcggcgccgccaagctctcgctcgccgccggcggcatgtccctccccagctactccgactccgcgaaggtcgcctacgtcctccaaggcaagggaacctgcggcatcgtcctgccggaaggcaccaaagaaaaagtggtcggcgtcaaagaaggcgacgc

SEQ ID NO: 1987 - DNA, 316 bp, Triticum aestivum
  Clone ID: LIB3280-020-P1-K1-G3
cagaaggacccgcccacataatgcagtgcaggtcctgttgggaagaccttgttcattgggaagcaacaattattggaccccctgacagttcctatgccggcggtgttttcttagagaacattcatttcccttcggattaccccttcaagcgcaccaaaagtatcttttaaaacaaaagtgttccatcctaatatcaacagcaatgggagcatatgccttgatatttttaaagagcacaggagccctgctttgacaatatccaaaggcttgctctctatatgctccctgctgaccgatcccaacccggatgatcccc

SEQ ID NO: 1988 - DNA, 427 bp, Triticum aestivum
  Clone ID: LIB3280-020-P1-K1-G5
gataaccctgcgcacggctttcctgtttccagggattgcctttgttatcttcttcatcttgaatgcccttatatggggggagaagtcatccggtgctgtcccattcaccaccatgtttgccctggtcctcctctggttcggcatctcagtgcccctcgtgtttgttgggagctacctcgggttcaagaagcccgccatggagcctccagtgaagaccaacaagatcccgcgtcagatccctgagcaagcctggtacatgaacccgctcttcaccatcctgatcggcggcatcctgccgttcggcgcggtcttcatcgagctcttcttcatcctcacctcgatctggctgcaccagttctactacatcttcgggttcctcttcctggtgtttgtgatcctcatcatcacgtgcgcggagatcacaatc

SEQ ID NO: 1989 - DNA, 337 bp, Triticum aestivum
  Clone ID: LIB3280-020-P1-K1-G7
gtccccggccacctcccctctccttcacctgcgctcggtcacatggggtggtgacgcatgcaggagtgcggaggatgtgtctacgtgggatgcgcaactcgggccgcaacggcatgccgccccgtccttgcctcgaggtcgcagccgccgcgtcgtacacgtgccgtcaccttgggtcggtcagcgcagaagccctggcaaggagtcgctgaatcttcctgtcgattttcatcgacgtgaattgcatgactgtgggcagcgacaacacgacacctgacgaggatgcacgctcggacatgaagactagacctggatggcgcgattggagggacgacaa

SEQ ID NO: 1990 - DNA, 366 bp, Triticum aestivum
  Clone ID: LIB3280-020-P1-K1-H1
accgaggcaaaattcatagttgtagttgactgcaatttactatggcaaaaggtcagaagattgtccttccagcgtgtcgtggccacctccccatagcaccgcctacatccagcgcgccggcccgcttccccacagcgtgccgacgcaggcgtaaccctacatcgcacattgagaaatggtggcgcgcggggtgtgaggcggcgtctccccaccatttttgtaggttgccgcaaaaacaagatgcacaagttcatcttttgtatgcttttcagtacatctacttcccaatgctcgatccaggaggtgctagctcatgctggctggaactaggatgcaaaagggttgacggatccatgcccgacaagc

SEQ ID NO: 1991 - DNA, 295 bp, Triticum aestivum
  Clone ID: LIB3280-020-P1-K1-H10
acagcagagacgggccctttttttaatttttttttttttttttaatttttttttttttttttttttttttttatttttttttatttttttttttaatttttttttttatttttaaattttttttttaatataaaattattataaacaattttttggtcatattttctttaataaattcaacatatgaagaaaatttagaagagggggtgagaaaaaaccatataaaaaaaaaaaagaatattttattttaaaaataaaaataattgtataagacagataaaaataaaaacttttt

SEQ ID NO: 1992 - DNA, 256 bp, Triticum aestivum
  Clone ID: LIB3280-020-P1-K1-H11
ccttcattgaatgaccgtataacaattgcgactcttcttttttaccgtgacaagacatggggtggttttaatacaacctacaacttctcatggctaaaagataataatccaaatgccctcatatattcttatcatggaaaagagaaagcgcctgtaagaccggaaaatctacatctgctgttccaagtaaaatgaatagtatggttcttcaagaacatttactaaaagatggtgcctttgaggctgccccctgtcc

SEQ ID NO: 1993 - DNA, 369 bp, Triticum aestivum
  unsure (1)...(369): unsure at all n locations
  Clone ID: LIB3280-020-P1-K1-H12
cggtccgtgtgcttcagtgcgagcacagtgtcattcaacgctacccagcctttggcgtctgccaaaggtgtatgcgtaaagaggattgacaacgggccctacttgtacgtcaacatgggcattaaccatgttgtgacgaacactgtctacaggcacacttctggctgatatatgcttgctgcattccggccaaagcatgaagagtgctgtgctgcactgatagcatgggctcttcttggagttggcgcttctggacttttaagttttggtacgatagcatctgcagatgaagctgagcacggtttggcggctgcagagtacccctggccgcatgctggcatncttagctcatatgatcatgcatcaatc

SEQ ID NO: 1994 - DNA, 351 bp, Triticum aestivum
  Clone ID: LIB3280-020-P1-K1-H2
accgaggcaaaattcatagttgtagttgtctgcaatttactatggcaaaaggtcagaagattgtccttccagcgtgtcgtggccacctccccatagcaccgcctccatccagcgcgccgccccgcttccccacagcgtgccgccgcaggcgtaaccctacatcgcacattgagaaatggtggcgcgcggggtgtgaggcggcgtctccccaccatttttgtaggttgccgcaaaaacaagatgcacaagttcatcttttgtatgcttttcaagacatctacttcccaatgctcgatccaagaggtgctagctcatgctggctggaactaggatgcaaaagggttgacggat

SEQ ID NO: 1995 - DNA, 177 bp, Triticum aestivum
  Clone ID: LIB3280-020-P1-K1-H3
accacgcgtacgcttatacccctaccactaaaaagtttgcggcggctgcgctgctcataccatcaccgccggctgctgctaagctggaagccagattccggttgtggtgcagggcgcaaggccactggccaacagggggccgtcgcagcctaaccttacatacacatatgacaaatg

SEQ ID NO: 1996 - DNA, 377 bp, Triticum aestivum
  unsure (1)...(377): unsure at all n locations
  Clone ID: LIB3280-020-P1-K1-H4
tgtgacgccgaaaggtgccttatttacattgtgttgttggttgtaaccttgtctgtccgccgntaccgtaggaggtttatgttacctggcaccttatttcatctcttctgctactctctagtctgcttgcgtcgtctcatgctatcttggtagcatgatgagctgcgcgagtcgtcgtcagtcgttgcgtcgcctcgtgctaccttggtagcatgaagagctgcgcgagtcgtccgtcgggttaaagcatggaacatgagttgtgctgagtcgtcggtcgggttaaaagcatggaacatgaaatcttctgtttccaactgttgcaagaagaatgattcttatgtatgctgaatctggctgagtttttaaaanaaaaa

SEQ ID NO: 1997 - DNA, 395 bp, Triticum aestivum
  Clone ID: LIB3280-020-P1-K1-H5
ccttcattgaatgaccgtataacaattgtgaggcaactttgggacctaacaagagatgttgtggttttgttagagcctggaactcctcaagggtcaaagattataagccaaatgcgctcatatatcctttggatggaaaagagaaagtgccgcaagagcggaaaatctacagctgctgctccaagtaaaatgaagagtatggttcttcaagaagatttgctgaaagatggtgcctttgtggttgccccctgtcctcatgatggtcggtgtccattggagaattcaaacaaatactgccactttgttcagagattggagaggacgtcatcacagcgtatctacaaaaggtcaaaaggtgtgcctttgcgtggtttgaggatgagaaattctgtatg

SEQ ID NO: 1998 - DNA, 96 bp, Triticum aestivum
  Clone ID: LIB3280-020-P1-K1-H6
cacctccgtgccacacgctccccaccccccgcgccgccgttcgtgggagccaagggtggatgcgtaaagcaggattaacaatcgagccctacattg

SEQ ID NO: 1999 - DNA, 324 bp, Triticum aestivum
  Clone ID: LIB3280-020-P1-K1-H8
catggcacgtacccagggggacataatactagttttaagggggcgaccaattatatttatttttattcctgggggaggaaatggaactgcccttggcttcggcatttgaaaacggccggtgttggaagttgaaaccgggtaaaaaaggggtttttaaagcaacacgagcgacttcagccattgaaaatctgcgccgaggctttttcgcttttataaacaaaataagccagagcggtttgacaacctccaaattggccaaaattccccaagcaaacttggggggaaaaactttcttttttccccacccgcaaacacttttttttt

SEQ ID NO: 2000 - DNA, 340 bp, Triticum aestivum
  Clone ID: LIB3280-020-P1-K1-H9
caacaaaagaagatgggtcatataaagaccaaagtcggcttgctctgtccaattattagccattcaaattccgtcaacagaagaaatacacgacgaatgctcaagtatgtattcctcgtagcaaattttggggtatccaggtctgaaagccttattcatgccctcaaggcacgatgccatcctcgatgggctgaaacaagaccttggaccttaccaaacctccggacgcaactcaccgggtggagggagcatccatttcccaaaattggacccccttttaacaacttttcattccagaaccttttttaaggaccccggtttcttcttaaaaaaccttttt

SEQ ID NO: 2001 - DNA, 407 bp, Triticum aestivum
  Clone ID: LIB3280-035-P1-K1-A1
cccacgcgtccgacaatacagactacattggagcaatttctgctattgaagatggcataggaggtctggggtcaaaggatgctgctatgtcaccattgtctggcaggcttattgttgttgtaggtgctggtggtgctgctaaggcaattgcctatggagcaaagaagaagggtgcaagagttgtagtagcaaatcgtacctatgaaaaggcagttactcttgccaatgcagttggtggccaggccctgaggttagccgacctggaaaatttcaggcctgaagaagggacgatcctcgctaatgcaacatcattggggatgtacccaaattgtgatggcactcctgtttcgaagaaagctttaagtttctatgatgtagtggttgatgcggtataatccccaaaagtt

SEQ ID NO: 2002 - DNA, 407 bp, Triticum aestivum
  Clone ID: LIB3280-035-P1-K1-A10
cggacgcgtgggcgcgcgccgcccactatgatcatctccaagaagaaccgcaatgagatctgcaagtacctcttccaagagggggtgctgtatgccaagaaagactacaacctggcgaagcacccgcagattgacgtgccgaacctccaggtgatcaagctcatgcagagcttcaagtctaaggaatacgtcagggagaccttctcgtggcagcattactattggtacctcaccaacgatggcatcgagttcctgcgcaacttcctcaacctgccatctgagatcgtgcctgccacgctcaagaagtctgccaggcctcctggccgcccactcggttctggcccacctggtgaccgcccaagggggccacctcgctttgagggcgacaggcctaggtatggtgacag

SEQ ID NO: 2003 - DNA, 445 bp, Triticum aestivum
  Clone ID: LIB3280-035-P1-K1-A11
caaacctctctccccgctttcccggagacagatccagccatgggcgccgcggcgaggagggcgcccgagcaggagcaaagctgcaaggccacggaggacttcgacgccgccaagccgccgcccttccgcatcggcgacgtgcgcgccgccgtgcccgcccactgctggcgcaagagcccactccggtccctctcctacgtcgcccgcgacgtcgccgtcgtggccgcgctggccggggccgcatggtggctcaacagctgggccgtgtggccgctctactgggcagcgcagggcaccatgttctgggcgctcttcgtcctcggccacgactgtggtcacgggagcttctcaaacagcgggacgctcaacagcgtcgtcgggcacctgctgcacacctttatccttgtcccatacaacgggtggaggatcaaccacaggacgcacc

SEQ ID NO: 2004 - DNA, 197 bp, Triticum aestivum
  Clone ID: LIB3280-035-P1-K1-A12
caaacctctctccccgctttcccggagacagatccagtcatgggcgccgcggataggagggggcccgagcaggagcaaagctgcaaggccacggatgacttctactccgacaagtcgtcgcccttccgaatcggcgacgtgcgctccgtcgtgcccgcccactgctggctcaagagcccacttcggaccctttccta

SEQ ID NO: 2005 - DNA, 384 bp, Triticum aestivum
  unsure (1)...(384): unsure at all n locations
  Clone ID: LIB3280-035-P1-K1-A2
ctcatgcgaccgttacggcacggtacatgggaggagttggaggtagtgaagagagaaaaggaggggggtagcataggataggggtacgatagaaaggaatggagatccatgggagagacggagtacctggtgcgtgcttgagaaggccatacgctgatccgaccaaagacaaaaaggtgcaagaaggcgctttagncaaatacggcgagatcataaggcacctaatcatgaaaaagcagttagacggccaggccctgagggtaccgatctggaaaattgaggcctgaagaagggacgatactcgataatgcaacataattgggaagggacccaaaggtggatgactcttcctcgaacccaaagcaaagcttataaagtttttta

SEQ ID NO: 2006 - DNA, 454 bp, Triticum aestivum
  Clone ID: LIB3280-035-P1-K1-A5
cggacgcgtgggcggacgcgtgggcatcttcctcgcctccgcttccgaagggtcagagatggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagctgctacatgactcagaaccttggcatcagtgtccccatgatgtcatcttctccattgtttgccaatgcaccacctgagaagaaaggtgtcaagaactttgcaattgacttcctcatgggaggagtgtccgctgcagtttccaagactgctgcagctcctattgagcgtgttaagctgcttatccagaaccaggatgagatgatcaaggctggcaggctctctgagccatacaagggtattggtgactgctttggc

SEQ ID NO: 2007 - DNA, 349 bp, Triticum aestivum
  Clone ID: LIB3280-035-P1-K1-A7
cgcatcgaccaggcccatccagtgggcgtgacctctgtttcctgggctccagcgatggcccccggtgccctaatcagcccagggccttctgggcagtttgagtatgtccagaaacttgcttctggtggctgtgacaacactgtcaaggtgtggaagctcagcaacgggagttggaggatggactgcttcccagcccttcagatgcacagggactgggtgagagacgtcggctgggctccaaacctaagccttccaaagtccacaatcgccagcgcctatcaggatggaacctgtgtcatctggacagcgccgaatgaaggccagcaatgggaaggcagggttctgaatg

SEQ ID NO: 2008 - DNA, 393 bp, Triticum aestivum
  Clone ID: LIB3280-035-P1-K1-A8
cggacgcgtgggcgccaagcaattccaaggttacccatgtaatagatcgaaatcatcaatcacatattgagtatcgttggggaggagaaggtctaagaaagtatcttgtgaaatgggctacttcagtggttgaaagaaagggaagaattgaaaggcaaatgatttttgaagattcagaacactcttctacatattgtcttgcatttaaagtggtcaatccaaatcatctgcctcccctaaaggagttgaggaagttgatgagaatccagtcgctccgttgtaatgcgctgtataaccacagcgctaccagactgtctgtaactcctattcatgcgtcacgttctcaggcaataaggtacttgtttgtacggtgggggatagagttgccaaata

SEQ ID NO: 2009 - DNA, 456 bp, Triticum aestivum
  Clone ID: LIB3280-035-P1-K1-A9
atgggatactgctggccaggagcggtttaggacaatcactagttcttactatagaggtgctcaaggaattattctagtatatgatgtcgcgaagagagagagcttcacaaatttgggtgatgtatggactaaggagatagactcaaactcatcaaacaaagactgcataaaaatgcttgttggaaacaaagttgataaggatgatgagagaacagtcacaagagaagaaggtcttgcctttgcacaagaatctggatgtctgtttcttgagagcagtgcaaaaacacgagaaaacgtcgagaattgttttgaagaacttgtgctaaagatccttgaggttccaagtctcctggaggaaggctcgtcatcggttgtcaagaggaacattctgaaaaagcaacaggaaagtcatgcaaagtatggtggtagatgctgtcaatagaatcgtgagtatga

SEQ ID NO: 2010 - DNA, 458 bp, Triticum aestivum
  Clone ID: LIB3280-035-P1-K1-B1
acactcccgtttcccgccgcctccgccctctgccgccgcagccgcagccatgggcgcgtacaagttcgtgtcggagctatggaggaggaagcagtccgacgtgatgaggttcgtgcagcgcgtgcgttgctgggagtacaggcagcagcccgccatcgtccgcatcaccaggcccacccgccccgacagggcacgccgtctcggcttcaaggccaaacagggttatgtgatctaccgtatccgtgtgagacgtggtggcaggaagcgcccagtgcccaagggtattgtttatggcaagcccaagcaccagggtattacccaactcaagttccagaggaacaagaggtctgttgctgaggaaagagctgggcgcaggcttggtggtcttcgtgtcctcaactcctactgggtgaatgaggactccacctacaagtactttgaggtcatccttgttgatg

SEQ ID NO: 2011 - DNA, 442 bp, Triticum aestivum
  Clone ID: LIB3280-035-P1-K1-B10
cgctgccctagttctcgattccctctttccccgatcttccccgccctagtttccgatccctagtttcctcgatctcgattctcggagttttcgcgcacctcgtcgaacatggcagcgatcatggcggcgcgcgggcaggggcaggtgcaagatttcgacttcttcgtggtggtggacttcgaggcgacgtgcgtgaaagacgcgcggatctttccgcaggaaatcattgagttccccgccgtgctcgtcgacggcgccaccggccgcatcgagtccgcgtttcgcaggtacgttcgtccaaaacatcaccctgtgctgacccaattttgcagggaactcaccggcatccggcaggaggacgtcgacggcggcgtggatctcggggaggcgctctggatgcacgactcttggctgaaggcggcgaccgcggggggagggagct

SEQ ID NO: 2012 - DNA, 448 bp, Triticum aestivum
  Clone ID: LIB3280-035-P1-K1-B11
gacatcttggatcaagcccttttgaggcctggccgcatagacaggaagattgaatttccaaagcctaatgaggattcacgaggtgatatcttgaagattcattcaagaaggatgaacttgatgcgtggaattgatctgaaaaagattgcgggaaagatgaatggcgcttccggagctgagctaaaggcggtctgcaccgaagccggaatgtttgctctccgtgagagaagggtgcacgtaacgcaggaggacttcgagatggcggtggccaaggtgatgaagaaggacaatgagaagaacatgtccttgcggaagctgtggaagtgaggacccgacctttcgccttgctgaggctgtggaagcaaggacaatgagaagaatgtccttgcggaagctgtgggagctttctccgccttgctgaggctgtggaagcgtgtaactggacgtt

SEQ ID NO: 2013 - DNA, 185 bp, Triticum aestivum
  Clone ID: LIB3280-035-P1-K1-B12
ggaatcttgcatcattcccataaaggcctaacttatatacaggaacatacaatttcgggggctatcaagattcacgatgtgatatctttaaaattcatttaagaaggtagaacttgatgcgagtaattgtactgaaaaagattgagggaaagatgaatggcgtttccggagctgagctaaaggct

SEQ ID NO: 2014 - DNA, 404 bp, Triticum aestivum
  unsure (1)...(404): unsure at all n locations
  Clone ID: LIB3280-035-P1-K1-B2
cctctttctctccttcctcccatggagtcggcatagccagtagccggttctgcccgttgagagcgctcatataccctccacacctccagatctgtggcctgttgtagtctctgcctcctcagaacaacaagcccccgcagccgcgcccggatcggatggacaccgccatgcaccccgccggcgccgacgacggcggcctcgccgacccgctcaccggcaacgcgggcacaggcaccgagggcattatttgtggtatgccagacttcaagatgggtggaaagaggggcgatgaatctgcccctactgatgctggtgatgaagacggcgaagatgatgacggngatgaggatggtgacttcgcggagggcgaagaggaaatctcggaaggagaggagtatgacaac

SEQ ID NO: 2015 - DNA, 421 bp, Triticum aestivum
  Clone ID: LIB3280-035-P1-K1-B3
tcgcggaagggtactatgtcatggatcctaagaaggcgattgaaatggtggatgagaacactatatgtgttgcagccatcttgggttctactctcactggagagtacgaagatgtgaagctgttgaatgaccttcttgtggagaagaacaagaaaacagggtggaatgtgccgatccatgtcgatgccgccagtggaggatttatcgctccttttcttcagccggagcttgaatgggacttcaggctgccattggtgaagagcatcaacgttagtgggcacaagtatggccttgtgtaccctggtgttggatgggtcatctggcggagcaaagacgatctgccccgacaactcattttccacataaactatctgggaacagatcagcccacattcacactgaacttttcaaaggggctagc

SEQ ID NO: 2016 - DNA, 392 bp, Triticum aestivum
  unsure (1)...(392): unsure at all n locations
  Clone ID: LIB3280-035-P1-K1-B4
cccacgcgtccgcccacgcgtccggcagcaccagtcctcccgccgacgccggcctcctccttctcctcctcacgcccttaaccaccccggccttccttccctggagtcgatcggtgcgcaatcaatctcttgcacgttttgatcggtcggtatcggagggcgctccgatccgatccatgtccaggcggcggcaatggagcccgcggagctagccaagatcatcttctcccgggtgcaggaggtggagccggacaacgtgagcaagatcgtcggctgcatcctgctgcgggagcccgacgaggatgagctggtgcacctcgcctacgccaccgacgccgcgctgcgcaacaccatctacgaggccaagggcacgctcgccgncatctacgccc

SEQ ID NO: 2017 - DNA, 459 bp, Triticum aestivum
  Clone ID: LIB3280-035-P1-K1-B5
ccccgccacctcaaatccggcagcgagtcggggaagtcaaaggccagatttcgatacaggagcccagcagcgcctccctcactccctcggccagccgctcccgcccagcaacgccgcggctcggtccacagccagtgagtaaaccatgagccacgccggcaagcgtaccagccagcacagggatcatgacagagaagacagggaccaaaagcgaaggccggcccacacccaggaaacctccagtaaggatgaattggttgtttaccggatactttgtccagacaaagcgattggtagtgtaattggcaagggtggcaaggtgataaattccatccggcaacaaacgaatgccaaagtcaaggttgtcgacccttaccctggtgctgacaaaagggttattttggtatattgttatgtcaagcatagagaacctaagcatagcgacatagatgctgatga

SEQ ID NO: 2018 - DNA, 446 bp, Triticum aestivum
  Clone ID: LIB3280-035-P1-K1-B6
cccacgcgtccgcccacgcgtccgcaatgagcatcaaatcctccatcagagcgagcctaagatagttgcttcatgcgaactgtgacgagcgtgcgtgggtatgaccaagtacgatggagtcaaatctactacattgatttttgcccctcacgaggaggcaacttcaataaaatattatctcaattccgcccctcacaaggaggcgaggctacaaattatacaatggttttgtctctcacaaggagatgagattaataaactattactctgattccgctcctcactcacgaggaggcgacgtccatacaaccagacattgattttgctcctgcaatgaagcaaagatagatatatgttttattggcaagctcttccaatgcatctgtggtatattccacatcgacatcttggccgagtgtcgacgagacaaaaggctatgcacacca

SEQ ID NO: 2019 - DNA, 313 bp, Triticum aestivum
  Clone ID: LIB3280-035-P1-K1-B7
cggacgcatgggcgtctacaagatgaacaagtttctactctactagagtgcacagaatgggggcaacggcaaattggagagatcgatcaagttctcttttctcaaggaatcagaaatgtggaaacaccgggtgttattcttgccaacttttttccatgacatgacactgctatgtttcgttagatgcttgggtcaggaagacataagttcagaatggggaaaatggtcctcaatttgaactaaatactaatatctttctttagcgcaatctttgtatatttcttgtaaagttcatgcttcataactaatcgca

SEQ ID NO: 2020 - DNA, 405 bp, Triticum aestivum
  Clone ID: LIB3280-035-P1-K1-B8
ccactagacagagaccctaccttggggtggcgcctggctcggtccgggagaagaaggcctagatccactggcctaggtggaataattctgggagaagaagaagatggtgaccatgaagctgggttccaagccagacatcttcgtcctcgaaggcctcacatggagatgcatgaccgagctcgagagtgatgtcgttgtcgaagtaggagacatgtccttttatctccacaagttcccgctgctgagtcggagcggcgtgctgcagcgtctgatcagcgagtaccagccgccgtcggacggcagcggcggcggcggcatgtgcacgctgcagctggacgacataccgggcggcgccaaggcgttcgagctggcggcgcgcttttgctacacgtcaagatcgagctc

SEQ ID NO: 2021 - DNA, 287 bp, Triticum aestivum
  Clone ID: LIB3280-035-P1-K1-B9
cccctttgtattttacatccctatgtctatcttcatgtctcaacctttcctctttgtacctttcatctctatgcagttcctcatctttatgcctatcgtctttgtgtttgttacttttatgcctgtcctgagctttggacctatcatctctatatttttcttctctatgtttttccacacctctaggcatgtcatctttcaatttctcatctgtgtgttgctgctcgtaacatccatcagttttggtacgagcatcccgaggcatggtttgccctcctttgctgctg

SEQ ID NO: 2022 - DNA, 452 bp, Triticum aestivum
  Clone ID: LIB3280-035-P1-K1-C1
cacacgcaaggagcacgaggaggaggcaagggaagccgccgccgccgccccgtccctcctcgccggcccgccgcgacaggtttcaagatgtcaacctgcacgtttgcgacctcctgcgtgctcttgggcaatgctcgaacaaccgatgccccccagaaagcggtcaagagccgcctgagcttccttggccgaggcgccgtgcaggtgccgagcctgaggtcctcctctttcaagaagctggacgtctccgcggcggccacgtacaaggtgaagctggtgaccccggagggggacgagcacgagtttgaggcgccggacgacacctacatcctggactcggcggagacggcgggggtggagctgccctactcgtgccgggcgggggcatgctcgacctgcgcgggcaagattgatgcgggcgcggtggaccaatcggacgggtcgttcctgga

SEQ ID NO: 2023 - DNA, 173 bp, Triticum aestivum
  Clone ID: LIB3280-035-P1-K1-C10
cgctaacaaaaatagagtaattaaccgggagatctggagctcagccagccttgcatgcatgcatgcgttgcgacgtacgtcgacggattgtcctgcatgcatacatgcaccggccaggccagtcaatccttaacctcttttgtctctggacgtacgctcctcgacatgaagct

SEQ ID NO: 2024 - DNA, 59 bp, Triticum aestivum
  Clone ID: LIB3280-035-P1-K1-C11
acggaaaccattcttcaatatattaataggacatattatttctaaaactacttttaata

SEQ ID NO: 2025 - DNA, 220 bp, Triticum aestivum
  Clone ID: LIB3280-035-P1-K1-C12
gacacacatcccctatctatgagtcggaaatactattactccatcttattctcgacttacggggggcgctagcaaagtaacagcctgtaccatggccaggatccctctacaggcctaggtcgccaggctcgtgctcatagatggcttgttatgctgatcggcccctcggcgacggtgcccgtgctcattcttctggtgcctttccatttcttgtccgacc

SEQ ID NO: 2026 - DNA, 406 bp, Triticum aestivum
  Clone ID: LIB3280-035-P1-K1-C4
cggacgcgtggggttcgccgacctcacccaggaggagttcctagccaggtacgcgtcgtcctacgatggggtcggtgatgatactggcatcacgttgcctgtgggcggtggcgacgccgagctgtggtcgtccggcggcgacaatgatagctccttggaggctccgcctcccagctgggactggagatccaagggcgccgtcacaccggtcaagtcccaaggcgcaggatgcgctagctgctgggcgttcgtgacggttgcgacgatcgagactctgaactggatcaggacggggcagttggtgcccctctcggagcagcagctggtggactgtgaccaatacgacggggggtgcaaccgcgggtcctttcacagggcctacaattggattgtggagaatggcggc

SEQ ID NO: 2027 - DNA, 447 bp, Triticum aestivum
  Clone ID: LIB3280-035-P1-K1-C6
cccacgcgtccgcggacgcgtgggcgccctctccactttcctgctgctggtgctgttaaccggactccccgacgccgccgtcgccgccaacatgaccgaggtctgcgtcaaggccgccgtcggccaccccgacacgctcggcgactgtcccttctcccagagggtgctgctcacgctggaggagaagaaggtgccctaccagatgaagctcatcgacgtcagcaacaagcccgactggttcctgaagatcaatccagagggcaaggtgcctgtgtataacggtggtgatggcaaatggattgctgattctgatgtgatcactcaagtcattgaggagaagtacccaactccatcacttgtgacccctgctgaatatgcataagtgggatcaaagatcttctccacctttgtcacgttcttgaagagcaaggatgcccgcgatggttt

SEQ ID NO: 2028 - DNA, 453 bp, Triticum aestivum
  Clone ID: LIB3280-035-P1-K1-C7
ccactcagctcgcgagaccggagacggactgggggaagaagaagcggcagcgccaaaaccctactgccccctcgcgctgccgcctcagatctccgatcctacccggtccagatctggtgtcgcagatggcgagcacggggcggtcgatgctgctgtcgctgctgctgttcgcggtgacgctgtcgctgctggagatgtaccggggctggttcgccgcgtccgagctcaagaccatcgccggcggattcgtcagctccctcctcttcctcctcctcctcgcctttatcggtaattaccaagaagctagtggtgttagaactgggtggggtgcagttgttgtagcagaacttgttgctcttattgtagctggcactgtccaccgcgtttgcatcacaacatgcttcctgttttctgccgggatcctttacgaggtcgacaagctttccgggatga

SEQ ID NO: 2029 - DNA, 441 bp, Triticum aestivum
  Clone ID: LIB3280-035-P1-K1-C8
cccacgcgtccgccaactctcattccttcattcctttatcctatcctatccccgacctctctccggcatggggaacttcgcgtcctgcacgctggccaggatccccggggcggccaagggcgccagggtcgtgctccccgacggcgggctcaggctggtcaggcccccggcgacggcggccgagctcatgctcgaggcgccgggccatttcctggccgacgcgcgcgcgctgcaggccgggcgccggatcgaggcgctcgcggctgacgaggacctcgagctccggggcgtctacgccgccttccccatgaagcggctcggctccaaggccgcgcccacggacttggcgcgcctggccgccgttttcgcgagggaagctcatgggcggagacccgctttggccaaggtggcggccatcgtcgtggcgccgcccgaggtggg

SEQ ID NO: 2030 - DNA, 386 bp, Triticum aestivum
  Clone ID: LIB3280-035-P1-K1-C9
gaatttctaggtaactttatatttctttcatactactgacgacatgattggtgcagaagtacaaaactaaaaaataccactaaaaatgtaacagttctcccagccgaacgtttacaacaggggccaacagtaaaagacattctactgcatgaagaacgggattacaaagttatccatcttctcttttctctcaagttcggccttctcagcaatctgcttcagtgtagtccacccttttcttgcccgcttccttgaactgccagctggctgagtagaatcacctggtgcagactttttatttgatgctgacttgctataacttccaggggccttggcagcaactgaaccacaattcttcgctttattggtcaaggtacttctagtct

SEQ ID NO: 2031 - DNA, 446 bp, Triticum aestivum
  unsure (1)...(446): unsure at all n locations
  Clone ID: LIB3280-035-P1-K1-D10
gtcgctgcctcgcaccaaaacacaactaccaccagcggcagcagttcgactccggagaggcagagatgggctccaccgcaaccgacatggccgcctccgccgacgaggaggcgtgcatgtacgctctccagctcgtctcgtcgtcgatcctcccgatgacgctcaagaacgccatcgagctgggcctcctggagaccctggtggccgccggcggcaagctgctgacccccgccgaggtggccgccaagctcccgtccacggcgaaccccgccgcggcggacatggtggaccgcatgctccggctgctggcctcgtacaacgtggtgtcgtgcacgatggaggagggcaaggatgggcgcctgtcccggcggtacggcgccgcgcccgtgtgcaagttcctcacccccaacgaggacggcgtctncatggcggcgctcgcgctcatg

SEQ ID NO: 2032 - DNA, 429 bp, Triticum aestivum
  Clone ID: LIB3280-035-P1-K1-D11
aatcttgctaccgagctgggccaatggcctcggctccatgggatccatctcggtgtcctacggcgaggacggcccggtgttctgcggcctcagctcggacggctcccacttggtcacctgctccggcgcggacgcatctgtcgtctacggtgctcccctcaggatccccttcctcggcctcaccgcgggggatgggttcgcgtgcggtctcttgcttgataccagtcagccttactgctgggggagcaactcatatgtcaagatcggggtgccgcaaccaatggtcgagggcgtggagtattccctgctcagtgccggggacaaccacctgtgtgcactgcgaatgcctgacaaggggattcctcacggtgttaaccctgatactttagtgatagaatgctggggtacaacatgactgccacacatgtt

SEQ ID NO: 2033 - DNA, 66 bp, Triticum aestivum
  Clone ID: LIB3280-035-P1-K1-D12
ctatgtgatccatctcaaccggcgggggcgaggacggtccggtggaatgcaacctcacttactact

SEQ ID NO: 2034 - DNA, 456 bp, Triticum aestivum
  Clone ID: LIB3280-035-P1-K1-D2
cgaggaggtcagggaggagaaggagctcgacctctcctccaacgaggtcgtcaccaagtacaagaccgccgccgagatcatcaacaaggctctgaagttggtattgtcagagtgcaagccgaaagccaagattgttgacatttgtgagaagggtgacaatttcataacagagcaaactgggaatgtctacaagaacgtgaagaggaagattgaaaggggcattgctttcccgacatgtgtatctgtgaacaacacagtctgtcatttctccccactggcaactgatgattctgtactcaaagaaaatgacatggtgaagattgatatggcttgccatattgatggttttattgctgtggtggctcatacacatgtcatcagaactgggccggttactggaagagcagctaatgttcttgctgctgcaaacacagcagcagaagttgcaatgaggct

SEQ ID NO: 2035 - DNA, 373 bp, Triticum aestivum
  Clone ID: LIB3280-035-P1-K1-D3
aaaaaagaactgcaattgtttactaatatatccgaatcccgatttatgtttttatatttaaacagaagtccaaacttgcaagttctacaacagggctgtttcatacacatgtaattcgcaacatggtcatgggaaaaacaaaaaaatagtaactgcttttgcaaagttacaggtaaatttttcacggacagcgacggttgattttagcgaaactttttttctttcaaaggtgcacattttctttgcgctttggaattggaaaatacattttatgcgggaaacccaattttattttttttggttgccgggttcggactcttgttcaaaatttaacttttttcttggagcttggaaaaattccacctctttattt

SEQ ID NO: 2036 - DNA, 428 bp, Triticum aestivum
  Clone ID: LIB3280-035-P1-K1-D4
cgcgtccgcggacgcgtgggcgcgtccatccgcatggtcatgtccggcgcggcccccatgggcaaggacctgcaggacgccttcatggccaagatccccaacgccgtgctcgggcaggggtacgggatgacggaggccgggccggtgctgtccatgtgcctggcgttcgccaaggagccgttcggggtcaagtcggggtcgtgcggcacggtggtgcggaacgcggacctcaagatcgtggaccccgacaccggcgcctccctcggccgcaacctgccgggggagatctgcatccgcggcaaccagatcatgaaaggttacctaaatgacccagagtccacaaagaacaccattgacaaggacgggtggctgcatactggagacattggctatgtcgatgatgacgacgagatctttattgtcgacag

SEQ ID NO: 2037 - DNA, 451 bp, Triticum aestivum
  Clone ID: LIB3280-035-P1-K1-D5
cgaactccgatcgccactcccccagagaaatcctcctcacctcgaaacttccgtgaagcagcaaacgcaagtccggccaagatgtcgtggcagacgtacgtcgacgagcacctgatgtgcgacatcgagggccaccacctcgcctccgcggccatcctcggccacgacggcaccgtctgggcccagagcgccgacttcccccagttcgcgcccgccgagatcactgccatcatgaaggacttcgacgagccggggcacctcgcccccaccggcatgttcgttgcaggtgccaagtacatggtcatccagggtgaacctggcgctgtcatccgtggcaagaagggagcaggaggcatcaccatcaagaagaccgggcaggcgctggtggttggcgcctacgaggagcccatgacccctgggcagtgcaacatggtggtggagaggctcggcg

SEQ ID NO: 2038 - DNA, 331 bp, Triticum aestivum
  Clone ID: LIB3280-035-P1-K1-D6
ggctgacaaggcaaagaggcctggcaaggctggcaaccgcttctggaagagtgttggccttggtggaagaccccaagggaagcgatcgatggtacctacattgacaagaagtgcccattcactggaactgttgccatcaggggcagaatcatagctggaacctgccacagtgccaagatgaaccggaccatcattgttcgcaggaactaccttcattttgtgaagaagtatcaaaggtatgagaagaggcactccaacatcccagctcacatcttcctctgcttccgtgtcaaggaaggcgaccatgtcatcattgggcagtgcaggcccc

SEQ ID NO: 2039 - DNA, 370 bp, Triticum aestivum
  Clone ID: LIB3280-035-P1-K1-D8
cccacgcgtccgagatgagggagatcctgcacatccagggcggccaatgcggcaaccagatcggcgccaagttctgggaggtgatctgcggcgagcacggcgtcgaccccaccggccagtacaccggcacggcccccgagcagctcgagcgcatggacgtctacttcaacgaggccggcggcaaccgctacgtgccccgcgccgtcctcatggacctcgagcccggcaccatggactcgctccgctccggccccatcggcgccatcttccgccccgacaactttgtctacggccagtccggcgccggcaacaactgggccaagggccactacaccgagggcgccgagctcatcgactccgttctcgacgt

SEQ ID NO: 2040 - DNA, 438 bp, Triticum aestivum
  Clone ID: LIB3280-035-P1-K1-D9
cttggtatatgcgtgcgttgtgtgtgtgtgagtgttcttgtgggaagccaccgacgagaagagtagcttgagagagatggagagttgtgtgaggcagctcaaggtagaagaagaagtggcgctgcgaggtgaggcggcgccaacaattggcatcagagccttgtcgatccgcggaagcgatggcggtgacgacgacacggcggactccatgtgacgtggaggacgtccgtgcgagatgaaggccattggcggcgcgatgccgccggtggccggttgcggtgcgatgccgcaagatgatgatggtgtggtgatgggcgctgtgacggcgtctaccacgacaagatggtgcatggtggtgtccggcgctgcgacggtgtcgaccacgacaagatggtgcacggtggtgtccggcgctgcgacggcgtcattcacaacaag

SEQ ID NO: 2041 - DNA, 110 bp, Triticum aestivum
  unsure (1)...(110): unsure at all n locations
  Clone ID: LIB3280-035-P1-K1-E10
ccggaccggaaaacccggcccgacccacgcgaccagaaagacnaaaaaaccgacacaacccgagaaacgaaacaaaaaacaaaggaacacaaaaggggggggaaaaaaca

SEQ ID NO: 2042 - DNA, 457 bp, Triticum aestivum
  Clone ID: LIB3280-035-P1-K1-E11
caccattcaggtccagttgtcgttgccttcacttgctttgtcgtttacccatctgtcagctcgccgatcccctgacttgctgtcaagttgagatcgaggagagagcaagccgttgcagaggagaggggatacgagggtgggcggaggtcaggcattgctaacagatttgcggcggagcctcaccaccggctcctgtttggcggtggcaaagagaagggtgccgaggatgtgttgctctatgcatggctgttgaagtacatcatcgttatgatgtgtatggtttctctattttcagccctactgctccagatcccaaatcccatgaccatgcccccacctctccttcgttgaatgaagggagtctggttgctaaaaagtgacttctcttaatcagtatgtatggcccctctgcacatgccggttcttcgtatttaagaggcccttaagctttgtcagt

SEQ ID NO: 2043 - DNA, 429 bp, Triticum aestivum
  Clone ID: LIB3280-035-P1-K1-E12
cggacgcgtggccgtcggtgccagcaccatggaccgcgagttcccgtcttacatcgtcttcaacggcacaaagatcaaggggcagagcatgtcggagacatcgctcaagggcaaggagtcttaccccatgatcgattccgccgaagccgcagcgcccggcagagcggtagatgacgccaagatttgcctgcaggggtcgctggacccgacgaaggtgaaggggaagatcgtggtgtgcctgcgtgggacgagcgcgcgtgtggccaagggcctgacggtgctccaagccggcggcgccgccatggtgctcgccaacgacgccgcctccggcaacgagattatcgcggacgcgcacctgctcccggccacgcacatcaggcacggcgacggcctcaccctatacaactacctcaaatccgccaagtcacc

SEQ ID NO: 2044 - DNA, 411 bp, Triticum aestivum
  Clone ID: LIB3280-035-P1-K1-E5
cccatgcgtccgaacgccccgcgacgcgatctggccgccgagcatggcgacaccgctccgcctcgccgcgctcctcctcctcgtcctcgtcgcggccttcgcctccgccgcgcgcgctgatctcgtcatctccagggcggatcggaaggttgatttgacttcgcacatcgtccgcgtcctcacttcgctcaaggttgaaaatgccggctccgagcctgtctctaaagtcttgctggcttttcccaacatccaagcaaaaaacctggcagcgatcagagcattcggcactgagggaaaagtgaagggtctcagtagtattcttccgattgaagttgttgagccttctggtgttcccccagaactgaccttcttttcagcattcgtgcacaaacctttggacaaggggaaaga

SEQ ID NO: 2045 - DNA, 245 bp, Triticum aestivum
  Clone ID: LIB3280-035-P1-K1-E6
atttttatatttttttttttgggtttttttttttttttattatttttttttttttttaaattataccacgcactaatcttaaaatttacaaactatacaaaaaaaaaataaaacataatacatcatacaaatcctaactaatgaaaaaataaaaatacacactacgagcctgttaataaagtattaataaactttacccaacatacaatcaaaaaacctgacaaagatcaaatcatataaaacta

SEQ ID NO: 2046 - DNA, 451 bp, Triticum aestivum
  Clone ID: LIB3280-035-P1-K1-E7
tccacatccacgagacacacacagcacagcatcggcgtaaagggaacaccagcaagatgtctcagctcgcccgcgccagcctgactgcgatggcgatgctccttctccttgccgctgctgcggcggcggcggggccggcggccggcggcgcggctgtggcggacccagcacgctgccaggacgacgttgtggcgctcaacgaggcctgctacaagtacgtgcagaagggcgcgccgacggtgccgccgtcgcaggagtgctgcgacgccgtgaagagcgtggacgtgccctgcgtctgcagctacctgggcagccccggcgtgagggacaacatcagcatggagaaggtgttctacgtctcccagcagtgcggcgtcagcatccctgggaactgcggaggatcgaaggtctgaagcaagaacaggccggctgaatggccagcttggataat

SEQ ID NO: 2047 - DNA, 427 bp, Triticum aestivum
  Clone ID: LIB3280-035-P1-K1-E8
cggacgcgtgggcgcggacaagaacctggtcgccctctacgccggagggtaccaccctctccgtccgcatactaccggcgccgaattccggcccgctcctaggcctgcgctcgggccacatgtgcagcgcggacaagaacctggtcgccctgtacgccggagggtaccaccctggcgccgatacgattgcggagatgggagcctatctcatctacgacgccagggatggctccctctccgtcatcccccctatcccctgcgacgacgagtatctgagcatggggcaccagtcggccggcgtcatgtgcgacgccaccgggaccgggggtggctaccttcttgccgagctcgtctgggtcatgccagggttctcccgagccagcggctggctgggggagtcgtctgccaaagaatgggtcttgaagcc

SEQ ID NO: 2048 - DNA, 271 bp, Triticum aestivum
  Clone ID: LIB3280-035-P1-K1-E9
ggtggtttggaagtcaacccaaccctggcaactctctaagtcggcaggtacacacactggggctgtggatactaccgtcgtcgaatttcgggccgatcttatgcctgctgctcggtccaaatcgtacagcgcgtacaagaacctggtcgccctgtacgccggaggtcaacaccctggctccgataccattgcggagatgaaagcctatttcatctactacgcgagggatggttcgctgttcgtcatgccctctatagacttctacgacgac

SEQ ID NO: 2049 - DNA, 414 bp, Triticum aestivum
  Clone ID: LIB3280-035-P1-K1-F10
gccagatgaagttagaggtgaaatagggccgcactttaacgaccgttctgccataacagaggagcagggtgaaaagttggctaagccaaggaacaaagttgtggaccctgccaacaagcagttcataaggaaggggcttactcccaagtggggtgaccttgacgtgaaccaacatgtgaacaatgtgaagtatattgggtggatccttgagagtgccccgatttcaatactggaaaagcatgagcttgcaagcatgacactggattacaggaaggagtgttgccgtgacagcgtgctgcagtcactgaccaacgtttcgggcgaatgcgtggatggcagcccagactctgccatccagtgcgaccatttgctccagctggagtctggagctgatgtggtcaaagctcacacaac

SEQ ID NO: 2050 - DNA, 146 bp, Triticum aestivum
  Clone ID: LIB3280-035-P1-K1-F11
cccacacgaacttaaaagcgacatgaggtcttatttataactggcgctatgtcataacagagggggtcatgctatagagagctaaactctatgccaatcctgttgaccgtatatatatgcagagactaaagatggttcttactctt

SEQ ID NO: 2051 - DNA, 242 bp, Triticum aestivum
  Clone ID: LIB3280-035-P1-K1-F12
cgcatggttcatgtcaaccatactgatctgcaatcatatactgatgtgaatgtaaaaggcggggtctgtaataccacccaactttcaactgacttctccaaatacctttaaaaggataacagggatgacgtgggacatcattgagctaacttcattgaaatgcaagactccaatatgaagacctggtatctgttgactgaaggtgaacactatgccgatgcttcaaatcaaagatgttgctt

SEQ ID NO: 2052 - DNA, 406 bp, Triticum aestivum
  Clone ID: LIB3280-035-P1-K1-F2
cccacgcgtccgctcttcccggagagcgacggtgagaggggtaaaatggcgaggatcctgctgcatgggacgctgcacgtcaccgtgttcgagggcgaggggatcaccaacaacagcaggcccagcagtcaggcgccgcagttcctccgcaagctggtggaggggatcgaggacacggtgggcgtcggcaaaggcgcgagcaagctctacgccaccgtcggccttggcaaggcccgcatcggccgcactcgcacgctgaacgacgagtcgtcgaccccgcgctggttcgagtccttccacatctactgcgcgcacctcgccaccgacgtgctcttcaccatcaagggcagcagcaccatcggcgccttcgtcgtgggcacgggctacctacccgtccgcgacatct

SEQ ID NO: 2053 - DNA, 388 bp, Triticum aestivum
  Clone ID: LIB3280-035-P1-K1-F3
cccacgcgtccgctcctccccttccggttcgggttctggttcggttcgggtccgagagtagctagcctagtctagggtttccgtagttcggagaggagagaaagggagagatccatggcggagacggagtaccgctgcttcgtgggcggcctcgcctgggccaccgacgaccacaaccttcagcaggccttcagccagtacggcgagatcctcgacgccaagatcatcaacgaccgcgagacgggcaggtcccgtggcttcggcttcgtcacgttcggcagcgaggagtcgatgcgccaggccatcgaggagatgaacggcaaggagctcgacgggcgcaacatcaccgtcaacgaggcccagtcccgccggtccggcggtgggggcg

SEQ ID NO: 2054 - DNA, 384 bp, Triticum aestivum
  Clone ID: LIB3280-035-P1-K1-F4
gtttggactcaaaaggggcataacattcattaatgagattaaattgtttggtacaaacgtgacacgatttatttgctttggcaaacatacactcctgcatcgttcagttcaagcgactgatcagtacacacgagtacacgacgggtatggtataatgttacagattcctgtagtagtctactcagattcactagtatacaaatagttcctattcatgattataggccttgaatccctgacaagccggtccatactattatctacaaacaacaacttacatagcgatacaagaattcctgaactgatgtatgcttttaatcaaaggggtcgattcgaggatcatgctcacttgccattgccattcctgtacagaggcatgggggg

SEQ ID NO: 2055 - DNA, 347 bp, Triticum aestivum
  Clone ID: LIB3280-035-P1-K1-F5
cccacgcgtccgtgtggcttgccccccaattgattttaatgggtattgctgaggccttcaatgcggggggacaaatagaattctataataagctattttcagagcagatgctaactctagcaggatccctctttttcgttacgttagctggagcaaactacttgagtactgttctggcaaacattacaaggtatgtgactaccagtgatgttcacactagctggttgacagatgacattaattttgatcaagcttgattattacttctatttcattgccctcataagagttctgaactttttttacttacttatatgcttcacactactattaatattaattcatgt

SEQ ID NO: 2056 - DNA, 412 bp, Triticum aestivum
  Clone ID: LIB3280-035-P1-K1-F7
caagggctgtaaatcgtaccggacaaccaactggtttcagactcgtgcctggttcaaactgggtgccatttgctctgcctgaggcaaagtttcttcgaagagccgggttcttaaagcacaatctttgggtgacaccatacaagagcgatgagaagtttcctggaggggagttccccaaccagaatccacgtcttcatgagggtttagctacttgggtgaagaaggatagacccttggaggaaactgacatcgtcctctggtatgtatttgggctcacccacatcccaaggctggaagactggccggtcatgccggtggaacacatcggcttcatgctcatgccacatggattcttcaactgctcgcctgctgtcgatgtgcctcctggcacttttgatgccgccgatgtcaa

SEQ ID NO: 2057 - DNA, 371 bp, Triticum aestivum
  Clone ID: LIB3280-035-P1-K1-F8
gagaaaatagcgattcattcatttccagttcttgtcactgcacaaccccaggtacgtccatttgttcgtgcctaagttgatctcgttaactctgcagcttacatgcacaaaaagaatcacatctagcggtcgaacaaactgaattcacgaatcacgaggaggaagtttcttctttgcatagttttcggctgagggtgctgaagttggctcgcgagaactggcgggacgcgttccctcagtccgccccggactttatcatcagctcgaactcctggtagctgatgcgtccgtcccggtcggggtcgacgtcgcggatgatctcgaggatggcctgctcgatgggtcccagcttcctgcggagctaggcaatc

SEQ ID NO: 2058 - DNA, 100 bp, Triticum aestivum
  Clone ID: LIB3280-035-P1-K1-G10
acccacgcgtccgcttctacaacaccaccagccgcccttcttttttttttatttttctttttttcttaaactccgctttcttttatcctaaatttttcat

SEQ ID NO: 2059 - DNA, 117 bp, Triticum aestivum
  Clone ID: LIB3280-035-P1-K1-G11
ggggggttgtttttctttttttttttttttcttcccacggaaaaaaaaaaaaacggctaacttttcacaggggcccgccccccacagggaaacagtccccccctccccggataaggg

SEQ ID NO: 2060 - DNA, 155 bp, Triticum aestivum
  unsure (1)...(155): unsure at all n locations
  Clone ID: LIB3280-035-P1-K1-G12
gaaggaagagagactgagcggcgangaaanaaaaagcgnaaagggcaagaaagaaagggcggggggaacaaccggggaaggaagcanagaagaagaagggccgaagagcaaaaacgcacagccgaggagaggggcaaaaacccgagcaacagccc

SEQ ID NO: 2061 - DNA, 454 bp, Triticum aestivum
  Clone ID: LIB3280-035-P1-K1-G2
ccacgcgtccgcccacgcgtccgaccacctcgtctccctccaaatctcgtcggattccgccgcctccacgcgcgcgcggaggtcctgacaaaaatcgcccggagctcgcgcgcgtctaccacggagtggtcgcgccgcgcggcgccgagccatgaactacgggccctcggacagcagcggaactgatgatgacctttcaccaccatatccgaataatccgaataataggagtatacgaggcagcgggcgtgccagtggtaatggcagagctattgttcctgtcagtggtaatggaagggccattgctcctgccagctcgtaccctagagcccagaccgatatggaaacacaaattcaacagcttgagcaagaagcgtattgtgcaggtctgcgtgcttataaagctcagtctgatgccctcacatgggagaaagagggtctgattaccgaactt

SEQ ID NO: 2062 - DNA, 389 bp, Triticum aestivum
  Clone ID: LIB3280-035-P1-K1-G3
ctctctgcctcctccggtccctccccaaattcgtccgttcccagccccggccgcggctgcccgtgggctccccgcagccctcccgcgccgacggcggcggggcaccgcaggccagccccaccggcgctgcagcagcgcggatcggttacccccttcgtcggttaaggcacaacaatggcttcaactgctgcagtaccggccgcaaatacaaatgggaaccatgcactaagtgtggactcacattccagccaagatgttaggcggcgaacagttgttgttgcaaagaaaaaacctacacctgagcttcttactgaaggcggagttaatggcgtcccagatgataaggtttctagcaagaaagatattggtcaatcatacacgccggggag

SEQ ID NO: 2063 - DNA, 148 bp, Triticum aestivum
  Clone ID: LIB3280-035-P1-K1-G5
atattgtttttttttatagcggggggttacacatacatcaacaccctaattgtaaatactacacgcacaacgcaggaaacaacattagtagctcaatgttctacccaaagaaacatctatcccccaccacacataagctacataagtc

SEQ ID NO: 2064 - DNA, 459 bp, Triticum aestivum
  Clone ID: LIB3280-035-P1-K1-G6
ctcccccaagcaaacccaaatcggccgccgtcccctctcctcctccgtcctccgcccacccccgccgccggtgccgcctcctcgcgagatctcgaccatggagggcagcagcggcctcgacgcggcgatcgagtcgctcctgaacacggagaagcagtgccgcctcgccggagatgtggccggcacccggaaggccgccgtcgacatcgtcgagctctgcttcaaggacgccgcctggaagacgctcaatgaccagatcgtcgtcctctccaagcggaggggccagctcaagcaggctattactgctgtggttcagaaagcgatggagtacattgacgtgacaccagacgtggagacacgtattgagcttatcaaaacattgagcagcgtcgctgctggaaaaatatatgtggagatagagagagctagattgatcaaaaggcttggcaaaatcaaaga

SEQ ID NO: 2065 - DNA, 432 bp, Triticum aestivum
  unsure (1)...(432): unsure at all n locations
  Clone ID: LIB3280-035-P1-K1-G7
acccacgcgtccgcaagggctgtaaatcgtaccggacaaccaactggtttcagactcgtgcctggttcaaactgtgtgccatttgctctgcctgaggcaaagtttcttcgaagagccgggttcttaaagcacaatctttgggtgacaccatacaagagcgatgagaagtttcctggaggggagttccccaaccagaatccacgtcttcatgagggtttagctacttgggtgaagaaggatagacccttggaggaaactgacatcgtcctctggtatgtatttgggctcacccacatcccaaggctggaagactggccggtcatgccggtggaacacatcggcttcatgctcatgccacatggattcttcaactgctcgcctgctgtcgatggtgccctctggcatttttgatgccgncgatgtcaaggaagc

SEQ ID NO: 2066 - DNA, 342 bp, Triticum aestivum
  unsure (1)...(342): unsure at all n locations
  Clone ID: LIB3280-035-P1-K1-G8
tcatacttgtttttgttgtcggtgatggttagacttggagggttcatgatgacacgcaaatagtcaatccagttactgatgaaaaatctagttccatatctagtcacgccaatggtgtatcgcttggagagcccaatttaaaagaaccannnnaaccaaccagtactggagagtctgtgcagtcatatgtggctcaaccaaaacctgtaaagaaatgtagcttacgggcaaaggttccttttgagaagggatttagcccaatggactgtcttaagctgactcgtacacatgcagatctagctgggctcaaggcacagtcaaattggaggttaatttctttgg

SEQ ID NO: 2067 - DNA, 391 bp, Triticum aestivum
  Clone ID: LIB3280-035-P1-K1-G9
aaccaattgtttatatactcgggcatggttaaactaggggggtatttgatgtcactcaaacaaacaatctatctacagacgaaaaatctaaatacaaatctagtcacgacaccatacaatagctatgagagcccaattgaaaagaaccagttcaaccaaccaccacgtgtgagcatggcatacaaacgtggctgaaccaaaacctaccctgaaatgaaactgacagccaaatgtgccttgtgatagggcttacacacaaacgtacggtgttaaactgactcgtactcacgcagatccacatgggctcaatgcacatgccaaatggatgctataacttttggcagaaggtaaacatcattaaactgacttttgattctcgacattttaaaaa

SEQ ID NO: 2068 - DNA, 316 bp, Triticum aestivum
  Clone ID: LIB3280-035-P1-K1-H1
ccacgcgtccgcccacgcgtccgttagccgccgccgccgacgtggagcatagcagcagagcgacacgatgacgggggggaagatggcggcggctacggcggctaagtgggcggaggggtacccgtggaaggagaagctggccaagtacaagggggagctgagcaaggtggtgtgggggtactgggagctgggcgcgtggaaaccgctggggatcaacgggcggcaacgcgcgccgcttctcaaggaggtgcttcttgccggcgaagactgggcctaccaccccccccggggtgagattcgcaccaagcgcaagggc

SEQ ID NO: 2069 - DNA, 270 bp, Triticum aestivum
  Clone ID: LIB3280-035-P1-K1-H10
aaaaaaaaacataggtcccccataaattccaactccaaccccttgtaaagagcttggctatattttgtcttattgaacttttaaaaggcgcccatgtaaggcccactcttacacttaaaacggggaaaggaaagggaaaaaggggcctggttacttaaatttacggcccagcggggggcccctacccccttattgttcttttttaaccacccaccacaaaaaaagaatttcctcaggtttttttttttaagtacccattcctttttttct

SEQ ID NO: 2070 - DNA, 187 bp, Triticum aestivum
  Clone ID: LIB3280-035-P1-K1-H11
ctagttctagatcgcgagcggtcttttttttttatttctttattattttttatttttatttagttgtgttttttttttatttttatttttatttaatttttttttattattattttaatattaaatattttatttttttttatttaaatattattttttttttattttttttttttttttttttttt

SEQ ID NO: 2071 - DNA, 342 bp, Triticum aestivum
  Clone ID: LIB3280-035-P1-K1-H2
caaacactttttccttgggggatttatgagaagtcatcaatctcgatcgcgggtgcatgacacgaagaacaagaattgatattgattgtcaatcaaaaatgctggccacacgtgacacacacgcttgcatatgctccataggggcgcggagcgcctagctcagattttgtggccaccaccagcgggggcggcagtaggagcagcggcggttgcggctgcagccatcgcgaagatggtctctaccaccgcggcctcataagtaataagcctcctcttatggggtttgggagaaattggaggcgttagcctccttgaccgccggctcaaggggggggacgtatt

SEQ ID NO: 2072 - DNA, 406 bp, Triticum aestivum
  unsure (1)...(406): unsure at all n locations
  Clone ID: LIB3280-035-P1-K1-H4
cggacgcgtggggatttccttcacagcacagccaaacaaattgtaactcgtaaaacaaaggggaggaaaggaaaatataaaccctagccgcgccgatcgacgccagcgagacggctatgcggccggcgatcgacggagaccaggatcgccgtctctagccgcaccgaccagtacccgtccgctcgcctccgccgccatgagggccgccgcggcgcagatcgatccgtccccgtccccgtcccccgccgcgctggccaagtcgcggctcaagcgcctcttcgagcgccaggtgctgcgggtctcgccggcggagcggctcccgcccgtctccgccggcggngagaaggacaaggagaaggatgacttggagcccagctcggtgtgcctggacggcatggtccgcagc

SEQ ID NO: 2073 - DNA, 359 bp, Triticum aestivum
  Clone ID: LIB3280-035-P1-K1-H5
agattgaatggtatcacagggtggggtagacacagacatcaacaccgaaatgttaagactacttgcacaccgcaggaaacaacattagaagtttaatgttctaccctatgagacatcaaaccaccacgacacagaagctacataggtcggtgtgtaccagacccgctcaatcatcatctagacagcagataaactaagggactgaaacacgacagcaggaaagcagatgattttttttttttggccgggggatggtcctaatgttccttatcctccttatggtcgatctgttcatcggcttgctcatcatccaagtgataataggtctcaccagccttggaagcatacttcttttactt

SEQ ID NO: 2074 - DNA, 72 bp, Triticum aestivum
  Clone ID: LIB3280-035-P1-K1-H6
ctttattttatggggtggtgtggttttgataatccctttctctgccaaacgccccatggtcccgattttttt

SEQ ID NO: 2075 - DNA, 313 bp, Triticum aestivum
  Clone ID: LIB3280-035-P1-K1-H8
tcgaacgacgacggacacaaccgctcgcactgcatctccccatcgtaggcgagctctgctcatgtgtgaatctccatcgtctctggtactgcaagtgtttgcgtttccacagagacatactttgaaccctaaatttctccccgccacatgttgacggcgcgtgtttccctaacaccggttgcatcttcttgagcgtcatggccagatgccgcctcgtccccagccgccaccggcggcgtacaagcacttctgcagagtctgcaacaaggggttcacgtgcggcagcgcgctcggcgggcacatgagggcccac

SEQ ID NO: 2076 - DNA, 359 bp, Triticum aestivum
  Clone ID: LIB3280-038-P1-K1-A1
ccagcggaaattgaccacagggcaactttctttggcttctcttctggacaatattcagtattacaatgtatgcagaagactgacaaatagatggacatgattaacatggaactccaacatttgattgaacatagaagttgcaatatcatcctccccacaagagcattggcgacagacataaatacttactaccaacctagatagactcttttgctcactatggcagacgcagcagaccatttagagcacttatttggcaggaacgatgacataaaaataaaagcagtaacacgggatacagtaggctttgccggtcacccggccagctgcttaaccgaaactaccatagcaggacacca

SEQ ID NO: 2077 - DNA, 448 bp, Triticum aestivum
  Clone ID: LIB3280-038-P1-K1-A10
aaggacaccaaggaggatatcgccgtgaagcggctcgacaaggaagggttccaggggaaccgcgagttcctggtggaggtgctgatgctgagcctcctgagccaccccaacctcgtgaatctgatcggctacagcaccgacctcgaccagcggatcctcgtctacgagtacatgcccaacggctcgctggaggatcatctcctagatctcccggagaacgccaaggcgctcccctggcagacgcggatgaggatcgcggtgggcgcggccaagggcatcgagtacctgcacgaggtggccaacccgccggtcatctaccgggacctcaaggcctccaacatcctcctggacaaggacttcaactccaagctctccgacttcgggctcgccaagctcggccccctcggcgacgagagccacgtcagcaccagggtgatgggcacctacg

SEQ ID NO: 2078 - DNA, 391 bp, Triticum aestivum
  Clone ID: LIB3280-038-P1-K1-A12
actggacagactctacgaatgcatgatagtttattattacagcacaatgacatttttaccggcataccagtaggccagcattatgcattatcaacatacagtcggatcatgaaccaggcgtttcagatcatgcaacaaatgcggactgatactgccttgttaaccaaagaagaaggtggttcacctatccgaaatcctccaactgctgctgaagatgcacgattagcatctcttatatctctagacaacatcttaaagcaagtcaaggaagtaataaaacaaagctctacaagaccattacgaaaatcaaaaaagaaagcattgctagaatcattagatgacctattggcacagatgccttctctttttgacattgatcatccatgtgctc

SEQ ID NO: 2079 - DNA, 373 bp, Triticum aestivum
  Clone ID: LIB3280-038-P1-K1-A3
gttcagggttaagatgggtcacacatctatataaataagagaacggattacattattttggagcgcatattactcttattcatatacatctggtgcactccattcggaagtgcatatgcacacctatttatgcttgctacataaaaagtagccacaaacacaaatctgctccaaagaacggaaaaagccaacacacacaattgcagagcattaagtcaactcaagagctccttcccgaaaagcccagcaatggctcgcccaggatcttcttccttgatcagagactcttctaccaaaacagcagaaacgccagcgctatgcacatatgcaacatcatcgggagtgaacaggccagattcaccaacaacaaata

SEQ ID NO: 2080 - DNA, 100 bp, Triticum aestivum
  Clone ID: LIB3280-038-P1-K1-A4
tggttttttttttttttttttttttttttttaagaaaaacaccaaatccagcaaagtacaggagaagtccgtgaccaagagaacaaaaaaaataggtttt

SEQ ID NO: 2081 - DNA, 127 bp, Triticum aestivum
  Clone ID: LIB3280-038-P1-K1-A6
caaggtggtgcaccgcgtgaccgacgccgacaacgcgctccgcgccggcgacccgttccccggcacatcggcgaactccaccgtcaccgacaccgaccgctacgcggcggccaaggagctctacctc

SEQ ID NO: 2082 - DNA, 183 bp, Triticum aestivum
  Clone ID: LIB3280-038-P1-K1-A7
acatctaaccagatatatatatttaaattaaatcaataaataattataaacttaccgcgtgaaataagcatctaactatctcaaaaaacaatcaagaactctaaaaataacaataaactcgactccggcctgaacttgattccacctattattcattcaagcactcactatgttgaaaatcaa

SEQ ID NO: 2083 - DNA, 199 bp, Triticum aestivum
  unsure (1)...(199): unsure at all n locations
  Clone ID: LIB3280-038-P1-K1-A8
cccacgcgtccggtttgaggatcaagtcattaaacatttggatttgtggaaaactactcatgggctaggactagagcaagtttttctttttcactgtgctgttgagacttttttgtttcttagctctctgaggactgagacctcattaaaaaataatgaattggaaggacaaagtaaagtctcgctggacaaaananaa

SEQ ID NO: 2084 - DNA, 198 bp, Triticum aestivum
  Clone ID: LIB3280-038-P1-K1-A9
ggagaggaatatattctgaggtcaatctcattacacaatacgtacatacatagatcggacattcagtacacatgatctatagtatacccagcttagtttagagccgatggattacttcttatctttctttcttttttgcggggaaggattacttctttatctatagagcaaccttgtagagcaaccattatcacgagc

SEQ ID NO: 2085 - DNA, 465 bp, Triticum aestivum
  Clone ID: LIB3280-038-P1-K1-B1
acatgattgctttgtcatttgtccgcaaaggatcagatttggtgaccgtcagacagcttcttggacagcatgcaaagcgcatcaagttaatgtcaaaggttgaaaaccaagagggcattgtaaactttgatgacattctgagggaaaccgatgtctttatggttgctagaggtgatcttggaatggagattccagtcgagaagatattccttgcacagaaaatgatgatctacaagtgcaaccttgctgggaagcctgtggtcacagcgacacagatgctcgagtccatgatcaagtcccccaggccaacccgcgctgaggctactgatgttgcaaatgctgtgctcgatggaactgattgcgtcatgctcagtggcgaaagcgctgctggagcataccctgaggtggctgtgaagatcatggcgcgcatctgcgttgaggcagagtcttccctggataacgacg

SEQ ID NO: 2086 - DNA, 377 bp, Triticum aestivum
  Clone ID: LIB3280-038-P1-K1-B10
gtaaggattagcactctcgagaaggcaaacatgtatatgggcactacacacgcttacaaaaatacaaatcaatcgatacatatatacttatatatatataacttaaaacaaaacagagcaactaaaaaaacagaggacaaaaaaacaaatggcacattctaattcatcaagtagggaccaaatggtgagaccatctgtccattgattagcaaactagcatccgacggtgaaccatttccggtcagccgacggccggttggcgcgctccgccttccttttctcctcctcgcaggcgcacttggcctccttcagctttttcaccttggctgggtggctggtcttgttgcggtagagctggcgggcgcccctttgcagga

SEQ ID NO: 2087 - DNA, 314 bp, Triticum aestivum
  Clone ID: LIB3280-038-P1-K1-B11
gcgctgggtatggcgggaggaagactgaggaggagggctatggtggttctgggtatggatctggcaggaaggtgcaaggcgaggatgaaggtgcctatgggtctggtgggtaccagaagcccaagccgtatggagaggagacccagggttcatatggtggtgggtatggccaggggaactatggccgcaagaagcaggatgacgactctgatgatgagaagaagaaccgttacgcgaagcgcgatgactctgatgatgagaagaaggaacgttacgagaagcaccaccaccatcgccgccacaactacgatgac

SEQ ID NO: 2088 - DNA, 448 bp, Triticum aestivum
  Clone ID: LIB3280-038-P1-K1-B12
cggacgcgtggggctcagagaaagtggtcaaggccaacatcaaacatatgctcttggaattaaagaggtctgggagatagaagaaggaaagcataagccaggttctgtggttcatactgtagggtggcctttggacatgaagacatatggaggatcatttctataccaccttgatgatagacagttggcaattggtctggttgttgccttgaattatcgaaatccttttctcagcccatacgatgagttccagaaattcaagcagcaccccgcaatcagaacacttcttgaaggtggaacagttcttcagtatggtgctcgtactttgaatgaaggtggttttcagtcaataccaaatccagttttccccggtggtgcaattattggatgctctgcagggttcctaaatgttcccaaaataaaaggatcacataccgctatgaaatca

SEQ ID NO: 2089 - DNA, 292 bp, Triticum aestivum
  Clone ID: LIB3280-038-P1-K1-B2
atcgctgtcctcctccacccaaccccaaccccaaccctaaccctagccgcgccgggccgcgccgtcaccatcgagcgccaaatccctaatctccctccaccagacccagacagaccccaatccaaagctagccgccatggcccctccgatggttctccttgaccgggagattgagttccggcccgaccccgacctgcgggggttcttgggcgatagagggccacaaacccgcgatgccctgaccatgagcgaacaagttatggagtacctgcggaccttcaagggccgcgcg

SEQ ID NO: 2090 - DNA, 389 bp, Triticum aestivum
  unsure (1)...(389): unsure at all n locations
  Clone ID: LIB3280-038-P1-K1-B3
cggacgcgtgggtgtctggtgactggcgaatatgggtggaccgccaacatggagaggatcatgaaggcccaggccttaagggactcgagcatggctggctacatgtcgagcaagaagaccatggagatcaaccctgagaacgccatcatggacgagctccgtaagcgtgccgatgccgacaagaacgacaagtctgtcaaggacctcgtgatgctgctcttcgagacctccctgctcacctgcggcttcagcctggaggaccccaacaccttcggcaccaggatccaccgcatgctcaagcttggcctgagcattgatgaggatgacgaggcgccagagaacgacaccgacatgccgcccctggaggacgacaccngcgagagcaagat

SEQ ID NO: 2091 - DNA, 442 bp, Triticum aestivum
  Clone ID: LIB3280-038-P1-K1-B4
cggacgcgtgggcacagcgtacacaacacagcacaaacacaaaccaatcgagatccaaagcaaccaagagcaatggcgggcgagaaggggctggtgctgctggacttctgggtgagcccgttcgggcagcgcgtccgcatcgcgctggccgagaagggcctgccctacgagtacgtggaggaggacctgatggccggcaagagcgaccgcctcctccgctccaacccggtgcacaagaagatcccggtgctcctccacgacggccgccccgtcaacgagtccctcatcatcctccagtacctcgaggacgccttcccggacgccccggccctcctcccctccgacccctacgcgcgcgcgcaggcccgcttctgggccgactacgtcgacaagaaggtctacgactgcggctcccggctctggaagctcaagggcgagccgc

SEQ ID NO: 2092 - DNA, 445 bp, Triticum aestivum
  Clone ID: LIB3280-038-P1-K1-B5
cggacgcgtgggcacagcgtacacaacacagcacaaacacaaaccaatcgagatccaaagcagccaagagcaatggcgggcgagaaggggctggtgctgctggacttctgggtgagcccgttcgggcagcgcgttcgcatcgcgctggccgagaagggcctgccctacgagtacgtggaggaggacctgatggccggcaagagcgaccgcctcctccgctccaacccggtgcacaagaagatcccggtgctcctccacgacggccgccccgtcaacgagtccctcatcatcctccagcaccttgaggacgccttcccggacgccccggccctcctcccctccgacccctacgcgcgcgcgcaggcccgcttctgggccgactacgtctacaagaaggtctactactgctgctcccggctctggaagctcatgggcgagccgtatg

SEQ ID NO: 2093 - DNA, 340 bp, Triticum aestivum
  Clone ID: LIB3280-038-P1-K1-B6
acgattctgagtcatgggcatacacccttatagaggagggctatggtggttctggctatggatcggtcccgaagagataccaagagtttccttgtttgcaagaaaaaaatggttacctctccccatatgctatgcagaggctgcccacctccgatcaaacagtttcttgagtctgtcacaaatatgaaatttgatgaagagccaaattacgccaaacttatttctctctttgaaagtttgattgaatcacctgcatcaaggcccatcagaattgatggggcccttaaggtggggcaaaaacgtggaaggctacttgtaaatcatgaagaagatgatcact

SEQ ID NO: 2094 - DNA, 440 bp, Triticum aestivum
  Clone ID: LIB3280-038-P1-K1-B7
atctgtgtactccttcacccaaccccaaccgcaaacataaccctacccgcacccagcctcgggggcaccatgcaaaccgaaatacctaatcttcctacaccagaccacacacaaccccaatccaaatctagccaccttgtcccctaacctggttcttctataccggctaaatgagttcctcccctacccatacctgcggagattatgtggctatagaagaccacaaacccgtaatgccataaccatgatcgaacaactgatggaatacctgcacaccttcaaggccccatcagcaattcacgaaccgccaaaaccgttcttgctacacatactggagccgccgttatccgacccactgccggcgtcatacataggcctgaactcgctcctcatctacaccacggacaagaacctgttcacactctacgccgtctggtacc

SEQ ID NO: 2095 - DNA, 285 bp, Triticum aestivum
  Clone ID: LIB3280-038-P1-K1-B8
tccggtcaagtctcctcctccaccggcaccagttagttccccaccaccagcaccggtgaagcctccacccgcaccggtgagctcaccacctcctccggtgaaatcgccaccacctccagccccagttagctcaccgccgcctctagtcaagtcttctccaccaccggcaccggtcaactcaccgccaccagcaccagtgttgttgcctcctccagcaaaatccaccccagcaccggtgaaagaagagccacagtcacctccagcgggatcacttacacccccaaa

SEQ ID NO: 2096 - DNA, 265 bp, Triticum aestivum
  Clone ID: LIB3280-038-P1-K1-B9
gtagtaattagcactctcagaaggcaaacatgtatatgggcactacacacgcttacaaaaatacaaatcaatcgatacatatatacttatatatatataacttaaaacaaaacagagcaactaaaaaaacagaggacaaaaaaacaaatggcacattctaattcatcaagtagggaccaaatggtgagaccatctgtccattgattagcaaactagcatgcgacggtgaaccatctctggtcagccgacggccgagtggcgcgct

SEQ ID NO: 2097 - DNA, 244 bp, Triticum aestivum
  Clone ID: LIB3280-038-P1-K1-C1
gaacacccccccgacccacgcctccgaaacccaatctttcattcaaccctaacgcattctatcttctttcctttaaacaaatcagggatcaactatctgggaatctataacataactttcatctctcctaaatccataaatcaatcaaatctgtcaaaacatatatacaaatatccttataattaaaaacaaaacatagcaattttttaaacttaattcatgaacacaattacctccctttaac

SEQ ID NO: 2098 - DNA, 393 bp, Triticum aestivum
  Clone ID: LIB3280-038-P1-K1-C10
ttttccacctcatgattttgcgaacagaagcgattatggaggccaaatcactagcttcaataagaagccagccagcagcagttaaactgaattgcagaagaaaaaaaagggaaaacaaaacaaataaggaacgaattcccctgacatcacatctctatacaggttcgttttgcaacaaaaactgccagcaacacccaagggtttgttcactgatgcttatttctcctcgatatctcaacgtgttagaagagtactcatcttcatcttcaggttggtgacctatgggagtgtagctctcaactcctttctgtctgcgccaaatgactcaacgccgaaacccttaacgtagacatttgtaaagagctcagaagcatcaggcataggactttcctt

SEQ ID NO: 2099 - DNA, 393 bp, Triticum aestivum
  Clone ID: LIB3280-038-P1-K1-C12
gtgaagagcgtgatccaggtggacgactacaagaagccgaggtactcggggtcgatcgacgctctcaagaagatcgtcgcggccgacggggtcaagggcctgtacaaggggttcggccccgccatggcccgcagcgtcccggcaaatgccgccaccttcgtggcctacgagatcacgcggtcggccatgggctgactgacccaaggtcccggcgccgccctaagtctcttctccgacgcggctgaagcggcgttccacggagcaactgagagataattcaggaccatggcaaacaaaagaaaggaaaaattaaccattcttctttgctgcgacgttgtttctgaaaaccttgcatagactggcagcaatggcaggatcgttggtgataataaa

SEQ ID NO: 2100 - DNA, 457 bp, Triticum aestivum
  Clone ID: LIB3280-038-P1-K1-C4
agaagaaagccggaattatagataaaggacagaccacaagcaagtttcccaccaaaatacagtctttggcagtatgactccgaaaaatgtgatccgtttcattttggtgctgatccatgtgagcagctgtttgggtagatcagggaaaatgttttctcctagctttatctcagtggcgaagtcattgtcaagctggccaattttcagcgcagggatatctgtaactgttgcacttgttctgtccttgtttctaactttcgagcatctctgcgcgtaccatcaacctgaggagcagaagttcttgattggtctcattatgatggttccagtatatgctgttcaatcattcttctcattactgaattcaaaggttgctttcatctgtgagatgatgcgggattgttatgaggcattcgcaatgtattgctttgagagatatctgatagcatgcttaggt

SEQ ID NO: 2101 - DNA, 273 bp, Triticum aestivum
  Clone ID: LIB3280-038-P1-K1-C5
aaaaaaaaagggggggccccttattttaattaaaagggggggcccaaggaaggacatttttggtcaaacacacccgaggggggcatacaaaattacggaacacgaacgggggttttattttattaagcgccccccccccaaagcccatgcgggggttgggaaaaaaaccctgggggggggaaaactgggggggagggggcttgtttgtttgccctcctaaacctggggctcccctttgccggccggccttttgggccccggttaatttgcaat

SEQ ID NO: 2102 - DNA, 427 bp, Triticum aestivum
  Clone ID: LIB3280-038-P1-K1-C6
aatttgtataaatttttgtctttcatttttatccactacagccaagtggactgctccatccttttccacaaagcgaatagtcaggttctaaaagtactgcagacacacacgccgtactgcatggatgcgccggcaaaccgcacggagggaggctcgctgtccaaattacaggaactgcaaaaaatggcaacaaaactgcaacaatagctacggcggtggaactggtgctccgattaaccacacataggggagcaccaaactgcatgcatgggggtggactccaggtgcgggcgcgcctcgccgtgtggccacaacaccttggccggaggcagcagacctgcacaatcatagcttgtcgtgcggctatcgttgtcttctcaggcaaaaatcccagcgagtagcacggctggaggcgtggctccctgac

SEQ ID NO: 2103 - DNA, 188 bp, Triticum aestivum
  Clone ID: LIB3280-038-P1-K1-C7
gagaaaagcaagcagaaatgatttggtgatgacaaaataacgtacgtctgccatccatccatccatccatacatctagtagttcatcatcatcaactcgactggaaataataaaagcaacagcggcagcatctctaatgtaatgatcaacaaaagacagccagcatatgcgagttcatgcctagaccg

SEQ ID NO: 2104 - DNA, 256 bp, Triticum aestivum
  Clone ID: LIB3280-038-P1-K1-C8
gcaactgcgagatgtgtaccaaggagtagactgctctgtctactctggtcgtctagttattagctagggaggcgtaccaccaataaactaaatccatatggagctagagaataatagttattctaggagtgtatatgcatgtcgtcgatgacatgcatgtgcatgcatgttactggctagccagtacgcttcagcttgagcagattgtggaactgatcgatcaataaagattctggatgtgagttccgttttgttt

SEQ ID NO: 2105 - DNA, 278 bp, Triticum aestivum
  Clone ID: LIB3280-038-P1-K1-C9
aattgggggtattaaaaaggggttattaagttatattatttaataaaaaaattaataatgtttttttaggggaaaaaaatttttatttaaattttttttttaacaaaaaacccgggggggggaaaaggggaaaaaaagcccaaaccccagaaagggggaacccaaaaaaaaagggaaaaaaaaaagggcggggcccaaaaaagaaaaaggcaacaaaaaagcggaaccacggggggagaagaaaaaatcatgggggggggggggggcagggggaacac

SEQ ID NO: 2106 - DNA, 361 bp, Triticum aestivum
  unsure (1)...(361): unsure at all n locations
  Clone ID: LIB3280-038-P1-K1-D1
ccggccggaccgacgcgtccgacttgtacaagatgaccagccgccctaaaggattttatttggtgaccgttagacagattgggggacagcatgcggggagctttatgtgacttcaatggtggaaaaccaagagggcttcgttaacttcgaagacatgctgagggaaaccgctggcttaacntgggctagaggcgttcttgggatgaaaaaaccagccaagaaaatcttcccagaacagaatatgatgatgaacaagtgccaccttgctggcaagcatgggctctcagccacacaaaggctcacgcccatgaccatgtactgcacttcattgggcgctgcggctacttatgattcaaatgct

SEQ ID NO: 2107 - DNA, 395 bp, Triticum aestivum
  Clone ID: LIB3280-038-P1-K1-D10
atggggcatagatacatgggggtataaagagcaaattgccgataaaatataaatcatgaaaggctttaagtttttcaaatgaaaccataccaccatatcttcatttagttcctttggaaatctaaaggtctaaccgaatggttcattttagaaggtgataattctcaacaaataactaatctaacttgtaaacaaacaattcatgttgggaagccacaaagaaacagtccagatttattgttgtaatacatgtacatgtatttaatcgacttacaaggacttttttgcattcatgtgcatgttgtgacacagtatataacttattgttagctttatatgaaccagacattcacatttcattaccttgtatatgaggcttgggcctacttttatat

SEQ ID NO: 2108 - DNA, 419 bp, Triticum aestivum
  Clone ID: LIB3280-038-P1-K1-D11
ctgtctttcaaaattttgttgatatgttgatgatatcttgcatgccaacaaaaaatgttggcttttcaaggcctcctgccatttggaaaaggttctgaaacaaaatggatcatttccggtcctttctaacaactcatcactaaacctggacctctcctaattaatctcaactaaatcaacaagctagctagctatggctagtctaggctactctgaatcctcgatctaccgggccgggctgttgctactgccccagacgcttgttcatcgtgggggtcttcatctcccatgcacgcaggttggtgagcttgatgtccgactcgccattgttgaagacgaacaggtgtgcattgtccccgacggccttcctcgggtagaccctcgtgaggatgcacgtcttgccgccggcaccaaaactt

SEQ ID NO: 2109 - DNA, 400 bp, Triticum aestivum
  Clone ID: LIB3280-038-P1-K1-D12
ctgtctttcaaaattgtgttgatatgtgggtgatatcttgcatgccaacaaaaaatgttggcttttcaaggcctcctgccatttggaaaaggttctgaaacaaaatggatcatttccggtcctttctaacaactcatcactaaacctggacctctcctaattaatctcaactaaatcaacaagctagctagctatggctagtctaggctactctgaatcctcgatctaccgggccgggctgttgctactgccccagacgcttgttcatcgtgggggtcttcatctcccatgcacgcaggttggtgagcttgatgtccgactcgccattgttgaagacgaacaggtgtgcattgtccccgacggcctttctcggttagaccctggtgaggatgcacttttt

SEQ ID NO: 2110 - DNA, 384 bp, Triticum aestivum
  Clone ID: LIB3280-038-P1-K1-D2
gaataagatgaaacgagccttccaatttaccaaaacaagcagagcagagcagagcaggtcatcctagcaacaacctctgcgtccccaaaacaggcagcgtttgttttttgtgttatggagactctcaaatctgttgacataaagtatgatgatgattctattgcgggctggcgggaaaaaacacggcgaatttcgactagttactagcacaaccggaccggacggaataaataacagcaaccgtcttcaaatttttctcaagctcactaaagctagggagacaaaacaaattctctcattccacctcccaggagatcggattcgtcatcacctctcctgactggctgtcaccctctgcatgatcatcgcctcggccgcctggat

SEQ ID NO: 2111 - DNA, 262 bp, Triticum aestivum
  unsure (1)...(262): unsure at all n locations
  Clone ID: LIB3280-038-P1-K1-D3
cgaacgccaaaaacgcgagcggacgccncaaaaaagagngagaaaaaaaagggggaaaaaacaggagggggacaaaagcaaagggcccacaaaaaaaaaagcaagaaaggcccaaagngggacaaaagaaaccaaaccaccagaacgcaaanaaggggcaagggaaaacaaaagggcgaaccggaaggaacaggggagaaggggcgaaaccacaacaaaaaacaaaacaaacggccaaacaaacagaacaagaggggaagcc

SEQ ID NO: 2112 - DNA, 338 bp, Triticum aestivum
  Clone ID: LIB3280-038-P1-K1-D4
gggaattgaattttttttttttattttttttttttatgggaaaaaaatagttttcaagaaacaaaactcaaaaatgtttacaggtggggttaaggaaccccatttatataaaaaaatacaagccctaaaggtggaccttcttggttttataggtaacaagggggtgtttctggaacaacaacttttttttggccaccaaaaattttttttggaaaaacccattttaatttgccatgcaaaaggtgaaattattaaacgctttttaaggaaacaaaggattggttttttttaaaaacaggcgggaggaaacccccccttgggtttaacatggaaaaccc

SEQ ID NO: 2113 - DNA, 259 bp, Triticum aestivum
  Clone ID: LIB3280-038-P1-K1-D5
tttttcttttaatatcgtttttttctttggggaatatatacatcccaacaaaacatatttcttcttcagaaccaattccttttcaaaaacacctatcccacattctttacaatccgtctctaagatcccccattactaatctccatcccctcctataatttctcccttcctgttcaatttacccaccgtgtcttttcctggaaacaccaactccttttccccccccaacaatttttttctaatcccccatcctcttttc

SEQ ID NO: 2114 - DNA, 441 bp, Triticum aestivum
  unsure (1)...(441): unsure at all n locations
  Clone ID: LIB3280-038-P1-K1-D6
gtgcaagaagaagtgcatcgtcggttgctacaaggacctgccgccggtgtgctacaagatgtgcgtctcccagacctgcctcaccctgccaccatgtaaacgaggggattgcttcaaagcatgcgggatcaaatgcttccacaaccagccgtaccccgggccaaacccgggtccaacacctcctaggcccatgccaccgccgccatcacctccgaagcccatggccgcggccgtcgcccatgccaccgaagccatccccgccgaaggccgctgccaaagccaatggctactagttgtatccgcgtcgagcaacactagcaacaactgatgggtgtacgtcggtacgcgacgaaggtctatgcacacatacattcaaaaaggacgatatgaatatatgaaggcgccctatatgattgctnnnnaaaaaaaaannnnnaaaaa

SEQ ID NO: 2115 - DNA, 445 bp, Triticum aestivum
  Clone ID: LIB3280-038-P1-K1-D8
cgaaacccagccctagaagccgccgccgcctccaataaacccgatggctttgcgctccatcgccagaaagttgccggccctcggtgccaggtcgccgccgatgggcccccgtatcgggccggtccacgcgctctcgccggcggcgggttctcgcctcatgtcccacggtggcagtggcacggggggacaagtggtttattctgatgatgataaaacgctggccaaacagcgtgaggaaataaagcgcatgactgcagagtttgaccagagtatgaaggatatatccaagaatttggatgatatggatttagctgagaggcgtagcaaggaggacttggcaaatttccacaggaggctggataacatgcaaaaggtggtcaatgttgctcttattgtgctggtgcctacaagcattatgatttttttgtctctgtagtatcatctc

SEQ ID NO: 2116 - DNA, 402 bp, Triticum aestivum
  Clone ID: LIB3280-038-P1-K1-D9
ttgaacatagatacatgattcttcaagagcaaattgccgagaaaatataaagcatgaaaggctttaagttgtacaaatgaaaccataccaccatatcttcatttagtttctttggaaatctaaaggtctaaccggatggtacatgtgagaaggtgtgaatccacaacaaaaaactaaactaacttccaaacaaacatttcaagtttggaagccacaaagaagcagcccagatctctcgttgtagtacaggtacatgtccttaatcgtctccaaggacttcttggcattcttgtgcaggttggacacagcaatcctcgttgcgagctgcagaagaaccacacaggcaccttccttcaccttgcctttgatgcttggccctactttcatatttgatgcacaccg

SEQ ID NO: 2117 - DNA, 398 bp, Triticum aestivum
  Clone ID: LIB3280-038-P1-K1-E1
ccctcaagctcgacgcccagatcccctgcggccaagcccttctacccgtgagtcaagtcccagtccggctgctctgcttcccagctgctccttcaatccggcttcggcagctcacttctcaccacggttcagcacctcaacaaggtattagttagtcatggtgttcagcaaggtggaagttaacttgagaaggctgcttgaggcggccccccgccagcagaatcaggctaagcttgtccattacataaccaacagcagggagctggtggagcaacttggagctgaaattacaccagaaggaatatcaagtgtttcaaaagctaagctcagtgagtattcagaaaagattgaagcactagctgccacgcttgcttctctagtgccagaaaatgaaaatc

SEQ ID NO: 2118 - DNA, 454 bp, Triticum aestivum
  Clone ID: LIB3280-038-P1-K1-E10
cccacgcgtccgagaaaatcccttccatccagccgccgccgcaacaatcccttccggcagatgtgcacgacctacccttccccggccagccgccaccaaccatgcttgcctctggccagccgcccctgctgaccctgccgccctcaccgccggcggtcctcgataagcaacctctccagagatgcgggatcaagccgccgccaccatggattcagccgccacgccccaatcgatggtcctcatggccagccatcgccggtgacttacaccgccatgcccaacggccccctgccagtcaccgccgctccacagatgagcattaattccatcatattccttcgtcttacccgcttttatgtcgcaaactcttccacctccatgccacaaatgcatatgaaacggcctcacaacactaaatttacggtcgtcattatctcctgcttcattaccctgc

SEQ ID NO: 2119 - DNA, 449 bp, Triticum aestivum
  unsure (1)...(449): unsure at all n locations
  Clone ID: LIB3280-038-P1-K1-E11
cccacgcgtccgctcaattcctaacacggattacagaagcgaaggcgacgatggccgtgagcaagcgatggacgcgggtgcgcacgcttggccgcggcgcgtcgggggccgaggtcttcctcgccgtggacgacgcctcgggcgagctcttcgcggtcaagtcggcgagcgcagcttgctcggcggcgctgaggagggagcagcgtctcatgtccggcctgcaatccccgcgcgtggtctactgcatcggcggccacggcgcccgtgatggttcctaccagctcttcctcgagttcgcccccggcggctcgctggcggaccgggtggcgatcgacgggggcctcgacgagcgcgccgtccgcagctacgcggccgacgtggcggccgggatcgcgtacctccacgccaccgggatggtgcacggngacgtcaaggcgcagaacattatg

SEQ ID NO: 2120 - DNA, 195 bp, Triticum aestivum
  Clone ID: LIB3280-038-P1-K1-E12
tcgctcacgcgttcattcaatttctatcacggattactaaatccaatgcaatgatcgtcgtgatgcagcgatggaaatgggtacacacttctcgtcacccaactataatggctctaagcttattcgcctttgaccacctctcgtactagctaataggggccaacttatcgaccttaccatcatctgcgcagctta

SEQ ID NO: 2121 - DNA, 101 bp, Triticum aestivum
  Clone ID: LIB3280-038-P1-K1-E2
gtaagttgtgtaagagctacatggcttcgtcttacaaacaggaacagttctgtgcttatttttcaaatatttgtgataatctagcaatttgttcgcaaacc

SEQ ID NO: 2122 - DNA, 221 bp, Triticum aestivum
  unsure (1)...(221): unsure at all n locations
  Clone ID: LIB3280-038-P1-K1-E3
nnnnnnnnnnnnnntnnnnnnnnntgnnnnttttttttggggtttttttttttttgtttttttttttttttttgttttttttttttttttttttttttttttttttttttttttgtttttttttttttttttttttttttttttgttttgtttttttttttttttttttgtttttgttttttttttttttttttttttttttttttttttttttttttttt

SEQ ID NO: 2123 - DNA, 306 bp, Triticum aestivum
  Clone ID: LIB3280-038-P1-K1-E4
aatattattaatttttattattatttttgttaaaccgagggaattaaatattttaaaccagcaaaatgaaaagttttcaaccaatacttcatatttaaaaaacaccacatcttaaaattaaagaaaatgtggctccaaaataaatggaacacaaaaatcaataattgaaaccaatggggtgtcaaaaaccagaagaagacgggcttcttcaaactctaaaagggggataaaaaagcaaccaaaacatcgatctaaattctccatgacttccccaaagcgccgccgtttgagaggataaaaatatac

SEQ ID NO: 2124 - DNA, 373 bp, Triticum aestivum
  Clone ID: LIB3280-038-P1-K1-E5
atagaaataaataaaaaaaaaaacaaaatatataaaaaaaaaaaaaaaaaaaaaaaaaaaaaagaggaaaaaaaaaaaaggggaaaataaaaaaaaataaaaaaaaaataaaaaaaaaaaaaaaaaaaaaaaaaaagggccgacctttttgagggggcgccctttttaggggtcccagtttaccttccccgtccttcctatttttttttttttttttgggtccccccaatttattttcctggcccgttttttaaaacctcttggtttggaaaacctttggctttccccattttatccctttttaaccctttccctttttccccggttgtcttataacgaaggggcccccccccatttccctttccaaaaattg

SEQ ID NO: 2125 - DNA, 466 bp, Triticum aestivum
  Clone ID: LIB3280-038-P1-K1-E6
gccaacacagcgcgctcccgcctcgtcaaatcctaattccccatcgcccatcgccaaatctctccgcgcctccaccccgccagccgccatggaagcctcagccgccggcgccgtcgcgaaggcgaagaagtacgtggtggggcgcaagctcggcggcgggcccaggaagcaggcggtggcgcggtccgtcaaggccgggctgcagttccccgtcggccgcatcgggcggttcctcaagaagggccgctacgcgcagcgcgtcggcatgggcgcccccgtctacctcgcctccgtcctcgagtacctcgccgccgagctgctggagctcgccgggaacgccgccaaggacaacaagaagtcccgcatcatcccgcgccacctgctgctcgccatccggaacgaccaggagctcggcaggctgctcgccggcgtcaccatcgcccacggcggcgtgctgcccaacatc

SEQ ID NO: 2126 - DNA, 439 bp, Triticum aestivum
  Clone ID: LIB3280-038-P1-K1-E8
ggtcggggggggggaccgagggggggggggatcgggagcggtccactgggagttttagggggggggtaaacagggggggatgttggggggggggaaattgataattaaaaggggaggggtggagtggggcaacagggggggggggggggtggggggggggaggggggggggggggggggggggggggggggggggcggaggaagggggggggggggggggggggtgggggggggaggtgggggggggggggaggggggggggggggggggggaggcgggggggggagggggtggggggatggaggaagggggagggagggggggggggtgggggagggggaggtgcggggaaggggggagggagggaggggggtgggtgagggagaggtaggggggggggggggtggggggaggtggagaggggagaagggggggaggg

SEQ ID NO: 2127 - DNA, 313 bp, Triticum aestivum
  Clone ID: LIB3280-038-P1-K1-E9
ctttttttttttttttttgtacaagaacttcaggtatctttgtattccagtctattgaaacagtacgtgcacaggcttacaaaggagggcatatggcagttcgttttgaaaaaaaaaaggcatatggcagttcagctacatatacatcacagccacacactgcaacgaacgaactataaacacaccaattcagggagtaagaacataggcccaactactatctattggattccctttctccatgtcaaattctactcaaagaataggtacccttggcctatattgacagggagctttctttcttggacaggac

SEQ ID NO: 2128 - DNA, 420 bp, Triticum aestivum
  Clone ID: LIB3280-038-P1-K1-F1
ccacaagccaccgatcgcaaccggcctctgtcctctccacctcctcgccaccaccttggcatcagtgcctctccctcccccctctccctgcaacttttcccctcatctcgttggaatccatggcgtccaagtccgcggtcaccccaggtgggcagcccaagggcaaggaggagccctcctccatggcggacgtgtacaaccacgagctgacgccgctgcagaagcacgtcgccttcttcgaccggaacaaggacggcgtcatccacccctccgagacctacgaagggttccgcgcgatcgggtgcggcgtcgcgctgtccgccttcagcgccgtcttcatcaacggactgctcggtcccaagaccataccggagaacatgaaggttggagctttcaagtttccgatctacgtaaagaaca

SEQ ID NO: 2129 - DNA, 450 bp, Triticum aestivum
  Clone ID: LIB3280-038-P1-K1-F10
ctccgcactctccccttaccgccgggatggacgtgcagatgggcgagccgcaggcggcccgtcctcccgccgccgcagcggcggcgccggcgccggccccttccaccatccaacatctgaaggagatcgccgcggtgatcgaggcggggtcggtcaccaaggaggtccgccggatctcccgcgccgtccgcctcaccgtcgccctgcgccgccgcctcgccgcccgcgacgtctcggccttcctcgccttcgccctcccgggcaacagcgacgcatacgcccgcctcactcccctcctccccaaggatgatgaaactgggatggatattgatgcagcagctccagcaactcagatttctatcaagcatggccttcctgagattgaaatatatagttctttgcttgctctgattttcctcattgatcagaagacatacgatgaggctaaag

SEQ ID NO: 2130 - DNA, 448 bp, Triticum aestivum
  Clone ID: LIB3280-038-P1-K1-F11
cccacgcgtccgccctccgcgcccacgctgaatctgtcaacgccaccatccacgacggggaggtcatcgacgtcattgactccatgatgcagtcccgcgacagtggcctggttgatgggattccgagtgacttcccattccagatcctcaaagaggaggggcttaaagacatcactcttacaagaagtttgaatggggagcagattgaggtcatggtttccatgctcaaaccagatggggacgaggaggaatcctcggattctaggtatacgtcggatgaagacgaaggggacaatagcatacctctcagggtcacggtttccaaggccgatggatcaaaccttaaattcacctgcactgcctatcctgacaatgacaacatcttcatcgataccttgtccgtgagacacccaccatcacgggccaaagaacatgaggaagatatcct

SEQ ID NO: 2131 - DNA, 461 bp, Triticum aestivum
  unsure (1)...(461): unsure at all n locations
  Clone ID: LIB3280-038-P1-K1-F5
ctcctcttgttccagcatcgccgaacccgaaccacgccgtccggtccaccccgagaggagagcgcagcgacatgccggcgacgccgaccatcatcggtgccctgctggggctgggcacccagatgtactccaacgccctccggaagctcccctacatgcgccatccctgggagcatgtgctgggaatgggtctgggtgttgtgtttgtaaaccaactggtgaagtttgatgagaaggtcaaggtggaccttgacaagatgcttgagcgtgcgaaacacgccaatgagcagcgctactttgacgaagacgacgattagctattcaaatttgtttggcggctaccagggtttttgcagtttgctttggtcagaaaaactggctccgcatttcatctgcggtagtgtaataaactgatgtttcacagtacttgngttgtacttgtacgggagacctttttatgg

SEQ ID NO: 2132 - DNA, 429 bp, Triticum aestivum
  Clone ID: LIB3280-038-P1-K1-F6
ccacgcgtccgcccacccgttcgtcctcgctttcgtgacggctgatgctacccgccatcctctccgacagcagctgctactccagtgggcgccagaatcaattcaagatccaatccaagatcgcctcgttcatggcgtcattacaccagtcactacaccaacctagccgtgggcccaccggtggctgtgcgcgcaactgagcgcgtcaacaaagactgccacagacattggcggggacatgtggacgacgagctggaagaccgacaacctggccaacagggtggagccgcgggacgactggctgcaggactggcacccatacgtgaatggatacgtcaatggctccgactaccacttcgacctggagagggctgcggggaggcctgcgcctatgcccgcaccggcgcctgtatcgtagactgggtctag

SEQ ID NO: 2133 - DNA, 411 bp, Triticum aestivum
  Clone ID: LIB3280-038-P1-K1-F9
acaagcctcactctcagcataatattacataaaaatgtcaccccacagagaagcttcctttttagttcgagcaacaagaacacccacgggaactgcgttgttacggaacacacgtgcatttctctctttccatatttcccaagaaatcagtagcatcagagaaaccatcacccttcgggccgtgacatccccgagatatcatcaccatcactattattattcacattggcaagacatgataagaaatgctgatgaatgcttccggcgccgcatgcgcccacgctgttatcctactcaatcaaccgcgaccgtccatcccttcttgtcctccgccaggcccatctggatcgacgtcagagccgtgtaaagcttcttcgacaacgtgtcctccccggtcctgaactcgtacct

SEQ ID NO: 2134 - DNA, 419 bp, Triticum aestivum
  Clone ID: LIB3280-038-P1-K1-G10
actgctaaaaaccttcacaatcattaagttatgagcacaaactgtttggattcacctacctccggttatcgaatgagctactggagggacagaactatgccactttccaaacttttgttgagaaaatgcatgctaacctgggtcatgacccaagtgttgatccagtggcgcctttggaaagatcaaagccagaaatgccaattgaaatgatcctgaaagcagcgcagccaaaactggagccattcccctttgataagaataccgacctgccagttaaagatcacactgatgtcggggatgaggtgctcgttgcccctgtgtagaaatctttctctatcttcataaaataatgtgcatcactgatgcagtctacaagagggtcaagacgtgctttctgagaattgaggtgcacaggaaat

SEQ ID NO: 2135 - DNA, 390 bp, Triticum aestivum
  Clone ID: LIB3280-038-P1-K1-G11
cgaacgcgtgggctctgtagctcatgctatacaccaaccgcgccgccgtgctcggcgactacgaccaccgtgtttggacctaccacacctttttctatccaatgagcttctacacgctcacaattatcccagttctcaaagaggagatgcgaaaaggcctgctacccttggtcatgagccaagagcactaccagcgcgtccttcggacatataagcgccggtacttcctatacaattcatcctgaaaggagtatgaccaaaatctgggtctatatccctaacataataatgttcaacttgcacgacatgaatactatgatggagcctactaactgctatcttcccctggctagataaatttcactatatctaaataagatattgttgtat

SEQ ID NO: 2136 - DNA, 390 bp, Triticum aestivum
  Clone ID: LIB3280-038-P1-K1-G3
caccattgagaactcccgctccgacgagaagctcctgtcggtcttccgtgagggcgtgacctacggagccggcgtgggcccaggcgtctatgacatccactcccccaggatcccctccacggaggagattgccgaccgcgtcaacaagatgctcgcggtcctcgacaccaacatcctgtgggtgaaccctgactgcggcctcaagacccgcaagtacacggaggtgaagcccgccctgaccaacatggttgccgcggccaagctcatccgcacccagctcgccagcacaaagtgaggagctcacggaagcgagcagcctgatactactgcctaatgttttgtggggacaggccgccagatgaaccacatttgtttcgaataatccgattc

SEQ ID NO: 2137 - DNA, 305 bp, Triticum aestivum
  Clone ID: LIB3280-038-P1-K1-G5
ccgggaccgacgcgtccgcccacgcgttcgctcctcctcctccgccgttctccggctcccccggatcgcccgccgccgcccgctctcctgctggggctcgccgctcgccgtgttcgccaccatggagtcgccgtccgagggctaccgcaccaacgtcggcatcatgcctcgccgaccccaccctcaccaagatcttctccgtgtccaggatcgacatccccacggcgtggcagatgcctcagggtgggatagacccaggggaagagccacgagcagctgccattagggaatttgtgggaagaaac

SEQ ID NO: 2138 - DNA, 423 bp, Triticum aestivum
  Clone ID: LIB3280-038-P1-K1-G6
cggacgcgtgggatggattccactagtttgactgccgataagctggagctggccgaggtcttcgtgcagcccggcacttgggaggtgcagtaccaggtgtgctctcctgatgccatggggaagctgcttgccaaggctgggcttacgcagcctgcgcctgaggcctgatgtgctggtttgctgtggcttgcgatgcctactactcttagaccgcttaatcagttatgtttctgttgttttaagccaaactatttgacaattatgcattttaattttatgtcgaacatgcttcatattttctttatctgatggattgtcgtatgttaggtgaaaattgtgatccttgtgccccatgcttgattgttattgtgactaatgcgcttatagaaaactgcagcgaaacctatgtgtttgaccatgttc

SEQ ID NO: 2139 - DNA, 450 bp, Triticum aestivum
  unsure (1)...(450): unsure at all n locations
  Clone ID: LIB3280-038-P1-K1-G7
caaacgcggacttcctccctgagacgcacgcaccgcaccgcaccgccccgcgtcgcgagatctcaaatccccgatccgaccccaccggcggcgatggccggcaaggagctgagcgaggagcagattgcgtcgatgcgggaggccttctccctcttcgacactgacggcgacggccgcatcgccccctcggagctcggcgtcctcatgcgctccctgggtgggaacccgacgcaggcgcagctccgcgacatcaccgcccaggagaagctcacggcgcccttcgacttcaagcgattcctcgaactcatgcgcgcccacctncgcccggagcccttcgaccgcccgctccgcgacgccttccgcgtcctcgacaaggacgcgtcgggcaccgtctccgtcgcggacctccgccacgtnctcacctncatcggcgagaagctcgagccccat

SEQ ID NO: 2140 - DNA, 85 bp, Triticum aestivum
  Clone ID: LIB3280-038-P1-K1-G9
gaaaaaaaaaaaaaaaaaaaaaaaaaaaaaaaaaaaaaaaaaaaaaaaaaaaaaaaaaaataggaaaaaaaaaaaaaaaaggaaa

SEQ ID NO: 2141 - DNA, 192 bp, Triticum aestivum
  unsure (1)...(192): unsure at all n locations
  Clone ID: LIB3280-038-P1-K1-H11
gctgaacccgctcgcgttcctaaccaanaacgagaattccatttttgtttttttttctaagggggggaatgccactggtaagttaaaaacagccttttgcattctcctgtgagtggatctgagcatcaataattagcctgaatacaggacggatatgccttgtcgcgctatcaaccttgcttcgttttgttc

SEQ ID NO: 2142 - DNA, 464 bp, Triticum aestivum
  unsure (1)...(464): unsure at all n locations
  Clone ID: LIB3280-038-P1-K1-H12
agcacatttctgatattgtatcctatcggtatccttagcgaagttgtacacatcaacagggcagttcctgtatatggcggagccggcagactttgtccacatctttgatgtcaaaagtgattataacaagaggcaagagctggatttntttggtgagatatctggcatgtctttcagccctgacacggacacgctcttcgtcggtgtttgggacaggacctacggcagcctacttcagtatggccgcctctataactactcataccttgactcgctgttctaaggtcaatgcaaacaagtgttggttgggcctcttgtgtgtcacttctgccgattttcgtcggcgccgactattaagtactccataatcagatttatgttatagattggcattctttaataattcatgtatcctgtgttatgtgtacaaaagaaatgtatacagatatagctttgctttgagg

SEQ ID NO: 2143 - DNA, 76 bp, Triticum aestivum
  unsure (1)...(76): unsure at all n locations
  Clone ID: LIB3280-038-P1-K1-H2
ccgggccgtacccagcgtcccataggcgacaaactatgtatcattggtcttgaattcatcctgatnacatctcttc

SEQ ID NO: 2144 - DNA, 162 bp, Triticum aestivum
  Clone ID: LIB3280-038-P1-K1-H3
acgcgtccgttatgttataagtatttattacatatgtaccattacttgttacacacatagcttcgcaagggtgggtttaaagagaaagctaattatacaatctgcatcctctttttgcagctatcgacatgctaataggtgacagatatactaaattatcat

SEQ ID NO: 2145 - DNA, 398 bp, Triticum aestivum
  Clone ID: LIB3280-038-P1-K1-H5
ccggctcgacaccacgcttgcgtttctagaccacaagcagacggactattaatgatttcaatctcaaggagagcaagaccgggggaatctacatactcgccttcctattcatgtccctgcagaccatatcaacaataatcgggcccttacagaacctcctcgaccacctctcagaccccgtcaacaacaacatcctcaccagcctcaagttccactaggcgaaatcgatccgatccgatccgagcatcgtcgtcctgtgcatggtacccgtcgtcgtgggaaacgtgagcgtgcgagaggtatatatgcgagggtgggtgtaaaatgtaaatttgtacgcgtgctgcgtgcatgcttgtaatatttatatcgtgctaccaaaattagtgcattgcatc

SEQ ID NO: 2146 - DNA, 366 bp, Triticum aestivum
  Clone ID: LIB3280-038-P1-K1-H6
gggtaaccttggtgctataagatctattcgctacacatcagatggtcagttcctgtcgatggcggagccggcagactttgtccacatctttgatgtcaaaagtgattataacaagaggcaagagctgcatttctttggtgagatatctggcatgtctttcaggcctgacacggacacgctcttcgtcggtgtttgggacaggacctacggcagcctacttcagtatggccgcctctataactactcataccttgactcgctgttctaaggtcaatgcaaacaagtgttggttgggcctgttgtgtgtcacttctgccgattttcgtcagcgcccactattatgtacttactaataaagatttatgg

SEQ ID NO: 2147 - DNA, 389 bp, Triticum aestivum
  Clone ID: LIB3280-038-P1-K1-H8
gggcatcctgccggcggtgcgcacctacgtcgacaccacccccggcgagttcgactccttcggggacatcatgaacctctacgagggcggcatcaagctgcccatggtgcccgccctcgaggagctgcgcaagcagttcccgctccagctcatcaaggacctgctccccgtgggcggcgactcgctgctgaagctccctgtgccacatatcatccaggcggaccagcaggcgtggaggaccgacgaggagttcccgcgcgaggtgctcgccggcgtcaacccggtcatgatcacgcgtctcacggagttcccgccaaaaagtagtcttgaccctagcaagtttggtgaccacaccagcaccatcacggcggcacacattcagaaaaacc

SEQ ID NO: 2148 - DNA, 312 bp, Triticum aestivum
  Clone ID: LIB3280-038-P1-K1-H9
cccactcgtacattaactcataaatttgcacagatagataaatttatatataatcatttgcgcggggcatttcatgggccatatattatcacacagttcttagataggctctcacaccttctcacacatcttctcgtccgtatgtaccaatgcattaattactgacgaaccatcacacgatccaacaaccctatagaccatgtatcactccatgttcctcacgccgtactatatacccgtgcaatcactcgtctattgtttggacttctacatgaactcgtagtatattttgtatctactcccattgctttt

SEQ ID NO: 2149 - DNA, 440 bp, Triticum aestivum
  Clone ID: LIB3280-039-P1-K1-A1
cagggtcgacgccgcgcgtccggtcgatgactaccttaagagaagcaattactgtgttggtttaggaagcaactactatgggaggagcgacttcatgcctacgttttactcttatagcaaacaattgacaccctgacgatacgctaacgatctaataaggcgctacaggacccagctgaatgcattatacaactatggggctggaaagcttgcattgagtgcaattggagcaggtggttgtagacctaacgcgctcagaagacagccggacggtaggacttgcctagaccgcctcaactgagccaaccagagcttcaacaacaagctcagatctcttggtgatcagctcaacaacaatcaccctgatgcaaaggtcatctacatcaatgctgatggcattttccaggacatgaacacatattctggcagatttgggttta

SEQ ID NO: 2150 - DNA, 172 bp, Triticum aestivum
  Clone ID: LIB3280-039-P1-K1-A11
gtgtaagtgttctatgctgagcctctccacccactgtagcgaaccactgaaccagggggggattttgaaagatcttagatttcttctactaccgacaggggcagaaacggtacagtcttatgacatactgatcaagcactatggacagcggatcttggcgttttatgaggac

SEQ ID NO: 2151 - DNA, 381 bp, Triticum aestivum
  Clone ID: LIB3280-039-P1-K1-A12
gcaaccgatcatggggagacggtaatggccagcctctaactccccacccacgcgcccaggcgagtctctccttcttcccatcgccgccggcacgtctgcccgcccgcccgcgcgcgttgtgtcagtccgttcctcgaccgacgtcgcgcctaatcagttggcgacgcgtgcagttcccccggtggtcttaatcccttctgtttcgtcgatgcgaccgatcggccgtcccggagatcgatcggtaatttcgcggggtcgatcgggccgctgatccgcgggaggaactaggagccgtcgggcgcggccattcagcaatggcgagctgcgtgcggggctgctgctgcgtcctggtgctgctgctcgtcgcgctcggcatcacgg

SEQ ID NO: 2152 - DNA, 337 bp, Triticum aestivum
  Clone ID: LIB3280-039-P1-K1-A2
aggaagccccttctaagggaggagctacttcatgccttccatttactcttatatcagacaattcacaccccaacaataccctaacgatctacatcaggcgttacaggacgcagctcaatgcattatacaactatggagcttgaaagtttgcattgaatggcattagaccagttggtagtagtcctaacgcgctcgcaagtagtccggacggtaggacttgcgctgaccggatcaacttagcaaaccagatctttaacaacaagctcagatctcttggtgatcagctcaacaacgaatagccctgatgcaaagtttatctacatcaatgcttatggga

SEQ ID NO: 2153 - DNA, 328 bp, Triticum aestivum
  Clone ID: LIB3280-039-P1-K1-A3
agcgtccggtcgcgggaaagctcaggagatgtatttactttgttggtttaggaagccacgactatgggaggggggacttcatgcgtacgttttactcttctatcacacatttgacacccgaacaataccctaaggctctcatgaggcgtttcagcacccagctcaatgcatgatacaagtatgcgactctgagcgaggcattgaatggcagcggatcggggagtttctcatacaacgcgctggtaggcagtcccgacaggaggacttgcctagaccgtatcaactcagcaaaccagatctttagcatcaagcgatgaactcttgatga

SEQ ID NO: 2154 - DNA, 437 bp, Triticum aestivum
  Clone ID: LIB3280-039-P1-K1-A4
gacagacagggtcgcccagatcggagcagatgacggcggcagcgggagcggcgacccggccggcgctggtggtgggggcgctcgtggcggcgctgatgatgctgggctcggaggcggtgtggctcgacctgccgccctcggggaccaagtgcgtctccgaggagatccagcccaacgtggtggtggtcgcggactacatgctcatgtacgaggcccacgccaccgcccaccccaccgtggccgtcaaggttacctcaccatatggcaatactgtacatcacaaagaaaatgccacagtgggccagtttgcatttacaacttcagaagctggaaactaccttgcttgcttctggctagacagcgcagagaaaggatcaggagtatctctaaatcttgattggaagatagggattgcgacaaaggactgggactctgtt

SEQ ID NO: 2155 - DNA, 271 bp, Triticum aestivum
  Clone ID: LIB3280-039-P1-K1-A5
gtctgactgcgccggacggagccgccccacccaccgaagcgatccaccggaccggctagcggctgtagaaggcgggagatggcttctaccgccgtcggggaggaaaccgggccggcctttgacattctgatcaagcacgaggggtcccggcgcaaggcgttcttgaaggacccggaagggcgggttattttcgtcaccacgcgcgccgacttcctcgagcgcctttgggaacttcggcccagattcttttcgggccggggctttttttttt

SEQ ID NO: 2156 - DNA, 466 bp, Triticum aestivum
  Clone ID: LIB3280-039-P1-K1-A6
gggtgagctgccacaggcttttgcacgtctaagtgctgtttatggtggcacttatatggtaaataagccagagtgcaaggttgaatttgatatggaggggaaagtgtgtggtgttacgtcagaaggtgaaactgctaagtgcaagaaggttgtctgtgatccttcttacttggccaacaaggtaaggaagattggaaaagttgcacgagcaattgctattatgagccacccaattccaaatgcaaatgattcccactcgattcagattattttaccacaaaagcaacttgggcgcaagtcagacatgtatgtcttctgttgctcgtacactcacaatgtcgcgccaaaagggaagttcattgcatttgtgtctgctgaagcaaagactgataacccacagtccgaactaaagcctggaattgatctacttggtccagtagatgaattgttttttgatatgtatgac

SEQ ID NO: 2157 - DNA, 455 bp, Triticum aestivum
  unsure (1)...(455): unsure at all n locations
  Clone ID: LIB3280-039-P1-K1-A7
aaagacattgtgtaggttaatctttgctgtgttccatcttcagcctgaatagaagctgggatccattttgtttcctcttttgcacagacacagtacgacagacgaacccggcaacaccggctcacaacacccaccatcattgttcatcggtattactgtgtctgtgcaaaagaggaaataaaagacattgtgttggttaatctttgctgtgtttcatcttcagcctgaatagaagctttgatccattttgtttcctttgacgtactgtgtctgtgcaaaagaggaaataaaagacattgagtcggttaatctttgctgtgttccatcttcagcctgaatagaagctttgatccattttgtttggnanggantttctnaagcaaaactgataaacccacaggttgaactaaatcctggaattggtcttacttggttcagtagatgaaattgttttt

SEQ ID NO: 2158 - DNA, 395 bp, Triticum aestivum
  Clone ID: LIB3280-039-P1-K1-A8
gacgaaattgcgtaagtccatcgctgctgttttccatgttcagcctgactcggagcaggaggcatttcggttcgtcttttgcacatacacattgctgcagacgagcccggcattaccggctaacaacacccagcttcatggatcaagggtgttacgtgttctgtgcacttgaggaactagggaacgttgagttggaaaatttttgctgcgattgatctcaagactcaatcgaatcttaaagccattgagttccactttgttgacattattctgtcacaaaaggaactagacgcatggcgacagttatctttcctgtgctccatcactaacctgaatagagccgtaggggcattttttttgttagagttttgctgaaacatatacttgtatactca

SEQ ID NO: 2159 - DNA, 424 bp, Triticum aestivum
  Clone ID: LIB3280-039-P1-K1-A9
gtgaaagcgttgtatgttgagaatctgatgcagctggagagaacgatggataaaaatgctcatttggagagatctttgtcagctgctaccaccgaggttgcaggattgagacagaataaggccacactggaagaatcttgcaaacagcttagctccaagattaatggctaccagtctgagcgagccatgttcattgcgcggattgagggaatttctcataccatggagaagctatcagagaagaacgtgtttttggaaaatttattatctgaaaactatactgagcttgaaaaccataggatgaagcttaaagacttggaagagtctgcacaggcactccgcaatcaaaattctttacttcgatctgacaagagaactcttgtgcaggaggtggatagcatcaatggtgccttacttgatttgg

SEQ ID NO: 2160 - DNA, 500 bp, Triticum aestivum
  Clone ID: LIB3280-039-P1-K1-B1
attacaggctagactgctctgcacactgtctgaaagtcttaagggcttataaagagaacagggggagtgatacttagagggggggatattctttggcacccatcgagattctctagggacaaacacacaaggagatttactcaaaccacaatttcactagccacatgggcatggctagagctgggccatgataccacccaagcccaagggtacaggacatagactacagtttagcatatgttcacaaaagcttgttatctcaagcagcataacatgcatagagaaaattaccatgagcaaatgttaaacactatcagtttcctttaaaaatgagccaaaaagtgagaaattacacccaaacaaaactggtgtaataaatgcaaatttgcttacgagcatatacgccttggttgtgcgggagttaatgtataacctcacaacttgcatttcagagtgagagtgagacacacatcacacatactacacccgccgggatcata

SEQ ID NO: 2161 - DNA, 258 bp, Triticum aestivum
  Clone ID: LIB3280-039-P1-K1-B10
tatcctttcacccttgcctggccagattttttttacgtgggcggcggctgctgaggaggagaagcagcaatggagcaacgacttgttataggacggatcaaggtcgtccactgatctactcgtgccctccttttacttggcaaagcggcgcgtgccggccagaggaggtagcaccggcggagctgcctggttaatcaaggcgccggcgcggcccgcgggcatagcgcaagccgtcgctactggggtagttaaactcgc

SEQ ID NO: 2162 - DNA, 99 bp, Triticum aestivum
  Clone ID: LIB3280-039-P1-K1-B11
taacctttcaacctggaggggccagatttttttttttaggtcggcagctactggggaggagaggagtaatggagcaactacttcttctaggacatttca

SEQ ID NO: 2163 - DNA, 466 bp, Triticum aestivum
  Clone ID: LIB3280-039-P1-K1-B12
caccaaccagcagggctctgccactgccagagccaagcaactcaagaacagtagaacaccgacgatgaagaagctttgcaccaccaccgccaccaccactctggctctcattctcctcctcgtcctcatagcagccacgtccctccgtgtcgccatggctggatcagcgttctgcgacagcaagtgcggggtgaggtgctccaaggcgggccggcacgacgactgcctcaagtactgcgggatatgctgcgccgagtgcaactgcgtgccgtcggggacagccggcaacaaggacgagtgcccctgctaccgcgacaaaaccaccggccacggggcgcgcacgaggcccaagtgcccatgatccgccaccggccatggcgcctgcatagcatgtacctgaacttcatgcatttttatcatgtcgtactatgtcgcggggcactactaatatattatactatatggg

SEQ ID NO: 2164 - DNA, 351 bp, Triticum aestivum
  Clone ID: LIB3280-039-P1-K1-B2
tgatcctgccggggatggtctcacgcggcagcgagcagctcgtccgcggcgaggacgggtacgccacgcaggacgtcgtggccatggactcccccaacatcgtcacgctcgctcaaggccaggctgtctccgaccttctcaaggccatgtgagagagcacaactcgtacgtaatgtaattttggcaggaagatgactgcagaatttgcatacaaggtagtataaatttatggatgtgcaagcatgagcaaacatgtggcaaataattttttatgtcttagcatgcctccttgaggtctgttgtacatatatatacactttataaatgaatagtatataagacttgggggat

SEQ ID NO: 2165 - DNA, 441 bp, Triticum aestivum
  Clone ID: LIB3280-039-P1-K1-B3
agatcctgccggggatggtcttacgcggcaaagagcatctcgtgcgctgcgagcacgggggcgcgaagcaagacggcggggccatggactcccccaacattattacgctaggtcaaggccaggctgtgtccgaccttctcaaggccatgtgagagagcacaactggcacgtaatgtaatttgggcaggaagatgactgcataatctgcatacaaggtagtataaacatatggatgtgcaagcatgagcaaacatgtggcaaataattttttatgtcttagcatgcctacttgaggtctgtgcgacatatatatacactctatgaacgaataggatataagacttggaggatcaaaaaaagaaaaaaagggtcatcgctttacaggatccaagctgacctacggcgggcatacgacgtcatagctgttctatagtggcacct

SEQ ID NO: 2166 - DNA, 403 bp, Triticum aestivum
  Clone ID: LIB3280-039-P1-K1-B4
ggggggggtttttttttttttttttttttttttttttttttttttttttttttttttttttttttttttttttttttttttttttttttttgttttttaaaaaaaacaaaaaaaattttgccgcttttttaagggggcgggggggtttaaaaagtggtgtgggggcccccccctcttttttggccggaaaaaaaaaaaatccgtttttaggcccccccccccccccccctttgggggggggaacagttttttttttttaaaggggcgcggcccccaggtttggggggggattttataaaattaaagagggggggggggggcgcccccctttttatttggggggggccccccccccataaggggtttttaatccaaaggagagttgggggggtgtaaacccccc

SEQ ID NO: 2167 - DNA, 485 bp, Triticum aestivum
  Clone ID: LIB3280-039-P1-K1-B5
gcaaaaattgaagaacttctccaagaagaccacaatgctaaacgtagaagggaaaagtaccagaagcaatcatctgtgttgtcaaagctcacacgtcaacttagtatccatgacaatcgagctgctgcttcctcttattcaaatgatagccctgaagctgagagccctcggacacccggccgccctggcgaggactggaggtcagccttcgattctgcagcaaatggccctgccccgaacatcgaatcaaggtcgagaagtgccgatggtcgcaggcgctccgaaaatggggatcccaactctaccagccgacgcacaccaaaccgaatgccgccagcgccaccgagatactaatcgtgctgattagtatccatgatatattattatgtattcttgctaggcacacgccctgtttctgataattgggtggtgagattggtggagcagattgagattggacgaatagagtgagcgccttggtcgag

SEQ ID NO: 2168 - DNA, 409 bp, Triticum aestivum
  Clone ID: LIB3280-039-P1-K1-B6
aacaattgtaaatcttcctatttgaagagccctgcatctgtttagccaaacctacatgtatgtgacatgaacaaatagccattaaatggcatgcaggcaattcctagaaatgtacatttgatcccagcaaagtcactaactaccctagattacaaattaagtaactcttagattacaatgataaaaaagagtggcagcagtacatatcacctatgacagaccaaaaaacaattacctgtatatgcggctctgtaaagcactgaatatgcactaatataaccaaccaattgtccaaaaatatgacacaaacaggaaaaaatatatatctttcaaagtctgctttcagataaagcaaatggtatagaagttatggttctccatgtgcttctaaatggtcctgactatggag

SEQ ID NO: 2169 - DNA, 402 bp, Triticum aestivum
  Clone ID: LIB3280-039-P1-K1-B7
aaacagaggtaacagggagcctgaacatcagcacatcaagaaggaagctgatgatgatgaatacgaccatcttggcatggattgctgctgctgccatgcccatgtccagcaacatgttgttgtgccagtgctgcaatcttctactccaaacacgatcgcaggcaatgtggtcatgaacttttgggatacttaatgttccctgtatttttctagcaatgtcttaagtaggacgtagatgcaagggctcatataaatatcaatgaattgatattagttaccatgataatttggttatatatatgaccatatccgaatcattttaggcttataatggcatttgttttaatgatttatttataaagttttacaatggggccaagggggggattctttcttttttgt

SEQ ID NO: 2170 - DNA, 202 bp, Triticum aestivum
  Clone ID: LIB3280-039-P1-K1-B8
ttttatgttggtttttattattttgtttgtttttgttgtttttgccttgcggagaagcaacacccaaccttttcctttaattgaaataaaaggcgtccatcacaacctgggacgatttaaaaagggggcgcgctccctacctttaaccatacacatgggccccaccgccggggacacaaaagttattaaaagagaacacggg

SEQ ID NO: 2171 - DNA, 406 bp, Triticum aestivum
  unsure (1)...(406): unsure at all n locations
  Clone ID: LIB3280-039-P1-K1-B9
tatcctttcacccttccctttccagatctctcttccgtgggcggcggcggctgtagatcaaagcagcaatggagcaacgacgtggtagaggacggatcaaggtcgtccactgatctactcgtgccctccttctccttggcaaagcggcgcgtgccggccagaggaggtagcgccggcggagctgcctggcagatcaaggcgccggcgcggccggcgggcatagcgcgagcgggcgcgactggtggagtagagctcgcaagagtggctgccgcagcagagtgcccttgcgtgttggcagagtgtggcatgcatgcgtggtgagcaagggcaagtgaggtgtacgtgcgtggttttccaatctcagatntttcttgttagttttctgcgacaggagcttcaagaaaaa

SEQ ID NO: 2172 - DNA, 266 bp, Triticum aestivum
  Clone ID: LIB3280-039-P1-K1-C1
atacctgctatttttttgggtgaaataattagatggcgtgcaaatctagttgtccctaaaaaaaaaaaaaacttagaatgggtggattaaggtatacacaacctacaactaaaacaaatataagaagtgcggggcggccgttccaaacctagaactacttcaagagggattatacctacaccgcgcttattaaactcaaaccccgtattttcaaaaatccattaagtctttctttatttatgcacatttactgtttatacgaaact

SEQ ID NO: 2173 - DNA, 71 bp, Triticum aestivum
  Clone ID: LIB3280-039-P1-K1-C10
tcgcgctttagcatcagcggtcgcgtggttcgtcccccgtttactagcccggctccttcaggcgtcctggc

SEQ ID NO: 2174 - DNA, 181 bp, Triticum aestivum
  Clone ID: LIB3280-039-P1-K1-C11
tcccggtcgactcacgcgtgcgtgtcagtgctcgagatcgttagcgagtcagaccatatgagtgttatgattttcttttgcgggggagtgcaggcaaagggtaaagaaaaatcccgcgtaaccgcatctcctaggaaataagtcttgtgctggcctggactagctggccataatttttgcg

SEQ ID NO: 2175 - DNA, 311 bp, Triticum aestivum
  Clone ID: LIB3280-039-P1-K1-C12
ctgaggttgctgttcgcaaaaagatcgactattggacttatgactcgaaaaaagaaacaggttatgttggtctcaagaatcagggtgctacctgttatatgaactctcttctgcaaaccctgtatcatataccttactttcggaaggctgtatatcacatgccaactactgagaatgacatgccatctgggagtattcctttagccctgcagagccttttttacaagctccagtatagcgacaatagtgtagctacaaaagagttgactaaatctttcgggtgggacacctatgattctttcatgcagcat

SEQ ID NO: 2176 - DNA, 93 bp, Triticum aestivum
  Clone ID: LIB3280-039-P1-K1-C4
ccctttttatcgctcgtttggtgccgctgtttaagaaccaagttctcgggccattccatgctacgttattgtttttcaataatagtacctaat

SEQ ID NO: 2177 - DNA, 166 bp, Triticum aestivum
  Clone ID: LIB3280-039-P1-K1-C5
tgtagttgcttgattagcttaagaatcaatcatatgagtgttaggatttccgttagcttaggagtgaagccactgtagagagaaacagacacgcatatgttatttacatctttattaggcctgtggaacaataatcaagtgaagaggaataaagtggttagtagtt

SEQ ID NO: 2178 - DNA, 440 bp, Triticum aestivum
  Clone ID: LIB3280-039-P1-K1-C6
cccacgcgtccgcggacgcgtggggacggagagcaacgaggagtacacggagtggaccaccgtgatccggcaggtcatcaccgagaactgccagcccaccgacgacggcgagatgcccttcgactacggcatgtactcgtcggccgtcacctcggacgtgaccacctccaaagacatgaccaccaagctcctcttctgcctctggtggggcctcgccaacttgagtacgctaggccaagggctcaagacaaccatctacaccggggagtcgctcttcgccattacgctcgccaccttcggccttatcctaatggccatgctcatcggaaacattcagacgtatctgcaatcgctgaccgtgcggctggaggagatgcgggtgaagcggctggactcggagcagtggatgcaccaccgcctgctgccgatggagctgcgcg

SEQ ID NO: 2179 - DNA, 393 bp, Triticum aestivum
  Clone ID: LIB3280-039-P1-K1-C7
cccacgcgttcgaggacgcgtggggtcagtcagctacgaggagtgcactgcgtgggggagcgtgatccggcagggatcaccgaaaactgccagcctcacctgagacacgtagatgctctgtctagtacaacatgaactctgtggccaggacttcagacgtgactacctccaaagacatgaccacgaagctccttttataggtttgaaggtgacttcccaactcgagtacgctaggccatgggctcaagacaaccatatacaccggggaggggctgtgcgccaccacgctcgccaccttaagactcatcctaaaggccatgcttatcggaaacatttaatcgtatttgcaatagctgaccgaactgctggaagagatgcaggtgaagcggtggt

SEQ ID NO: 2180 - DNA, 438 bp, Triticum aestivum
  Clone ID: LIB3280-039-P1-K1-C8
gactcgaccgtgtggggaaaggggatgagtgccggggatcccgccgactatgcggggcccagtttccgaggaggagccagggccggggcggccgctcacccacggcggttcccgacggcggtgcaaccggaggtcatgcgcgcggcggataaagacgacagctactccgactacgttaccgaggcctgccgtgacgcctttcgccagctatttggtaccagggtggccgttacttaccagaacgagataaaattgcttgggcagtccctctattacttgctaacaactggttcaggtcagcaaacactcggagaatattcttgtgatatatcttaagttgtaacctcacatgctcttccctcgacacctgcaaagcggatgcttttcattttgtaccaaactactgagccctatcttgctgaaagaatcagttgtaga

SEQ ID NO: 2181 - DNA, 473 bp, Triticum aestivum
  Clone ID: LIB3280-039-P1-K1-C9
gtcgcaccgcgtctccctcagggtgacgtcgccgtacgggaacagcatgcactactccgagaacgtgcagtcggggcacttcgccttcacggcggtggaggccggggactacctggcctgcttctgggcgcctgaccacaagccgcccgtcaccgtcaccttcgagttcgactggaagagcggcgtcatggccaaggactggtccaacgtcgccaagaaaggcaaggtcgatatgatggaactagagctgaagaagctagaggataccatcaaatctatccatgaagaaatgttttatctacgtgaaagggaggaggaaatgcagaacatcaacaggcagacaagctcgaggatggggtggctgagtttcctctcgctcggcatctgcttatccgtggcagggctgcagctgtggcatctgaagacctttttcgagagaaagaagctgctgtagttcccccatgatcacaaac

SEQ ID NO: 2182 - DNA, 355 bp, Triticum aestivum
  Clone ID: LIB3280-039-P1-K1-D1
cggacgcgtgggcggacgcgtggtcggacgcgtgggttctaagcctgttgtcattgctgagggtggtcagatttcttagatctgactgagattgttgatgatgatgatgatgatcttgaggatccaatggtagctttatattgcttctctgtgatgtactctggcttatggtgctggattttgaagtttatcgctgttgtgaaactttgagtttggctcccattgaataacaagaacttaaagttaactttgatatcaaaaaaaaaaaaaatgggcggacggtttagaggattcaagcttacgtgcgcgagcatgcgacgttatagctcttctatagtaggacctaaattcaatt

SEQ ID NO: 2183 - DNA, 459 bp, Triticum aestivum
  Clone ID: LIB3280-039-P1-K1-D10
ccaccttccgtccttcccccgtcgtcgcggctccagctagggtttctcgcccccgcccgcccgcctcaccgccggccccgtccgccatgtcgaagcaaggagggaaggccaagccgctcaagcaggccaaggtcgccgagaaggactacgacgagaatgacctggcatacctccagaagaagaaagatgagcaaaaggccctgaaggagctgaaggccaaggcaggccaaaagggtgcgctgggaggatccggtctcaagaagagtgggaagaaatgagtctgcccacccattcgtaatacccagaaaaagataatctatctatctacctatctgtgtcgcgcttcactctctggggttgtaacagactaccttcagttgtgttgagcattgtgcatcgtcgcaatacgtcgctgaaacctatggcatgtcagcagcctcttctgcttatctgtgatac

SEQ ID NO: 2184 - DNA, 351 bp, Triticum aestivum
  Clone ID: LIB3280-039-P1-K1-D11
ctttcccttccttcatgcatttagcggcgcgatcgacacagtgccattgcattaataattccttttgtaatttttctctagcatttatgtggtggtgcattgcatggatggataatatgcaatccccctgataagtcaggataaggccctgtgagccgtgataaatcttcagttatgctaatatatatagttggactggtttattttttaaaagacaaaacatgccagaagggagcactataaagatccaaaattaataaatagagggaagaaaagagattggcaacccattaaaaaaaacccaaaggggggggcccttttaaaggacccaagcttacttccgcttgcctg

SEQ ID NO: 2185 - DNA, 444 bp, Triticum aestivum
  Clone ID: LIB3280-039-P1-K1-D12
gtgaagctgtatttagcccaatcaggaaggtgctgctggcgatgatcgaggctgcattttcagccataaacctcgaagtgcactgtggaactcatccaaggatcggtgtcgtcgatgacatttcattccaccccttgactcaagcggccacaatggaggatgctgctcagctggctaagctggtagcctctgacattggcaatggcttgcaagttccagtgttcctatatgcggcagcacaccccaccggcaagaagcgtcagtgcagtccggcgtgagctcggctacttccggccaaaccacaagggtgtccaatgggcaggcccggtgctccctgacactctatcgatgaagccggatgtgggcccagtacacgttcctcatgaaagaggcgccaccatggtcggagctcaacctttggtcgagagctacaatgtgccgata

SEQ ID NO: 2186 - DNA, 292 bp, Triticum aestivum
  Clone ID: LIB3280-039-P1-K1-D2
gtttttaagccggcaaatataattgattgaggtataaattcgaaggcattatggagctaccaaaaagcttctaacttgctgtggccggccccaaggtggaaaaaatagaattgtccctcaattgcaaataaacaatgtggaaaaaacagaaccgtacatggtaaagaaaaggtttcttgttagcaaactatgaaacatattttctgcacggaacgcctttccccctccccttaggatccagggcacccggaacgtgggcctttttccgtacccaaatcccgggggaggggcc

SEQ ID NO: 2187 - DNA, 246 bp, Triticum aestivum
  Clone ID: LIB3280-039-P1-K1-D3
gccttggcccatgagatgagatatcctggtggagactgcacctctgacatatggatctaggaggaagggtgtaggacacaggcagctggagatccatggtgttgagctcactgtaattaaaatggtctcttccccgcctgcggtgttgtatgtgatgtggtatcaattggaataagttcctgatagaacctctgacattggcttcatgggagctttgggccctaataagagttgcctctgattctg

SEQ ID NO: 2188 - DNA, 436 bp, Triticum aestivum
  Clone ID: LIB3280-039-P1-K1-D5
tggggagaaggtgcggagcttgcccgattgcctgcacgtgttccacgtgccgtgcatcgacggctggctgatcaagcacggatcatgcccactctgcaggaggaagctctagatcatcatcatcatcatcaacatcatccacgaccgacgacgacgaccgacgaggaacttctgaacttgtgtctgctgctattaggaaggaggtcttgctctgcttgctgctttgcatgctgtgtgtgcgcgcgctatgcctgtgttgctgttgctgctgttaggaggctgacatatctatagaacgaaccctaaatttatagagctcttttttttgccttcttttccttttgcgttttgatttttgatctctcttctcccggtggatgtaatatagtagtatgtactaccactggaacaaaaaaagcactggaccggcttgcgc

SEQ ID NO: 2189 - DNA, 465 bp, Triticum aestivum
  Clone ID: LIB3280-039-P1-K1-D6
ccagtttgtttggacagcaatgctcaagtcgacccaagggataactttcttattgcggaaaatgtggattcactgatgccggatgccctgttgtcaagagggatgggttccggaaaggatatttgcaatcttccttctgggcaaagggatcacagggaggttgataatgagctatcctctgctgcattcagttcccagtcatttggtgtgcctgacatatccttcaagcctggatgttcaggtgatattgctgttaatgatggtggaatgccaagccaaggattgtggaataatcaaacacagcggatgagaactttcacaaaggttcaaaagcgtggatctgtggggagatcaatcgacatcacacggtatacaaattatgatgaacttcggcatgatcttgcatgcatgtttggtattcaaggccagcttgaagatccgtacagaatggactggaagctagtc

SEQ ID NO: 2190 - DNA, 171 bp, Triticum aestivum
  Clone ID: LIB3280-039-P1-K1-D7
tcagtttattttgacagcaatgctcaattcaacccaagggataactttcttatagggggaaatgtggatgcactgatgcctcattccctcttttcaataggtatggttttcgaaaaggatattcataatcttccttctggacaaagggatcacaggaatgctgaaaatgtt

SEQ ID NO: 2191 - DNA, 303 bp, Triticum aestivum
  Clone ID: LIB3280-039-P1-K1-D8
ataccaaattaaagcatgggaagatataacgcataaaaacacgctcactcgagccccacaagacacgagtttcacatggttcaggttcatcaagtagaaaaggagcaattagtaaatataacaacatagtatcggaatagatccattgtcaccgcaagaatttattctcaagttcttaagccctgactcaacaacttctcaaaacatcaatcaccatggcacccgatcttcattcatcatctgtgcgcacagagggcttctgctgcttctcgtcggcccacttggagagggagaagtggacct

SEQ ID NO: 2192 - DNA, 333 bp, Triticum aestivum
  Clone ID: LIB3280-039-P1-K1-D9
tactacaaacttgaccgatcgtccttaaaaccattatacaggctgaggttttacagaatcagcaagaggtgctctaagattcaaagctttgcaaaacaccaacagcaatagaaatgatcatatgccacagtcccaccgcacgggggctcctcttgctcttgtgatacaaaaatctatatagatgaaacaataaacgtctcaaatatgttcttccaagtcgagtcccaatatgaatatgcctaaggccgtttcctgccccgtttattctttgatgacgcgagaaaaatcgggcgacggagtaggcactgcactgcacatttgcgagctctcagt

SEQ ID NO: 2193 - DNA, 410 bp, Triticum aestivum
  Clone ID: LIB3280-039-P1-K1-E1
ggggtgtttaatatttttgcctctaaactttgtcaaaatttacaaagcttgactttgatcaagctaatataagtcaagctaatatgcagagtaagtaaaagcaaagggagtacaatgcaactgtagcgactatcgggagcgaaatgcccgaaatgcctgtttttttttttgcgggctaaattgagagctttatttaataaaagcgttctaaattgagatgataaatcagagaaaagcaaacatagtagacatggctgatgccttgctgcaatctatggctcgtcttgcatcagacaccgcaacacaggatgtactgtgccttgttcgccgagtctactatgatccacacattgtcaagtctcgatggtcattgctcggcaattctgttgtaccatatgatctgaccaccc

SEQ ID NO: 2194 - DNA, 371 bp, Triticum aestivum
  Clone ID: LIB3280-039-P1-K1-E10
cggacgcgtgggcagacgcgtggggaatgatccatccgtccgtcgccatggtctgtttgcctcgatcgatcagttgtaataaactaataatgcgtacgtgctgatctatatgtgtcacgcttttctttttcttttgctttatttaattatgcctccctaattaattgttcggtgagatcaatcaatttttgtcttcctttcttttgccaattaatgtggatcgtgtaatcagcttggctctcaacataagtagaaagatttgttcttcattcaccaaaaaaacgcttgcggcgctacgcctttggctgataaaaggccctgtgacagtccggccgacaaacttgccggccttggtgatgcttttgccaacc

SEQ ID NO: 2195 - DNA, 461 bp, Triticum aestivum
  Clone ID: LIB3280-039-P1-K1-E11
gacactgagaagcccaggatgaggggacccaagagggcctccaagatcaagaagctctgcaaccttggcaaggatgatgatgtccgcagctatgtcaacacataccgcaggaccttccttaacaagaagggcaagaaggtgagcaaggctcccaagatccagcgccttgtgactcccttgacactccagaggaagcgcgccagaatagcagacaagaagaagaggatcgcaaagaagaagtcagaggctgcagagtaccagaagctgcttgcacagaggctcaaggagcagagagaccgccgcagcgagagcatggccaagaggaggtcgaagctgtctgctgccaccaaggctcctgctgcctctgcctaagatgtttacagtcttccgttattagctgtaatagtggaagaatttctcgcactttgttggatgatatgaatctagctgctactttcagc

SEQ ID NO: 2196 - DNA, 257 bp, Triticum aestivum
  Clone ID: LIB3280-039-P1-K1-E12
gacacagatcggcagaggccgacggtacctattatggcctccaagatcaagaagggagggatccttggaacgggtgaatatatcctgagctatgtcaacacatactgcatgaccttccttaacaagatgggcaagaacgtgatctaggcttacaagatccagggctttgtgactgccttgacacttcataggaagcgcgctttaatagcctacaagagcacgagggtcgcatacaataagctctaggctgcagagta

SEQ ID NO: 2197 - DNA, 418 bp, Triticum aestivum
  Clone ID: LIB3280-039-P1-K1-E2
cacctacctagagattaaatggatatctttgacagtcatcacaccttcattctctcttgggaggggtaatcgtatctgcagcacatcaatgctcatttctacagcattcagccgttgcttacaatcctaactgtcaaagtctaattttcagctagcacaaacagtctgcttacgaactaccctgtttgtatgacctacgcatagggacccgactacctgcttgtattggggcgggctgaatgcagagcttgatattctacctatactctaactagagagcgcgatttggaatcatcgatccttattagacgtcgctggtccggttcctctaatcacggcaatgattacaacatgcacgcaggccaaatgtctaatgtgcgctttttacctggtttactgccatccacacattaacctg

SEQ ID NO: 2198 - DNA, 463 bp, Triticum aestivum
  Clone ID: LIB3280-039-P1-K1-E3
cggacgcgtgggccgcgctccgcctcccgctcccctgcacgccgtctccgtccccgccggcgggcgtcaccatgatcatctccaagaagaaccgccgcgagatctgcaagtacctcttccaggagggagtcttgtacgccaagaaggactacaacctggccaagcacccccaggtcgatgcctcgaacctggaggtcatcaagctcatgcagagcttcaagtccaaggagtacgtcagggagaccttctcgtggcagcactactactggtacctgaccaacgacggcattgagttcctacgcaccttcctcaacctgccgtctgagattgtgcccaacaccctcaagaagtccgccaagcccccgtcccgccccttcggctctggcccaccgggtgaccgccccaggggtcctcctcgttttgagggtgacaggcccaggtatggtgacagggatggttacag

SEQ ID NO: 2199 - DNA, 356 bp, Triticum aestivum
  Clone ID: LIB3280-039-P1-K1-E4
gagtttaacaaacccgtacactgggttgatacagagaacttcccgttacaagtagcctaagacacttcattcagcagtgttacaaataatacgtgtacacccattagcacgcggctttttggtccatgcgctaatccctccgcacctggagattgcgcttacatatcgattggtcggccaatgctaactggcacggccgcacgccgaggtattcttgttacgcaaactccggaggagcagggtggatttcctaaaacggtagtcgtggccccatggcctgatatactggcgcctctaacgactcaaggaccgcataatccgggtccggctctgatgaaagaaggtcagtgatcacc

SEQ ID NO: 2200 - DNA, 400 bp, Triticum aestivum
  Clone ID: LIB3280-039-P1-K1-E5
gttcagaactccacgtatatttctccaaattcgtgcatgcagttcttattacagtataaaagatgtagcgaccattagtttaagcttggtcggatcatattacggtggagattgatacgtcatccctcttagctcgagattcatacttcaccgatcataatctagtggatttcaccacccacccacaccacatacttctctggcatgtagtggcagatcggctcgccgcgggacccgttgagcgtcgcgaagtactcggcgtcccagccggaggtgtcctcgtggcagacggcgatcgccgtcgcgcccagcgtaaggtcgtcctgcccgaccagctccacgcgcaccgagcccacgttgtttggccggtggcagtacagcacgtccgccgggtacggca

SEQ ID NO: 2201 - DNA, 459 bp, Triticum aestivum
  Clone ID: LIB3280-039-P1-K1-E6
agaaaagcgcctctccaggagtgggaaatactagtgctccctctccttctcgtgttactatttgtgctagcaaagcaacagccgagaccatggcgatgggtcacctccgtgccttcctggttttcctcctcgtgcaggtctgcctgttcttgatgatggccgcgtcggcgaaggtgcagggcagggctgtgcccggagttcccgcgtgctgctcctaccgccccgagtgctgcgagcgccggcggaagccccgctcgccgccgccgttactccctgatggcctcgcctgcggcggcttgtgggggtcgctctcctccctagaaatgtgtccgtgacgtgagcatacatgatacattctactggatttgcaatctgcatacatctatggttccgctgcttttcgagtctctatatatgtgtttcagaacttttcattccaagcatgttgttgtgatgtgt

SEQ ID NO: 2202 - DNA, 440 bp, Triticum aestivum
  Clone ID: LIB3280-039-P1-K1-E7
cggacgcgtgggcggcgcatggccatggctgctggagctcagtcccaaggcaagctgggctgcagaggtgcggcaagagctgcaggctgagatggatcaactacctgaggccggacctcaagaggggaagcttctcgcaggaggaggaagccctcatcgtcgacctccacagggtgctagggaacaggtgggcccagatagccaagcacctgcctggcagaacggacaatgaggtgaagaacttctggaactccaccatcaagaagaagctcatatcgcaggccgtgggcagcctccactccgatttgtactataacattctggatggggcgggacaaggcatcgcagctgcggggtgcgcgtcgctcaacgggctggacaatgcggctcaagctgtggccacgcagccccctccgtcctccgcggcatggctcaatttc

SEQ ID NO: 2203 - DNA, 329 bp, Triticum aestivum
  Clone ID: LIB3280-039-P1-K1-E8
cggacgcgtgcgctgcgcatggccatagttgttggagttcattcccttttcttggtggggtgggtacgtgcagcgcgacctgcaagatcatatggatgaattacctgcgggcgtacctaaagaggggaatcttgccgctcgaggtggtatcgatcatcgccgaccccgacaaggtgctagggaacaggtgtgcccagatagccaacctgctgcctggaccaacgggcaaggtggtagagaacttctgagactccatcatctagaagaagcttatatgacaggctgtggggcggcggcacttgggtgtggctataacactttggatgggg

SEQ ID NO: 2204 - DNA, 313 bp, Triticum aestivum
  Clone ID: LIB3280-039-P1-K1-E9
ggaaagatactcaaatacggcagatgcaaacaatgtcgaaatcaaatcaaagacaaagacaaatacaaacatgtactgtagtactatgtttctgataaaaaaatgatggtgaaaaatggagacagataacaactaccggtagtagtactaagtaactaaagagtagcaggagacgggaacggtaaagctacgctcgcagttgcattatcagtcactcgtcgaccgtcggcacgcttgcggcgctgcgcctttggctgctgaaaggccctgtgacagtccggccgacaaacttgccggccttggtgatgctttt

SEQ ID NO: 2205 - DNA, 323 bp, Triticum aestivum
  Clone ID: LIB3280-039-P1-K1-F1
ggccactgacccgagcgaaatcagcctggacgtgatcaacgagcgcgcgcactaaggcaaatcatcccaatgcctcgcaatatggatttatgtcaactatagattgggcggcgtgactcttgaaactttcttgatgatttgtggctttgctaccgcgtcgaaaggccctcctcccgtggtccgtgagaccacggagggcttgctctatcatgtaatctgttctttttcctctgcccatttatatgccgggccttatgctgctgcactgcactggtcttccaaggtacggacatcaacaatcaaatgttctgtttggattcgtc

SEQ ID NO: 2206 - DNA, 442 bp, Triticum aestivum
  Clone ID: LIB3280-039-P1-K1-F10
cggacgcgtgggttttttttagatgaaacaatgagatataaataaattaataaaggtaactcatattatttttattttctcgaatcacaaaggctcaaacagatcaaacactcaaaaataaaacaaagaaacaaaacatagtgcaacaccacgagtaagctacccccctgctgtcctcgacaagtaccaacacctcataagcacacagcttgtgcaaagagcaccccaccatacaaactcaatggaatgcgcatttggttaccgcttgcaaatgccaactatctaacccctcctccctggtgcttcctgcttagaaagccaatgggggcagtggcaggttgttggtgagtcctgacttcatccgcctcttcctgagtctctcggcgatgatgaaagcgagctccagagactgcgacgcgttcagccttgggtcgcagtgggt

SEQ ID NO: 2207 - DNA, 440 bp, Triticum aestivum
  Clone ID: LIB3280-039-P1-K1-F11
cccacgcgtccgagcccatcgaggtcaaggtcggcatcaaccacatctccatcctgtccagcacgctggggttgcaggacagcggctcctacctggagcgccggcaggccgggttgcactcggtcaccatccagggcctcaacacggggacgctggacctgaccagcaacgggtggggacacatcgtgggcctggacggcgagcgcaagcaggctttcacggacaagggcggcgaggtgcagtggaaaccggcggtgttcgaccagccgctcacgtggtaccggcggcgcttcgacatgcccaccggggaggaccccgtggtgatcgacatgaacccgatgggcaagggcatcctgttcgtcaacggcgaaaggctggggcggtactggagctcgtacaagcacgcgctggggcggccgtcgcagtacctgtaccacgtg

SEQ ID NO: 2208 - DNA, 441 bp, Triticum aestivum
  Clone ID: LIB3280-039-P1-K1-F12
cccacgcgtgcgatctcattgagggcaaggatggcatctacctcatttccttgggggggagcacgctagggctgtaggactagaactcctacctggagcgccgtcaggccgtgttgcactcagtcaccattcagggcctcaacacggggacgctggacctgaccagcatcgggtggtgacacattgcgagcctggacagcgagcgcaagcaggctttgacggccacgggcggcgaggtgcatggaatacccatggggttacagcaggcgctcacgtggtaccggcggcgcttcgacaggcgcaccgtggtgagccgcctgttgatcgacatgaacccgatggcagaggccttctgttcgtcactgttaatgagtggggcgctactggagctagtacattcccgcgctggggcggtcgcagactagctgtctcatgtgccgg

SEQ ID NO: 2209 - DNA, 472 bp, Triticum aestivum
  Clone ID: LIB3280-039-P1-K1-F3
ccgaggtcttccgggacgtaaagcagtacccgcatgccaagagcgtccccaacatcctcgtcttgcagctgggctctcccatatatttcgtcaacgcgggctacttgcgagagaggattttgagatgggttgaagatgaggagcacatttgcaaggggcacgggcaagacttgcaatgcctggttcttgatcttggtggcgtgacttcaatcgacaacacggggatcgggatgctaggagaagttcacaagggcctggaccggaaggggatcatgatagctctggcgaatcccagactgcaggtgacggagaagctggtggtgtcagggtacatcaaggacaccataggggaggagagcgtgttcctgaccatcacggacgccatcgcgtcgtgccggtacgggctgcggaggttcagaggcaaggagggatgcaacgaagtataacggcgtttagacagtgtggatgtaga

SEQ ID NO: 2210 - DNA, 382 bp, Triticum aestivum
  Clone ID: LIB3280-039-P1-K1-F4
gaatcagtgacacaatgatacaatatgtaccaagtttcttgagacagttgaatacgaatttcaaatttgaataaacagagctctgcaggttctgttcctttattacaaacactgctctggtgatcatctagtgtcgagctacagcagtagagcaggtggtatgaacaacagaagacgtaggtaggagcagatagtagcagtagtacatcgatcttggttccggcgagacaacagagctggccgggacgctcacgccgtcgagcgcttcacgttcttggcccaaattatgtgcccgtacggcatgaggtggcagaccggcgtgccgccgggcttggtgccaaggagcttgaaggacacgtgctctgggttccacagggacgtg

SEQ ID NO: 2211 - DNA, 468 bp, Triticum aestivum
  Clone ID: LIB3280-039-P1-K1-F5
ctcactcccgtgcccccgcctctgcctgcctgggttaccctaccacccctcctcccacccatagccgaggccagaggagagagagaagccagggcttggctggtagatgcgcgagtagaggtgtctgccaaaggccaaggggaatgggaggcgacggcaggcccagcgacggcggcggcggcggcggcgccggcgccggcgccggccacccgcaccagttccagtaccaagcccttctcgccgccgtgcacacgcagaaccccaaccacagccacaacctcccctttccccttcctcccctcaatggacctggacctgatgcatctacacacaatgctgttcgccagcctccgacgccaagggggtttgctgattggagtgcgtctaccagtgccttcacgtcccttgctgtgcagagcactccttccacagctactgccaatgcataccattacagcctatctcctt

SEQ ID NO: 2212 - DNA, 464 bp, Triticum aestivum
  Clone ID: LIB3280-039-P1-K1-F6
caccaagcccgggatcctctccatggccaacgcggggcccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaggtggtcatcgccgactgcggccagctctagatccgcccgcgcgcgggtcgcctttcgccgtcgtcgtcgccgccccgtgtgtcccgtgtcgtgtcgtcgatctaaataagagagtcgtgtgtcgtgtcgtgtcttcccctggtccgtccgatgagatctccgtggttggtttaggagggttttaggtggactctttgggctgctggatctctgtccggccgccttggttatcttcctgtgtctgctgctatcttaccagttgaatgagatgaac

SEQ ID NO: 2213 - DNA, 471 bp, Triticum aestivum
  Clone ID: LIB3280-039-P1-K1-F7
cccacgcgtccgatgatttagagtcattggcatacacccttatatttttgataaaaggaagattgccttggcaaggctaccagggagataccaagagtttccttgtttgcaagaaaaaaatggttacctctccggatatgctatgcagtttctgcccacctccgttcaaacagtttcttgagtctgtcacaaatatgaaatttgatgaagagccaaattacgccaaacttatttctctctttgaaagtttgattgaatcacctgcatcaaggcccatcagaattgatggggcccttaaggtggggcaaaaacgtggaaggctacttgtaaatcatgaagaagatgatcagcctaaaaagaaagttagattaaggagcccagcatcacagtggatttcagtttacaatgccaggcgccctatgaagcagcggtatcattacaatgtggctgacaacaggctttaacagcata

SEQ ID NO: 2214 - DNA, 468 bp, Triticum aestivum
  Clone ID: LIB3280-039-P1-K1-F8
cccacgcgtccgaagatttatagtcatcggcgtacacccttatattttcgataaagggaggattgtctgggcaaggctaccaatgagataccaagagtttccttggttgcaagaaaaaaatggttacctcttcggctatgctatgcagtttctgcccacctccgttcaaacagtttcttgagtctgtcacaaatatgaaatttgatgaagagccaaattacgccaaacttatttttctctttgaaagcctgattgaatcacctgcatcaaggcccatcacaattgatgggtcccttaaggtggggcaaaaacgtggtaggctacttggaaatcatgaagaagatgatcagcctaagaagaaagttagattatggagcccagcattacagtggattttagtttacaatgccaggctccctatgaagcagcggtatcattacaatgtgggctgacacaggctttaacagc

SEQ ID NO: 2215 - DNA, 406 bp, Triticum aestivum
  Clone ID: LIB3280-039-P1-K1-F9
cccacgcctccgatgatttatagtgattggcgtacacccttatattttctataaagagaggattgcctgggcagggctactaatatagatccaagagtttctcttgtttgcaagaaaaaaatggttacctcttgggatatgctatgcacattttgcccacctcctatcaaacaggttcttgagtctggcacatatatgaaatttgatgaagagccacattgcaccaaacttatgcttctctttgaaaggttgattgaatcacctgcattaaaggcccattaacttgttcggtcccttaaggaggggcaaaagcgtggaaggcttcttgctaatcatgaagaatatgatcagtgctaagaagaaagttaggattatggagcccatcattacagtggattttagttta

SEQ ID NO: 2216 - DNA, 411 bp, Triticum aestivum
  Clone ID: LIB3280-039-P1-K1-G1
cccacgcgtccgctcaatcgaccgagttaattgcctgtccgggccggaaaattcgtggagccgtcgtcgtcgtcgtggttgacggacgaggctggctgggagtgaggtggagcggatattccccccgccgatccctgccgtgtgcaatccacactgtgcgcggtcttcataaatagggcctccccgacggcggactcctccaacaatcttcttcctctacactctagctcatcttgcccatgcatttctccctggcttgactggcctgtgaagaagctgcacgagccaaccccctagttatctgtctgcctagctgcttcgtcggaacaagagatccccggcggcgatccccggcgagagatcaatcaaggagggctcgcggcgatggcgcgcgagcagctggaggtgctg

SEQ ID NO: 2217 - DNA, 253 bp, Triticum aestivum
  Clone ID: LIB3280-039-P1-K1-G10
ataaagacacacttgtccctttcttttttgagggggaacaagcacacggtgtggcccctcatgtgtcacaaaaagagaacactctcttccttgaagggcagaaagccagataaatagggcactgcgagtccttattcgggaaaaagtggaggcgtaatgagtcttgctctgttgcctaaattaaagtgcacctgatgttgcgagacttgatcattgcttcacacctcctggggatatgaaccgcgcatcgcct

SEQ ID NO: 2218 - DNA, 249 bp, Triticum aestivum
  Clone ID: LIB3280-039-P1-K1-G11
gtgtatagctcgatgttccaaaaatgctttggtgaaaatttgtctagcattgtatgtagcttgcgcagagtgcttgttaatctgatagcagctggtgattcttttgtcgactacaaataaaatgtgtcagtgtaatcctatatcctgggagagaaacagctagttagctgtttaaaaaaaaaaaaaaaaaattgaaaaataaaaaaataaaaaaataaaaaaaaaaaggcataatattataaataaaac

SEQ ID NO: 2219 - DNA, 249 bp, Triticum aestivum
  Clone ID: LIB3280-039-P1-K1-G12
gtgtatagctttatgttacaaaaatgctttggtaaaaatttgtctagtattggagggagattgcgcatagtgcttgtttatctcttcacagctagtgattatttcgtctactacaaataaaatgtgtcagtgtaatcctatatcctgggagagaaacatttagttaactgtttaaaaaaaaaaaaattaatgagttgtctctgaccgggtgctctacctcgggccactttttagggaggcccccagctt

SEQ ID NO: 2220 - DNA, 169 bp, Triticum aestivum
  Clone ID: LIB3280-039-P1-K1-G2
ctttccggacttttttttggggggggcgagttttagggggaccctcatctttttcttttaataaagatcttcctcatttttccccaggcatggcccgtcttttgcaaggaacacaccccccggcaaaaaaaataggccctccccgagaagaggttcctacaacaaacag

SEQ ID NO: 2221 - DNA, 409 bp, Triticum aestivum
  Clone ID: LIB3280-039-P1-K1-G5
cccacgcgtccggcggcggcggcggcggcggcggttggccctctcgagtcatggtgctacccgccaccctctcgcgcgacgccagagctcactcgtgccctgcacaggacggccagggggaagcggggccgccgcgcccgtgcagaccgcccgcgttctacagctccgtgttcgcgcagatcgaagaggtcgggtgggggcagctagtgagcgccacaggcgacgacggcgtgtcgtgcatcaccttccgcgtcgtggatgagcagcgacggcaacatttactggagatcacactgcccatgaactacccggcatgccctccttcaattgctgcggatgttccttatctccccaaattacagtggtcaaaaagctcgagactggaagatgttctctgccagttccaagc

SEQ ID NO: 2222 - DNA, 388 bp, Triticum aestivum
  Clone ID: LIB3280-039-P1-K1-G6
cccacgcgtgcggtgggtgccgcggcggcggcggttgtccctcttgagttatggtgcgaggagggaccctttcgcgcgacgccttaacttactctttccctgcacactaaggtcagggggaagcggggacgtctggcccgtgcataccgtccgtgttttacagcttcgtgtattcacacatcgaagaggtcagttgggggcaactagtgagcgccacaggcgacgacggctatgttgtgcatcatctctcgacccgtggatgagcaaacggcggctcacttactggagatcacacgtgaccactgaactacccggcatgccctcctttaattgttgaggacatgccttatctgcccaaatcacagtggtcaaaaagcatgcgactgca

SEQ ID NO: 2223 - DNA, 98 bp, Triticum aestivum
  Clone ID: LIB3280-039-P1-K1-G7
cccacgcgtccgcccacgcgtgcgttgacgcttgttcggccgcgtgagctatggggggggaggctatgatttggttggacgcataaactaactctttc

SEQ ID NO: 2224 - DNA, 374 bp, Triticum aestivum
  Clone ID: LIB3280-039-P1-K1-G8
gaagacccgcgagcccaaggaggagaacgtgacgctcggccccgccgtccgcgagggggagcacgtcttcggcgtcgcgcacatcttcgcctccttcaacgacaccttcatccatgtcacggatgaaggtgtcgttgaaggaggcgaagatatgcgcacatcttttcaagtgtccactgatacatgtcttctttttatccccaggcactcgaaaaatcaaaatatgaagaacaatggctggcgacagttcgtcgtttcattgtaatatctgaaaaggagctcggatttttctatcggtatgtggcacttgatggaaaaacacaatcccagaatgctgatctggttcatggtgggggcaagaaagcttctaaact

SEQ ID NO: 2225 - DNA, 251 bp, Triticum aestivum
  Clone ID: LIB3280-039-P1-K1-G9
agagacaaatatttcagtttcttttttcaccgagaacaagcacacggtgtggccgctcatgtgtcacaaaaagagaacactctcttccttgaagggcagtaagccagataaataggtcactgcgagtccttattcgggaaaaagtggaggtgtaatgagtcttgttctgttgcctaaattaaagtgcacttgatgttgtgagacttgatcattgttgcagacctcttggtaatatgaaccgtgaatcgtct

SEQ ID NO: 2226 - DNA, 463 bp, Triticum aestivum
  Clone ID: LIB3280-039-P1-K1-H1
ctggatatcgaccgcgagcggccgaccgaaaagtttaagccgagagagacaatgtcatcagcagtcacgagctcaagcagttgttcttaccccaacaacattccttggccagactaaagactaaagctttaacccccttcgtgatgtatgtctttctacggatctccgaagtacactatgggaaatgatctttggtatggacctgacagagtgaagtacttaggacccttttccgttcaaactccgtcttacctcaccggagaattccctggcgattatggctggcacaccgtcagtttatccgcagaccctgaatgctttgacaaaaacagagctgttgaggtgatccatgggagatgggcactgttgggagcttatggatgcataacccctgaagttcttcaaaagtgggtgcgctgggacttcaaagaaccagtcttggttaaagccggatcacaaatct

SEQ ID NO: 2227 - DNA, 58 bp, Triticum aestivum
  Clone ID: LIB3280-039-P1-K1-H2
aagactaaatacctagcgtccccccctgtaaagtttttgccgagagagacattcgtca

SEQ ID NO: 2228 - DNA, 413 bp, Triticum aestivum
  Clone ID: LIB3280-039-P1-K1-H4
acctttctttgagaacccatacagcagacatttttcttagctctccaatggcggcgaccaccacgtccctctcctcctcgacctttgctggcaaggcggtgaataatgtaccatcgccagctctcttcggcgaggcccgtgtgaccatgcgcaagactgcagcgaaggctaagcaggtttcctctggcagcccatggtatggtgctgaccgggtgctctacctcggcccactctctggtgagcccccgagctacctgaccggtgagtttcctggtgactatgggtgggacactgctgggctttcagctgaccccgagactttcgccaagaaccgggagctcgaagagatccactgtcgctgggccatgctcggagcacttggttgggtctttccggagttgctggcccgcaat

SEQ ID NO: 2229 - DNA, 396 bp, Triticum aestivum
  Clone ID: LIB3280-039-P1-K1-H6
gtaaaatacaaagttctagtgagatgtccttgtctgacatgcttgaccccttgatatcttcttaatgccaggggttaatgacagatcaattgccaaatgaactcaaatctggcattcagtattggtctctagaaaggaaagcttgtcaagcattatcaagaaatgataagatatctatcggagatgttattggaagcaattcattttaaatcatttgactattcggttcttaatctgatgatgtatcggcttactgggcagcagggtaatgacttgcacatggagttcttgtctgcctcagaatttttagttgagatatgtgatgacccgtatgattatgaggatgatgtgggttacaattacttttaacaatcctcgcatgtttgctgcgatata

SEQ ID NO: 2230 - DNA, 166 bp, Triticum aestivum
  Clone ID: LIB3280-039-P1-K1-H8
gtaaaatacacggggggggggagatgtccttgcctgacatgctttactcccttgataatttcctacaatgcctccgggtaaatgacagatcaattgctaaatgaactcaaatatggcttctagctttggtctttagagagtaagttcttcatactatataagaaat

SEQ ID NO: 2231 - DNA, 448 bp, Triticum aestivum
  Clone ID: LIB3280-039-P1-K1-H9
aaagaaagaaaatattattcatggtgatattgctgcaatgatgaaccgaaggttgggtgctgttttcatgcctcatggtcttgggcatttacttggaattgacacccatgatcccggaggctaccccgagggcttagagaggccaaaggagccaggattgagatccttgcggaccatcagagaacttaaagaaggcatggttattacggtcgagcccggctgttatttcatcgacactttactgaggcatgccagggatgacccaatttcctcaaagtttttcaactgggagaagatagaaatttacaaaagctctggtggtgttcgcgttgaaagtaatatgtatgtgacggcacaaggatgcaagaacctgactaactgcccccgagagatcagggaaattgaagcgggtatggctggcgcgccttggcattcacgtgacaccctt

SEQ ID NO: 2232 - DNA, 445 bp, Triticum aestivum
  Clone ID: LIB3280-041-P1-K1-A1
gacggatgttctgttgggcaagaggcccaaggaggtcctgccggccggggcaccggagaagaggatgaaggtggtcaggagaaggctgccgcagtcgctcgtcgagcatatcgtggcaaaacccctaccagatggccgtagtccccgccgacgcgctggccagggaaaccaactactaccgcgagtcgtacgccgaacgcaggcgcacagccgacaggatcgccgcctaccagcagggcatcatcgaccagttcaagtcctttggctacgcggaggaggataccgaggtcaccgacgacgatgacgatgacgacgaccactagatcgatggtggagaagtggcgcagcaatcagaggggcttgagcctcagagcctgcatgtgtgcaagactcagctgcttttaagatgtgtgtactctcgtgtgcgtttgccgtccatctacct

SEQ ID NO: 2233 - DNA, 395 bp, Triticum aestivum
  unsure (1)...(395): unsure at all n locations
  Clone ID: LIB3280-041-P1-K1-A10
gtgtatttctaaggggagggagcaactagttcatctttgtgacgcactgcttccagtagttccttccaagctatctctatcactgagaggacccgcttttgttgattatttatcttcgacttgtcagatttcgcagttagaaaacttgcgacttactgacagtgaagttgcaaacaagcaaagaaggtgtcgtcagtcaagacattacttaagttctgctgcactttcgatgtcacctgaaggcatcgaattgttagcacaaagcagccgttttggtgataggcgcgagaagtttatagaccagacgattgcctagaagtatagagttaatatgggttggatgagaggcngcagaatatttctgctatagcttgattagagttggctgaggcgac

SEQ ID NO: 2234 - DNA, 300 bp, Triticum aestivum
  Clone ID: LIB3280-041-P1-K1-A11
atcgcctcgtggcccctctcctcgtcctcctgggcctcctcctctccccggcgccggcggcggcggccgcgggggacgaggagcccctgatccggcaggtcgtcggggccgccgaccccctcgacaacgacctggagctcgactcgcagttcctcggcttcgtgcagcggttcgggaagacctacagggacgcggaggagcacgcgcaccggctctccgtcttcaaggccaacctccgccgcgcgcgccggcaccagatgctcgacccgtccgccgagcacggtgtcaccaagttcttcg

SEQ ID NO: 2235 - DNA, 415 bp, Triticum aestivum
  Clone ID: LIB3280-041-P1-K1-A2
aaacctttccttagcttgtttggtagaagtggaatcaggaaaatagaagaaaccaagccggctaggggagcggccacagatatagtacctagtaagaagagcccgaaggatcctcaaaaaaaaaagtaagaagagcccgaaatatcctgacagctgaatgttactcttctgtctctaactcgaaccagccccaaatagacggacgatgagacgcttagcgacggccctaaccaactccaccgcctcggcggcctcctgaatcatacgcacgtctatgccggctctgatgaacggcccgaagaagagctccgatatggtgacgaccataaaggtggtgccaacaaggtacgccgccgccttgggcggtcgccacagcccggccaccctggcccaccgttcggcgacgtggaaagcg

SEQ ID NO: 2236 - DNA, 303 bp, Triticum aestivum
  unsure (1)...(303): unsure at all n locations
  Clone ID: LIB3280-041-P1-K1-A3
cttatacttaattgtatatatataatttcactttaaactattctgtgactggccctttggggtagggggactttgatttgacattttccatatcttttagcgtgcatttgttagggatttaccccgactgatctccggttgcatcttatgaaggaaatttcaggnttccccctctattttaaggaagagccacgtgaggctgcttccttcccatattctagcggtgaaccatcatcctctgggacgattaaaaaanacaggaacgaaatcccataagcttcatctgcttcttgcaaggagatg

SEQ ID NO: 2237 - DNA, 363 bp, Triticum aestivum
  Clone ID: LIB3280-041-P1-K1-A6
gtggagggtttttttattttttcataatttttttttttttcattttttattatgttttttttttttatttaaattgtatcttaataatgaaattttattattttttatatttttaaaaaaagaggaacccccatttataaataaggagattataacaaaaacccatcttttgtagaaaaaatgggcgaaaagaggtagtaaaataaaaaacaactccatttttattttttataaatatacccctaccacagggaacatcaaaattctataattaatgattattaatgtgggaggacattataaaatattatattatcttaatatatataaatatctattaaattttgagtaaaatattttata

SEQ ID NO: 2238 - DNA, 287 bp, Triticum aestivum
  Clone ID: LIB3280-041-P1-K1-A7
gggtttttggtttttttttttattttttttttttttttttttttttttttttttttttattttattttttttatattttattttttatttttttttttttttagagaaaaaaaacattgggaagggtaaaaataagaaataaaaaaaaaaaaaaaaaggggggggaaaaaaaaacaaaagggaacgggataaggaaaaagataaaacggagcggataaataaagaacacaaaactaagaagggaaaaagtaccactcaatggagggaagaaaaaatatctatttatg

SEQ ID NO: 2239 - DNA, 452 bp, Triticum aestivum
  Clone ID: LIB3280-041-P1-K1-A8
cttagatactctagatgttcatgatcctttatgtttatgtttcagtgtgtttgtaagggtcaacttctttgtactgattcatgatatgaataaaaaaattctcaaaaaaaaaaaaaaaaaaaaaaaaaaaaaaaaaaaaaaaaaaaaaaaaaaaaaaaaaaaaaaaaaaaaaaatatatattaaaaaaaaaaaaaaaaaaaaaaaaaaaaaaaaaaaaaaaaataaattaaaaaaaaaaagggggcccccttttaaaagaaccaaacattatccccccattttccaaacataatatttttttaaaggggcaccataaaaaaaattcatgtgccaagataataaaatatttggaagggaaaaaccggggcgttcccaaaaataaaggcctggaaacaaaacctcattacccccgctggaaaaaaaggaaaaaggccccaaactaaatttactt

SEQ ID NO: 2240 - DNA, 439 bp, Triticum aestivum
  Clone ID: LIB3280-041-P1-K1-A9
cccacgcgtccggatcaccgaggatgactatgagactcagcagaagaagcaagctgctgcagatgttcttttcaactattcacagtttgttatggtgtgcattggtgagggagttcgcccgactgatctccggttgcatcttatgaaggaaatttcagggatgcccacctctttgaaggaagagccacggcaggcagctgcctccccagattctagcggtgaaccatcatcctctgggacgatgaaagaagacaggagcgaaatcccataagcttcatctgcatcttgcaaggagatgggtatctcaggatggtaggctctgatttgtgatcatagagatgtaaataagttagcatgcttgaggcgaggcctgatttggtttacagcgctgaagagcacattttcctggcggatggtaacgtttgtgatcatttttcaa

SEQ ID NO: 2241 - DNA, 444 bp, Triticum aestivum
  Clone ID: LIB3280-041-P1-K1-B1
ctgatactttcttgtagatatttgatccgccgcagactacttttgactggcactccaatgcaaaagggcctacaggagctgtggtcattgctcaactttattctgccaaatatttttaattcatctgggaattttgaggaatggtttaatgcaccgtttgcatgtgatgttagcattaatgatgaggaagagctattgatcatacatcgtttgcatcaagttttgcgtccatttttgctccgtaggaaaaaagatgaagtggaaaagtatctcccttcaaaaacacaagtaatactgaagtgtgacttttcagcttggcaaaaagcatactacgagcaagtcgcaagcaagggaaaggttgccctaggatctggactcaaaccaaaggctgtggcaaacctatcgatgcagcttaggaagtgctgcaatcatccttacttattt

SEQ ID NO: 2242 - DNA, 287 bp, Triticum aestivum
  Clone ID: LIB3280-041-P1-K1-B10
ggaaacgaggcaaaaaatttgccattttaattgattaaaaaaaaaagagttgcccgtttaattaaaggaaaaccaggcgaaaacttagatacaaaccctacagggggaacacgcggacaatctggttacaacaacgccaaacagttcaccgcaaatttaaggacatggcatctccgatttttgctgagagcttaaaaaaaaaaaatttgaagccttcacccgaccttattttagccaaatttcagaaaggccccgctgcttaaaaacctccttatggaattattttt

SEQ ID NO: 2243 - DNA, 404 bp, Triticum aestivum
  Clone ID: LIB3280-041-P1-K1-B12
cccacgcgtccggtccctattaatcattactccgatcccgaaggccaacacaataggacgggaatcctatgatgttatcccatgctaatgtatccagagcgatggctgggatgcagcaggggcacctgttgctgtggaaggtgccgtccctgctcctgttgtggctgctactggctgggacgccgcggtgcaaccccctgctcaaggctgggagtagactaggatgtccccttgagatgtctttgcggcttaaaggtcatattttgtgaggcatgaatggatatctagaatctgatgcgatctgctatatctaccctaatggacaaaaacccgtgttttaaggatttctaaaataacttggtatctctgctatcgacactgtgatgagggaagagggagactgt

SEQ ID NO: 2244 - DNA, 244 bp, Triticum aestivum
  Clone ID: LIB3280-041-P1-K1-B4
gaaccaaatggtttttatctattttaaaacagggggtgaaattcaactttaacttgaggggagcaaaaaacaagttttgatgtggatgccaacaaagctctacctaatacattagaaagctccagataacataaacgatacatatcaaaggagtgtcccccctgcgcaactgtgcccttgatggcgaaccgcgaataacttccctggcactcaagaaaatgtttgcgggcaaaaaaaccaggga

SEQ ID NO: 2245 - DNA, 350 bp, Triticum aestivum
  Clone ID: LIB3280-041-P1-K1-B5
agattgcaatcacttcgatccagaagcactaaacaggagcccaacaatgcacgtcagtgaccttgcaagcatgttcacttcaagctacagtttcatgcagaatctactcgaatagatagataggtagagatataataacatgataccatgtcacacaatatcacagcgtacgatagcatagtgctagctagccaaactgcaggggtcataattaaacataaaacaagctgggcggccatctttggttctcatttttccacctcgtcttcacacgttttccttggtaacggcctgggctacgcttctagcccactgccagagaaagcagtagcagcagccacatacacaac

SEQ ID NO: 2246 - DNA, 341 bp, Triticum aestivum
  Clone ID: LIB3280-041-P1-K1-B6
gtatatatacatatatattgcatgaatagtataagtacaatcaccgtgggtcatacatgacattgtttctactgtaataacataaatctaaatatattttttgaggggcgtaaatctagatatataagtgttgaaatccagctataagttatggatcgagcactatctatatatccgggtacctccatgatatatgtggcttcttctttagttaattcgcataccatattactggcatcatgcatgcatggcaattgtcggcgtacgtctagggggaggtctcggtgttttgacgggcgtatggcggcgggccgggtgcaggcttgtggggtgccggcttg

SEQ ID NO: 2247 - DNA, 444 bp, Triticum aestivum
  Clone ID: LIB3280-041-P1-K1-B7
ccgatactttcttgtagatattacatccgccactgactacttatcactggcactccaagccaaaatagcctacaggagctgtggtcattgctcaactttattctgccaaatatttttaattcatctgggaattttgaggaatggtttaatgcaccgtttgcatgtgatgttagcattaatgatgaggaagagctattgatcatacatcgtttgcatcaagttttgcgtccatttttgctccgtaggaaaaaagatgaagtggaaaagtatctcccttcaaaaacacaagtaatactgaagtgtgacttttcagcttggcaaaaagcatactacgagcaagtcgcaagcaagggaaaggttgccctaggatctggactcaaaccaaaggctgtggcaaacctatcgatgcagcttaggaagtgctgcaatcatccttacttattt

SEQ ID NO: 2248 - DNA, 367 bp, Triticum aestivum
  Clone ID: LIB3280-041-P1-K1-B8
aaaaggaaaagcttggtctgaggctgttattgtcttaccatagtaggtggttaaacattgagaacaccacaccacacacacgagaatttacacatggagcgtacacaaagtacacacatacacacccatcactcgctagcatgcagtgagcagaccgggataagaaaagaaagttacaagcactagtagacagtagtacgaagctcaagacaaaccacatgcagcctcggacggcaacgtacgctatgcaggattagataaccaaaagagcagcaaacatggcggcgtctcagaagttgttgagcaccctttctttttcttcggccgacggcttttatttagcgggggttgctcctggtcctggtct

SEQ ID NO: 2249 - DNA, 88 bp, Triticum aestivum
  Clone ID: LIB3280-041-P1-K1-B9
cccacgcgaccgcgctctattaatcattactttaatcccaaagaacaacaggggatggggggaatcctattatgttataccattctaa

SEQ ID NO: 2250 - DNA, 444 bp, Triticum aestivum
  Clone ID: LIB3280-041-P1-K1-C1
cggacgcgtgggcttagatatcatggtatgcaagagttcgatcaggcaatgcagcatgttgaggaaaaatatgggtttatgacatctgagcaccagtatgtttcacggaaacatgaggaagataaggtgatcatcttcgaaagaggagatttggtatttgttttcaacttccactggagcaatagcttttttgactaccgtgttgggtgttccaggcctgggaagtacaaggtggccttagactccgacgatgcactctttggtggattcagcaggcttgatcatgatgtcgactacttcacaaccgaacatccgcatgacaacaggccgcgctctttctcggtgtacactccgagcagaactgcggtcgtgtatgcccttacagagtaagaaccagcagctgcttgttacaaggcaaagagagaactccagagagctcgtgga

SEQ ID NO: 2251 - DNA, 433 bp, Triticum aestivum
  Clone ID: LIB3280-041-P1-K1-C11
gcttgtctggacgacatcttaaatagtgttgtctccgcagggcaagcacatatacttcgatttgttggtgacgcaataatggaattttttgtggcacatgcatcttcaccttcagcccaacagcagcttctggaagtcatttcacagatgagtttgaagtgtccacaagaagatgctaagtggtggcacaaattttattttaggcttgaagttcttttgcatttcaagaagtcatttccttctgaagaagtgctgaatctagaagatatgaatgttgctgagtctatttgcaagattttgaggatgttttatcgtgtcattgaagttatatcttgccctagctctgtcacagcaaatatatactttaatgaggtttggaaagtgaggacggtgtttcacgaaaaagcatcaaatggttatgtagaatttttca

SEQ ID NO: 2252 - DNA, 382 bp, Triticum aestivum
  Clone ID: LIB3280-041-P1-K1-C12
atcctgaaccagtgcattggtttccgataaatcaattgaataagtctatgatttgttacacccattaaattccgcttctggggatttgggaagagcctcctgtacaaggctcgttgtaagctacaagaaccagtctaatgtgcctatctactcttgcactaagatcgatcacaaccccattggagaggaatttctaaagaccagcaaagctactgaaccacctcctgattccatcatccaatggagaatattcctttcttgattccatcactggatgtactagaatggtgtttgctgtcgtcttccgacggaagtggcacaccgaatacccagtcgaggacattcaggtacttggaccggaaaacctctctttcctgggcat

SEQ ID NO: 2253 - DNA, 368 bp, Triticum aestivum
  Clone ID: LIB3280-041-P1-K1-C2
ctcaaacgttagcgtataccccttcttcttaattggaaagcttgccttatcaactacgtggtgggggtgtgccaaaggacgtcaacgctgctgtggccaccatcaagaccaagcgcactattcagtttgttgactggtgccccactggcttcaagtgtggtatcaactaccagccaccaggtgtcgtcccaggcggtgaccttgccaaggtccagagggctgtgtgcatgatctccaactccaccagtgtcgtcgaggtcttctcccgcatcgaccacaagtttgacctgatgtacgccaagcgtgccttcgttcactggtacgtcggtgagggcatggaggaatggagagttttttgaggcccgtga

SEQ ID NO: 2254 - DNA, 246 bp, Triticum aestivum
  Clone ID: LIB3280-041-P1-K1-C4
tttgctatgacaatacggcaacgaataacaaagttctggctccatacgatagtcagcattgtatttatttcgacaaagagaaaaaaacaaagcacttcttacctaagcttgcagtagttctagttctcaaaacaccattatggatagagaatatatgcataaaagtccacgagaacaacatagggcgactcgagcatagctcgtactaacttcctaaacggcgctcttctaccagtgttctctact

SEQ ID NO: 2255 - DNA, 354 bp, Triticum aestivum
  Clone ID: LIB3280-041-P1-K1-C5
aagagcggcaagccactgcactacaagggcagctcgttccaccgcgtgatccccgacttcatgtgccagggcggcgacttcaccaagggcaacggcaccggcggcgagtccatctacggcgagaagttcgccgacgagaagttcgtccacaagcacaccaagcccgggatcctctccatggccaacgcgggccccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaagtcgtcatc

SEQ ID NO: 2256 - DNA, 286 bp, Triticum aestivum
  Clone ID: LIB3280-041-P1-K1-C6
acgagcggtaagccactgcactacaagggcagctcgttccaccgtgtgatccccgacttcatgtgggagggcggctacttcaccaagggcaacggtaccggcggctattctatctacggcgagaagttctccgacgagaagttcgtgcacaagcacacctagcccgggatcctctttatggccaacgcggtccccaacaccaacggctcccagttgtatatctgcaccgtcccctgcaattggctggacggcaagcacgtggtcttcggcgaggtcgtcaagggca

SEQ ID NO: 2257 - DNA, 440 bp, Triticum aestivum
  Clone ID: LIB3280-041-P1-K1-C7
cggacgcgtgggcggacgcgtgggcggacgcgtgggtgccccctctcgccggattgccggtccgcgtccaccgaagaatcaccaatggctccgacgtcgaagatggcgctcggcataaagcgggcgtcgagatcgcacacctaccaccgccgcgggctttgggccatcaaggccaagcacggcggcgccttgcccaaggccgagaagccggccgccgtcgccgagcccaagttctatcccgctgatgatgtcaagccacgcaccgtgagcacacgcaagccccatcccaccaagctcagatcgaccatcacaccgggcacggtgctgatcctgctcgcggggaggtacatgggaaagcgcgtggtgttcctcaagcagctccagtccggccttctcctcatcactggacctttcaagatcaatggcgtgccaatccgcag

SEQ ID NO: 2258 - DNA, 397 bp, Triticum aestivum
  Clone ID: LIB3280-041-P1-K1-C8
ccaagtgcgacccccgccacggcaagtacatggcctgctgtctcatgtaccgtggtgatgttgtgccaaaggacgtcaacgctgctgtggccaccatcaagaccaagcgcactattcagtttgttgactggtgccccactggcttcaagtgtggtatcaactaccagccaccaggtgtcgtcccaggcggtgaccttgccaaggtccaaagggctgggtcatgatctccaactccaccagtgtcgtcgaggtcttctcccgcatcgaccacaagtttgacctgatgtacgccaagcgtgccttcgtccactggtacgtcggtgagggcatggagggaggagagttctctgaagcccgtgaggatctcgctgccctggagaaggactatgaagaaagt

SEQ ID NO: 2259 - DNA, 303 bp, Triticum aestivum
  Clone ID: LIB3280-041-P1-K1-C9
ccaagtgcgacccccgccacgggaagtacatggcctgctgtctcatgtacgcgtgtggggttgtgcgggaggacgtcaactctactttgtccaccatcaataccaagcgctctatttagtttgttgattggttctccactggcttaaagtgtggtatcaactaccatcctccaggagttgttccaggcgtttaccttgttaaggatcatttggtctgtgtcatgatcttcatctcctcctgtgttgtctgggtcttcttctgcattgaccactattttgactctatgtactccaagtgtgcct

SEQ ID NO: 2260 - DNA, 445 bp, Triticum aestivum
  Clone ID: LIB3280-041-P1-K1-D1
cccacgcgtccgcgtcatccgtggcaagaagggagcaggaggcatcaccatcaagaagaccgggcaggcgctggtggttggcgcctacgaggagcccatgacccctgggcagtgcaacatggtggtggagaggctcggcgactacctcgttgaacaaggcatgtaggccaccccatcaatataacggcgtccacgatgatgatcagatcacacaattttcaagattctcttttaaatatctacggaaatatatgtgggccttttgtttccctcttcaagcggctctggcatccatcgctcatgatgaccagttgccctaacaagtttcatttgtaatgccttttcggctttccttcttcttcagtgggtccattattttggttgtcgtatgaattgtgttgacaacaaattttgtgctacatttctttcgattgtaaacttatag

SEQ ID NO: 2261 - DNA, 433 bp, Triticum aestivum
  Clone ID: LIB3280-041-P1-K1-D10
cggacgcgtgggctgagattgagtgagtgtgtgagagagaaatcggtggagatggccgggaggctgactgcgatgggatcccgcatcatgggcggccacggcgcagccgcgcgcgccgtggcctccgccctccgcaaccgcgccggcatgggcctccccgccggcaggcacatcgtccccgacaagcccctgcctgtgaacgacgagctggtgtgggacaatggcacacccttccctgagccctgcgtcgaccgcctggcgccgcacatcggcaagtaccaggctctggcgtggctgtgtggaggtctgaactttttcgccgctctcggcctggccgccgttgtgaatgacaaggcctccaagatgccatatacaccaaaagtctacccgttcgacaatttgagagcggaacttggtgatagatcataaaata

SEQ ID NO: 2262 - DNA, 409 bp, Triticum aestivum
  Clone ID: LIB3280-041-P1-K1-D11
agcagaaacattgtgttaggattgctgatgagaaggtggctttagccacacaggcatatgacctggtcgacgctcatatccaacagcttgatcaatacatgaggaagcttgaagaacttcgactagaaaaggaggcagcagcagctgcagctgcagctgcggcagatacagctgttgctgctacttcagctgctcctgctggtgctggtagcttaaggtctgcagctgctgatcctgctccaaaaactggaagagctggcgaaagaagcagaggagggcggaagaaggccaaggtgcccatggagatgcccacagagatgcccgtggaacagccagctatagatttagaattgcctgtcgatcctaatgaaccgacatactgcttctgcaaccaagtcagctacggtga

SEQ ID NO: 2263 - DNA, 231 bp, Triticum aestivum
  Clone ID: LIB3280-041-P1-K1-D12
aaagaggaaggtacaactgccatcttttttttattatttttttatttttttttttatgacattatatctctgcccgaggttgaaacaccctttttgtggaaacctttgtttaaaaattgcatatgatcaagagcaaaaatttttttgcacaaatatagagaggtcattgatgttcgcctggctacccatgaagatggccatcccaagggatttggtcatgttgctcccctt

SEQ ID NO: 2264 - DNA, 403 bp, Triticum aestivum
  Clone ID: LIB3280-041-P1-K1-D2
cccacgcgtccgtgtcatccgtggcaagaagggagcctgaggcatcaccatcaaaaagggggggggggctctggtggttggcgcctacaaagagcccatcacccctgggcagtgcaacattgtggtggaaaggctcggctactacctagctgaacaaggcatgtatgtcaccccatcaatataacggctgacacgatgatgattagatcacacaattttaaagtatctctttttaatatttactgaaatatatgtggaccttttgtattcctcttcaagcgggtttggcatacatcggttattatgaccagagtgtcttatcaagtttcattttttatgccttaacttcttttccttcttcttcagcgaggaccttaatttttagttgtgtgttatgaattgc

SEQ ID NO: 2265 - DNA, 437 bp, Triticum aestivum
  Clone ID: LIB3280-041-P1-K1-D3
cggacgcgtgggcggacgcgtgggtctcggtgcttccatgtatcccgatcgcactaagacaattgctggttcataacgaggcaaaagatatggtggacttccttgtattgttaaaccaaataatatgcaagtttaattcttcagcaagtggcatactggaggatgtctttcctactattgcaagtcgtatgtctgtgatattgtcacaagatgccttttctactggtcctgcaggcaataccgaggaaatgcgtgaactgcaagagctgcagaggacattatacacattcctccatgggatggttacacatgatttgtctgcagttctccttgctcctacctgtaggcagtatttggaaaccataatgcagctacttttgtttacttcatgcagtcataaagatatactgctccgggaggcgtgtgtgcagattttt

SEQ ID NO: 2266 - DNA, 382 bp, Triticum aestivum
  Clone ID: LIB3280-041-P1-K1-D4
ccgacgcgtgggcggacgcatgagactcggtgcttccatgtattccgatcgcactaagggaacggcggctttataacgaggcataagatatgaaggacttccttgtattgttaaaccaaacaataagcacgcttaattcttcatcaagtgtcatactggaggatgtctttcctactattgcaagtcaaatgtctgagatattgaaacaagatgccttttttgactgatcctgcacgcattaccgaggaaatgcgagaactgtaagagctgtatagaacattatacacattcctccatggaatggagacacatgatttgtttgcagttctgcgtgctcctacctgtaggtaggtttttgaaaccataatgttatttacttttg

SEQ ID NO: 2267 - DNA, 406 bp, Triticum aestivum
  Clone ID: LIB3280-041-P1-K1-D5
cccacgcgtccggcgaaccacagaacccgacgcgaggcgtggctcgccgcgagatggtggcacttttacattagcgatgctagtttgtgtcttgttatcttttgaaaatggtgaagctgacaatgatagcccgtataactgacggccttccattggcggaggggttagatgatggttgagatctgaaggatgctgacttctacaagcagcaagcaaaactgttgttcaaaaacttatctaaaggccagcacgaatcatcaaggctgtcaattcagactggacctacaccactgtgtgcagtggcggagtgtgacaagaaaggaaggaggggccgagagagaacggaaaatgatctagactagtggagaattttttgggacaagaagaaccgtcggatttttttaac

SEQ ID NO: 2268 - DNA, 433 bp, Triticum aestivum
  Clone ID: LIB3280-041-P1-K1-D6
cccaggggtgtgccccagatcacggtgtgcttcgacattgatgctaatggcattctgaacgtctctgcggaagacaagaccactgggcagaagaacaagatcacaatcacgaatgacaagggcaggctgagcaaggatgagatcgagaagatggtgcaggaggcagagaagtacaagtcagaggacgaggagcacaagaagaaggtggagtcaaagaatgccctggagaactatgcctacaacatgcgcaacaccatcaaggacgacaagatcgcctccaagctagctgcggacgacaagaagaagatcgaggacgccattgaccaggccatccagtggctggacggcaaccagcttgctgaggcagatgagtttgacgacaagatgaaggagctggagggcctctgcaaccccataatcgccaagatgtacc

SEQ ID NO: 2269 - DNA, 406 bp, Triticum aestivum
  Clone ID: LIB3280-041-P1-K1-D7
ctccaaggcgagccggcacgacgactgcctcaagtactgcgggatatgctgcgccgagtgcaactgcgtgccgtcggggaccgccggcaacaaggacgagtgcccgtgctaccgcgacaagaccaccggccacggcgcgcgcacgaggcccaagtgcccatgatccatgcaccacccatggcgtctacatggggcatatacctacctgaactggaagatgccctatcatgtactgtacttagtaccatgtcgcggatcactactatattatatgcgtgtaatcatgatctgaaacgcctggttcatgatccgactgtatgttgataatgcataatgctggcctactggtatgccggtaaaaatgtcattgtgctgtaataataaactatcatgcattcgtagagtc

SEQ ID NO: 2270 - DNA, 281 bp, Triticum aestivum
  Clone ID: LIB3280-041-P1-K1-D8
ctcaaaggcgagccgtcacgacgactgccttatgtactgctacatatgctggggcgagggcaactgcgtgccgtcgcataccactcactacaaggacgattgcccagttctacctcatacatgaccaccggtctttgagcgcgcacgaggctcaagtgcccattatccatgcaccacccatggtagctacatgtggtatatacctaactcaactggaagatgccctatcatgtacttttcttatttccatgttcgtggtacacttctatattacatgcttg

SEQ ID NO: 2271 - DNA, 408 bp, Triticum aestivum
  Clone ID: LIB3280-041-P1-K1-D9
cttatagcaatttcatcgctacgccatcgtcatcatcacaccaaaacatgtatttacacatccttgatcccttgacccggccacctgatcgaccttaattaccctgttttactctgtcatcgtccggaaaacatgcaagcacgcacgcacctacggcgcggctctgaatgcctacctcttctcccttggacccagcgagatggatctcttcgtcctccgctggccagcagatggatggattactacgtacgtacgtactaacttcttctgcgccatcatcgatctctctctgcttccgccattgctacgtgatcgagcacagtttagcttatggcggactcgcgcgggcgggccgcccagagcgtgctgagcgcgcgaaggcgctggaagtagtcccccagcacgagc

SEQ ID NO: 2272 - DNA, 406 bp, Triticum aestivum
  Clone ID: LIB3280-041-P1-K1-E1
ggtccacaaaaaatttagtgcggaaaatcacaaatagagaaaagaccagattatacatatacatctttttcacggagagtgtgctaatcatatattagtacacggtagcccaccatctatcggccacaatgattgactactctctactaacccacctacccttgagtagcccggcttgctgccatgtcctcccttcgatcacaattttcttgatgatcgtaagcacacaaagtgttgctccgccaaagacaatagcattgcggtgtttacaaagttcccaagtgatgagcgagagaatgatcctcgtttcatttcgcaaaaaagaaaataatggccctcgtttcgtttcccaagttattgtcaacagtgggagcttggtccggattcccaatagccgaccacacca

SEQ ID NO: 2273 - DNA, 435 bp, Triticum aestivum
  Clone ID: LIB3280-041-P1-K1-E10
gccggcgacggtcctcccgaccggatccagcgcagccaccctcccccctcgggtgccagggacgccgcctggcctcccccggtcccaccaccgtaagactcctctcggtccagcgaccttgagcacagagatgcggggagtcggaggtccactgctcactgtcagcgatctcttgagcgacctcgccgtcgaaggaggcgacgaccacctcgacggtggaggcgacgcctctgttccctctttccccttggcagcgcatcaggtggaggaggccgacccctccgagctccagcggctcttggcggaagactatgacaatttgatgaagtcgctacaggagaatgacccttcgtggccttccctgatgctgaaggtgtgcagggcgttgaaaactttcgataagctgctgagcttgccgaatgtgaaagctgagca

SEQ ID NO: 2274 - DNA, 256 bp, Triticum aestivum
  Clone ID: LIB3280-041-P1-K1-E11
cgctgaggagcagtgaccacaagaaggggcttaagcactggattcagaaactgaagccatcgcacagcgcgtgagctcagtcatctagcattgtttcgaccgttattttatccggttgggtatgctcccctagtctagcctagcgtaagatgatataagcttttcatttcgtgttttaagattctaggatggatgcggatgtttattaggtgagctacaatttgcttttttattacattattagtagttgtatacc

SEQ ID NO: 2275 - DNA, 208 bp, Triticum aestivum
  Clone ID: LIB3280-041-P1-K1-E12
cgctatcgagcactgaccataagaaggggcttaagcactgtattcataaacggtggccggcgcacagaacgtgagcattactcatttatcattgttttcaccgttattttatgcggatgtgtatgctctcctagtctagcctagcgtaagatgatataagcctttcattctgtgttataagataataggatggatgctgcatgttatt

SEQ ID NO: 2276 - DNA, 430 bp, Triticum aestivum
  Clone ID: LIB3280-041-P1-K1-E4
aaaggacagcagcagtgatgatgacagttctgatgaaagctctgatgatgagcctaaaaaggaagttacaactgccacaaaatcacagaaggaagagcctaatactcctgctagcaacaaaggtcaggcaacagggtcgaagaccctttggatggggaacctttccttcaatattgagtatgatcaagtgaagcaattttttgcacaaattggagaggtcgttgatgttcgcctggctacccatgaagatggccatcccaagggatttggtcatgttgagtttgctacggctgaagatgctcagaaggcgcttgattcgttgaatggtggagatctaatgggccgtcctgtgagacttgacatggctgctgaaagaggtgcgagcgctcctcgcaccaagggatggggatcttttggaaaaccaagtgga

SEQ ID NO: 2277 - DNA, 359 bp, Triticum aestivum
  Clone ID: LIB3280-041-P1-K1-E5
gcaaggcgaaaataaagaacataaatacatagtaaccatgggaggcaccggataatagtcatcagattacactgggtggccagttagtcatgcactactgaagcaatcatacggcctccccaattacaacaatcctactgtaatacatactagaaccgaacagctcaattcataagctcaggggaggcccataaatcttattacgccgcagcaacaacagcaccaaggacagtcacagaacaacaacacattctccgattagaaatgcgcaagattagatcgatgatacattactgctgggggacatagtagtatgccatactcgggtcggtggcaggcacgccggcggccgggcgcgg

SEQ ID NO: 2278 - DNA, 441 bp, Triticum aestivum
  Clone ID: LIB3280-041-P1-K1-E6
gccggagcccggatcgcgcgctgctgttcgccggcgggctgaggcgggcgtccgggcgcgcgccatggacgtggacagcgtcgagtgcctctcgctgcccgacgccgccatggacgcggacgacgtcggcctcgccctccacccgcacggcgggatcctcgccgccgcctcccgcccggccgcctaccccaaggccggcgccggcgcggggggcatcgtcgcgccggggagcagcgtgcacgagctgctcgagtgccccgtctgcaccaactccatgtacccgccgatccaccagtgccaaaatggacatactctgtgttccacatgcaaagctagggtacacaatcgttgccctacttgccgacaagagctcggtgatatcaggtgtttggcactggagaaagtagccgaatcgcttgagcttccctgtaagtactattc

SEQ ID NO: 2279 - DNA, 426 bp, Triticum aestivum
  Clone ID: LIB3280-041-P1-K1-E7
cccacgcgtccgcccacgcgtccgcctccggcgtcgggaagaccttcacccaagaagtgatcgaggccatggcctccttcaacgagaaacccgtcatcttctcgctgtcgaacccaacgtcgcactcggagtgcacggccgaggaggcctacacctggagcaagggcacggcggtgttcgcgagcggcagcccgttcgaccccgtggagtacgaggggaagacgtacgtgcccgggcagtccaacaacgcctacgtgttccccggcttcggcctcggcgtcgtcatctccggcgccatccgcgtccacgacgacatgctcctcgccgcctcggaggcgctggcggaggaggcgacccaggagaacttcgacaaggggctcatcttcccgcccttcaccaacatccgcaagatctcggccagcatcg

SEQ ID NO: 2280 - DNA, 290 bp, Triticum aestivum
  Clone ID: LIB3280-041-P1-K1-E9
ggttggaaaacgaggccattttttaaacctgaacaagaaacagtttcgccaacaacaataaactaaaccaattcatgatctgtcggatctgcattacaaagggcacaagtgttttccaagccaagagtagtgttgctgttgtgcaaactaaaccaatgtcactgcagttgcttattacgggtaaattggagtaaaaacgaacaaaaacagggatccctcagcaggagctggcacactcctgctcgtgagcaagtctcgggcgaacagctgaaacccaaaaaatttaactt

SEQ ID NO: 2281 - DNA, 52 bp, Triticum aestivum
  Clone ID: LIB3280-041-P1-K1-F1
ctaccacttcattacccacctccttcattcatttttttattcacacacacaa

SEQ ID NO: 2282 - DNA, 351 bp, Triticum aestivum
  Clone ID: LIB3280-041-P1-K1-F10
gcggaaaggggatcggtgccttcgttcccaatgatggttgcctgaacttcatcgaggagaatgacgaggtgctgattgctggattcggtcgtaagggacatgctgtgggagatattcctggtgttcggttcaaggtcgtcaaggtgtctggtgtgtctctgcttgccctcttcaaggaaaagaaggagatgcccaggttttagattgccgatgcatggaatagacaagttgtctggcctttatatgttgaaggaggatggtatttttgtgtttacagcacttattaagttgatatcttatgaacgttttggttaaaactattgcctttcacattcttgctccctttaaggt

SEQ ID NO: 2283 - DNA, 133 bp, Triticum aestivum
  Clone ID: LIB3280-041-P1-K1-F11
atattttgtttttgttttttttttatttattttttttttttttatttttttaataattattttttttttttattattttattttattttatcctattttatatatattattcattttatttctattattaaaa

SEQ ID NO: 2284 - DNA, 437 bp, Triticum aestivum
  Clone ID: LIB3280-041-P1-K1-F2
tcagcttagatctttccactgcttccgccatggacgccgaggccgccgccgccaccgccgccacggctacgcctccggcgccctcctcccaacctctgggctccatcccgcagccccctcctccaccccctcctccctcctccgtagtacacacgcctctccctctccagactgcgccgccggtcgccagcttcccttctgcggcctatatccacgcgatgcgcgtcgagagtgcccacatcaacctcggcgtccgcctcgatatgaaaggggccaactactcgacttggcgtggcctcatgcttgaggtcatcgaccagtacgatgtggcggcttggatcgcgccggacttcaccaaccgtgccggcgacgtggcgtggaacatcgtcaacaaagccgtcaagcgctggttctacggctccatggtcacggagctc

SEQ ID NO: 2285 - DNA, 442 bp, Triticum aestivum
  Clone ID: LIB3280-041-P1-K1-F3
ggggctacgccgtccacgccacgctccgcgaccccagtgatcccaagaacgcgcatctgatgcagctggacggggcggcggagagcctgcggctgtttaaggccgacgtgctggacagcgccgcgctggccgccgccgtcgaggggtgcgagggcgtcttccatgtcgcctcccccgtccctgcggataagatcgtcgatcctgagtcagaagtcatggtgcctgccgtgaaggggaccttaaatattcttgaagtttgttcatctctgaaggttcataaggttgtggtggtgtcatccactgctgccgttcattatgatcccaactggcctcagggtaaacccaaagacgagagttgctggtcggacagaaaagtatgcaaggataatgagatctggtatagtcttgctaaaactggtgctgaagagacaggttgggaata

SEQ ID NO: 2286 - DNA, 444 bp, Triticum aestivum
  Clone ID: LIB3280-041-P1-K1-F4
gacaggacaacatttgatgcaaggacattacaccgttacagagaaaccattgcacaaacaatggccaacagctgcagagaacacaagcgtggcgttccacgtccaccaccattgtcgctcttcattgctagggagcaagagccagcggtcgcgtggacacacccggctgctgccgacaacagcaacaagaagaggatgttgtccaagcagctttccatgaaggagaccacccgggaggtcaagtgggagaagcggcggcggcagatacaacgacaaaggagcagcatgggcctgtacgatgccgaccgcgtgggatgcgctaacatgcacgccactgcgaacggtgtgactgacgaggacctggatgagcttaagggatccatggagcttggcttcgggttcaacgaggagaacggaggccagaacctttgtgacacgctccct

SEQ ID NO: 2287 - DNA, 441 bp, Triticum aestivum
  Clone ID: LIB3280-041-P1-K1-F6
caactcgaccacagagcggcggcggcggcggcggcagcggaagaaagaggagagagctccagccatggtgcacgtcaacttctaccgcaactatggtaagacattcaagaaaccaaggcgtccttatgagaaggagcgtcttgatgcagaactaaagctggtcggtgaatatggactgaggtgcaagcgtgagctctggagggttcagtatgcactgagcaggattcgtaatgctgcaagacacttgctcacactggatgagaaaaatccccgccgtatctttgagggcgcggcccttctccgtcgcatgaaccgctatggtctccttgctgagggccaggataagcttgattacgtccttgccctgactgctgagaacttccttgcaaggcgccttcagactcttgtcttcaaggctggcatggcaaaatccatccacca

SEQ ID NO: 2288 - DNA, 136 bp, Triticum aestivum
  Clone ID: LIB3280-041-P1-K1-F8
tcgttcttccataatctaacaatatatgtgcatgactcactgacgttacacaacttcttgatcttaataactcatgtgttaaccaacttaatcttcttgcatcacattttcctttcgacagctgtcattatatcta

SEQ ID NO: 2289 - DNA, 382 bp, Triticum aestivum
  Clone ID: LIB3280-041-P1-K1-G1
cctatctggtagttctccaacttcattgtttccagaatcttttggcatgcaatcttatcgtcgttacttccttctagaagttcagggccaagaacaccaaagcgattaacaaattcatagaatgtttttcttgtggggtatccagcacagcttatcctgatagcttcaagaacacctgcacatcgtagttgttgaataacatttgtgttctcaaaaatggctggcttgaggagattgtttggcttcacacatctaatataatgggggtcagtagagctcaaggtctccatgagagactgaagttgcagcttaaaacgtgacccaatagaagaaaattttgaagactttgatgattctttcaggagtgaagggataagctagc

SEQ ID NO: 2290 - DNA, 438 bp, Triticum aestivum
  Clone ID: LIB3280-041-P1-K1-G10
ggacgacaacattagactgataagtgcttggttgaataactccatagactccattgatggaaacaacaaaaagggagaggtgtattggaagaatgtcacggaggactacaataaaaacagtccacccacccggaggagaaacagtaaaaactgcaaggaccattggggtaaaactaataggaaagttgtagcttttcatggagtttactgcaggctaaaagatgcctatgcaagtgggcaatgcgacttacagcttgtccagaaagccttggccatgtacaagaaggagaagaatcaaaacttcacactattgtactggtgggagaaggttagggtccaccagaagtggagtaggcactccgaggagggtaaaggcaaaggtaatggtacaatacaaacccagatggaaaaagaaactcgccccgatggaaccaaact

SEQ ID NO: 2291 - DNA, 369 bp, Triticum aestivum
  Clone ID: LIB3280-041-P1-K1-G11
gggttcttctgaagcaacacactgtacttatacctgtagaagaacaacattagtgatgaaagctcttagtttccccaggcacactcggatatgtattgctataggtgaaatctatgatggtaaaaagattaactgcatcgaatacaaagttccctaacatagcgtatgtgcacaaggatgcctttatctgatggtgaactacaccttttccaaaaaatactcaacccaaatggaagccctggactatcttgtttctggcataggtgaaggttttattccctgttctgaaggaaacatggctaaagttggtcaaggacaccacatgcctgtctatttatgaccttcctgatatgaaaatcggtttttttt

SEQ ID NO: 2292 - DNA, 392 bp, Triticum aestivum
  Clone ID: LIB3280-041-P1-K1-G12
cttcttccgcacacgggacagtacagcaccaccacccgccacctcaacgcacgcaaaggccgaggaggacaagctaggaggagcgagcagccatggcttcgtcggtggccgccgcggcgagcgcgttcttcgggacccggctggcggacccggcgccgaagaacgggcgcatcgtggcgcggttcggcttcggcaagaagaaggccccgccgaagaaggccaaggcgcccccgaccaccgaccggccgttgtggttccccggcgcgcaggcgcccgagtacctcgacgggacgctcgttggcgactacggcttctaccccttcggccttgggaagcccgcggagtacctgcagtacgacgtggactccctggaccagaacctggcccagaac

SEQ ID NO: 2293 - DNA, 109 bp, Triticum aestivum
  Clone ID: LIB3280-041-P1-K1-G2
aaacattagaagtccccactgttttctccatgtactccgtggccgtcagtccactacctggggtaggcatacacgtttggcgccccactccaaacctttgaactccatt

SEQ ID NO: 2294 - DNA, 440 bp, Triticum aestivum
  Clone ID: LIB3280-041-P1-K1-G3
cccacgcgtccgtctgtttttaccctgatgagagaccttgcaatggattctcagaagctcttgagcgatacagggagcttgttccgcatttgcgcttggctggaccgacatcttttgcaccaataattgagatggctatgaccatcgtggagcaaagtggtgggcagtaccatgttctgctgataattgctgtcggacaggtcacaaggagtgtagatactgcatctgggcagctgagttcccaagagcaaaagactgttgatgccattgtgagggccagtgaactgccgctatctattgtgttagtaggagttggtgatggcccatgggacatgatgaaggaatttgatgataacattcctgcccgggcttttgataattttcaatttgtgaacttctcggagataatgtccaaaaacatgccacaatcaagaaaagag

SEQ ID NO: 2295 - DNA, 431 bp, Triticum aestivum
  Clone ID: LIB3280-041-P1-K1-G4
gaagagcaaacccggcgtgcgaagatgaagacgatcctggcgtcggagacgatggagatcccggaggaggtgacggtgaaggtgtcggcgaagatgatctcggtgacggggccgcgcgggacgctgacccgcaacttcaagcacctcaacctcgacttccagctgcaggagggcgggcggaagctcaaggtggacgcctggttcggcacccgcaagaccatggccgccatccgcaccgccatctcccatgtccagaacctcatcaccggcgtcaccaagggcttccgctacaagatgcgcttcgtctacgcccacttccccatcaacgccttcatcaccgccgccaacaagggcatcgagatcaggaacttcctcggcgagaagaaggtaaggaaagttgacatgcttgacggtgtgacgatcctgcggtc

SEQ ID NO: 2296 - DNA, 412 bp, Triticum aestivum
  Clone ID: LIB3280-041-P1-K1-G5
gaagagcaaacccggcgtgcgaagatgaagacgatcctggcgtcggagacgatggagagcccgggggaggtgacggtgaaggtgtcggccaatatgatctcggtgacggggccgcgcgggacgctgacccgcaacttcaagcacctcaacctttacttccagctgcaggagggcgggcggaagctcaaggtggacgcctggtttggcaccagcaagaccatggccgccattcgtaccgccatctcccatgttcagaacctgatcaccgttggtaccaagggcttacgctacaagatgcgcttcgtttacgcccattttcccatctacgcttacattaccgacgtcaacaggggtattgtgtttaggaacttttcttggtgagaagaatgtaaggaaagttgacacgcttgac

SEQ ID NO: 2297 - DNA, 271 bp, Triticum aestivum
  Clone ID: LIB3280-041-P1-K1-G6
aaaaaaactctgttcttcttcaaatatacaaacatttttcagaaggaataaattggcatggcaatagcaggaacacggtggatacatagatagaagctactcacgaaaacaataacagtcgttgattttgttggatcaatgttgaagcagcacaaacgcatacagtgcttaattaggcgctcacacggtcacgtctcctttccgttcgtacgcacgtatcgatgattgccgtacgtgcgcgagatcgacgaggcagcagaggcgggcatac

SEQ ID NO: 2298 - DNA, 263 bp, Triticum aestivum
  Clone ID: LIB3280-041-P1-K1-G9
cgtgctgctgctatcccatgatctgcccgagtggctttatctgttatctgtctgtttgaatctttgctttgtggtgtttgttttataacctgttgtgttgtaagacccttgtatctttgaacctgttatgcaccttggttaatatgcatgctatctggttatctaaaaaaaaaaaaaaaagggccgcccgtttagaaggatccagcttacgtacccctgcatgccacgtcatagcttttttattggggcacctaaattcaatt

SEQ ID NO: 2299 - DNA, 253 bp, Triticum aestivum
  Clone ID: LIB3280-041-P1-K1-H1
ccaaaaaaaagcctcctaaaaaataaaaaacatgttttttttaaaggggggaaaaaattccaacaagtgtacgttgttggtaataataaaaaagcccgtttaaattcattctctcttcctatatctcacgtgtctttgaaaaaaatataattttttttgggggggggagagacaagaaaaatcaatatgttctcctcccatctctctgaattactcaattccaacaattgccataggtcaataattttttttt

SEQ ID NO: 2300 - DNA, 208 bp, Triticum aestivum
  Clone ID: LIB3280-041-P1-K1-H11
cgagcgttctacatttttatttttttttcattaaatcataaatacattctagggtttgggtatttttctatcatactaaatcttaaaaaaaaatataccttcctccttaatttattttcattcctttatctctaacatacatatataatattttcctcctttctaattacttctatttttaattattaattattctttatttaaaaat

SEQ ID NO: 2301 - DNA, 370 bp, Triticum aestivum
  Clone ID: LIB3280-041-P1-K1-H12
cggcagatgttggttcactgaacactcttttattggcattcttcagcctaagttaaagaactaatgcatcgactgcctgacataggtgacatgcacattaaccagcgatactacaacgcgaggtatgttaaaaggttcaaatcggcaacaacagtaccactctctgcagtctgcactgccttcatagaggctatgaacacaggacggcggctctttttacaggttcacggcaaaacagaacgcttctccttgctttacttcctaatgaacagggtgcgcagattgccacgctccagctttttgagcagattcttggcgccggcgacgttcatcttggagagcttttttaggtacccgatggggccctgcg

SEQ ID NO: 2302 - DNA, 78 bp, Triticum aestivum
  Clone ID: LIB3280-041-P1-K1-H2
aatcccgcgcgacccacgcctcctactaatcctacatccctatcgacccccctttttttttttttcttcctcttcctt

SEQ ID NO: 2303 - DNA, 91 bp, Triticum aestivum
  Clone ID: LIB3280-041-P1-K1-H5
cgagcggccagcgttcattctagattatccaagcttacctacgcattcatgggaggcggtggttcttctatagtctcacctaaattcaatt

SEQ ID NO: 2304 - DNA, 335 bp, Triticum aestivum
  Clone ID: LIB3280-041-P1-K1-H6
ttttggatgggaggacctccactgaatattaatgatttcaaaagagtatcatgaatactaattgacgacgatcataccgatctccagcttattattacatctgcgaattcaataactgcaagacacgtcattccaatttaactatcctctcgattcacgatctagaaacaaaagctaagctcctagcatgccggagacggatgtacttctgatctagttgggggcgaagaagatctcggagtcgagcctcttggagcggaacagcttctccatctccggggtggtgttgaacgccgtctctagcactgccggggaaattgccttccacaccgacg

SEQ ID NO: 2305 - DNA, 438 bp, Triticum aestivum
  unsure (1)...(438): unsure at all n locations
  Clone ID: LIB3280-041-P1-K1-H7
gcgtctgggagaaccactgggtgtactggctcggccccttcgccggcgccgccatcggcgccctcgtctacgacatctgcttcatcggccagcggccccacgagcagctccccaccgccgactactgaaaacctcactctcaatctcatccatccatcaccgccatgagagattgaaatcgattcaaaaaattccagcaagtgtacgtcgtcgtgtcatcatcagtaagccagtttagtttcattctctctccctctctctcacgtgtctntgagaaattcagggtaaacagggtgagtcagtcagtcaaggaatatctcttggcttgggtgtatgtcctcaaattatgaatgcctctatttcctgggccagaatggaggttggtccaaaaaaaaaaaaaaaacccttaaaattataaggattgttttattatcatat

SEQ ID NO: 2306 - DNA, 131 bp, Triticum aestivum
  Clone ID: LIB3280-041-P1-K1-H8
acgtctcctataaccactgagcttactggctctcccccttcgccctcaccggggtcggggttatcctataccacatccccttcatcatccaacctccccacaagcatctccccaccaacgactactacaaa

SEQ ID NO: 2307 - DNA, 381 bp, Triticum aestivum
  Clone ID: LIB3280-041-P1-K1-H9
gtcgcgattgactgggtgaatgagaacgtgcagccttacatttctcagacacgcattgttggaatcactgtggggaatgaggtgctgggaggcgatccgagcttggccgctccgctcgttggagctgttaagaatatgtacgatggtctcaagaaactgcatctggatgacaaaattgagcttttcacacctcactctgaagctgttttcgctacttcctatccgccctctgcatgtgttttcaaggaagaaatcatggtgtatatgaaaccgctgctggacttgttttcacggatcggctcacctttctatgtcaatgcatatccctttttggcgtacttaactgatccggggcagatcgacattaattatgctctcttt

SEQ ID NO: 2308 - DNA, 136 bp, Triticum aestivum
  unsure (1)...(136): unsure at all n locations
  Clone ID: LIB3280-044-P1-K1-A1
cccacgcgaccggaagaaggccngnaagggcagcgagcncaccgcngacancaagcacagggggccggacggggagaaganccggcgccncgancgccagnccaaangccnccaggacaagaggaccgccaaggag

SEQ ID NO: 2309 - DNA, 328 bp, Triticum aestivum
  unsure (1)...(328): unsure at all n locations
  Clone ID: LIB3280-044-P1-K1-A12
cccacgcgnccgcggacgcgggggaggagcccgcancccnncggcgcaccncgcggagaccggcancgncgccncccccaaggccaccggcgcngananncaaaccanggnccnnnnaagaggagaggcgnngaggagaaggcagacgccgncgcccaggcgcggancgncacggccgccaacgcccagcaccgccncccncgccgnagagcaacgacgacaccaagcgaggcacngncgacaccccgccgnccccccccggagacaacnnccgccaccaccgcgcagaaaccaancggcaacacgcccggaagcaagggacgcccag

SEQ ID NO: 2310 - DNA, 71 bp, Triticum aestivum
  unsure (1)...(71): unsure at all n locations
  Clone ID: LIB3280-044-P1-K1-A3
nagaggaaccaagcgaacgggcgcgggcangcgacgncanagcncnncaaaaggggcaccaaaanncaann

SEQ ID NO: 2311 - DNA, 432 bp, Triticum aestivum
  unsure (1)...(432): unsure at all n locations
  Clone ID: LIB3280-044-P1-K1-A4
actagnnctagancggacgcggncagncatcaaaccccagtttcgcgcacggagctgaccatcgagatcgatcaggccggagggaaccaaggcgcgcgccgcgttgttgtcgtccggctagccgggccatggcgaacagcctcctccccgtcgtggcgctcctcgcgctgctcttcggcgcgtcgcgcgccgccgacttcgaggtcggcggggacgccgggtgggtcgtgccggcggccggcgactccggcacgtacaacgactgggcgttcaagaaccgcttcctcgtcggcgacagcgnncatttcaagtacaaggcggactcngtgatggaggtgacgcaggaggagtacgacaagtgcgggtcgacgcaccccatcttcttctccaacaacggcgacaccgaggtgcgcctggaccgcccgggcccct

SEQ ID NO: 2312 - DNA, 467 bp, Triticum aestivum
  unsure (1)...(467): unsure at all n locations
  Clone ID: LIB3280-044-P1-K1-A5
gctaactcaaggagaagcataaaancncagggagactccttngnncncgcgagagnngcgagaggcagcagcctaaaatcccagggagaagcataaaatcctgtgagaggaaggcatggagagcgcccataagaaggcactcggcatcgtgacgctactggtggttctgcagctgctcgtggcggccatggctcgctcaccaccagaggagatggaaacggaggcggcgagatcattaaagatagcgattgagcgcctcgtcctgaaagcgccgcggtgagacgcgaaatgcgccgacgaaacatgctatactagtttttgcttcntcgtcgctggttgcagctgccagtatccctactgtacaaagtctcgcgtcccaacgccagttcatgcttgaaaagcttctncttccattcgttgacggacccctaaaacggtgggatttgctttctcgcttaagaaaaagc

SEQ ID NO: 2313 - DNA, 413 bp, Triticum aestivum
  unsure (1)...(413): unsure at all n locations
  Clone ID: LIB3280-044-P1-K1-A7
aacaccgaagaagagaggagacgagaaaggggancgccgccgccgccgccgccgncgcccaggangacgncnangcngnccgcgnncncgncgnggnncgngaacccgcgccgcaacccgcnggcccgcanccacaggcccaccancgccaaccgccncaagaaccacggccggaggnacgacgaccngnangaccccnacnncgancgggacancaaggaggcgcncngcaggcggccccgggagggggncgacgcccgccaccagcgncncaagcgcgccanggaccnnnncaggaagcaccagaaccgccccgacgacgnccgggcaccacagacaccanncaaaagcnnagggagcgacaggcnggcncnggagaaaaaggaggcagcagagccgaaagcaccgggagc

SEQ ID NO: 2314 - DNA, 442 bp, Triticum aestivum
  unsure (1)...(442): unsure at all n locations
  Clone ID: LIB3280-044-P1-K1-A9
tcatttaggacaagcactgcaaatttacaaagtatgtttaagtctatgttgaaagaagttggcaagctgtcacgagaagcacaacattccctccgtaggacaatggagaaatacagtgcatcgtgtagactcatattatgctgtaatagctcctcaaaggtgacagaagctgtaaggtcccgttgcttgaatgtgcgagtgaatgcacctaccgaagatcagattgtncaagtactggaattcattgggaagaaagagaatctgcaacttccatttggatttgctgctcggatngcagctcaatcaaaccgcaacttgaggcgagcaatattattttttgagacatgcaaagtccagcaatatccattttcagcaaatcaagtggcacctcctcttgactgggagcagtatgtgtctgaaataacaactgaaatcttgagtg

SEQ ID NO: 2315 - DNA, 408 bp, Triticum aestivum
  unsure (1)...(408): unsure at all n locations
  Clone ID: LIB3280-044-P1-K1-B1
ggnctnnnactgccacacccccagcaacgngcaagcactccgngtccaactngnnggacaggaggaccctgccgncggcgccacggccatcgcagtatgccacaaggataccggcgactgggatgaggcgtacttcgtgatgctgaacggatcccgtggcgagccgatatgtcacttcatgccggccaattacctcctgtggctctaggaggtgaagacacgagcagcaagtaccagagttgagagacagccggccggtgacgtgtaatttcggacttagtagccgatctagcttaaataaacgtcactgtatctgtatgcccttaccagttattgtaagcgcatgtagcgcaaagatatatgtaccccgaaaaatgatatgatacagtcatacagatatagtaaaaa

SEQ ID NO: 2316 - DNA, 280 bp, Triticum aestivum
  unsure (1)...(280): unsure at all n locations
  Clone ID: LIB3280-044-P1-K1-B10
ggagaccaagctcttccaaaacttaggatgagcacaattgcaatgatattaagagcgcaagtccatcctggaggaattacaatgccaagtactactattacatttgatgttcgctgagatatcaaggcacgagtgatctgtaatgcatgaacataagtactgacccgtacttnancatcgaatatgctatgtataatcttaggggcactgtcaacttaccaaaatgcaaacaattttcagcccaagttttgaagtatcaaagatcaatttttcatgatgt

SEQ ID NO: 2317 - DNA, 428 bp, Triticum aestivum
  unsure (1)...(428): unsure at all n locations
  Clone ID: LIB3280-044-P1-K1-B2
aaaatggatacacgagcttttcttctgcagaagtttagttcagaggaacgaattcagattgacaccgcgttggagcaaggggtggatgctgtgaggacccttgtgctgaagggttttagtggaagtattgagagatttaatctggtgcagaagtacaagttcaacagggcttgatgattctttagatgcttggatctgtctacttttggaagatacatgaatgcacatgaaaatgtttttgcaagcatttgatgtgataatttgcataaccttaggtgcactaagttgggtgtcctgtanntttgaggatataaaaaacttagcanggtgtagataaggtagagttcttctgcacatcttcctaaatataactcatggtttactcanattggaaataaaataggtccatttgatgaaggtcatgtaaa

SEQ ID NO: 2318 - DNA, 432 bp, Triticum aestivum
  Clone ID: LIB3280-044-P1-K1-B3
gtggaaggtcttggcggcggtctccttgatgacgtccggctcgggcacctcgtcgctggccttgtcgaagtccatggtccagttcaccaccgcgccggcgccgtcggcgcccttgtcggtcacctgcaccgtcaccctgaagttcttgtagaagctcaccagctcgccgtccaccacgctgtacgacaccaccttcttctcgtcgtccgccacctccaccttctccttggcgaacgtcaccatcggaaccccctcggtgtacttgatgaggcggacggtgccggcggacttgccgtcgccctccacggtctcgatgctcttgtactgctcggagaagatcttggggaacagctccgtcgactcgcgcatcgccgtccacagtttctccgccggcgacttcacctacaccaccagctagaccttgggctacaa

SEQ ID NO: 2319 - DNA, 331 bp, Triticum aestivum
  unsure (1)...(331): unsure at all n locations
  Clone ID: LIB3280-044-P1-K1-B4
caaggaaaaagggatagggatatgaattttctcagcaaggaacatcgtttcgtttgtcaaacaagcccgcacgcagaaattgcagcctacaggaggctaactgggctcttaaatacctcatgtgtaaaataggggcacaaagttgccagcatcaagcacaacagttaactgnttacacccactggaacacaccatcttagatgggtctgcttaatgttcttctatcttcttcaggtccttcatatttgtagtggccacaggggnnccataaagcgcaatcttttgaatttttgggaaggcagctccgcttttgattgtcttcgaaaaacat

SEQ ID NO: 2320 - DNA, 208 bp, Triticum aestivum
  Clone ID: LIB3280-044-P1-K1-B6
gacaaaatcgataggtcaaagggttttggaatccttgcatagagtaaagtaggcaatctatcagatatctaactctcattaccaacaggaactctgtatagaatcataggagtttatgatgtaaaatccatgtccagctagcaataatcagaaccaaagaatagtgtatactgcatcagaaattcagaatagctctttgtttttcatg

SEQ ID NO: 2321 - DNA, 76 bp, Triticum aestivum
  Clone ID: LIB3280-044-P1-K1-B7
cccactcgtccgcccacgcttccgaataataaatataaaaaaaataaaaaataaggggaagggggccaatttaaaa

SEQ ID NO: 2322 - DNA, 142 bp, Triticum aestivum
  unsure (1)...(142): unsure at all n locations
  Clone ID: LIB3280-044-P1-K1-B8
gcaaaacaattttacacggtgattggaatggttaagtaacacccaacataccagccgaaatttcaaatggtacattgcctctgagttgagaaacctctttagtattgacatgtnaccacactaactgcagcaaatgtttccg

SEQ ID NO: 2323 - DNA, 448 bp, Triticum aestivum
  unsure (1)...(448): unsure at all n locations
  Clone ID: LIB3280-044-P1-K1-B9
aagaaaagcgcctctccaggagtgggaaatactagtgctccctctccttctcgtgttactatttgtgctagcaaagcaacagccgagaccatggcgatgggtcacctccgtgccttcctggttttcctcctcgtgcaggtctgcctgttcttgatgatggccgcgtcggcgaaggtgcagggcagggctgtgcccggagttcccgcgtgctgctcctaccgccccgagtgctgcgagcgccggcggaagccccgctcgccgccgccgttactccctgatggcctcgcctgcngcggcttgtgggggtcgctctcctccctagaaatgtgtccgtgacgtgagcatacatgatacattctactggatttgcaatctgcatacatctatggttccgcttgttttcgtgtctctatatatgtgtttcagaacttttcattccaagcatgtt

SEQ ID NO: 2324 - DNA, 470 bp, Triticum aestivum
  Clone ID: LIB3280-044-P1-K1-C1
gaaagcagtacagtatgacgatcatgcggatgttcctagctctctgcgcccttgggttcgtcgcaggagtagtagaagatggatcgtcgtttgacgtcagcgcttacccggtcaagtgggatgaggacccatctgtgggatcaggggacgtggccgctccaccgtctcccggtactgaggcgccggcgccgcctccgaagcatcacatgatggtgaagaagggcatgctgtttctggagcgcgacctctttgccggggcgctcctgccggcaaacacccggctgggctacgtcagacgcacgagttcaccaggcccagtcatttcaagtactacaagcccagtaccacccttcaggtacagcagtttcgagaaaatcttgaagttttacaatgtaacgcacggctccaagcaagcagggaggatctcggagactctccagttctgcgaggaggccggagacaaggaacca

SEQ ID NO: 2325 - DNA, 249 bp, Triticum aestivum
  unsure (1)...(249): unsure at all n locations
  Clone ID: LIB3280-044-P1-K1-C10
gaaaaccaaaagaggctgggttcttacagttgaaaaatgcaggcctaacatcgcggatacagacgttacaaaacagtttacaaatcggctgagcatctgaatcattttcatggtctaagtctaaaggaagggcaaaactaacacctatatgaacctaaagcaaagtgacagtcactagacgcagcanacagagacatgcagattgtacagctacagcatgccggcgctgatcattaagtacttgataag

SEQ ID NO: 2326 - DNA, 335 bp, Triticum aestivum
  Clone ID: LIB3280-044-P1-K1-C11
agcagaagctcttgaagtttttgcggaaaatgaatttaaggttgaaataattaatgaattgcctgaggacaagaccattacagtatacagatgtggtcctttggtcgacctttgccgtggcccgcacatcccaaatacttcctttgttaaagcttttgcttgcctcaaggcttcagcatcatactggagaggaaaagcagaccgtgagagcctgcagagagtatatggaatctctttccctgattctaaacgtctcaaggaatatcaacatatgatagaggaagctaagaaacgtgatcatatgttattagggcagtcccagaaactcttttttt

SEQ ID NO: 2327 - DNA, 52 bp, Triticum aestivum
  Clone ID: LIB3280-044-P1-K1-C12
accggaccggaaagcccggcccgacccacgcgaccgaccacacgcaccccga

SEQ ID NO: 2328 - DNA, 450 bp, Triticum aestivum
  Clone ID: LIB3280-044-P1-K1-C2
atggcggcggcggcggcggaggtgagcaacaagagggtggtcctgaagcgccacgtgacggggttccccaccgaggacgacatggagctcgtcccggcgacggcgcgcctggccgtgccgcccgggtcggccgccgtggtgctcaagaacctctacctctcctgcgacccctacatgcgcagccggatgtccaggcacgacgagcccagctacgtcccggacttcgtccagggggaggttttaaccgctttgggcgtaagcaaggtggtagaatctgggcatcaggattacaaaccaggtgatctggtgtgggggatgacaggatgtgaagagtacactttgatcactaatctggagtcgcatttcaagatcaaccatcctgaattaccactgtcgtactacacaggtgttcttggcatgcctggctttactgcatatgctggatttttc

SEQ ID NO: 2329 - DNA, 439 bp, Triticum aestivum
  unsure (1)...(439): unsure at all n locations
  Clone ID: LIB3280-044-P1-K1-C3
acctccccctcccggcccggcgagaggccacccaagcggctccgcctatcacgctcccgcgcccacaaacccccaggaaccttgtcctcccgaggttaccgcttcgccgcgcttccgagccgccacaatgccgatccggttggatatgaagaggaacctcgcgcacaggtcggagagggtcaagtccgcggatctgcatccgacagagccatggatcatgtcgagtctttactcgnggagtgtctgcatctggaactaccaaacgcatacaatggtgaaaccatttgaagtcacagagttaccatttcggtcggctaaatctattgcacggaagcaatgggttgatgctggtgccgatgatatgtatatccgtgtgtacaattactatacaatggataaggacaaggtctttgaagctcatactgattacatcaagtgt

SEQ ID NO: 2330 - DNA, 354 bp, Triticum aestivum
  unsure (1)...(354): unsure at all n locations
  Clone ID: LIB3280-044-P1-K1-C5
cccacgcgtccgtacggaagtgctgcgcgagagccgactggccggggaacagaagggctccgaggcaataatggaggcggcgtcggcggagacggcgacgatggtgttcgtgtacggcaccctgaagcgcgggtttcccaatcacccccgcctggccgtcttcgactgccccttcgccggcgcggccaccaccgccgccccagcctccctcgtcatcgggccctactccgttcccttcctcctacctgccccgactccgtcctccggccgtctggtctccggcgagctctactccgcgtctcccancnccctcgccgacctctacttgctagagggcactcacctcggcgtcta

SEQ ID NO: 2331 - DNA, 381 bp, Triticum aestivum
  Clone ID: LIB3280-044-P1-K1-C6
gatatatttacacctcaggaacagaaaattctgatcaagtaccgcaaggaaaattttgcagaaaaagaacttgtctatagggaaagacggctcattggaaagtgccctttaactccagaagaggtaggtcttattcttcgtgcactgggctttgataatacaacacacatttaccttgcttctggagagctctttggtgggaaacgcttcatgaggcccttcaaggatatgttttcgcgcctagaaaaccatagctccgttggacctggaaagctggaagaaaatacccgtggactggcaggttctgcagttgattacatggtctgtctcctatcagacatttttatgcccacatatgatggcccaagcaactttgcaaac

SEQ ID NO: 2332 - DNA, 293 bp, Triticum aestivum
  unsure (1)...(293): unsure at all n locations
  Clone ID: LIB3280-044-P1-K1-C7
cgcgagacgagagagaccacaccagacgaggcgagcgagacccaggctccgccgagggaggcgaggcgacgcgatgcggcgcgcgaggccgccgccggggccggggctggagggcgaggaggtgaggtaccgcggggtgcggcggcgcccgtcgggccggtacgcggccgagatccgcgacccggcgaagaagaccccgatctggctcggcaccttcgactccgccgaggccgncgcgcgcgcctacgacgccgccgacaggaacctacgcggcgccgccgcgcgcaccaact

SEQ ID NO: 2333 - DNA, 420 bp, Triticum aestivum
  unsure (1)...(420): unsure at all n locations
  Clone ID: LIB3280-044-P1-K1-D1
aagattttagcattgcaagatttgcacagatgatgtggaggctaaatttcttgtggcttgctgttgcatggcccttgacaatgattttatgttgtactatatctgcccaatgcacaccctatttacacttatggtgtacgcatcacttggcctgtttaacaagtataatgagataccatcagttatggctattaagattgctggctgcttcttggctgtcatcttgatatggnaagttcctggggtattcgaaattttgtgggccccctttacgttcctgcttggctataaagatccagagccttctaagtcacacttacccttgttgcatgagtggcatttccgatctgggcttgatcggtacatatggattattggaatgatttatgcttacttccaccctaatgtggaaagatggat

SEQ ID NO: 2334 - DNA, 338 bp, Triticum aestivum
  Clone ID: LIB3280-044-P1-K1-D10
cggacgcgtgggcaagcctgctgctgccactgtggtggaattttgtggtgggcctatgtgctggaacactcgtacgatttctgcatcttctggaaaaggtgcttattgtaatgggcaaaagattcatgtcagtccaacagaaaaggtggaacaatctcttctggttactgggtttggatatgaacatgatgatgcatggctgaccaatataaatttgttcaaggaatttactgatgttagcaggggagtacgaaggctaggctctgctgctgctgatatgtcccatgttggtctaggcattacccaaacctactgggaatatcggcttaagccatggg

SEQ ID NO: 2335 - DNA, 480 bp, Triticum aestivum
  unsure (1)...(480): unsure at all n locations
  Clone ID: LIB3280-044-P1-K1-D12
attccttcctccacggagcgatggaagacacgacgccgcccgctgacgagaggccgctggtgctcctggggcagccgctcttcccggagttcgccaccgcgctggccggccgcttccggttcgtcctggtcgcggacgccgacgccgcgaccctggcccaggggagggcgctgctcatcgggctcaacccggtcacggacgaccacctggccgcgctcccggcgctcgggctcgnggcgggcatctccgtgggcgtcaaccacgtcgacctcgccgcctgccggcgccgcgggatcgccgtcaccaacgcaggcgccgtcttcgcggtcgacacggccgactacggcgtcgggctcgtcgtcgccgtgctccgccggttggccgccgccgaggcccacgtccgggccggcaggtgggcggccgacggcgactatcctctcaccaccaangtgagcggcatgcgggtggggatcgtggggc

SEQ ID NO: 2336 - DNA, 414 bp, Triticum aestivum
  Clone ID: LIB3280-044-P1-K1-D3
gtcgctgtggatatcacagaggacaaggaagtgccggtagagttctcttattcagtaacatggaaaaagacagacattccttttgagaaaagaatggagaagtactccaagtcttcctctatgccgcagcacctagagatccattggttttcgataattaactcatgtgtaacagtgcttcttttgactggctttctggcaacaatcctcatgcgtgtgctcaagaatgatttcatcaaatattcccatgaagacgagtcccttgaagaccaagaagagactggatggaagtatatacatggcgacgtcttccgtttcccgcagcaaaaatctctttttgcagcaatcattggatctggatctcagcttcttgcccttgcaattttcatctttctcctcgcgattggtggggtc

SEQ ID NO: 2337 - DNA, 257 bp, Triticum aestivum
  Clone ID: LIB3280-044-P1-K1-D5
cgaagaagttggtgctgagttcgacgagggtgaggacggtgacgagggcgatgagtactagagcctgcctcctggtgctttcccaaggcatgctgctgcaatcctatgatctgcccgagtggctttatctgttatctgtctgtttgaacatttgctttgtggtgtttgttttacaacctgttgtgttgtaagaaccttgtatgtttgaacctgttatgcaccttggttaatatgcatgctatctggttatctacacc

SEQ ID NO: 2338 - DNA, 395 bp, Triticum aestivum
  Clone ID: LIB3280-044-P1-K1-D6
cggacgcgtggggtcctcccgcagcctcatcgaatccaagagatcaagtcgctgtttccagctgccaccatgcagaacgaggtgggtgacatggtggacctctacgtccccaggaagtgctcggccaccaacaggatcatcacggccaaggaccacgcctctgtccagatcaacattggtcatgttgatgagaatggcctctatgatggccgcttcaccacctttgctctctctgggttccgccgtgctcagggtgatgctgatggctccctcgacaggctgtggcagaagaggaaggctgagatcaagcagctctagatgttgctagtagttttacctggaacttgtttccttcccatgtctacctagctcttggatgtctctgggtgggttca

SEQ ID NO: 2339 - DNA, 325 bp, Triticum aestivum
  Clone ID: LIB3280-044-P1-K1-D7
cttcctcaggttgagggaatacagggaattatgtcagcttataccagtgcgctacgcaatgtgtcattggctggtcctacactctttggtcctctacttagcaccgttacagcaatagcaggccattcctttacaagcaaccaacaaaaatacttaatttggtaataaggaccggtggtgtaatgactgattttcaagagactattggtgccatcattaaggcattccaattttctttggccataaatggtggtggaggtggtggggctgactctaaaggaatggagattctggatccaaataaagggggaagattggaaagctc

SEQ ID NO: 2340 - DNA, 455 bp, Triticum aestivum
  Clone ID: LIB3280-044-P1-K1-D8
tgcctggcccgtcccccacacagccgatggcgactccgccgtcctccacacggccgtcaacaaagactacacgacgccgcgacaacgtagaagctcctcccttagcagatgcgttcttcctctgcgccacctgtggaacagttcgtgcgcccagtgccgccgattcgatggtctgcagatgtttgatctaagatgcccgactgtactacatgtacatggaagaagaaagctcaatgaaccgaagctggggaaaaggaataaccaaggaggggaggggaggtcacatccttgaagccaacggcaaattaaggcatcaccttgaatttgtaactccagtaactaaatggagatccttttttaggtcgaacttgtgatccttcttattactgaaaccaagtatcaatctgagaatgattgttctcttattggggtctgaccagacttaaatgttggat

SEQ ID NO: 2341 - DNA, 465 bp, Triticum aestivum
  unsure (1)...(465): unsure at all n locations
  Clone ID: LIB3280-044-P1-K1-D9
tcctcaccttccccgtcccgtttcccccctcctttctctgccgtgcggatcaaggcatccatccatccatccaacgagacctgcgggctgcggccatggagatggaggtgccgtcggcgcaggcggaccgcgacggcgcccggcgacggctccgggactacctgctcgcgctcgaggaggagcgccgcaagatccacgtcttccagcgcgagctccccctctgcctcgacctcgtcacccagacaatcgaggggatgaagagccagatgggcggcgccgccagcgaggagacggngagcgaccacgacgggcccgtgctcgaggagttcatcccgctcaagcccagcctatccttgtcctcttccgatgacgagactagcacccacgccacggcgccggtctcaaacgctaaggccgagacgtccgccgccacgccggagaccaagaaggcgatgccggactggc

SEQ ID NO: 2342 - DNA, 445 bp, Triticum aestivum
  unsure (1)...(445): unsure at all n locations
  Clone ID: LIB3280-044-P1-K1-E1
cttctccatcgcttcttcccccgggaagaaaggaaccgccatggcggaggagtgctgcagcggggacctggtggagtggatcggccctgacgtctcagcatgcgtcttcggccgccttgaccaccccgccgacctcgtccgcgccgccgctgtctccataacctggcgcagatgcgtggtcgagagcggcttgagcaagagcctttgcctgcggctgtgccccgaggtcgccaccntcnccgcggcggcagaggtggccagatcgccgccttcaaccgccgcccatgaatcaggccacnanagggactacaggatatactccaacctcgccggcgcctacgtcttcgacttcgccgccaagcccttcgcggaatgcatcttggactgcatcggggcctccagcaccgacgactttccagcagagaccatggaaaacaccctcgac

SEQ ID NO: 2343 - DNA, 469 bp, Triticum aestivum
  unsure (1)...(469): unsure at all n locations
  Clone ID: LIB3280-044-P1-K1-E11
aaaatcttcacgtaaagctggatctggaaaaatcattagagacagaaggggtcgcgggcaacgttgatggctgatgggattaggagcatggatgtatgttccaacgtattcatccagaggacccaatctttaatatttctcctagtcgatttataatatagtcagattttttatcatcatggattaggaccatgttccaaggcgttcatctagccgatacatcaaccatgcatctanaaaaacacatccgtcgtgtaagattgcgatgcgcaacgaccaccaatataagattgttatggtgcnnngacggtgacaacgatttacggctgcacacgccgacgagcgactactctatgaggtagcagagacgactacatactactgcacatctcggatggctcaccggcgaagcgagcggcggctgcgtcacaatactgtttatggccgacatgtgactgctccagcacgg

SEQ ID NO: 2344 - DNA, 342 bp, Triticum aestivum
  unsure (1)...(342): unsure at all n locations
  Clone ID: LIB3280-044-P1-K1-E12
cggacgcgtgggcccacgcgtccggttggttgctccagcagttacagatgctgttgtcagaggaaaaaggcaggctgatcagttggttactccagtcattacagatgctgttgtcagaggaaaaaggcaagctaatcagttggttactccagtcattacagaagctattggcaatagaagaacacggcagaccagtcagccggttgccccantcattacagaagctattggcaacanggcaacccaagtcaatcagtttgttgctccagtcgttacattgccaagacaacaattacaaaacaatnnncaacagaagcttagcatgataactctgcccacaag

SEQ ID NO: 2345 - DNA, 428 bp, Triticum aestivum
  unsure (1)...(428): unsure at all n locations
  Clone ID: LIB3280-044-P1-K1-E3
gccacttcgacccctacggcccgatctacaacgaccgggagcgtgctcagattttcatctcggatgtcggcgtgctggccgtgtccctcgccttgttgaagctcgtgtcgtcgttcgggttctggtgggtggtgcgggtctacggcgtgccgctgctgatcgtgaacgcgtggctggtcctgatcacctacctgcagcacacccacccggcgctgccgcactacgactcgacggantgggactggctgcgcggggcgctcgccaccatggaccgcgactacggcatcctcaaccgcgtgttccacaacatcacagacacgcacgtggcgcaccacctcttctccaccatgccgcactaccacgccatggaggccaccaaggcgatcaagcccatcctcggcgagtactaccaattcgaccccaccccc

SEQ ID NO: 2346 - DNA, 412 bp, Triticum aestivum
  Clone ID: LIB3280-044-P1-K1-E4
gatcaggctgtggaggtggattcagcagctaagcttcctgtcatgctcgcactaactagtctatggataaggaaaaactatgctggcagttttatggttaattttatcgactcgctgccggagatgtatcctgtagttgaggaatgggtggaagatgttctgatggatgaagggaacgcaacaatattgactctatttgcttgccttgtaactgtcctgtacttgagagagcgtcagaggcgtcaagtggttgcagacaacccccaacagcctgacggtgcacccaactaatgccaagatgaggggcccctatgcagatgcgattggttgaagtacatatggctgtttattctcagttttagcggtaagtttttgttgaaaagcgagaagcgatgaaatgaatgctcatact

SEQ ID NO: 2347 - DNA, 456 bp, Triticum aestivum
  Clone ID: LIB3280-044-P1-K1-E5
cccacgcgtccgcccacgcgtccgcccacgcgtccgcgcaactgcacaacagaccgaagaaacgcacagccgcaaagagaccagacccaaccgcatcggcccggcggcgcaggggtttccttccttccacgatccacggtcgcggcgaggcgatggacgccgaccacgccggcggctaccgcgacttctcctcccgcttcgccgccccgcccgcctccgccaagtcctccatggacctcggcggccgcgacgcgccgccgctcttccacccgccgcccgccgacggggccccacgggcctgaccgctcctccgccccctcggatcgcgccacaggaaaaggaaaggtatcgctcgacggtggtggtcaaacttcaaagcgtggcaaaaagacggtggccttttctcggatggttcggctccataggacgggatgcggattgggatcgtttctttct

SEQ ID NO: 2348 - DNA, 382 bp, Triticum aestivum
  unsure (1)...(382): unsure at all n locations
  Clone ID: LIB3280-044-P1-K1-E6
gacccgacccgacccgaccccccaccaccagcctcgcctcccccgccgccgccaccaccggcgaccaccggagcccttgaagaaaagcgcgagcgccccgcgaatcgaagcggaggagatggtgggcgcctcgacgtcgtcggtggtgaacgtgtacccgctcgccaactacacgttcggcaccaaggagcccaagatggagaaggacacctncgtcgccgaccgcctcgcccgcatgaaggtcaactacatgaaagaaggaatgcggacaagtgttgaagcaatcctactggtgcaagagcacaatcacccacacatactgttattgcaaattgggaatacatnttgcaaacttcctggtggacgtttgaggcctggagaa

SEQ ID NO: 2349 - DNA, 101 bp, Triticum aestivum
  unsure (1)...(101): unsure at all n locations
  Clone ID: LIB3280-044-P1-K1-E7
ttttgggtttttggttaaaaaantactantttattttaataaaatattttatatattttaaaataaaaaaataattaaattacaataaaaaagaatataat

SEQ ID NO: 2350 - DNA, 411 bp, Triticum aestivum
  unsure (1)...(411): unsure at all n locations
  Clone ID: LIB3280-044-P1-K1-E9
gatatatttacacctcaggaacagaaaattctgatcaagtaccgcaaggaaaattttgcagaaaaagaacttgtctatagggaaagacggctcattggaaagtgccctttaactccagaagaggtaggtcttattcttcgtgcactgggctttgataatacaacacacatttaccttgcttctggagagctctttggtgggaaacgcttcatgaggcccttcaaggatatgttttcgcgcctagaaaaccatagctccgttggacctggaaagctggaagaaaatacccgtggactgncaggttctgcagttgattacatggtctgtctcctatcagacatttttatgcccacatatgatggcccaagcaactttgcaaacaacctcattggtcaccgcctatactatggt

SEQ ID NO: 2351 - DNA, 487 bp, Triticum aestivum
  Clone ID: LIB3280-044-P1-K1-F11
cgccgccattctcccccttccccttttcctcaccgccgcaggagaagaagcagacgcgcggaggagagcttccaggcggcgaccatggtgaacgttccaaagaccaagaagacctactgcaagaacaaggagtgcaagaagcacaccctccacaaggttacacaatacaagaaaggcaaggatagtctttctgctcagggcaagcgtcgttatgaccgcaaacagtcaggatatggtggccagacaaagcctgttttccacaagaaggccaagacaacaaagaagattgtgctgaagctgcaatgccagagctgcaagcattactcgcaacgcgccatcaagaggtgcaagcacttcgaaatcggtggagacaagaagggcaagggaacctctctcttctaagctgatgatacccctgttatgttcagagtgttgtgccagaacttcccactcgaacaatgtattatctcgttaatttctgggtatg

SEQ ID NO: 2352 - DNA, 434 bp, Triticum aestivum
  unsure (1)...(434): unsure at all n locations
  Clone ID: LIB3280-044-P1-K1-F12
gtttcctggtgttgtcaatcctcttgatggtgtagagtggaaacaggagcagacaactggattaacagggatgtaccagtattttgtgaaggttgttcctactatctatacagatattagggggcgaaagattcactcaaatcagttttctgtgacggagcactttagagaagcaattggccttccaaggcccccgcctggtgtatatttcttctatgaattttcaccgattcaggttgattttactgaagaaaacacatcgcttcttcacttcctgacaaacatatgtgctattgttggaggcatattcactatggctggcatcatagattcttttgtgtaccatggccatcgtgcgatcaagaagaagatggagatcgggaagctcgggtaaatccaacttgagcagcatgtangcagncagtaggacggta

SEQ ID NO: 2353 - DNA, 464 bp, Triticum aestivum
  unsure (1)...(464): unsure at all n locations
  Clone ID: LIB3280-044-P1-K1-F2
caaccttggaagatgaaaaggcaacaccatacaaatctgagaagctacagtaactctccttcttcccaaggctttattaccatcaaataaatcttgcaaagccttttatttcattgctgttgagaatcattaagaactctgcaacattgccaccagcccatagagttcattctattcttttgcatgtcatagttgaattatgacccacaaggtctatccagtctaccaagtaggctngacatgcgagtgctagatccctcctatccccttggtcatggtttttcatgggtttgattgggtgaaaataattgctatttggcagaaatgactcgacagttattgacatgggccctcctgctgattgggtgaagataaatgttaggagaactaaagattgctatgaagtctatgcattggttcctggccttcttcgtgaagaggtacatgttcagtcagatcccgct

SEQ ID NO: 2354 - DNA, 304 bp, Triticum aestivum
  Clone ID: LIB3280-044-P1-K1-F3
cccacgcgtccggatcaaggagcggccagagatgttcatcaaggatgactctgtgaggcctggggttcttgtccttataaatgactgcgactgggagttgtgtggaggccttgatgcagagttggaagataaggacgtggttgtcttcatctccacactgcacggtggttaattttacttctactgtaggctaccgatggtattgcgatctgtggaaaagaaactaaatgcactgtaattttcaatgtcactgtaaccttctccttgtttcactatctaagtgaaggatcaactggttattatg

SEQ ID NO: 2355 - DNA, 420 bp, Triticum aestivum
  Clone ID: LIB3280-044-P1-K1-F4
gatcaaagcaataaactccatctcgcagcaaagtgaagaataagccatctgggtccaagctcaactatcaagctacgatggagatgaagaagatcgccttcgccgccctcatgggcgctgcctcggccaccgccgttgtggcctccgaagcagcaccagccagcgacgccaacaccgtggcagccgcccccgccgcagccctcgccgcggtctccttcatcgcatatttcctctactgatggggacaaggcaggagggagatcgatattagcatcacctcagttgcacccgcgcatgcatccatgcgaaccaatgggtgttggcttttccgctaatttcatttcatttgtaacccgattatgtgaactggtgatgatacgagttatttgaatatatataattttcattctgtcatataaa

SEQ ID NO: 2356 - DNA, 473 bp, Triticum aestivum
  unsure (1)...(473): unsure at all n locations
  Clone ID: LIB3280-044-P1-K1-F5
ctgccagctccctccccaacccctggaaacgctctggtagtctccgccgcgggagaggcggagatggagaacgcggtggtgctccgggagtggttcgaccgcgtcgacgccgccggcaccggcaacatcacggctcctcagctccagagcgcgctggccgtgggcaacctcgacttccccctctccgtcgtgcagcagatgatcaggatgtacgactttgatcggaacggcaccatgagcttcnaagagttcttggctcttaacaagttccttcagaaggtgcagactgttttctcctccctagaaaggggccgtggatttctcagccttgaggatgtgtatgaggcgttaatcaaactcggtttctctttggattcacctgccttttacactggctgtgagagcttcgacaagagcaagaaagggatggttcgtttggatgagttcatatcgatctgcatctttgtgcagtc

SEQ ID NO: 2357 - DNA, 433 bp, Triticum aestivum
  unsure (1)...(433): unsure at all n locations
  Clone ID: LIB3280-044-P1-K1-F6
atatatacatatatattgcatgaatagtataagtacaatcaccgtgggtcatacatgacattgtttctactgtaataacataaatctaaatatattttttgaggggcgtaaatctagatatataagtgttgaaatccagctataagttatggatcgagcactatctatatatccgggtacctccatgatatatgtggcttcttctttagttaatncgcataccatattactggcatcatgcatgcatggcaattgtcggcgtacttctaatgggaggtctcggtgttttgacgggcgtatggcggcggtccgggtgcaggcttggggggtgccggcttgagcgcgggcggcgccggtggcgttggcggcttggggctcggcggcgagggcgtgaggccgcaacggatcattcaaacgatgctcttctggttgc

SEQ ID NO: 2358 - DNA, 471 bp, Triticum aestivum
  unsure (1)...(471): unsure at all n locations
  Clone ID: LIB3280-044-P1-K1-F7
ctcctccaatccttcaccgtgcaattttcaggccatttggggccttcatatggggccctttgtctcctccctacctcctagcgcggcacgcttataactaaaaatctatcgcgtcgccctctccatctcctctaagaaatgaagtcgtatagtcttcagcgtagggctccaccggcggaagacggcgcgccagtgctccggcggagcgcgagcgcgaagcaggcgtcctccccgtcgccgctcagcgtctcctcctcctcctcccagtaccagtcggcgcgcgcctcgacgtccacggccaacgcgcctgccttcgcgcgccacaaggcgccgtccatcaactgcatggcggccagctccaccgacacgccgncggccacccccaggggcaccaagcagcagaagcccaagtcggcgtcgtactcggtcgtgttctccccgaggaagctcatgcagcgggcctcccgcgcc

SEQ ID NO: 2359 - DNA, 423 bp, Triticum aestivum
  unsure (1)...(423): unsure at all n locations
  Clone ID: LIB3280-044-P1-K1-F8
tgtccatactggacctcatacttcgcgtcattgcggtcatcagcaccctcgcgagcgccattgccatggggactaccaatgagacgcttcctctgttcacgccgttcatccagttcaaggcccgatacagcgatctcccggctctcacgttcttcgtggtggcaaattctgttgtgagcgcctatctcatcctttcgctcccagtgtcaattgcgcacataattaggagcggggctaaatatagcaggctggtcttgatcatttttgacgcggcaatgctagctctggtcaccgcancgtcatctgcagcaacagctattgtctacttggcacacaagggcaatgtcagggcaaactggcttgctatntgccagcaattggattctttctgcgagcgtatctttggcttccctgtttgctcgt

SEQ ID NO: 2360 - DNA, 384 bp, Triticum aestivum
  unsure (1)...(384): unsure at all n locations
  Clone ID: LIB3280-044-P1-K1-G1
gtaacacttcagccactctcccctaatccctatccggccgcttaaccaaccccgcacggatcgcggagctggttgcctcccacttctccggcggccgccgcgttgcagagacgtttcggtatgaggaagggcgcggagctcttggtcctgctggtcgcgtcgtccctctgcctgtccgctgcgattgccgcgcaggaaacctgcccggccnacatcgacgccaagtgcggcgatgccgnttatgatgactgggagggcgagttcttccccggcattaccaagatcagatatgagggtcctaccaggaagaagccgttttcttacaagtggtataacgcggaggaagggatccttggaaagaaatgaaagaatggttgcggttca

SEQ ID NO: 2361 - DNA, 369 bp, Triticum aestivum
  unsure (1)...(369): unsure at all n locations
  Clone ID: LIB3280-044-P1-K1-G11
cccacgcgtccgcccacgcgtccggcatctttgatgccaaggctggaattgctctgaacgaccatttcgtcaagctcgtctcgtggtacgacaacgagtggggttacagcaaccgcgttgtcgatctgatccgccacatggccaagactcagtagagcgttctgatttcctttggtcagaggtgtccctgctttgtctatgcgaagaataaatgtggatggtgtcgccagacgacgcctggttcatgttagttggacatgagttaccttctgttttccgcatcaactagtacttctgtaatggagntgctaatcaagtactctttattggttgtggtttgtgaagattatataaatcgttcagtccagt

SEQ ID NO: 2362 - DNA, 350 bp, Triticum aestivum
  unsure (1)...(350): unsure at all n locations
  Clone ID: LIB3280-044-P1-K1-G12
aagaaataataactttcataatgagcagtgaggccacatacaaacgaacagacggcccttacactgaagaacacaacggatgggtgcagcacacgcactgcatctgcacatccaaattacacagacaaacaaaaatcacgatacctaatcaaacgatcgaggcagcattcgcgcgcgtgcatgcaggagctccgggcggccggccgatcgatcgatcctgcgcgcccaccgcacgagcaatgcatgcatgcaagcccggggtaaccggcggntaaatatttaattagtactcgacgccgacggacggggggtcgatgatcagaagtcggcggcggggggtttacccccct

SEQ ID NO: 2363 - DNA, 451 bp, Triticum aestivum
  Clone ID: LIB3280-044-P1-K1-G5
ccaggtaacagagaagttccgggatagggttgttgatgaaggttacaacccgagctacggtgccaggcctctgcgacgcgccattatgaggcttttggaagacagtctggctgaaaagatgctggctggcgaggtcaaggaaggtgattctgctattgttgatgtggattcggatggtaaggtggtagttctcaacagcgggggtggtattgcagagccgctggagcctgctctgagtgcctagttgggtacaccatctttttatttcgttatctcagcatggggtcctggtgatggtacctagattaatatcactgccctatcagttatgtgttctcttccttttttgtctctcctctttcactctcttgaagttcgaagtttgaagcgaggcactaagaaatgttatgtaaacgaaacaaacatagatgcatgtacgagcaagctgtat

SEQ ID NO: 2364 - DNA, 325 bp, Triticum aestivum
  Clone ID: LIB3280-044-P1-K1-G6
gcataaagatcaaccaataatgatgttcatcaattatttatttaggccaaatgaataataacaacaaaatggtagtacattgcttgctagtcaatttccaaccgtcccgtgtcaaatagacagccaccgcgaaaaacacatcctcaaaggcagaatattagttatttcctctcttgtatcgcggctttcgccacaaaaacctagtatcgttcttcgcaagcgtcgccgccaacctcgttctttctcatgagcttccctttttaggtttactgaatatcccgaagcttttggccgggccggtatcggcaggcttaccggcaccacc

SEQ ID NO: 2365 - DNA, 466 bp, Triticum aestivum
  Clone ID: LIB3280-044-P1-K1-G7
cccacgcgtccgacagtttcttccattatatcaattaaatagcacgctgcctctgtaataggattaagtactattcctagccttacttatagaactttgtgtaactataggtattttctgttttcctctaaaatagatttatatttcaaggaagcagattcataagtaaaatcatagtattacaggcagaacatgttcttgcaaaacatcaacatgaaagaggtttgctgatggttctaggtctgatgctcttagggaccatgagtatgtccttacctatgaagacaaggatgctgactggatgctcgttggcgatcttcctccggattcaacaagttgtgtctcaatcttgtaagttctgtcacaaggatgagattgttagaatggtacaaaacttttacgtgatagcagttgttccagtcaactaggatgtctacatgatgtttcttgggttcatagcaacaaa

SEQ ID NO: 2366 - DNA, 445 bp, Triticum aestivum
  unsure (1)...(445): unsure at all n locations
  Clone ID: LIB3280-044-P1-K1-G8
tctgcttctccgacgacgagcgacggcggcgcgggcgacacaccagcgagcggagcggcggggactccgcgcggaccgcgaccagattcgtcgacgccatgtcgtcgttcgccggcgtcgatctgtgccccccttgcgccgggtcggcctgcgaaaccagcgcggactgcgggtaccacctgctcgtggtccaggactactcgcgcgccaaggagaaggcgcctaccgggnagagcatcatctcccggcccttcagggtcggatgccacacgtggcagatcgagctcttccccaacggcaacaacccgagctgcgccgacttcgtctctctctacgtctgccgtctcgacgactatctcaacaatgccgtggatgccaagttcagtctcagtttcgtcgaccaggccgagaagcagaagccggtgtacattcttgggaccgagac

SEQ ID NO: 2367 - DNA, 278 bp, Triticum aestivum
  unsure (1)...(278): unsure at all n locations
  Clone ID: LIB3280-044-P1-K1-G9
agggggcctccgtctaatcgtcctccctgtcgatttgctccccccccacacacgcggaacagagagaaaaaccatacccaccaccccctagcgcgcctcgccgcgccagtcaatcaaccatccagccagccaaccaatcacccccatccccctccccatctcgcgtggattaatggatctccgccccgccccgctcttcctctaactnctgcttctgctgctcgctactccgcagaccgccacgccgactcgcggagccgcgccgacggacatggggc

SEQ ID NO: 2368 - DNA, 284 bp, Triticum aestivum
  unsure (1)...(284): unsure at all n locations
  Clone ID: LIB3280-044-P1-K1-H10
atgaaaagtnaccgacttcagggagtgccagcacagccaaatcaccggtacgagcaacagcggcaccatttgccggttctgcggctccaagctacagtagtagccgccgggccaccaagaagcagatggagctgcagcatgagccgctctgcggccaanctgcagcgtcagccaccaagatggagcccaaagtgtcgccgtccgcctacaccanntgggttctcacttatgtacgagtgnannggggaaaggaacgggatgaggactatgaactgatggtggat

SEQ ID NO: 2369 - DNA, 91 bp, Triticum aestivum
  unsure (1)...(91): unsure at all n locations
  Clone ID: LIB3280-044-P1-K1-H11
ataaaagatatttttttttttttttctagcaaaagagggttcatttatatttcttttnccccaatatacatttttatcctatgctcaacat

SEQ ID NO: 2370 - DNA, 396 bp, Triticum aestivum
  unsure (1)...(396): unsure at all n locations
  Clone ID: LIB3280-044-P1-K1-H2
cccacgcgtccgctcgagtccaggaagccttcttcactcctccccgtcccatcgattatctgtggcggccatgagggtagcctccagggtggtcgtcctcgtccgagactccgcgggctacggcgcagccctcgctgacgcgctccggccgtcgccggngctcacgaggggttcctcgcccttcgatctccctctcgataagtacggcctcaacggcgagaaggcctctggcgagctcnntagcttctctgactccagtggctctcctcaggtgtccttttttgttctgcctgactataggcctnctggtgctgcatgtgctatgaatgagattttagcattgatttcttctgaagctccctccatccagcccgttctgattgtaccattcatcac

SEQ ID NO: 2371 - DNA, 467 bp, Triticum aestivum
  unsure (1)...(467): unsure at all n locations
  Clone ID: LIB3280-044-P1-K1-H4
anganatnaggcaacactnggaganngangcacatggnggnggcgnaaangacanngcanncgcccatccaaagaagcagcncngnataannaccngnggagacganaagacganaaaggggngggaggccaccagnggaacaaaacaannaaccnnngaagggcangaagcnccngncnatncngnnngnccacannacaaggaaaananncagnncancnnnncaactgctnaagagggaaaganaaaggcanggctctatgataatcttgggtccagagttgactatgatgcaccaggtcattggtgcactncgatggcatatagtgcggatgggtcaagattattttcttgtgggaccagcaaggatggtgaatcacacctggtggaatggaatgagagtgaaggtgcggtgaaaagaacataccagggatttcgtaagcgatcgatgggtgttggacaattt

SEQ ID NO: 2372 - DNA, 299 bp, Triticum aestivum
  unsure (1)...(299): unsure at all n locations
  Clone ID: LIB3280-044-P1-K1-H5
catgatagcactgttgaagatgtccagttctgcccttcgagtgcacaggagttctgcagcgttggtgatgatgcttgtcttattctctgggatgcccggactggtactagcccagccgttaaggttgagaaagctcatggtggagatgttcattgtgtcgattggaatcttcatgatgttaactacatcttaactggctctgctgataactctgtccnaatgtgggatcggcgaaatctgtgtcctggaggtgctggttctccaattcacaaattcgagggccataaaactgctgtcct

SEQ ID NO: 2373 - DNA, 315 bp, Triticum aestivum
  unsure (1)...(315): unsure at all n locations
  Clone ID: LIB3280-044-P1-K1-H7
atgcagcagccaaccagtgatgacaattggttctgcaaggacgatcatcatcaaatttgtttattcgtctattttctgcagaaaatgttgatcaacctatctccactatactgcatcaacgcactgtttacattcttcagatcatctccacgcgaccaaactgtacccgnccctgagaaccagctagagcgtgatgtactcattgggatcaagggatcccacgaggcatttctccaagaggaactctgcgttcacccaggcatggtatgtatatgacaaagcagtgcagattttttccagcacccttcataagca

SEQ ID NO: 2374 - DNA, 126 bp, Triticum aestivum
  unsure (1)...(126): unsure at all n locations
  Clone ID: LIB3280-044-P1-K1-H8
gattaattattttttattttgggtttttatatttttanttttttaatatttttttttattttttttttataataaattttataataatgtatataaaaaaaaaaaaaanaataaaaaattaattaa

SEQ ID NO: 2375 - DNA, 415 bp, Triticum aestivum
  unsure (1)...(415): unsure at all n locations
  Clone ID: LIB3280-044-P1-K1-H9
gtgaggatgagaaaaagcagtccaagcaactgaagatcacctgcaacttaaacaatgctgcctgcaagctgaagctgaaagactataagcaagccgaaaagctttgcaccaaggttctggaactggacagccaaaatgtcaaggctttgtacagaagggcccaagcttacactcagcttgcagacctagagttagcagaggtcgacattaagaaggcactggaaattgatcctgaaaacagggatgtgaagttgacatacaagactctgaaggaaaagatcaaggaaatcaacaagaagganggccaaattctaccagcaatatgttctctaagatgaccaagccttcagcagaagaaagcaaagcttgaactggagcagtacccaaaggaaggataggagtcccggagtgcgct

SEQ ID NO: 2376 - DNA, 293 bp, Triticum aestivum
  Clone ID: LIB3280-046-P1-K1-A1
tcgcccacgcgtccgctcaagttgcatcctgacttaaagggtcctttgagagccctctgcgaggacgagagcactacggttatcgttctcagcggaagcgacaggagtgttcttgatgaaaattttggagagtttaacttgtggctggcagcagagcatgggatgttcttacgcccaactgatggagaatggatgacaacaatgcctgagcatctgaacatggattgggtcgacagtgtaaagcatgtttttgagtacttcacaaaaaggaccccaagatcttattttgaaca

SEQ ID NO: 2377 - DNA, 419 bp, Triticum aestivum
  Clone ID: LIB3280-046-P1-K1-A10
cctgcttatgcattatagcccccggtgttgacttcgatttgcagctaagtcctgctctcctttcctttcagtccttgtagcttcttttttccttgcagtctactccctgttccgttgcaaataagcccctgagctctgtcacattctagcctcgactccttggtcttgggaggagttcgtcgcagatccgatctagagagcctccccgcaccacccatgtttaccttccccttcctctgacggccgccgccccccgatgaagctgcgcgttcgctgccgctcccactccttctccgtcgccttcctctactggttctacgacttctcatgaactcctcgcccctcgagaacgccgcatccatccagcctctagttgattagtagatccagcctcgtttcttccacggtcttgccttact

SEQ ID NO: 2378 - DNA, 436 bp, Triticum aestivum
  Clone ID: LIB3280-046-P1-K1-A11
gttctttctggtagcatggagcctggatttaaaaggggtgatattctgtttttgcacatgagcaaagaacctatccgcactggagaaatagttgtttttaatattgatggccgtgaaattccaattgttcaccgtgtgatcaaggttcatgaacggcaagaaagtggagaagttgatatcctcacaaaaggcgataataattttggggatgaccgacttctgtatgcacaagggcagctttggcttcagaagcatcacattatggggcgggctgtaggctatctaccatatgttgggtgggttacgattgtgatgactgagaagcccatcattaagtaccttctgattggcgcgctgggcctgcttgtcataacatcgaaagagtgaagctgtcaacctttagcacatagtttatcttgtaatcgagggcagaaca

SEQ ID NO: 2379 - DNA, 444 bp, Triticum aestivum
  Clone ID: LIB3280-046-P1-K1-A12
gagacacacacagcacagcatcggcgtaaagggaacaccagcaagatgtctcagctcgcccgcgccagcctgactgcgatggcgatgctccttctccttgccgctgctgcggcggcggcggggccggcggccggcggcgcggctgtggcggacccagcaagctgccaggacgacgttgtggcgctcaacgaggcctgctacaagtacgtgcagaagggcgcgccgacggtgccgccgtcgcaggagtgctgcgacgccgtgaagagcgtggacgtgccctgcgtctgcagctacctgagcagcccccggcgtgagggacaacatcagcatggagaaagtgttctacgtctcccagcagtgcggcgtcagcatccctgggactgcagaggatcgaagtctgaagcaagaacaggccgctgaatggcaagcttggataatgtaagc

SEQ ID NO: 2380 - DNA, 359 bp, Triticum aestivum
  Clone ID: LIB3280-046-P1-K1-A2
gcaaagtcctggtgctgcatgaaccgtctaacattgaggttagcagggaaaaatttcggtgtttgagaccacatggttggttaaatgatgaggtcattaatttgtaccttgaattgttaaaggagaggggaataagagaaccaaaaaggttcttgaaatgccatttcttcaatacatttttttataagaagcttgcttgtggaaaaactggatatgactacaaatctgtaaaaagatggactaccttcaggaagttgggttatgagctcattgaatgtgataaaatctttggtcccgtacatcaaaatgtgcattggtgtttggcaagtataaacataaaaggcgaagacagttcaata

SEQ ID NO: 2381 - DNA, 381 bp, Triticum aestivum
  Clone ID: LIB3280-046-P1-K1-A3
ataaactccagatccataggagacggcgcgctgctgctcgtccgccgccggcagccctccccaccgccgcaacctgccttgccccgccttgaatcgccttttaaccgcccggctcccccttgtctgccgccgggcccctccttgtctgccgccgtccgtcgtcgaccacctcggccgccgtctccgaccgccggactccctccgccgcgctccctccctcctccgccgccgtccccgaccatcggaccgcgtaggctgtgtgccttctctgcctccccgaccacctcgcatctcaactgaatcacaatcttagtgcccctagagatggaaggaagaaagacaggtttctggtaaaccctggtaaatattcgtgggaggtca

SEQ ID NO: 2382 - DNA, 403 bp, Triticum aestivum
  Clone ID: LIB3280-046-P1-K1-A4
gtcctactaaaccgcgctgccgtcgtcacgccgtcgtcgacggtgttcttcctcgaggacgcggtgcgcgtcggggagagcctgcccttccacaggatccatcgggccaccgtcgccgccgaggcgtcggcagagcagccgctggagctgtacaccgtccgctccgtgagggcggtcgaggggtccagtttcgtcctgtgccggggagaagccggcgaaggggccgtgtacgggtgccgcgccaccggcccggcgagggcctacgttctggccctggccggcgagcgcggtgacgtggcgatgaccgcggttgccgtgtcccggtgggacccggaacacgccgccttccggctccttggcgtgaagcccggcggcgcggtggtctgccacgccgtgccggacg

SEQ ID NO: 2383 - DNA, 441 bp, Triticum aestivum
  Clone ID: LIB3280-046-P1-K1-A5
gtgttgacgttttcagatccacaggtgttctctatggctgcagcttcctcagcaccagcagcgctatctcaggttgccgaagcagtgttcatacaagaagctggacacctgagatgcagtggtgctgagataggtagatttattgccatgcttcggaatcctacgccagttcttcgtgcgtgtgctgcatttgcccttcttcagttctcaatcccgggaggtcgacatgcaacacaccatgcggaccttctgcaaaatgttggagcggctcgggtcttgcgtgcagcggtggcagcaacatcggcttccattgaggccaaagtgttcgccagaattgttcttaggaatctggaacaccatcaggcatggacttcaacctgaaaacgcaatggcgagcacaagcgcgactaattctccaacagggcataacttttaaccttt

SEQ ID NO: 2384 - DNA, 430 bp, Triticum aestivum
  Clone ID: LIB3280-046-P1-K1-A6
caagagctcgctaataatccaccgcaataagcagataaccaacctccgtccgcgcaatctctcaatcttccacaggcatcaatggcgggcgcaaggaacaacgagctgcgcatgaccctgctcggcctggccctgctggggctcctgctgctgagccacaccgcggctccggtggaagccgccgcgggcgtgcaggagaacagcttctccatgaacggcgccggtggccgcagtctcaacagcttcagcatgaacaccgccgagagcgctgaggtcgccaagggggggaaggccaaacccgccgccggcgacttctgatcgacgacccttccgccgccgtcgtcgagtactaattaaataatttatccttcggttacctcgtgcttgcatgcatgcgtgcatggctcgtgcgggaagatcgatcgatcgg

SEQ ID NO: 2385 - DNA, 275 bp, Triticum aestivum
  Clone ID: LIB3280-046-P1-K1-A7
cggacgcgtgggcggctcggtccccatcggctgcgcgccggcggagctcgccacgcgtagcgccaacggcgagtgcgacctggagctgcagcgcgccgccgcgctctacaacccgcagctggtgcagatgaccaaggacctcaacgctcagttcggcgccgacgtgttcgtcgccgtcaacgcctaccggatgcacatggactttatctccgccccggcggcgtacggcttcgtcacgtccaaggtggcgtgctgcggccagggcccgtacaacg

SEQ ID NO: 2386 - DNA, 436 bp, Triticum aestivum
  Clone ID: LIB3280-046-P1-K1-A8
caggctgctcgttggtgccgagccccagcgtagcacccatcgtctccatctcctgcgtcaggacgctgttcccacggccctccgacaggttcgtggctaagtcacggcgccgcgatggcaagtactccatgcgccctcggtcggtcgctgccgtcgccgagcagtcctcctatgatttcgcatcttagttcgctactggagatgaacaggaccaagagctgcagagatggcaagtacttgacaagaaagaattacaggcagttccacctggaggtgggacaggctgtggaaattgaatgtattgtaaagatttaggatgtaaaccaggaggtgatcaaagtattggaggggctgggatttcgtgaaggccataccattgcaggaaacttggcttacttgggagtatgatccatgctttatgatgttgggagtgact

SEQ ID NO: 2387 - DNA, 371 bp, Triticum aestivum
  Clone ID: LIB3280-046-P1-K1-A9
tcgcgcagctgcagcgaatttacactgcaggtcgaggctagctgagatccatggcgtcgagcagggcgatcttggccatgggcctccttgccgccgtgctgtcccccgccttgtcaaagcggtcgtttatctccatgccagccgacgtgagtagtcctgtgaccctggccaacggcctctcctacggttaccacgccaactcctgcccgcagctgcaagacattgtgtggccgatcgtggagagcgcggtcctgggtgaggtggccatcgccgccggcctcctccgtatcttcttccacgactgctttcctcagggctgcgacgcgtccgtccttctgacgggacccaacagcgagcgggacctgccgccg

SEQ ID NO: 2388 - DNA, 445 bp, Triticum aestivum
  Clone ID: LIB3280-046-P1-K1-B10
cgcgactccgtgaaactcgccggcggcccggactacgcggttcccacgggccgccgcgactcgctcgtctccaaccgcgaggagtccgacgacaacctgcccggcccggacatccccgtgccccaggtcacggccgacttcgtgaaggccggcttcaccgccgaggagatggtgctgctgctcgccggcggccacagcatcggcaaggtcaggtgcatcttcatcgagcccgacgcctcgcccatggaggcgggctatcacgccagcatcagcaagctctgcgacgggcccaaccgggacacgggcttcgtcaacatggaccagtccaaccccaacgtcgttgacaactccttcttcgccaacgccatcgccgagaagatgccgctcaccctcgaccgccttctcgccatcgacgagaagacggggcccctgctcaaggacatgc

SEQ ID NO: 2389 - DNA, 444 bp, Triticum aestivum
  Clone ID: LIB3280-046-P1-K1-B11
caaccagtaaatatggtgctgatgatggccttcccgagcttcgagaagcacttctcgagaagcttcacagggagaataagctaaccaagtcatcggttatggtgactgccgatgcaaatcaagcttttgtaaaccttgttctgaccctttgcgatgctggtgattcagatgtcatgtctgcaccatattatttcaattccttcatgtcattccagatgactggcgtcactgatatattagttggtgctagcaatcccaagacacttcatactgatattgattggttagagaaggtgctgaaagaaaataaccctatccctaaacttggtactggtgtcaatccgagaaacccttctggagcttttattcccaagcctatgctacagagaatttcagacctgtgcaagaatgctggtgcatggctggtggttgacaatacctatg

SEQ ID NO: 2390 - DNA, 375 bp, Triticum aestivum
  Clone ID: LIB3280-046-P1-K1-B12
ccctctctctccctttctggacctctcacgagcaggggcgcctttcctccctcccatcctcctcctcctccggtcgatggaggagccgccggaccacgccacggccacgagatattcttaacatatggattaaggaatttatacaagagggaagcctgttcttgtttcagccggatctcagactcataattgattgagttggaaataaggaaagaacacttcttggaggagcagcatgtgcagtagctttgcaaacttgcagtaacaagaaatgtctggagtgcttgatagtaacagttccttgctgcgtaagtcggccagcggggccgaagccagagagacggcgctgcagctggaccaatcagcgcgcggcgg

SEQ ID NO: 2391 - DNA, 500 bp, Triticum aestivum
  Clone ID: LIB3280-046-P1-K1-B2
acgtgacgctctaccagagccatgacgtccggtgcgaccacgcgtacgctcgccacgccgacagcggtccccttcggcaaccatggctgggatggcatcacgcagcgaaggcacgacaaccggcgacaaaggctactgtagtgtgatttattcaccctatccacagtcgtcgcctcttcctccacgcctgaccgacctgttccaacaatttggtctggacaagatccgcgcgatcatgaacagttctgatggtaagacgttcgagcaaaagatcgacaagttacgagaggaaatgagtgctttcgaacgtgctcgtaatgaattcttcgtcgagggcgaggatgttgacgaggacgacgaagacgacgaggacgacgacgtggatgtggacgagtcggatagaaagctcttagatgatgacaagaaacccgatatcacgaaacgaccacacacttcctatggagatgaggtggaatgcaagaagccaaagatagcagaag

SEQ ID NO: 2392 - DNA, 387 bp, Triticum aestivum
  Clone ID: LIB3280-046-P1-K1-B3
aaggtcgccgacgagaagaagaaggacgcggagaacaccaaggtcatctacgcccgcgccaagcagtacgccggggagtatgaggctcaggacaaggagctggtgcaacttaagcgtgaggcccggatgaagggtgggttctatgtcagtcctgaggcaaagctgctgtttgtcgtccgtatccgtggtatcaatgctatgcacccaaagaccaagaagatcttgcagcttttgcgtttgaggcagatttttaatggtgtgttccttaaggtcaacaaggccaccattaacatgctgcgtcgggttgagccatatgttgcttacgggtaccctaacctcaagagtgtcagggagctgatctacaagagaggttacggaaagctcaac

SEQ ID NO: 2393 - DNA, 454 bp, Triticum aestivum
  Clone ID: LIB3280-046-P1-K1-B4
gcggcctgcggcggcggcggggcgaggccgggcgccggatccagcatgcagagggcggggctcctcacgccgttccccctgagggcgcgggccacggccaggacctgcatggtctccagcttcgccacggagttgctcgagataagatccagggagccttcgccgtcgctccacgttctggtcgtccctggcaatccaggtattgttggattctacagggactttgtcgaagccctgtatgaaaacctcggcgggcaggcatctgttacggcgatagggcacgtttcacatgggcagaaggattacgagcacggacgattgttttcattacacgaacagattgagcacaagattgattttcttgagcaagagcttctacataccgaacagtccataattgtggtgggtcattctattggcgcgtacataggtctggaaatatgcaaaagatttc

SEQ ID NO: 2394 - DNA, 449 bp, Triticum aestivum
  Clone ID: LIB3280-046-P1-K1-B5
ggcagggagaatttctttcactgctcaaaatgcggatgttgttattccaaagtgttgaagaacagtcatgcatgcgttgaaagagccatgcatcatgactgtccaatctgcttcgagtacttgtttgagtcgagaaatgatgtctctgttttgccatgtggtcataccattcatgaaaaatgcttgaaagagatgaaggagcattgccaatttgcatgcccgctctgctccaagtcagtatgtgacatgtcgaaggcatgggaaagactggatgcagaactagcgactctgtcaaactccttcgatgataaaatggttcgcatattgtgcaatgattgcggagcagtatcagaggtgcagttccacttaattgcacacaagtgccataattgcaagtcgtacaacacccggcagatttgaagtagtgaaaccctggatggattctacat

SEQ ID NO: 2395 - DNA, 250 bp, Triticum aestivum
  Clone ID: LIB3280-046-P1-K1-B6
cccacgcgtccggtgctaggtcacggtccaacgagcgcgttggtgacctcaccgtctctggcgaagcagcaccggcacccagggagctcgcctgcatatccggcaccggctacgtgggcgagctcaagaacccgctcctaggcgcgaggcgcgcgctcgctcatgccgtctacctcgaagccgccaagctcgagacgcaccgggaggaggctgtacccgcggtcgaagcaagaaaatcctgtatccccgc

SEQ ID NO: 2396 - DNA, 419 bp, Triticum aestivum
  Clone ID: LIB3280-046-P1-K1-B7
ctcctatcgccgcagcctccaccgaagccaagagaggagcagggcgaaaggaggccgtcggagatgtcggagaagaagcgcgcccccggcccgcgcaaggacgaggtggtgacccgcgagtacaccgtcaacctccacaagcgcctccatggatgcaccttcaagaagaaggcaccaaatgccatcaaggagatcaggaagtttgcacagaaggccatgggaaccaacgatgtccgcattgacgtgaagctcaacaagcacatctggagcagcggcatcaggagtgttcctaggagagtccgtgtcaggattgcccgcaagaggaacgacgaggaggatgctaaagaggagctgtactctctggtcacagttgctgaaatcccccaagaaggtcttaaagggtttgggtaccaaaggtt

SEQ ID NO: 2397 - DNA, 368 bp, Triticum aestivum
  unsure (1)...(368): unsure at all n locations
  Clone ID: LIB3280-046-P1-K1-B8
cctggtagagcagggcatgtagacgacgacgacgaccacgccacgccgccgcagcaccaacaatactaccggccaaaagacacagtagatctccacgcgcacgcatatgggattgtggttcaatttctctcgcatcctcctctaatcctctctccctgtcccggcaactacttaccacccctcttgattcatccgcgatattttttccccttgtttcatgatgatgagccgttcgtttcggctaataattttgatttttctctcctatacgtatcgttttggtcatttgggttgcccgtttgagttgtggatccggaacaatatatatatgntgatgccattggtattttgcaatatacgagaatatt

SEQ ID NO: 2398 - DNA, 437 bp, Triticum aestivum
  Clone ID: LIB3280-046-P1-K1-B9
ctgggacaaaaatttggataatgttctttttttgcacctgcttctcgcctcctatgtttgccatatatttgtgcattttttgtcaataacaatgatgctaagccctaagcaaatgtttctttcatttggggtggttctttttgcacgattatcattttctcctgcttgtgaaacagcctcggtgcccgatgcggtgaaggcggagctgctgcaacgcatccgatcctttctgatgtcttcctcgctttggtagcccatgtagcataccaatcggaagtcgcgtgtaggaagcttgaagcatcgatcttgaacgtgtcacacttcagggaagcagcaaatatcaacataaaacggatctggtgctgtggacgtgtttcctggtcaggcatgtgagtgggccttgtttgtgactgcaccatcaccacactgtatttgta

SEQ ID NO: 2399 - DNA, 454 bp, Triticum aestivum
  Clone ID: LIB3280-046-P1-K1-C1
cacacaccacgcctgcctcatctctcggagcagcagcaggaggagcttgcaggaacaatggcggcccagggtcttctctctgggaggcagctgcttgggaggcctctgcagtcttccatctccaggtcgtcttcctcccggaagtccgccttcgtcgtcagggcatcgtccagcccccctgccaagcaaaatgacaacaggcagctgtggttcgcgtccaagcagtccctcacctacctggacggcacgctgcccggtgactttggcttcgaccccttggggctgtccgacccggagggcaccggcgggttcatcgagcccaggtggctggcctacggcgagatcttcaacggccggacggcgatgatgggcgtggtgggcatgatcgccccagaggccctgggcaaggtgggcctagtgccctcggagacagcgatcccgtggttccaggccg

SEQ ID NO: 2400 - DNA, 376 bp, Triticum aestivum
  Clone ID: LIB3280-046-P1-K1-C10
cggacgcggggctctccacccatctcagcaaaaaagaagctagcacagcctcctcaagacctccttctccggcgtccgcctcccggcggcggcccgcaccccgtcctgcgtcgccaccccgcgcgccggcgccatctgcaactccatctcctcctccaccccaccctacgacctcaacgccttcaagttcagccccatcaaggagtccatcgtctcccgcgagatgacccgccgctacatgaccgacatgatcacctacgccgacaccgacgtcgtcatcgtcggcgccggatccgcggggctgtcctgcgcgtacgagctctccaaggacccctccatcagcatcgtcatcatcgagcagtccgtgtcccccggc

SEQ ID NO: 2401 - DNA, 417 bp, Triticum aestivum
  Clone ID: LIB3280-046-P1-K1-C11
attgggtgccggggaatatcagactgttattggagccagtgccatttctggattctgagcggctgcttgcagtctgccctttgattacgtgaaaacacaaattcagaagatgcaacctgatgccactggcaagtacccatacactgggtctttggactgcgccatgcaaaccttgaagaccggtggcccatttaagttctactccggcttccctgtatattgagtcaggatcgccccgcatgtcatgatgacgtggctcttcttgaatcaaatccagaagtaccagaagaagatcggcatataagatctccagttggagacaagagtaccaatccttgttcgacacatttaataactttccagcagctttgcactcccgtggttgtttttggtagacagagttttaagcaattttta

SEQ ID NO: 2402 - DNA, 329 bp, Triticum aestivum
  Clone ID: LIB3280-046-P1-K1-C12
gccgcaacaaacactatcgaacagaagccggaggtctggcgattcgaccctcgagaggcggccgaaccgagcagacgccatggaccgcgagtggggctccaagcccggcagcggcggcgccgccaccgcccagaatgaggccattgaccggcgggagcgcctgcgccgcctcgcgctcgagaccatcgacctcgccaaggacccgtacttcatgcgaaaccatctcggcagctatgagtgcaagctctgcctgacgctccacaacaacgaggggaactacctcgcgcacacgcaggggaagcggcaccagaccaacctcgccaagcgtg

SEQ ID NO: 2403 - DNA, 457 bp, Triticum aestivum
  Clone ID: LIB3280-046-P1-K1-C2
gcaactattactccagatgaagatcgggttaaggagttcaacctaaaacaaatgtggaggagcccaaatggcacaattaggaacattataaacggcaccgtgttcagagagccaattatatgcaagaatgtcccaaagcttgttccaggatggactaagcccatctgcattggaaggcatgctttcggtgatcagtacagagcaactgatgcagttctcaagggacctggcaaactcagactagtgttcgagggaaaagacgagacggttgaccttgaggtttttaacttcactggtgctggaggagtcgccatggctatgtacaacacagatgagtcaattcgaggttttgctgaagcttctatggcaatcgcttatgagaagaaatggccattgtaccttagcacaaaaaacacaattcttaagaaatatgatggcaggttcaaagacatttttc

SEQ ID NO: 2404 - DNA, 350 bp, Triticum aestivum
  Clone ID: LIB3280-046-P1-K1-C3
aaacagaaagattttatatatttaatcaaatcggtttgcattacatggaacacaatctgataaagatattacatgatctcctatttattaaccatgaaactgacattgtataacgtaaacgtaaaactatcttgtagtagccccattctccacctttctatcaacaacttagcaatgcatcatcttcgtcttcatcgtccttcatgctggatgacaagcttctctaggaactacctgtgaatgccttctatgacattgttataggatgaattaccgccaccctgcccatggttcagtactagaactgactggcaatgcgccaattcaggtgtgcatttcgttccacaaag

SEQ ID NO: 2405 - DNA, 437 bp, Triticum aestivum
  Clone ID: LIB3280-046-P1-K1-C4
cccacgcgtccgcgaaaactttggccgatgtgaaaggtggcacactgatctcatatgaagggagggttcagcttctggagattgcacaggttcctgatgcacatgtcaatgagttcaagtcaattgagaaattcaagatcttcaacaccaacaatctatgggtgagcttgaaggctatcaaacgccttgtcgaggctgatgcactcaagatggagatcattccaaacccgaaggaagttgagggcgtgaaagtccttcagttggaaactgcagctggagccgcgatcaggttctttgaccacgcaatcggcatgaatgttccgaggtcccggttcctaccggtgaaggcaacatcagacttgcagctagtacagtctgatctgtataccctggttgatggcttcgttacacgtaatgcagctagaacaaatccatca

SEQ ID NO: 2406 - DNA, 351 bp, Triticum aestivum
  Clone ID: LIB3280-046-P1-K1-C5
ggacaagtacggcgaggacagggccacggaggagctgcccgtcacgccatgggccttctccgtcgcgagtggttacacccttctgagagatccgcatcacaacaaaggactggcctttaccgagagggagcgggacgctcactacttgcgtggccttcttcctccaggagttgtctcccaggatctccaagtgaagaagatcatgcacaaccttcgccagtacaaggtcccgttgcagcgctatgtggccatgatggaccttcaggagagaaatgagaggcttttctacaagcttctaattgataacgtggaggagctgctccctgtggtttatacaccaactgtaggtga

SEQ ID NO: 2407 - DNA, 363 bp, Triticum aestivum
  Clone ID: LIB3280-046-P1-K1-C6
tgccgtcgtcggagaagttggagctcaagaaagcctttgattgtaaataaaggagggggcctctgggaataaagaaagagaaagagaagagattttgcttgttcaaaaggagagaagttgtatatttgtacctttttccctcttcgagtaagatacatatctatatctatatatatatataagaaaggcaaagcatggaagcaaattagctgaaatatttagggttagatgatgatgggaagcaaggacacctgtagatccttttgccttgggtttcatcagtgtataaggtttccatctcttgtaaagatttcctattttactgatgtttcgcagaagtcaaatgtttcagtctttgtaaag

SEQ ID NO: 2408 - DNA, 400 bp, Triticum aestivum
  Clone ID: LIB3280-046-P1-K1-C7
cttttcttaggaggcggcgagatctggccgcatcctcgcgcagggtattgctccctgatggcatcctcggggaagatggaggggccgtcggcgccagcgctccggcgggacccgtatgaggtgctctccgtatcaagagactcctccgaccaggagatcaagtccgcctaccgcaagctcgcgctcaagtatcacccggacaaaaatgctagcaacccagaagcatcagagctgttcaaagaagttgcatattcgtacagtatcttgtcagatcctgagaaacggaggcaatatgacactgctggttttgaggcgttggaaaatgaaagaatggatatggagattgatttgtccaatcttggaactgtgaacacaatgtttgctgcacttttcagcaagc

SEQ ID NO: 2409 - DNA, 416 bp, Triticum aestivum
  Clone ID: LIB3280-046-P1-K1-C8
cccgcggcaggctcgccaccgacgacgcgcgccaccccccaataataggcgccggatcgggggagggccacggagcgagcgagccatgggcgtccacgcggcgcccttccccttcccccttccccgccgggaggaggacgacgccatcgtcctcggccgaggcggcgaccgctggggcgccgccgcgatgccggcggaggacgaggcggtagagcagtcgcccacggcgccgcccatctcctcctgcggccgctacatcctgcaccgcgtctgccgcttcgacacgctcgccggcgtcgccatcaagtacggcgtcgaggtggctgacgtgaagcgggtgaacggccttaccgccgacctgcaaatgttcgcgcacaagacgctgcggattccggttcccgggccgcacccgccgg

SEQ ID NO: 2410 - DNA, 443 bp, Triticum aestivum
  Clone ID: LIB3280-046-P1-K1-C9
cccacgcgtccgatcgcgtcaggcaaaggtagtaaccctgaatggaacgaaagctttgtcttcaccgtgtcagaccaagctacggagctggtgattaagcttatggacagcgactcgggcacatcggacgacttcgttggtgaagcaacgattcctttggaagcagtttatacggaagggagcattccaccaacagtttataatgttgtgaaaggtgaacactactgcggagaaatcaaagttggtctcacattcactcccgaggatggtcgccagcgcggtctccccgaagactttggtggctggaaacaatcgcattgagcagactcggaagaacaaggatgctcgtcaagccttgaggccttgaatcaccatctcatgcaaatacaatacgaaactctgtcactttggatttttatctgttccttttgaagctgaaagtc

SEQ ID NO: 2411 - DNA, 453 bp, Triticum aestivum
  Clone ID: LIB3280-046-P1-K1-D1
gacgctcttgattgcagaggaatgcggcctgactggccaaaggcctactaccggcagggtgcagctctgatgtcactgaaggactacacgaacgcgtgtgtggcgcttcttgatggattcaagttggacctggagaatgccgagatggaatctgcattacgggaagctatggaatctttgaagatatcgaaaggcggcgccaaggcaacatgacatgagcttgagctttgcactagtgctgaagatagatgcatgcagtcacctctcgtgaaaaaaagacatcctcttttcaagtccttttttttcctgcaaagtttatttcgtgcactagtgtggagctgtgccctctagatgttcaagtaataactcccttagtcatggaagtgcagtttgttatctttactgagaccggtcatgtgggtagcaattgactcaaattttttgcttgctctt

SEQ ID NO: 2412 - DNA, 443 bp, Triticum aestivum
  Clone ID: LIB3280-046-P1-K1-D10
cggacgcgtggggaaaagaactgatcagagagatcaccgatttagcacacaagcatgacatgtatgtgagcactggtgactgggcagagcatctcctgcgccagggaccctcttcgttcaagcaatatgtagaggaatgcaaggagttaggattcgacaccattgagctcaacgccggatctctcaagctccctgaagaggctatcctgagactagtacgcctcataaagaacaacggtttgcgagccaagcccctgttttcagtgaagttcgacagctctgatatccctgcagccggtgatagggcgtttggggcttacatagctccagtgaagcaaagctcagaaagagtcgaagacattgacctgctgatcaggagggccgagagatgcctggaggcaggtgcggacatgatcatgatcgacaccgatgacgtgtgccag

SEQ ID NO: 2413 - DNA, 431 bp, Triticum aestivum
  Clone ID: LIB3280-046-P1-K1-D11
cggacgcgtgggcggacgcgtgggcggacgcgtgggcggacgcgtgggcggacgcgtgggctggaggaacatgtggttgttccccctcctccctcccgcatcgcccccccgcgtggcgaccgggaggggaaccctagatcgtgccgccggtctccccttccttcctccctcctcctacctcgccgccgccagggcccggccgggcaaaggcctgtcggcgccggcggaggcaaagcatcctcgtctgcccgcgcggtggggttggcgcaggtcaacacccaggggcggggcgtggcgctaaagccgggcgccacagcggttcgtctgcggcgacgatgtgacgggcggcgcggtgcggtggtagtgtgtgcctggggcggccgcggcgttcggctgtcttctcctccggcggcaagggctgcggtcggcat

SEQ ID NO: 2414 - DNA, 440 bp, Triticum aestivum
  Clone ID: LIB3280-046-P1-K1-D12
gcgtcctgaagaggttggcgccggtgaccagggcatcatgttcggctatgccaccgacgagacccctgagctgatgcccctcagccacgtgcttgccaccaagctcggagctcgcctcaccgaggtccgcaagaatggcacctgcgcctgggtcaggcctgacggaaagacccaggtcacagtcgagtacctaaacgaggatggtgccatggtacctgttcgtgtgcacaccgtcctcatctccacccagcacgacgagaccgtcaccaacgacgagattgctgcggacctcaaggagcatgtcatcaagccggtgatccccgcaaagtacctcgatgagaacaccatcttccacctgaacccgtctggccgcttcgtcatcggcggcccccatggtgacgccggtctcaccggccgcaagatcatcatcgacacctatg

SEQ ID NO: 2415 - DNA, 379 bp, Triticum aestivum
  Clone ID: LIB3280-046-P1-K1-D2
gtccaccgcctccgcctgctgaggagcgccgtcgtctgctcttcctccgcgctgctgccgagcagccgcccgcgcctcgccatccccttcgcgcagccgccgctccgcggccccgccttcgccgccgcctcgtcgccgttgctccgctcggtcggcgccagattctcgctgttcagcagcatggccgccgccgcctcctctgcctcctccatccacgacttcaccgtcaaggatgcaagtggaaaagatgtcgacctgagcacctacaaggggaaggttctcctcattgtcaatgttgcatcccagtgtggcttgaccaattccaactacacggaactcgctcagttgtatgagaagtacaaggaccagggttttgaga

SEQ ID NO: 2416 - DNA, 331 bp, Triticum aestivum
  Clone ID: LIB3280-046-P1-K1-D3
cgaggttccgtcgccctgaggtccttttccagccatctttcattggtatggaagctgctggaatccatgagaccacctacaactctatcatgaagtgtgatgtggatatcaggaaggatctgtatggtaacatcgtgctcagtgagagctcaactatggtcccggatattgctgaccgtatgagcaaggagatcactggccttgcaccaagcagcatgaagatcaaggtggtggcaccgcctgagaggaagcacagtgtctggattggagggtcgattcttgcctcccttagtaccttccaacagatgtggatcttcgaaggcgagtttga

SEQ ID NO: 2417 - DNA, 408 bp, Triticum aestivum
  Clone ID: LIB3280-046-P1-K1-D4
gatcatgatcatgctcatgagcagtcacatgcacactccctgaaagatctttctgttggcttgtctattttatttggtattgtattgttctttattgtcgagaagattgtgaggtacgttgaggacaattctcaaagggggggtcatagccatgggcaccatcatcaccatcataagcgacaagacattagtgataaggccaagtcggatcacataaaaagtgatgatgagggtaaagacacagatcaagcgcaacaaaattctttgcatgatggtgcaactggaaaaacaatatatgctgaaaatgagcaagagtcaaatgctactaaggaagctgttttaggatcacagagatcagctttggacgtggtgcctggtgccaccgacagagagcctatcaattctaaa

SEQ ID NO: 2418 - DNA, 391 bp, Triticum aestivum
  Clone ID: LIB3280-046-P1-K1-D5
agcagatcgctcgagccctccgccgccgccgcgccttcagctctctccttccttcaccgattcaagatgaagttcatcgctgcctatctgcttgcttacctctctggcaacgccagcccctctgcagaggacctgacatccattcttgagtcagttggttgtgaaatcgacaatgagaagatggaactcatgctgtcccaagtgaagggcaaggacatcactgagctcttggctgctggtagggagaagtttgctgcggtaccatctggtggtggtggtgtggctagttcagccgctgctcctgctgctggtggagctgctgcccctgcagctgaatcaaagaaagaagagaaaggtcgtggagaaagaagagagtgatgatgacatgggc

SEQ ID NO: 2419 - DNA, 445 bp, Triticum aestivum
  Clone ID: LIB3280-046-P1-K1-D6
cccacgcgtccgctttctcgctcctccccctccgatctcccgacgagattgtactcgctcccggatcgtcgccggagcgtctcctcgatcaggcaagatgaacaggaagccaggcgactgggactgcaggtcgtgccagcacctcaacttcagtcgccgggacctatgccagcgctgcggcgagccacgcagtgccgctgaccgtggcagcgtcggtaggcgctcttggtggtgactacgccaactttggcggccgtggcgggggtggttcctcctttggtaccggctttggtgccggctctgacgtccgcccgggcgactggtactgcacctgcggagcgcacaacttcgccagccgctccagctgcttcaagtgtgctgtcttcaaggaggaagctgccgtcaatggtggcgctggtggctttgatggtgacatgtcacgctc

SEQ ID NO: 2420 - DNA, 342 bp, Triticum aestivum
  Clone ID: LIB3280-046-P1-K1-D7
ctcctccccactcagtcctcggttcccggtccggttcggttccgttcggttcgttagggtttagtagcggggaagaggaaggcatggcggacgtcgagtaccgctgcttcgtgggcggcctcacctgggccaccgacgaccagtcccttcagaacgccttctccaagtacggcgacgtcatcaactccaagatcatcactgacagggagacgggccgttcccgcgggttcgggttcgtcaccttcgcgtcggacgaggcgatgcgccaggcgatcgaggccatgaacggccaggacctggacggccgcaacatcaccagtaacgaggcccagtcccgccgct

SEQ ID NO: 2421 - DNA, 407 bp, Triticum aestivum
  Clone ID: LIB3280-046-P1-K1-D8
ctcctcctccccttcgcggcgccacccggacgctcgagcccccgaccaaccatggcggcagcggctggagaggcccctcgggcgctgtcccagaaggagcaggacatacagatgatgctcgccgccgacgtccacctcggcaccaagaactgcgacttccagatggagcgctacgcctacaagcgccgctccgacggcatctacatcatcaatctgggcaagacatgggagaagctccagctcgcggcgagggtcatcgtcgccatcgagaacccccaggacatcatcgtccagtccgcccgcccctacggccagcgcgccgtcctcaagttcgcgcagcacaccggcgccaacgccatcgtcgggaggcacacccctggtaccttcaccaaccagatgcagacctc

SEQ ID NO: 2422 - DNA, 424 bp, Triticum aestivum
  Clone ID: LIB3280-046-P1-K1-D9
aagagaagcaaatcggcagagagcgaagcaaaccggcggttcctggcccctcgccatggccggcaaagctagggtgttcatgtgcgtggcgctcgtcgtcctcctgctccttgtcgagaccaccgctccgagtggacaagctcacgccgtcgattgcggcagcgcgtgctcgtaccggtgcagcaagtcgagccggccgaatctgtgcaacagggcgtgcaacacgtgctgccggcgatgcgactgcgtgccgcccggcaccgccggcaacgaggacgtctgcccctgctacgcccacatgaccacgcacgacggcccgcacaagtgcccatgatccaaccgtctttctcgacgaccgatcgaggctaatgcatgctcgatcatggcgtctcagttaatatcccatcaagctagctacacccac

SEQ ID NO: 2423 - DNA, 437 bp, Triticum aestivum
  Clone ID: LIB3280-046-P1-K1-E1
cagctcttcatcttcttccttcatgctgagggatgctccccctgccgcaaataccagcattcatccagcggcaacaggcgagagggcagaggatgcggcagtgcagccgcaggccccaccccggacggggcttccaccgtggatggtgagccacatcaacgggtgaagggcatccagcccatacaggcgtactattcagtagagggtaacaagttgcaccggccagcctggtgtatgttgcggttgctagcacgcctgacccctttggaggggaaaggaaaagaaatcagagtaaagtagcaagctgcagcgatgtgtatatttcactttgtccacctcagtttccctcccagctgggctgagatagctgtacgagtaattaccatgtaatctatatgtagcttgagtgatgaattttcaagtttcatgatacccgt

SEQ ID NO: 2424 - DNA, 425 bp, Triticum aestivum
  Clone ID: LIB3280-046-P1-K1-E10
cccacgcgtccgggcaaaggatggacggcagggaaaaatcaatggaaaaggttattacttttatgagaagggtgggaagccaaagcctgaccctagtgttcaacatgtgattgacgagtacagaagacagacaaagacaatattcggtggaaagcttgttactttatcggatcaagatatattggagatggttttcttcccactcgttaatgaggcatgcagggtcatggatgaaaatgtggtcatcagggcttctgatcttgatattgcatctgtccttgggatgggctttcccaagtacaggggcagcctcatcttctgggctgatacggctggagcatcttatatacattcaaagcttagcaaatgggctgaaatttacggtgatttctttaaaccatcatcatacttggaggagagagcga

SEQ ID NO: 2425 - DNA, 430 bp, Triticum aestivum
  Clone ID: LIB3280-046-P1-K1-E11
agcagcagcactggcacgggcttatatattgttggcttgtagcataaattgttggcacgacagcataaatcgttcagcgtcttgacgcactaatgcaatcgtactgacaattggtagtaaccaaaatcatataaaggcagtctgctctcctttaaattatatttcataaactatattgaaccactgcagctgctatagatttgagattcacatctttttttacattgcctgctctaggaagttactgttgcgtagttagtctttttgcactgcatttgtacaattgtatattcttgccattactaggtgattccttaaattattcagttcgttgtagcataccagtttgatggaatgcctaaggcctaaggagataaacattggtatccataatagatctacctaaaccaacaggcacaaaacatgcata

SEQ ID NO: 2426 - DNA, 371 bp, Triticum aestivum
  unsure (1)...(371): unsure at all n locations
  Clone ID: LIB3280-046-P1-K1-E12
cgctgatcctgccgtccctggcgctgcggatgatccacaaccagatctggatcagcctgtcccgctaccagaccgcgcgcagcaagcaccgcatcgtcgaccgcggcatcgagttcgaccaggtggaccgcgagcgcgggtgggacgaccagatcgtcttcaacgggctgctcttctacgtggggtacctggcgatgccgagcgtgcggaggttcccgctgtggcggacggacggggcggtggcgacggcgctgctgcacgcggagcccgtggagttcctctactactggttccaccgcgcgctgcaccaccacttnctctactngcgctaccactcccaccaccacgccttcatcgtcaccgagcccatc

SEQ ID NO: 2427 - DNA, 302 bp, Triticum aestivum
  Clone ID: LIB3280-046-P1-K1-E2
tcgcccacgcgtccggtccacgtcgccggcgggtacgagagctactgcaagtgcaacaaggcgtgcatcgtggactgctacaaggccctgcccgtcggtatgctaccagatgtgcgtctccgagacctgcgtcaagctgccgccatgtaagcaggcggaatgctacaaagcatgcggtgacaaatgctaccacaagcagtcgagcccgggcccgaagccaccaagcccgaagccgccaagcccgaagcccactccgccaaagtccgcaccaccgaaccacggtggttcaccgaagcccacac

SEQ ID NO: 2428 - DNA, 460 bp, Triticum aestivum
  Clone ID: LIB3280-046-P1-K1-E3
cccacgcgttcgaattggtgagaaaccatatgtagatcttttctagaatatgtagaatttatagaaataaggaatataaattctaaaacgagtacatcattatgtagtgctacagtaaagagcaaatgcttaatgatgtgctccacccaatccatattaattctctcaaactaatattgttcggaggaagtacttgaattcaccattagaggagagaaatgcacatggttcatatttgaaatatattcaatcaactaaaaggaagtcgagttatacttgacgcaataatcaaacaagaggttaatttattactctgaacatttagaatagcaaactagcacgagaaaatctaccaaatattaagtccagccacacaatgaaaataaatatgaacgtgaagaaatagtcgaaagtgtgcctttactgaaaccatgaaatatatcttacctagaacacattt

SEQ ID NO: 2429 - DNA, 383 bp, Triticum aestivum
  Clone ID: LIB3280-046-P1-K1-E4
gatgaaaataatttcatttttcaaggacatattcgatactagtaataaaaagcccatgtgttaaaccatgctatttttaaaatgtctatcaaaaagatcatccagtaaacccatgagccacaattcctttctaatggaagcaggtaatgtaatctatgaggttgtaatagtggaaagaccattatcaatatttttattattcttataactgtaaagaaggagaccactaccatctgaattcatacgtgcacctgccataaaaccagatatttgaacaaactttagctattaaatatacatgccaggaaatttacattattacagtggggcacttctttgcacggttttcaaaataagaaacttaaccttttttgcagtatcat

SEQ ID NO: 2430 - DNA, 446 bp, Triticum aestivum
  unsure (1)...(446): unsure at all n locations
  Clone ID: LIB3280-046-P1-K1-E5
gtcaacacctacaccttaatcagcagggatggaaaggcgcaccttgttaagttccattggaagcctacatgtggtgtgaagtgcctcttagatgatgaagccgttactgtaggaggcacctgccacacccatgctacaaaggacttgaccgattctattgcagctgggaattacccagaatggaagctcttcattcagaccattgatgctgatcatgaggataaatttgactttgaccctcttgatgtcaccaagacctggccagaggatatcatcccactgcaaccagttggacggatggtgctcaacaagaacattgataatttcttcgcagaaaatgaacagcttgctttctgcccagcaatcactgtccctggaatccactactctgatgataagctgctccagacaaagatnttctcctatgctgatacccaaaggcaccg

SEQ ID NO: 2431 - DNA, 438 bp, Triticum aestivum
  Clone ID: LIB3280-046-P1-K1-E6
caaaatgtagcgaatatgttcaccaaggagaagagcccgtgggcaaagctttgtgctccttcttggtatatgtgtgcgtgtgtgttctttgagttcttccatgatgagtgtccttgagagaaactctgagtaggaagagttgcgagggagagaagaagagcggcgctgcgaggagaggcggcgccatcaattggcatcagagccttgtcgatccgaggcgacggtggcggcgcggcagactccatgtgagggggacgttggcggcgcaaggtgaacgccgttggcggcgcgatgctgctagcggccggtgcgtgtctccatcatcgtcgagctgcgtcacgagcgatggagaggggtgtgctttccagtaagttgcggcatcggcggcaaggtggtgatggccatgcgtggaggccattgccataaggagttccatgt

SEQ ID NO: 2432 - DNA, 271 bp, Triticum aestivum
  Clone ID: LIB3280-046-P1-K1-E7
gcagaacaggcgatcgatctttagctgttgcgagtcgcgaacctcccccttcgtcaagatgcagatctttgtgaagaccttgaccggcaagaccatcaccctcgaggttgagtcttctgacacaattgacaatgtgaaggccaagatccaggataaggagggcattccaccggaccagcagcgcctgatctttgcaggcaaacagcttgaggatggacgcaccctagctgattacaatatccagaaagaatccaccttgcacctggtgctt

SEQ ID NO: 2433 - DNA, 363 bp, Triticum aestivum
  Clone ID: LIB3280-046-P1-K1-E8
cattccgtcgcggcgatcgctgacctccctccatcgccgcaactgcaaaaccctcctcgccggtaacttacccctgcgaccatccatggccaccttcaccggagcaccgctcccgccggccggcgccggaaaggagaagccgctcgcgcgccccgcaccggcaaccgctcccgcggacctcgcgaatccagggaagaagacgcgccgccgggtgccgatgacggacgaggatcggtggaggatcgaccgcctgaaggagctgcacgcgtcagggaccgaggagctgcacgagctgatggacatacacaaggagctgcgcgactaccacgacgagcttctgttccagcagaggtgcctggccgc

SEQ ID NO: 2434 - DNA, 346 bp, Triticum aestivum
  Clone ID: LIB3280-046-P1-K1-E9
cgcaatttgcgtccttttctcgtcttcttcctcccggttagtttataacctgcctgcccatccttggaacaaccgaacgagtcagacaggttatgtagtggtggcttgcgcggctggccttggttttgcttgcggcgagaagcaatgggcggagcggaggacggggcgcacgcggcggggggccacgcatccaacgggcacgccaatggggccgtggaggagaaggtggacgagctgcggcgggtgatggggaaggccgacggggacccgctccggatcgtcagcgtcagggccggggcctggagcagcgtcttctgcgcgctcctgcaggacgcctacggccacc

SEQ ID NO: 2435 - DNA, 425 bp, Triticum aestivum
  Clone ID: LIB3280-046-P1-K1-F1
cttgtgtacaccgacgagtccaataaagcactatactcatccataacctccaagggagatgtggcagaggaaactggtaaaagagcagagccatacctgtaacttgtctaatcatctactcccttcgtcccataatataagaacgttttcgacattagtgtagtgtcaaaaacgttcttatattatgggacagagggagtaataagttctacactaatgttcatatattagacaagtaataagttccattggccattataacttcttatgcattatcttccattagttgctgcgctggataaaatagaagcggccctgggaaagttcagtgatggaccttttttccttagccagttcagtttggtggacattgcatatgtgccatttatcgaaaggtttcagatattttttttggtatcaaaaac

SEQ ID NO: 2436 - DNA, 427 bp, Triticum aestivum
  Clone ID: LIB3280-046-P1-K1-F10
caaccatccacgacacacacagcacggcagcggcgtaaagggaaaactcccgcaagatgtctcagctcgcccgcgctagcctgactgcggaggcgatgctcctcctccttgccgctgctgcggcggcggaggggccagcaggctgccaggacgacgttgtggcgctcaacgaggcctgctaccagtacgtgcagaaaggcgcgccgacggtgccgccgtcgcaggagtgctgcgacgccgtgcggcgcgtggacgtgccctgcgtctgcagctacctgggcagccccggcgtgagggacaacatcagcatggagaaggtgttctacgtctcccagcagtgcggcgtcagcatccctggcaactgcggaggatcgaaagtctgaagcaggaacaggccagctgaatggcaagcttggataacgtaagc

SEQ ID NO: 2437 - DNA, 389 bp, Triticum aestivum
  Clone ID: LIB3280-046-P1-K1-F11
ggccgtgcgatacgagctggccttgtgccactcatcatgggtctagtaaccaaccccacaggagctctcatggacgaggctatggcgatactctcaatactatccagccaccaagaggggaaggcagctatcggggcagcagagcctgttcctgcgcttgtcgagtagctcggaagtgggtcaccgagaaacagagagaatgctgcagctgtgatgctgcatctgtgcagcggcgagcaacagcttgtgcatttagcccgtgcgcatgagtgcgggatcatggttccgttgcgggagctggcattgaacggcacagaaaggggaaagaggaaggcagtgcagttgctcgagcggatgagcagattcatggttcaacaacaagaggaaca

SEQ ID NO: 2438 - DNA, 392 bp, Triticum aestivum
  Clone ID: LIB3280-046-P1-K1-F12
ggccgtcggcaccgtcctctgtgcgtgctactggtcagctcggagcgctagagaagctgttaccgaacaggaaaagctcctgaaggatggacatgaagtctcactgactagttagagggaggaggttctagtggcatcgtggacatcaacgtgatatcggcgatgatgtttgttgtggtcgcgtcgtgcttcctaataatgctttataagctgatgtccgcctggtttatcacatctactggttgtgatcttctgcatcggcggtgtatagggcctgcaaacatgcttggtggctatattatcaagatagcttacatctgctgcgagatcttttgtgaaagcgccgttctttggagcaatctcatacctgacaatggcggtatccccattct

SEQ ID NO: 2439 - DNA, 447 bp, Triticum aestivum
  Clone ID: LIB3280-046-P1-K1-F2
acagactcgatcgagagcttgtcttggttctgcaatgggggtgaggtgcctgctgctcctggctgtgctcctcttggctggggatcatggcggggaggcgcagccgctcgtgcccggggtcttcacgttcggcgactcgtcggtggatataggtaacaacgactacctccacaccctcatcaaggcggacttccctccctacggcagggacttccccaaccgcgtggccaccgggaggttttgcaacggcaagctggccaccgacatcactgctgatacactggggttcacgagctacccgcccgcgtatctcagcccgcaggcgtcagggaagaaccttctgatcggcgccaacttcgcatctgctggatcaggctactacgatcacaccgcgcttatgtatgtaagtattatcgatcatcggtctctcgaggaatcggcgccatg

SEQ ID NO: 2440 - DNA, 276 bp, Triticum aestivum
  Clone ID: LIB3280-046-P1-K1-F3
cacgaccgtcctcacgagagcgattctaagcgcggactcaagctcctacttccacgcagatctggaggagcacgcggagtagcccgcaccgtggacacctgcacgcctacctctacgccttggaggagagatgggacgtaagatgacgatgatgttcacccagctgttcacccagctggagatgaagatggtgatgaggggtctcaaggccggtgttaagaccactattctgaacacgctcatgctcaagcagatcgtcagcaagatcgtaaccat

SEQ ID NO: 2441 - DNA, 424 bp, Triticum aestivum
  Clone ID: LIB3280-046-P1-K1-F4
gctgcttccgcgtagataggaaacctcttcgacctctttcatcttgattggatccccttggtcactgctacttctagctctgatagattgagggcaggcctgatcgaggagtgcaagaaaacaacaaaaaggttgaagggaaggagacgaagggcatgggtacttgaaaaataagcaatcacgttgcctccatcttctacagaccgagttcttccatgaatttgaccctagacgatctggtgacgctacagacggcagagagacaaggacagctcccctcgctgcatgttcgtgcccactgcgacttttctgtttatcaggatgaggcagataactctaagcaggagatagagaagcatttggttgctgccttctctgttttggaactaaatctcacgacagaggggcatgttttttggtcatt

SEQ ID NO: 2442 - DNA, 433 bp, Triticum aestivum
  Clone ID: LIB3280-046-P1-K1-F5
acgaactccgatcgccactcccccagagaaatcctcctcacctcgaaacttccgtgaagcagcaaacgcaagtccggccaagatgtcgtggcagacgtacgtcgacgagcacctgatgtgcgacatcgagggccaccacctcgcctccgcggccatcctcggccacgacggcaccgtctgggcccagagcgccgacttcccccagttcgcgcccgccgagatcactgccatcatgaaggacttcgacgagccggggcacctcgcccccaccggcatgttcgttgcaggtgccaagtacatggtcatccagggtgaacctagcgctgtcatccgtggcaagaagggagcaggaggcatcaccatcaagaagaccgggcaggcgctggtggttggcgcctacgaggagcccatgacccctgggcagtgcaacatg

SEQ ID NO: 2443 - DNA, 454 bp, Triticum aestivum
  Clone ID: LIB3280-046-P1-K1-F6
cacaggtgttggcttattcacaatcaagctagattctgggctggttaagaaggttgccgagtctggggtctacttcagcgtcctaccctacatgagcttctatactccagatcgtggtagatttccatccctggcggagctcactgatgcatgatatgcgccgctcaagagcaagagtgcaaggccttgcgaaatggatgaagccattatcataaatgtactggtaggggcttcttgcaaaactaccgctatcaaatcctttttttattttctggtggggaggcaaaggacgactggtgcgaggtattatgaccgaaaccaaggacgcataatttgaatgatctgggccattcggtttgtccgaagttcattcaaatgtactaattcggattccaaagcgacaaaagtggaacaaagaccacatatgctgccatatgaagctgcttcttttttt

SEQ ID NO: 2444 - DNA, 310 bp, Triticum aestivum
  Clone ID: LIB3280-046-P1-K1-F7
accccgccgtcctcaaagccgtcaccgaagagcacgctgagatcgcgagggagaaggcgttgtccggcgagccactgtcgtgggccgacacgcggcggatgcggatgacgggccgggtgatccaggagacgatgcgggtggcgtccatcctctccttcaccttcagggaggccgtggaggacgtggagtaccaagggtacctgattcccaagggctggaaagtgcttcccttgttccggaacatccaccaaaaccccgaccatttcccttcccttgaaaggttcaatctttaacgattggagggggcccc

SEQ ID NO: 2445 - DNA, 448 bp, Triticum aestivum
  Clone ID: LIB3280-046-P1-K1-F8
cccacgcgtccgcccacgcgtccgcccacgcgtccgtgctcctccacccatccctgtctctgtctgaggcgattctttcttgactttaggtacctctcttcgctgtcgttatcttcggccccacatccccggaaaatcaatcaaagtgaacagaagacattcgtttgcaaaggtgaaagagaaattgacctggtcaaggaaataatgaaatgctctgattgaataatgtggaactacatacacatgccatgaagtgttaccacagcaagatctcgacaaatccacttgaatcttgacaccagatgatggcacattaacacggagacgacaatagtgcacagatgagcactaatacaaatgtcaaccctgcacccaaggatgccgaggagaagaaagcagccggctcgtcctcctcctcatcggagcacctggatgaagacgatgattt

SEQ ID NO: 2446 - DNA, 335 bp, Triticum aestivum
  Clone ID: LIB3280-046-P1-K1-F9
cccacgcgttcgggggttggattctcctctcgactcagggctcggttccaggtccgtctcggttccagtcggttctttcgggtttagaagcggcgtagaggacggcatggcccacgtctactaccgctgcttcgagggcggcctcgactacgacaccgtctaccagtccttctagaacgccttctacaacttcggctacaacatcatcactgacatgatgactgaccgggagacgggctcttcccgcgggatctggttcttcacctaggcgttgcacgaggcgatgcacgccgtgatcgaggtcatgaacgaccagcacctggacagccgtaaca

SEQ ID NO: 2447 - DNA, 443 bp, Triticum aestivum
  Clone ID: LIB3280-046-P1-K1-G1
cgaaatcagagaggggcaaagcaaatcgcaccaggcaaactcagagggtcttccggcgaaccccaaagcgagagagcgagcgagcgattcccaggagaggagaggaggcggagatggccaagggcgaggggccggcgatcggcatcgacctcgggacgacctactcgtgcgtcggcgtctggcagcatgaccgggtcgagatcatcgccaacgaccagggcaaccgcaccacgccctcctacgtcgccttcaccgacaccgagcgcctcatcggcgacgccgccaagaaccaggtcgccatgaaccccaccaacaccgtcttcgatgcgaagcggctgattggcaagaggttctctgacccctccgtgcagagtgacatgaagctgtggcccttcaggtcattcctggccctgcagacaaacccatgatcgtcgtcaactaca

SEQ ID NO: 2448 - DNA, 398 bp, Triticum aestivum
  unsure (1)...(398): unsure at all n locations
  Clone ID: LIB3280-046-P1-K1-G10
aattggtttccatggtgctgtgagctcgctgagattcagcaatggctccgcgctggatctctcatgaccagacaagactggccgaccgcactgtcactccgacagccacatcttggtggtaatcagtggagtaccgccactgtccatcaaaatctttgacctcccgcatccaccgccagttccgtctctctgcaagcaaatcacaggcgccattgctcagcttctgaggagcggagcggagccgagatggagcccatccctctgctgacgccgtacaagatgggccagttcgacctgtcgcaccgggtcgtgctggcgcccatgacgcggcagcgcgcctaccgcgcgtgccgtanncgcacgccgccctctactacttccagcgcgccacccccggc

SEQ ID NO: 2449 - DNA, 426 bp, Triticum aestivum
  Clone ID: LIB3280-046-P1-K1-G11
cagacgcgtggggtggtgtgtgtgtatggttgctgcagcatagctagctagggacggggaaggtggaggaagcagcggagtcagccatggggagggggagggtggagctgaagcggatcgagaacaagatcaaccgccaggtcaccttcgccaagcgcaggaacggtctgctcaagaaggcctacgagctctccgtgctgtgcgacgccgaagtcgcgctcatcgtcttctccaaccgcggcaagctctacagagttctgcatcacccagagcatgacgaaaacactcgacaagtatcaaaaatgcagttatgcatgacctgaaactactgtgcagaacagagaaaatgagcaactgaaaaacagccgcaatgagtacctgaaactaaaggcacgggttgataatttacagcgaacacaaaggaat

SEQ ID NO: 2450 - DNA, 249 bp, Triticum aestivum
  Clone ID: LIB3280-046-P1-K1-G12
atcccgcagcgcaagtcgaggaggaaccgaagaagaagaagatggcgcgtaccaagcagaccgcccgcaagtccaccggcggcaaggccccccgcaagcagctcgccaccaccatcgcggcgaggaagtcggccccgaccaccggcggcgtgaagaagccccaccgctacaggcccgggacggtggcgctgagggagatccgcaagtcccagaaaagcacggttctgttcatccgaaagtggccgttcc

SEQ ID NO: 2451 - DNA, 333 bp, Triticum aestivum
  Clone ID: LIB3280-046-P1-K1-G2
cccacgcgtccgcccacgcgtccgcaaccattcacactctgaaaaggttggggcagcatccccatattatgggtcaccgcttaaagtaatactgcctgagcagaaacctgatatgaaatctacaagatgccatgtggtaaagccaatgaagagtgtacaagcagactataaactttatgatgttgagttggcagtcgaaggaacctacaagggccaccgtgcacctcttgtttctctgacaagtaaatggaaccgtaaacctgttatggggtttcctgtacctgttgttgttttggatgataagtgccctgtggaaagtagaggcaatcacca

SEQ ID NO: 2452 - DNA, 455 bp, Triticum aestivum
  Clone ID: LIB3280-046-P1-K1-G3
cccacgcgtccgcaccgcaccgggggtcacctgagatcacatacacaatggtgaaggctgtggctgtgcttaccggcagtgagggtgtcaagggcaccatcttcttcacccaggagggagatggcccgaccaccgtgacgggaagtgtcactggactcaaggaagggctccacggcttccatgtgcacgctcttggtgacaccaccaatggctgcatgtcaactggaccacacttcaaccccgctggtcatgtgcatggggcacccgaagatgaaatccgccatgctggtgatcttggaaatgtgacagctggagcggatggtgttgctaacatcaatgttactgactgccatatcccccttactggaccaaattcaattgttggccgtgctagtgtcgtccatggtgacgctgatgatcttggcaagggtggacatgagctgagcaagagcact

SEQ ID NO: 2453 - DNA, 444 bp, Triticum aestivum
  Clone ID: LIB3280-046-P1-K1-G4
ggcagctgccgctgcagtcgaactaaaaaatctggcagaagaagttaccaggctttcttacgaaaatgcaaagctggctgcagactttactgcagccaaagagcttactgcatcagtcacaaggggcaatgacacaaaacgccgtgatcaagataatggaattttggttgaggagatgcagaaagagttggttgctagttgccagcgagaggctgccttagaagacacattatcgcaaaaggcccgaagggaaaatgagcttctgaagataattgatgatgcaaagtgccatgagcatgatttggaaaatgaactggaaaacatgtgggcccttgtttcaaagataaagaaagaaagctctcaagatgatttgttcgaatttaaatcaaagcaaaacggctttcattcatcgaagactgatactggtagaatcctaagtgatat

SEQ ID NO: 2454 - DNA, 456 bp, Triticum aestivum
  Clone ID: LIB3280-046-P1-K1-G5
ggaagaacttctttcttatcttaatgttttgtagaacccccagattgaccatatattgcatgctatcattcacaatacatgttctgtctttcctatcatgtgttccgagggttcaatctgcaagaaaacccatcagacctgtatatgtcatctgatttagatcacttaatttcatacatggattgctgaggttttttgatcttgcaggtcgcggcgaccaccaagaagacacccaactcctgcaccccgaactaccctacccgagcctgccgtcgcagctgctgtgtcaagtccacaacatcaccatgcatgctgacaaggacaatgacaggtctacgcacagatgactctgcaaccaataaactctaagtactgtcggaaagggagcttggtgaagatattcatgacatgctgaactgcgttttctctacatgtgcttttatcggtttgcatgct

SEQ ID NO: 2455 - DNA, 444 bp, Triticum aestivum
  Clone ID: LIB3280-046-P1-K1-G6
ataccctcgccgtctcctctcccacgaagcgcagctcgtcgagatggcctccgaggcggcgaaggtgccggtgccggagtcggtgaacttcaagaggaagaggggagaggtctgggccgccgcgaagaagcagaaggtcgccgacgagaagaagaaggacgcggagaacaccaaggtcatctacgcccgcgccaaggagtacgccggggagtatgaggctcaggacaaggagctggtgcaacttaagcgtgaggcccggatgaagggtgggttctatgtcagtcctgaggcaaagctgctgtttgtcgtccgtatccgtggtatcaatgctatgcacccaaagaccaagaagatcttgcagcttttgcgtttgaggcagatttttaatggtgtgtttcttaaggtcaacaaggccaccattaacatgctgcggcgggttgagcc

SEQ ID NO: 2456 - DNA, 441 bp, Triticum aestivum
  Clone ID: LIB3280-046-P1-K1-G7
tttaaactcaagtttaacattgtcacatgatttccataattaagattcataattgtgatgcaatttcactagtacattcttctgagtttgatttctcccatatgcaacgcgagttgcacatgcacaatcaaacatttattttggagaacccactccatgcatgtgtcacttcaactccttggctttgccatgcctttggcagaaagacttgaccctctccatgccatcctcgagaaggcctggatcgacagcaaacgtaatacggagccagttcttcattcctagtccactccctgggcaaatgacgacggactcctcgcgggcgagcttggtgcagaagtcgacgtcgtcagcgatgccgtccaagcaggagaggtccagcttcaccatgacgaacatggacccctccggcttgtgcgggcaggtgatgcactcgatgcc

SEQ ID NO: 2457 - DNA, 427 bp, Triticum aestivum
  Clone ID: LIB3280-046-P1-K1-G8
tctcaccccaaagacaacagaaaaccttcttcacgcgcgcacgcaccaaaatcaccttcgatctcatcaccggggaagggggatggccgccgaggagggagccgtgatagcgtgccacaccaagcaagagttcgacacccacatggctaatggcaaggagaccggcaagctggtgatcattgacttcactgcttcctggtgcggtccttgtcgtgtcatagccccagtctttgctgagtacgccaagaagttccctggcgccattttcctgaaggtggacgttgacgagctgaaggacgtcgctgaagcatacaacgttgaggcaatgccgaccttcctgtttatcaaggatggtgcgaaggtggacactgttgtcggtggcaggaaagatgatatccataccaagatagtggccctcatgggttct

SEQ ID NO: 2458 - DNA, 419 bp, Triticum aestivum
  Clone ID: LIB3280-046-P1-K1-G9
cggacgcgtgggtggtcgccgaggttgacgacgatggagtggcgcgtgggcggcacgtccacccactcgccgtccctgagcagctggagcccgccgacgcggtcgtcctggaagagcaggatgatgccgccggcgtcggtgtgggcgcggaggccgttgacgaggtccgggcgcgggcagggagggtagctgctgaccttggtgccgaaggtgggggcgcccttggagccacggaacgcgcgcgtgaggtaccccttttccaggccgaggttctcgcagagcaggtccagcagccgctccgccagcctctccagctccgacgcgaactgcttcatcacccgcctgtagtcgtcgtcgaggtcgggtatctcggcgatgttgggctccgggaggtggcgcacgaagaaggtgctcttcca

SEQ ID NO: 2459 - DNA, 446 bp, Triticum aestivum
  Clone ID: LIB3280-046-P1-K1-H1
cgagtccgactacttcgtggcgtacggcgtcgtgttcaagaacgacgcgccactggccaagccgggggccaagggcgggcaggcggtggcgctgcgtacgttcggcaccaagcaggccttctacaactgcaccatcgacggcgggcaggacacgctgtacgaccacaaggggctgcactacttcaaggactgcgtgatcaaagggagcgtggacttcatcttcgggtttgggaggtccttgtacgagaactgccgcatcgtgtccatcgtgaaggagatcgccgttctcacggcgcagcagcggaccaagaccatcgagggcgctatcgagagcgggttctcattcaagaactgcagcatcatgagcgaaggcgggggggatatctatcttggcagggcgtggggggactcgtcgcgtgtcatctacgcctacaccgagatgagca

SEQ ID NO: 2460 - DNA, 423 bp, Triticum aestivum
  Clone ID: LIB3280-046-P1-K1-H10
gccccgcccccaaccacccacgcgccggcagcgagagctaggaggactaagatggcggcggacggcggaggggagccggaccacctggcgggggagagggcgacggcgcagttcgacgtcgacggcatgaaggtcgcctgggccggctcccgccacgccgtcgaggtcgccgaccgcatggcccgactcgtcgcatccgaccccgtgttccgcaaggataccaggacgatgctctccaggaaggagctgttcaaggacacgctcaagaaggcggcgcacgcgtggaagcgcatcgtcgagctgcgtctcacagaggaggaagcaaacttgctgaggctgtacgttgaccagcctggttatgtcgatctccattggggcatgtttgttcctgccataaaagggcaagggactgaagagcaacag

SEQ ID NO: 2461 - DNA, 438 bp, Triticum aestivum
  Clone ID: LIB3280-046-P1-K1-H11
gacgacgccgatcgtgtccgactcgcggcccgtcatcctgttcgaggagttcggcttcaagcccggcggcgtcgcgcaggtctccgtgtccggcgtctcatggagcgtccccgagggctccccgccccaagccgtcgatcccggtctaatgggcttcatcctcatctccaacaccctcttcttcaagatcaccaacgaatccgagtacgccgaggagaccgacagctccttctgcccgctcaccagcgagtacgtgatgccgctcttccggctcaaggacatcgggcgcgacggcgccggcgggggcaacgtgaccatcggcgacgccgaccagtacacggtgctgtttaagcagctgccaggacggcgttcaagatcaccatggacgtgcgcacggagaatgtacaacatgcccggccccagcggcgacagggagta

SEQ ID NO: 2462 - DNA, 420 bp, Triticum aestivum
  Clone ID: LIB3280-046-P1-K1-H12
ctacaaagagcatgatctttttggcgcataacgacaatgacattctccgcccaggggatattgaatcggtaccttttttattgaagcattaggtcaatttcaaaccataaagattagtaaagagcaactattccctgagtccccttttggggccttgccttctttttgtatatccatttctttagcatgatattttagcatgttcatctaacagacccttctttcattcctttatagcgccgtgcggttcattctcctttggtgatgggactcatggtcctatatgtgcatttggcaaccactggaagaacatgcgacgactgggctctcaagttcagttatcataattaacttcgatgctttggagtgttgtttctagctggtgtaaaattggcaatgacctatgttggagatctcacg

SEQ ID NO: 2463 - DNA, 441 bp, Triticum aestivum
  Clone ID: LIB3280-046-P1-K1-H2
gtgcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtaaacaacatcatctctgtctttctactcattttctagctgacggacggaagtcagtaacatcaattgtgtagaactagaattctagtctattaatgtatcaaaaatgtcaatcttatttgcaggtgtggcccattgagggcatcaagaagttcgagaccctgtcctacttgccaccgctcagcacggaggccctcctcaagcaggtcgactacctgatccgctccaagtgggtgccctgcctcgagttcag

SEQ ID NO: 2464 - DNA, 371 bp, Triticum aestivum
  Clone ID: LIB3280-046-P1-K1-H3
gccaagcagaaatggcggcttcctgcacgctcaccgtccccgcccccttcgccgccgcctcctcctcctcctccacttcagcccgtcgctacaggcgattcggggtggttgccatggcgagcgcggggcagaaggtgtacgctcccggcgtggccgtctccgagggcaacggcggcctgcccaagatcagcctcaaatccccgcacgggagtgaggctgaaatttatctgtttggagcatgcgtcacgtcttggaaagttcccaatggaaaggatctgctctttgtcagaccaaatgctgtgttcaacggccagaaacccatcagcggtggaattccacattgttttccccaatttggccctggccccatg

SEQ ID NO: 2465 - DNA, 353 bp, Triticum aestivum
  Clone ID: LIB3280-046-P1-K1-H4
cgttcgcccacgcgtccgcttagagaatgggggtttcatgacatcttcaagaaggtcaagggtgaggagaacgctaaggctatgtcactgttagagggagttgttcagcggaatgatgaaatagaagatggtgagaaacgagcagagaacttgatccgtggaatcttagcaagaaacatatttgacttaaggtctgcacagcttgcagaagtttttgctaaagatggcatgtccttcttggcgagttgccagaatcttttatctcgaccttgggttattgatgacctagatgcatttaaaagcaaatggaccaagaaatcttgggaaaaggcagttatttttggtgataattc

SEQ ID NO: 2466 - DNA, 457 bp, Triticum aestivum
  Clone ID: LIB3280-046-P1-K1-H5
ctgacgcgtcgccgcccccaatccgacccgaggcggctgtagactccatagagttgccgccgcgccctcagcgtccgcggctaccaatccgtcacaccggcgccgccccgccccaccccgcgcaaacccctccgcctctcacgcgcgtcgccgccgtcgccgttcccgttcccgttcaacccatcgcgtccctggtgtctcgaccccgtccgcaattttggccgttcggttgctgagatagtgttggagaaacttctgtgatcgtgtttttacatgtaaaagttaagggggggcaaacttatctgcaactgaaataagtggcgggataatatggttgacatgaacactgatcacatttttgaggttcctgacactcctgaccgagtacagcagtcagtgtgcgctgtatcaagctcagctgctacgagaggtgtaacaaggatggctggaaatcctt

SEQ ID NO: 2467 - DNA, 325 bp, Triticum aestivum
  Clone ID: LIB3280-046-P1-K1-H6
ccgcaacctacaaagagcaagatctttttggcgcataacgacaccgacattctacgaccaggggatattgaatggccccctttcttattgtagcattactgtagaatcttctcagtcaggggatcgcttattctccagtcccagtgtcagaaagttgatcctaaactacaacaccctcttcttcaagatcaccaagtactgctcatacgcgcgtattatgaacgcatacattgaggattacttgtcttctgcagccaagggttcgaagaaagaagctgcaacagctccaggactaggttatgtggatcttccaaatacacaaata

SEQ ID NO: 2468 - DNA, 406 bp, Triticum aestivum
  unsure (1)...(406): unsure at all n locations
  Clone ID: LIB3280-046-P1-K1-H7
gctcccctagcttttttctccctcccttcctccaatggccaccaccgcatccaagtacccccagcactacgacgacgatgaggatgacgacgacgaattcgaggacgacgacgacgatgacgatccctcccgcccgcttcccgccggcagcgcggaggatcgcctcgaggccgttcttcgccgcctcacggcggacgaggtccggatccgggtgcacgacgtcacgatccggggctgcgcccgcacgcgccgggccgccgcggaggcagcggtggggcaggacctcgcgcgcgccgctaccgtgccggagctcctgcgtgccgccgcagcgggcggcgagcggctccgtcgcctcggcgccttcgaatccgtttccataccctagacaccgngccaccgggggtcc

SEQ ID NO: 2469 - DNA, 447 bp, Triticum aestivum
  Clone ID: LIB3280-046-P1-K1-H8
aagatcactcatcaccaacgacaagggcaggctgagcaaggacgacattgagaagatggtccaggacgcagagaagtacaagtctgaggacgaggagcacaagaagaaggttgacgccaagaactccctggagaactacgcctacaacatgaggaacaccatccaggacgagaagatcgcctccaagctgcctgctgatgacaagaagaagatcgaggacgccgttgacgccgcgatccagtggcttgacgccaaccagctcggtgaggttgacgagtttgaggacaagatgaaggagctggagggcctctgcaaccccatcatcgccaagatgtaccagggcgccggtgctgacatgcccggaggcatggacgaagacgcgccggctgcgagcggcggtgctggccccaagatcgaggaggtcgactaaattaggcgcttttatat

SEQ ID NO: 2470 - DNA, 439 bp, Triticum aestivum
  Clone ID: LIB3280-046-P1-K1-H9
cccttctttccctctactcgccatcgaccgcacagccgccgccgcttccccggggataaaatggcgacggcctcttccttcgccgccgtcttcatcagcagcgccatcgcctcctgcttcgctgaggtgtgcaccattcctctggacacagccaaggtgcgtcttcagctgcaaaagaaaacagctgctgggcctgcagctacagtaggaatgctgggcacaatgatgtcgattgcaagggaggaaggcgtcagcgcactttggaagggcatcatccctggctttcaccgccagtgcctctatggcggcctccgtgtcggcttgtatgagcctgtcaaagccttatttgtgtttgtaggtgatgccactttaatgaacaagattcttgccgctcttacaactggtgtcatagcgattgctgtcgcaaatccaactgatc

SEQ ID NO: 2471 - DNA, 359 bp, Triticum aestivum
  Clone ID: LIB3280-047-P1-K1-A10
tgccctccacgaacccacagcgcgctcccgagatccgcatccgaagcccgagagaaaagcgaagcgcgagaggaaaggcactgaactagtttgcaacaaagaacagggaaaatggcctccgctgtggtgatcctgtaggagaatgtgctcatgggccagcttgccgagcacgctgaccatttcgacgaaatgggtgtgtccatggtgaaggaggacacgacttttttgatcgcgacatggacggtgtggatcccttcctcgtgactttcgcatactataatgcccttggatcccgattggcttcctgcaacttgattgcctccatttttaataacgtgcatagcccccagaccaaagcc

SEQ ID NO: 2472 - DNA, 194 bp, Triticum aestivum
  Clone ID: LIB3280-047-P1-K1-A2
cccctccacccctcgttctgttcttcatcacaattagctgccttttttttatgctagagagtggactacggggtcgatgtttagtttcatggatccagcctacccgttctggcttaaataaatcccctgtccctctcttcccattgtctttacctatgtccttattaattattcatatttttaaactattaatg

SEQ ID NO: 2473 - DNA, 168 bp, Triticum aestivum
  Clone ID: LIB3280-047-P1-K1-A3
cgccccccacgaacccacagcgcgctcccgagatccgcagccgaagcccgtgagaaaagcgaagcgcgagaggaaaggcactgaactagtttgcaacaaagaagagggaaaatgtctaccgctgaggcaacccgtgaggagaatgtgtacatggccaagcttgccgag

SEQ ID NO: 2474 - DNA, 295 bp, Triticum aestivum
  Clone ID: LIB3280-047-P1-K1-A4
attcccgctcgacccactcgtcctccttttgcggattgaccaccaaccacctccgtctatactgaccactccccccggcgcagatggagatactccgtgggtgcttctgtgccgacctcaacttgcttgagcccgggttggctaccgtcggaacggccgccgaatgttctccagaaaagttcaaaaatggctaggaaagcccagaggtcaagccttggtggaaaaaggacgagaacatggccgagtatggaaccacatcattcagaaaatggcacggtgatgcaaaggacaaaaa

SEQ ID NO: 2475 - DNA, 327 bp, Triticum aestivum
  Clone ID: LIB3280-047-P1-K1-A9
cgccccccacgaacccacagcgcgctcccgagatccgcagccgaagcccgtgagaaaagcgaagcgcgagaggaaaggcactgaactagtttgcaacaaagaagagggaaaatgtctaccgctgaggcaacccgtgaggagaatgtgtacatggccaagcttgccgagcaggctgagcgttacgaagaaatggttgagttcatggagaaggtggcaaagaccgctgatttggtgagctcactgttgaggagcgcaacctgctctctgttgcttacaagaatgtgattggtgcccggagggcttcctggaggatcatctcctccattg

SEQ ID NO: 2476 - DNA, 333 bp, Triticum aestivum
  Clone ID: LIB3280-047-P1-K1-B1
cgccccccacgaacccacagcgcgctcccgagatccgcagccgaagcccgtgagaaaagcgaagcgcgagaggaaaggcactgaactagtttgcaacaaagaagagggaaaatgtctaccgctgaggcaacccgtgaggagaatgtgtacatggccaagcttgccgagcaggctgagcgttacgaagaaatggttgagttcatggagaaggtggcaaagaccgctgatttggtgagctcactgttgaggagcgcaacctgctctctgttgcttacaagaatgtgattggtgcccggagggctttctggaggatcatctcctccattgagcaaa

SEQ ID NO: 2477 - DNA, 271 bp, Triticum aestivum
  Clone ID: LIB3280-047-P1-K1-B11
tatacgcttacgctttatccgactccttccccacgaaagcgtgtactaaatgtgatgagggattacttgttttatgactgcctaactcacgcccgagccaaagattctctcacacatcctctagttaggaaccgagatcgaaatccgtggccacctccatggtcgccgctatgttggggtgtctgatcagggggcttaccatgaccgtgctcatgaagtgctctacgaggtcttctacaataccttgtttttcgccgagattcatgcaatg

SEQ ID NO: 2478 - DNA, 375 bp, Triticum aestivum
  Clone ID: LIB3280-047-P1-K1-B6
actgggaatgcttctcctagctgggtaaccatttcagtgcgaccgtacacgcacattctggttccatctgtctgcctgatcacctttacttcccagatgaatgtcatttgaggggtcttctgacttttcgtccttgggctacttcgcgccgtccgtagggacgttctggacttatcaatgattttgagcagcagcaccaactcccacgggacatgttgcctttcggattgcttcagagatcaccggtgaagacgttgcggcagttccacgccctgatgttccacgcccgccaccgagatagacaaggcgaaagaagaaaacaacggttggctctctagtagattcggcaatgccaaatgatacatctacatcagt

SEQ ID NO: 2479 - DNA, 211 bp, Triticum aestivum
  Clone ID: LIB3280-047-P1-K1-C10
cgagcccttctcgcccttcgcgccgccgctgctgcaagcaaccgccgccgtcgtcgtcggagcttaacccctcgcctgacgccttggggcgcatgcacagtcgcgggaagggttatctcgttcgtcggcgctgccgtacaagaggactcccccgagcttgggtcaaagaccgccgtcgctgatgtcgacgagttgatcacgaaggctgcga

SEQ ID NO: 2480 - DNA, 121 bp, Triticum aestivum
  Clone ID: LIB3280-047-P1-K1-C11
tccactccaatccacttctcactcttactctcactacatggatgggaaactctcaccagcagcgttccgtatcctatataaagcatgacccggtcatgaacatgcgttaaagttaacatag

SEQ ID NO: 2481 - DNA, 426 bp, Triticum aestivum
  Clone ID: LIB3280-047-P1-K1-C12
cccactcgtacgataacttttgcttaatagtaaagatgaggagcaggatttgcactagtataaatcaatactgtcgatgcactgcgactcactgtgctgcatcatgctatttggttgccacaataatccacatggtcccaaggccatccccacggtattatttaacatgtgactgggatcagtcttattttatactatcagatgacgggctacataataagcaattaaagaaggcgatcgagtggtactgctggaaccatactacaaaatcctatatttattctggaaagaacagcactataagttcaagtcaattcgtgtcgacttaccatatcatattattatcaacgagaaagcttcagcttgttattattgttgcccgggctttaaatttgggctttacataaaaccattaactgttggcaa

SEQ ID NO: 2482 - DNA, 224 bp, Triticum aestivum
  Clone ID: LIB3280-047-P1-K1-C4
acggtcaccactactagtagtgtaggatttctacaccattccggcggtcggcatggaggaggagctgacgctggtggggtactggtcgagcccgttcgctttgcgcgcagcgcttcgccctcaacctgaagggcctcccctacgcgtacgtggaggaggtgggcctcttcgacgagaagagcccgttcctccttgcctccaacccggtgcacaagagggtgccg

SEQ ID NO: 2483 - DNA, 449 bp, Triticum aestivum
  Clone ID: LIB3280-047-P1-K1-C5
gcgggggaaggtgcagctgaagcggatcgagaacaagatcaaccggcaggtgaccttctcgaagcgccgctcggggcttcttaagaaggcgcacgagatctccgtgctctgcgacgccgaggtcggcctcatcatcttctccaccaagggaaagctctacgagttctccaccgagtcatgtatggacaaaattcttgaacggtatgagcgctattcttatgcaaaaaggttctcgttgcaagtgaatctgaaattcagggaaactggtgtcacgaatataggaaactgaaggcgaaggttgagacaatacagaaatgtcaaaagcatctcatgggagaggatcttgaatcgttggatctcaaggagttgcagcaactggagcagcagctgggaagctcactgtaacatatcatatgcatggagaaccaacttatgcccgaattcatttc

SEQ ID NO: 2484 - DNA, 174 bp, Triticum aestivum
  Clone ID: LIB3280-047-P1-K1-C6
cccactcgtccgtctctctctcggtcggccatagtgacttactcttcgcggtggatggtggagagggggttgttctcgccttctattctaggtgataggacgccttaggagaggtgcttccacccctataaaaccgtgccctatcggccgtatgtcccctccatcttccgccag

SEQ ID NO: 2485 - DNA, 364 bp, Triticum aestivum
  Clone ID: LIB3280-047-P1-K1-C7
ctcctttcctctcctccttcttcggcctcgccgccaatgccactgccacttgttgactgattcacccccacgccggccatttcgctttcgcacaagaggaccagagttcccatggaggaggagatgcgggtggcggtggtgggcgccggcgtgagcggcctggcggcggcgcacgagctggcccgggccggcggggctgcgcgcgtgacggtgttcgaggccgagggagcctcggcggccacgccaggaccgccgacgtctacggcgtccacctcgacctatgcttaatggtcttcaaccgggtgacatacccaaacatgctggaatggttcgaagagcttggcgtggagatggagatatccta

SEQ ID NO: 2486 - DNA, 305 bp, Triticum aestivum
  Clone ID: LIB3280-047-P1-K1-D10
gcgcccacgcgtccggcggtgttaatttttgttgcatgttctactgattgctgattctgatggaggtacaaatatccaatttgaaaagaaagagctttgcctccaactaccattgtttcttgacgtggtttctattaattagaagcaaggttcattctttaattgaggttttgtagttgaagcgatccacgtgaggccgcaaccatataagtgagatctactcctatgttccataatgtaagagtgttttggatactagtgtattataaaaaacgcttttatattatgggatggagggattagtt

SEQ ID NO: 2487 - DNA, 265 bp, Triticum aestivum
  Clone ID: LIB3280-047-P1-K1-D12
gccgccttcttcctattctcctcatccgcttcatgggcgcgctcatgttcgagtgggagctatggaggaggaagcagtcctacttgatgaggttcgtgcagctcgtgcgatgttggtagtacatagcagcatccctccatcgaacgtatcaccagtcccacccgccccgacagggcacgccgtcttggcttcaaagtcaaactaggttatgtgatctacgtatccgtgtgagacttgtgggaaggaagcgccccgtgcccaaggg

SEQ ID NO: 2488 - DNA, 327 bp, Triticum aestivum
  Clone ID: LIB3280-047-P1-K1-D2
actcaggtggccagtactctgatagcactacccacagggctgagaagtcactagatatgcatggggatgaaatattatatgtaggggaccatatttttacagatgtgagccaatcaaatggttcatttacgatggaggacagcattaatatgccgagaactggaagatgagtttgacgcactaatcaaaagccatgcttagaaagaaaagcttgtcacacttataaacaaaaggaaattgttggagacctttttaaccaactgtggctggctcttgtagagacgcacaaattttaagttcttgcacaggaacgcttggttgcatact

SEQ ID NO: 2489 - DNA, 380 bp, Triticum aestivum
  Clone ID: LIB3280-047-P1-K1-D3
tgcccgtatcaacgcacaggcgtactcctctcgattctccgttgagcgacgtcgcaacttgttctccaactctgcggatgtagagagagagagagcatcgtgactgccatggcttgaactattttgttgagatcctggaaaaattgaatggtataattctgttaattgggaaccttggaattgattttcacctgaaaaggttgatcgagggtcggataatggacgtaaccagctgctagagaagatattataatatggaaaatagcatttgaggaggaagctgaagttggtagatcaattgagcatgagttccagacccaggttacaccatgaacaagtgcctcaaatattcattatccagcagcggaaggatcactccc

SEQ ID NO: 2490 - DNA, 140 bp, Triticum aestivum
  Clone ID: LIB3280-047-P1-K1-D6
attattttttttttttttttattttttttttttaatttttatttgtgtttttatgattttttagtagaatagaatattggataaaaaaatatggataggtatattatataaaaaacagaaagaaaatgcataccgaattt

SEQ ID NO: 2491 - DNA, 151 bp, Triticum aestivum
  Clone ID: LIB3280-047-P1-K1-D8
tcgattttgattgcataacataataattcaatcgcgtctaaagttttgattcacatgaggacagcttattcccagctgccatgattctacaaaccattgcgctacctaaaagattgtttctagctccaacaattttgtggggaaattgcaa

SEQ ID NO: 2492 - DNA, 168 bp, Triticum aestivum
  Clone ID: LIB3280-047-P1-K1-D9
cttcggctacctacaaacacatacgctctcgcttggaagttcggatatgttctaactcttcttcggcaacgattagctagataaataataactaggcctcagtccggcatggctctaactatcataacgaggaccatgtatagatcttaggaatctgtcagtgaagtg

SEQ ID NO: 2493 - DNA, 446 bp, Triticum aestivum
  Clone ID: LIB3280-047-P1-K1-E10
cttggtctctctagctccttagagttccctaaccagaagcttctaggctatagcctctatgccctagctaacttatcttttagttaaccaaggctttgcagtcagcaagaagtaccatatattttcattaccatgggtggctacggcgacttgttcgagaaggccaagccctacattcgtcatgattctggttgcagatcggctatgccggtatgaacgtcatcccaaggtctcgctcaacggtggcatgagccactacgtgctcgttgtgtgccgacacgccttctgcaccgtttacatggggccatttgccctaattttcgaaagaaaggtgaggccgaagatgacgtgggcgtccttccttcagatcttcgtgctggcactgttcgggcctgtgactgaccagaacttctacttatgtgggtctcaagaccaccggtccaacc

SEQ ID NO: 2494 - DNA, 313 bp, Triticum aestivum
  Clone ID: LIB3280-047-P1-K1-E11
cccacgcgtccggcaaatcatcacaaaggattttgtccagtttgccgcaaagtgtttgatgaaaaggacattgagcatgttcgtgatctgttggatgcaaacacttctcagctgatggcatgtttaacagttgaccttggagtagatgataaagagttgctccattccgaggcagagaagaagaggagagaaaaatttgggtcattgtttaatctgcaacaagaacggaatggtttaattgaaccaaagaaagaccttgccatacagcccggaatgtatgtttctcttgctgctagtgagccaaccacaagtg

SEQ ID NO: 2495 - DNA, 438 bp, Triticum aestivum
  Clone ID: LIB3280-047-P1-K1-E12
cccacgcgttcgtccacgcttcctgaaggcaacaactgtagtacgtacgtacggatgtgggctagcctcctcctgttctgcacgccatggcgctgctgaagaagaacacgagctccctgagcttcgccgtggccaccctcatggaggtcatggctgccacccttctcctgtcctcgagcgacgcccgcaaagtgatggataagcccaccgctttcctcgtgaggggaagggcttctcgaggcttttcccgaactgcaccgagcagcggagcaagaagttctgcgtccagccacttgccggagccggctgctataaccaatcccactgttgctgccctaatgctcaatattaaccgccgctaaagcaaccggccttaaaaatatttctaggtaaagatggcaataagcaaaattcgtgcacttcactaaatatacttcc

SEQ ID NO: 2496 - DNA, 329 bp, Triticum aestivum
  Clone ID: LIB3280-047-P1-K1-E3
ctgactcgtgttatctaatcaagctctcttctcctttcgagctccacggtttccagcaaggaagccgaagcactagatcctagatggttcgcgtggtactggtcgccgtgttcgccgtgctcgcggcactggcggtggcggacatggcgtccggggcggtgacctgctgcgacgtgacgtccgccgtctcgccgtgcatgtcctactcgtcggggaaggcgttggccccttgggtgcgtgctgcagtggtgtgaggaccctgaacgccaatgcgttcacctccggcgaccggaaggcggtgtgcaactgtcgtaagaacctggcggggt

SEQ ID NO: 2497 - DNA, 381 bp, Triticum aestivum
  Clone ID: LIB3280-047-P1-K1-E4
tctttcgcgtacccgttcgacgagggaggattaaataattcttcgccacgccgtccgccgactcgtctaccgcgccgccgttgtctgtagtggcttcatgagccgcagggccctcgcgacggcgcaggcgcccgcggaggcggtcgaggaccccgccttcctggaggcgtggaagaaggtgacaacattcatcgagcccccccatacgcccatgtcggccatgaatccccgccgcccacgccggtctccatcccctccaagcttaccgtcaacttcgacctcccctacaagtccgtgatcaccgactaggatgttgacatggtaatgggaccggtttcatttggcctgatggtgtttatgccaggccatgtcttccaaatt

SEQ ID NO: 2498 - DNA, 322 bp, Triticum aestivum
  Clone ID: LIB3280-047-P1-K1-E5
tcgtccctctttctcaaagctccgaacttctgctccttactcttctcatcccccactctctgaaccaatatcgtgagccaggggctcgccgattcccaatggcgcgcgtccacctccggtccctccacgccctcctcggcggcggcgcaagtacgcacgcacgcacccccctccctattccgccgatctgcgggactgactgactgaccctgccccgccgctggtcgcccagtcgccgacctgtcctctggaggcggaagaacgcctccgcggtggccgtcgcaggcgccacgcttgtctggtttcttttcgagcgcgccgg

SEQ ID NO: 2499 - DNA, 378 bp, Triticum aestivum
  Clone ID: LIB3280-047-P1-K1-E6
tctacggtacaaaccctagccttacatcccacgctacgtccttctccattctcgttagccgccgccgcctgtctgcctccctcctctctaccctacaaccacgccggcggaaggaagcctccgttcgtggcgccataccactgccggtgtgctgtgcacgcttcgttccccacagcccctccctcatcctcgctcggcaccgtcgctgcctgctactcccctccaccacgttgctacttgtgggtcgaatctagcattggcggccatcttcgttccaccccgagcttctcatcctccttccttgcttctctactcccacacgaaggaagaagatgcaaatggcgtccggcttgggagatagctcgcccggctgcaggg

SEQ ID NO: 2500 - DNA, 132 bp, Triticum aestivum
  Clone ID: LIB3280-047-P1-K1-E7
tccactcgttcgcatgaatcatccctcaaccacttttttaggttcgatggccaagatcacgagcatctcatttgcgctattccttgtgcggcggtgtgcattcatgtacgaacggggtgcttctcatgcttt

SEQ ID NO: 2501 - DNA, 336 bp, Triticum aestivum
  Clone ID: LIB3280-047-P1-K1-F1
tcgcattctcgcctattgccgcacactccctcggatccgctgtttcacccccctattacgttggcgcacgcccttgcacaagcaagcgatcaaccatgtcgacggcggtgcagacgctatactagagcgtttacatggccaagcttgctgagcaggcctagcgctacgaggagatggtggagttcatggagcgcgtcgcgaacgccaccgtcggggcacggcccggggggagctataacttcaggaacgcatccggctctttttggctgacaagaatttcattcgcgcccggggctcgtcctggaagatcatcttctccattttgcatatggttga

SEQ ID NO: 2502 - DNA, 447 bp, Triticum aestivum
  Clone ID: LIB3280-047-P1-K1-F10
atttttcatagactaatctacaatcacaagcattgtgtatttctacggcatcataggatacagttacccttgtaggccatattgtgactaggaatcctgatactaatcatgttaaaagaatatactacgtaataaaatcagttgaagaagacttggacctcaatttgaaagttggtgagcggctgaaaatcacttcacttggcttaaagatatctgaaaggctacgtctaaggagggttcaccatgcacatttatgttgtcatccgagggattggctttgctggtttcttacatcaccaaacatattgtatttgcatctgcaatagatcttcagcacctcttacaatacagaatcattcaattccctgattttgtggatgctaaattccgggagcaagcttaagctttgctacaaagtctcttgtgttttatatttacgcgaagggc

SEQ ID NO: 2503 - DNA, 144 bp, Triticum aestivum
  Clone ID: LIB3280-047-P1-K1-F11
tcggttggaacaaatatgtatgactctcattcatgcggtgagcgtgagattcacagaaccatgttggatttgttaaatcaacttgatgacttttattcaagaggcgtattaattggttattctttcgacaaaccgcattgagag

SEQ ID NO: 2504 - DNA, 412 bp, Triticum aestivum
  Clone ID: LIB3280-047-P1-K1-F12
tcttcctatcaaccgcgatggcctgatgaacatccacatgccggcgtacaagaacgccatggacaagggcgtctccactgtcatgatcttctactccagctggaacatgcttcaaaatgcacgccaaccaatacctcggcactcggataccttaaggacacgctctaattccagggcttcctgatctcggactgggagggtattgacaggatcaccacccctgcgggatctactactcctactgaggcaaggctttcattcttgccaggcttgacatgatcatggtgcccaacaactaccagcatttcattagcatactgactggccacttcaacagcggcgtaatcatcttgagcaggatcgaccactccgtgacccgtgttcttcgtgtcaagtataccatgggcctttt

SEQ ID NO: 2505 - DNA, 258 bp, Triticum aestivum
  Clone ID: LIB3280-047-P1-K1-F3
atgctctcctagatcggtagatgacatggctcacctgacggcactactcctcgcgtccgggctcgtcttcatcttgagtgcgacacccacgctgagcattatcactggcggaggcggcgcgactgcttggcagagtaccagcctcaaccatggcgccgctcgaacttacgtagtgcttttttagcctacagggcacgcgcaccactctgactaatccgttcaccgagatggcacgagtctttcctgccgccggggtcc

SEQ ID NO: 2506 - DNA, 307 bp, Triticum aestivum
  Clone ID: LIB3280-047-P1-K1-F4
tttctcatcatgatcaaaaaatggcgtcgggtctctgacgcttcttatgggaaaaggtcggcgttggcttccacacgaacgcggcggcgtactctaacacatatcattatccaaggcaggtctacagctatgaacaaaagcaccctcgtcctacgcgccattataacccacttacagctcgtagagcctccttggcacgcccaccaggcatacaaaccctagcaccaacaggggacgatgtgctactgctgccgacacacatccctgactagacaggcagacgcgactcaccgcccattctccagtg

SEQ ID NO: 2507 - DNA, 104 bp, Triticum aestivum
  Clone ID: LIB3280-047-P1-K1-F5
agaaagagggattgcccagcccttcgtccccatctgtccgttcctctccctctccctcggccatcgtcggcggtgacctcccccatggtctgatcgcccgccac

SEQ ID NO: 2508 - DNA, 440 bp, Triticum aestivum
  Clone ID: LIB3280-047-P1-K1-F7
atccgttcaggtctagttgtttgacagctacaatctgatcatgcatcagaaagataattgaagcaaaattagcagattgttacatgtcaataggactatccgaagaatgttcgtcattgggttgttcctgtatatacctggccattttcaagctgtcccttgtagaccctgccaaagcccccctctcccaaaaggttgtcggagcggaagttcttggtgctgtcgctaactcacggtatgtgaatgctcttgcatttttggccatgctagacctttctgcaggttcaccgtttgcttttatttcggatgatgattgcccatgtttcagaccctttgcaaggtgaagtttcagtatttgttagcggagaactccatttttgtgcttatttgaaggatcctagttttgcctctcgacgaaattcaaacagttctgcttcaat

SEQ ID NO: 2509 - DNA, 225 bp, Triticum aestivum
  Clone ID: LIB3280-047-P1-K1-F8
tcccccacgccttcgcctaggcgtgcacccacgcgcgctgctcaatgtcaataagggagtctgaccaaatcataagccgctgatcgtacgagggccttgcattccatcgggttatcacagacacattgtgccagtacagtctctatcctaggagcggcggaacctacatcaagatcatctgctgctcgaagacaaccgaaatggatgtccagaaccttctcacaa

SEQ ID NO: 2510 - DNA, 333 bp, Triticum aestivum
  Clone ID: LIB3280-047-P1-K1-F9
tcggcttgttggtggttccaccagaatccccagagttcagcagctgctgcaggacttcttcaacgggaaggagctctgcaagagcatcaaccctgatgaagctgttgcctacggtgctgccgtccaggctgcaatcctcagcggtgaggggaacgagaaggtgcaggaccttcttctcctggatgtcaccccactgtctcttggtcttgagactgctggaggatcatgactgtgctcatcaccaggaacaccaccatccccaccaagaaggagcaggtcttcttcacctactccgacaaccagcctggtgtgcgtattcaagtggttgatggt

SEQ ID NO: 2511 - DNA, 141 bp, Triticum aestivum
  Clone ID: LIB3280-047-P1-K1-G1
ccacagttccgtctcgaattccagtcgcgcaccgtcggttgtcggtggttgcaccagaacttctgactcacagctgctgaggaattagaaagggtaaggagcgttgaagagcattatccctgctgaattggtgcctacgga

SEQ ID NO: 2512 - DNA, 423 bp, Triticum aestivum
  Clone ID: LIB3280-047-P1-K1-G11
attcccgcctcgccccactcttccgctccctcttccactccctccggcgcgcgcaagctagatcgttcgccctgtgccctagaacccgttggcctcgcgccttgccaccctcttcaaggtcatcatccccggcgacagcggggttggcaagacttccttgatgaaccaatacgtgaacaagaggtgcagcaaccagttcaaggttccgattggcgccgatctcctcaccaaggaggtgcagttcgaggcaggctcttcaccctacaaatatgggatactgccgtgcaggagaggtttcaaagtcttggagttgcattccaccgcggacgcagattgcgtgtgttctagtatacgatgttaactcgatgaaattatcttgatgatcttaactactggcgtgaagagctcctaatctcaggccta

SEQ ID NO: 2513 - DNA, 240 bp, Triticum aestivum
  Clone ID: LIB3280-047-P1-K1-G4
attcggacaattctctgatcgctggacagatcacctctacggatgttgtcaaagttggcggcagcacctccatatgtcttccttcccaccgatagagggaagctgcgcccagagatccaagttgctgctcataactgctgggagaagaaaggcggtgctttcaccggtgaagacagtgctgagatgcttgtcaaccttggcgttccctgggtcatccttggacactctaaaggaggagct

SEQ ID NO: 2514 - DNA, 303 bp, Triticum aestivum
  Clone ID: LIB3280-047-P1-K1-G5
ggcggggcaaacggtggtgctaatgttgggcttgaaaagggtatcggtgctaatattgggcttcaaaagtctatcggtgctaatgttggtgttggtgcgaatggaggcgctggtgcgaatggaggcgctggtgttggcgccggccttggagcaaatgtaggtgttggagcaaatgtaggtgccaatgctggtcttggtgccggtgcaaatgcaaacggtggtgccgggctggtgtgaatggaggcgctaacgttggagctggtcttgagacaaatgtaggtggcaatgctggtattggtgtca

SEQ ID NO: 2515 - DNA, 288 bp, Triticum aestivum
  Clone ID: LIB3280-047-P1-K1-G7
tcgcggacgcgtgggcggactcttggtttttttccctctcacatgcccctcaccaccaaatgaagcaaacgcggacttcgttcttgagacgcacgcaccgtaccgcaccgtcctgtgtggtgagatctaaaattcccgatccgaccccaccggtggcgatggccggcaaggagctgatcgaggagcaaattgcgttgatgcgggaggcctttttccttttcagactgacggctacagtcgcatcgccccctcggagcttgtggtacttatgcacttcctgggggggaa

SEQ ID NO: 2516 - DNA, 150 bp, Triticum aestivum
  Clone ID: LIB3280-047-P1-K1-G8
gcaaaactttccgcttgatatttaagaaaactgttagaaaactgtaagagtaagcgaattgacatttgtcccacgatggtcgatatcatttatgaatctctactgaaatttggtaggcacaggaacaaattatggcacttatttcgatgt

SEQ ID NO: 2517 - DNA, 369 bp, Triticum aestivum
  Clone ID: LIB3280-047-P1-K1-G9
ttcctctcttttgtggaatcaccgccgccgcttggttctccttttcctacaccatcaacctgttaaaaggtcctgggggcaggcaatggcccccttccccgaagggtgcttttacaggaaccctcttggaagcgcccaagtctcacacagaatcccacaaacaaggtcaccgctgtgcctgcagataagaaggaaatctgtggtgcaactttcatggtggagggtctaccgttgtcgcggcacttcaataggagattctctcgtctccgtcgctgggcaaaacaggcaaggccgttctcctgtatatggtggtggggtaatataataaaacaaggcgcgtgcgctactcctcttgtgatcttatgtgaa

SEQ ID NO: 2518 - DNA, 164 bp, Triticum aestivum
  Clone ID: LIB3280-047-P1-K1-H1
tgtcgttcttatgttgaatcaccgccttcggctgcatctccttctccgacgacatcgacctgctgaaaggatcttgcggcaagttactggcgccttctccgcaaggttgcttctactggaacgctgttggaggcctgaagccgtacgagaattcctagaacaag

SEQ ID NO: 2519 - DNA, 280 bp, Triticum aestivum
  Clone ID: LIB3280-047-P1-K1-H4
caagctctcacctacattctagctccacggttaccagcaagcatgcctaatcacgagatcctctatggctcgcgtggcactggtcgccgcgttcgccagtgctcgcggcactggctgtggcggacatggcgtccggggcggtgacctgcggcgacgtgacgtccagcgtcgcgccgtgcatgttccacgctgtggagtaggcgtcggatccctcgggtgcgtgctcgatcggggtgtggaccctggacgccaatgcgttcaccccgtccgtccggtaggc

SEQ ID NO: 2520 - DNA, 291 bp, Triticum aestivum
  Clone ID: LIB3280-047-P1-K1-H5
cccacgcgttcggagttataaggtgttgttgactccgtcccggccgttggaacgcatgatcaccgcccccgttccaaagtaaacaatcatacatcgtcaagtagcgctgcacccgggatcaatgcaacctgccaaaccaagccaaaccaacacatcatgcccggccgtgtttaaatgcgaccctttttggtggggtttaggggggggccattcgcgctccaagggcaagaagtaggccgagaagaaaggcatagcgccggcgcccttcggcagcgcgcccggcgacgcgcc

SEQ ID NO: 2521 - DNA, 343 bp, Triticum aestivum
  Clone ID: LIB3280-047-P1-K1-H7
tcttgcaccctatctgcatacgtttcacttagatatgatatatacatacttaaaagcttcagcgcctgattaggcgccggaggaggaatgcccccacatgcatcggcatgatcattctaagactgtccacattagcgggttgcggtgctacaaggctcaggttgaactggcgtgtggtattctggaaaatgcccgtgtacttgaccacatggatgttcaacaagggtcggggtcgcaatatagtggatatgctgacctgaaaaatgttgatggtgaaagaagatttttacccggggttttagagtgggcacggcttacttcagatcgctgtggtaaggcgatc

SEQ ID NO: 2522 - DNA, 157 bp, Triticum aestivum
  Clone ID: LIB3280-047-P1-K1-H8
tccccgcccgccccacgcttacgcttgtatgatgttggtgactcaacttttggacatattattattcaaagtaagagggatcgggtggtgttaacaatcactggaagggtaaggatggccgtttgacaataccagataccaatatttttggggaaac

SEQ ID NO: 2523 - DNA, 342 bp, Triticum aestivum
  Clone ID: LIB3280-048-P1-K1-A1
cgccgccgtcgctgccttctctactgcaccgccgcagccatggtgaagtactcgacggatcccgccaatcccaccaagtccgccaaggccatgggccgggacctgcgtgttcatttcaagaacactagggaaacagcgtttgccctgaggaagatgtcgctcaacaaggccaagaggtaccttgaggatgtgttggcacacaagcaagccatccccttccggaggtactgccgtggtgttggacgcacagcccaggtgaagaaccgtcagcccaatggtcagggacgctggcctgccaagtctgctaagtttcgtctggatcttttaaagaatgcttagagc

SEQ ID NO: 2524 - DNA, 431 bp, Triticum aestivum
  Clone ID: LIB3280-048-P1-K1-A10
cccacgcgtccgtagcaatcaaatctcttggatcaaccgaaaagatggcctccgcctccaggatgctcacggtggcggtgctggcggcgctgttcgccggcgcgatggccgtgaaagtgaagttgacggtgcagaaggggtcggacaaaaagaagctggcgctgaagatcgactacacaaggccaaacgacagcctgtcagaggtggagctccggcagcacggctcagaggagtggcagcccttgaccaagaagggcgacgtgtgggaggtctcgtgctccaagccgctggttggccccttcaacttccgctttttgtccaagaatggcatgaagaacgttttcgacgaggtcttctccaccgatttcaagatcggcaaaacctacgaaccggaatattgatccacaacgttcaagtttcagttgatcaag

SEQ ID NO: 2525 - DNA, 337 bp, Triticum aestivum
  Clone ID: LIB3280-048-P1-K1-A11
cccacgcgtccggcgtgagcatgctagaacagctcacttgcttgcaaagcctgcccttgtagatatctcaaggaaaaggtcttgggatcgccttgaacgtgagcaggagtttggtgatgtgattagtgcaatcaggtcacagaatcctggtgcagtaatagctggtgactatgttattgagactagagatgcaatgtcttctgatgaagattcttgggaagaaagtggtgatgagtggtggtcttctgcccaagaccaaagtttaatcaccggacaacccgaatcgtgccccctaggccctggcttgaatggaaaactttggatcaccctaccattt

SEQ ID NO: 2526 - DNA, 356 bp, Triticum aestivum
  Clone ID: LIB3280-048-P1-K1-A12
gcggtcgccgccctcgacgcccgcgccctcttctcccctcccaccgccctcccctcctccccctcctcccgcctccgcctcgccgcccgtccgcgcgcgctcgccgcctcccccgccttcgtcgccgccacccccaagcagcgcttcctgaccccccacccggaccccgccggtggccgcggcaccagggatgtcgtcgcgatggttatcccgttcctgaggggaacagcgtttgagcagccgccgccggatttggcctcattcctttacaagaacaggatcgtgtacctggggatgtgcctcgtgccgtcggtgacggagctcatgctcgccgagttcctctaccttcaggacga

SEQ ID NO: 2527 - DNA, 381 bp, Triticum aestivum
  Clone ID: LIB3280-048-P1-K1-A2
cccacgcgtccgggtggaggaggctcaccgccgcgagaggaagatccggtagatcggagaagaagggtttgtcagggagcgatggatgaggagtacgacgtgatcgtgctggggacggggctcaaggagtgcatcctcagtggcatcctctccgtcgatggcctcaaggttcttcacatggacaggaatgactactacggcggagaatctacatccctgaatctggccaagatctggaagagattcaaaggcagcgacaccactcctgaccatctgggtgtcagcaaggagtacaacgtccacattgtgcccaagttcatgatggccaacggtgcattggtaccggtcttgatccgcaccaacgtgacaaagtatttgaac

SEQ ID NO: 2528 - DNA, 433 bp, Triticum aestivum
  Clone ID: LIB3280-048-P1-K1-A3
ctcccacccgctccccaccccccgcgccgccgctcgtcggagccccgcctcgccgtgtcaagtccgctcccaatcgagccctgaatggctgccggcaggggcattaaccagcttctgaggaaaactcttcagagccagtcttctggctcatctctgctttcttcatttcggggaaagcatgaagagtcctctgctggactgagagcattggctcttcttggagttggtgcttctggtcttttaagttttggtacgatagcatctgcagatgaagctgagcatggtttggcagctgcagagtacccctggccgcatgctggcatccttagctcgtatgatcacgcatcaatccgccgtggacatcaagtttaccagcaagtgtgtgcatcttgtcactccatgtcattgatttcataccgtggatttggttggg

SEQ ID NO: 2529 - DNA, 436 bp, Triticum aestivum
  Clone ID: LIB3280-048-P1-K1-A4
cggacgcgtgggctcaagttgttgatgatgttttaagtgaacacatcacaatgttgaaacttgacgaagataaccttgcgacgaagaacacctcaagtgattcagttcaagcccaagacgacggacctgttgtggcggctacaagaatatatgatctactatttacttggagatcagcattgtcaaaagtttatgtttggtatgccagctttggttcaaacatgtggaaaccaaggttcttgtgctacattgaaggggggaaggttgatggtatgagtatatcatgctttggttcacatgacacaagcccaccaagaggtaccatgtggaagactgtgcctcatagattggtttttgggagatcttctaccccttgctggggtaccggtggtgttgctttcctcaaccctgagataaactcaatgatgagtcatat

SEQ ID NO: 2530 - DNA, 414 bp, Triticum aestivum
  Clone ID: LIB3280-048-P1-K1-A5
ctaatctaaaaagtactgcggaccagtggatatgtggtgctgctcctattacgcctatgatgactgtaaggggatggtcgcgcggtcccactgccagtcaaattgggaagcccgctgtccacatggtaagcgtcgacttaaaaggaaaagcatacgagctgctgaggcaaaactcttacagccttctgatggaagacatgtacaagaaccctggaccgctgcaattccaaggaccgggtgccgacgcaaagcccatctcgttgtgcgtggaagaccgggactacatggggaggatcaaacagctgcaggagtttcttgagaaagttaagaacatcgtcaagcctgggtgcttgcatgacgtgctgaaagctgcacttgactccatggcacaatgtgacggactgctgaccatta

SEQ ID NO: 2531 - DNA, 373 bp, Triticum aestivum
  unsure (1)...(373): unsure at all n locations
  Clone ID: LIB3280-048-P1-K1-A6
ggcatccccatctgattttgtcactccgtcggaggtgagatccgggcgtcgatggaggggagctcggggcctcgctggcctcgccggagttccacccaagaggtaggcagccctggcggcggagcggacctcatcagcgccctccccgacgaggtgctcctcctattcctcgcccgcctcccctgcgccagcgccgccgcgcgcaccagcgtnctctcccgccggtggcgcggcctctgggcgctcctccgccagatcgtcttccgcgacgtgcccttcccctcgctcgaggcggcgctcggccgcgtnctgcctcccccgcacgcggtttccctgctcgaaatctgcgctcccgaggagcagtggacagaca

SEQ ID NO: 2532 - DNA, 416 bp, Triticum aestivum
  Clone ID: LIB3280-048-P1-K1-A7
actagctggcctgcttcgcgtgagttcatccatccatccaccatggcctccgaccgcctcgccgccctcaaggccttcgacgagaccaaggccggcgtgaagggcctcgtggacgccggcgtcaaggccgtcccggacatctttcgccaccctcccgacccgctctccccgtgcaccaaggtcgccgccatcccggtcgtcgacctctcgggtccccgctcggaggtggtcggcgcggtgagggaggcggcacggacggcgggcttcttccagctggtgaaccacggcgtgccggaagcggtcatgtctgggatgctggcggcggtgcggcggttcaacgaggagcccggggagggcaaggcaccctactacactcgggacgccgggcggggcgttcgcttcaactgcaacgccga

SEQ ID NO: 2533 - DNA, 420 bp, Triticum aestivum
  Clone ID: LIB3280-048-P1-K1-A8
cggacgcgtgggacaaacccccctgacctatatgcaaggttcataaaggcactctacaacttgcttgatggcacttctgataataccaagtttgaggatgactgccgtgctattatcgggacccaggcatacgttctctttactttggataaactgatatacaaagttgtgaagcagcttcaagctatagcaacagatgaaatggacagcaagcttctccaactttatttatatgagaagtcaagatcccctgggaggctctttgatctggtctatcatgaaaacgcccgtgtcctactccatgatgagagcatgtatcggatcgaatgttgctcaagtccaatgaggttgtctattcagctgatggagtatggtcatgaaaagcctgaggtgactgctgtatccattgagccaaatttt

SEQ ID NO: 2534 - DNA, 420 bp, Triticum aestivum
  unsure (1)...(420): unsure at all n locations
  Clone ID: LIB3280-048-P1-K1-B1
gggcgccaccgtcgaagccgctgccctcgctgaagccgaaggatttgggccaacagatggtgcatcaactggcagtctgttccccccagatattacattttacgtggatggaaaacctattgaagctcatcgggtcatcctttgtgctcgatcgcccttctttgaacagaaattcgagacagactggaaaaacaggaaggaagtgagattttctaataaaaaattatcttttggtgctttgtacaaccttatccatttcttctatgccgatagactcgaggctccagtagatgaaatggaaagtctgtcacgcacttgcaaagtttgcaagtgtgaagagctgcgtaagttagttgagaaagaaantctgcatcttaggtttgcactgtttaagtcaacaaggtagtttgggtttgaaaa

SEQ ID NO: 2535 - DNA, 296 bp, Triticum aestivum
  Clone ID: LIB3280-048-P1-K1-B10
cggacgcgtggggccgccactcaccaccaccatctgctcctcgccgccgccgcaccttcgtgtcgccgccgccgccgacaaaagggaaagatggtccgcgtactcatcttctgccatgcggacctccaagccctgcggaaccgctccgatcagctcctgtctgtacagctcgtctctctggattccgtgcgcatagcgagcgactcgtgtaagctcctcctcaacctgattgaggggagggactatcccaagaaggtcaagctgattgagcggaggtactggaactgccgccagat

SEQ ID NO: 2536 - DNA, 442 bp, Triticum aestivum
  Clone ID: LIB3280-048-P1-K1-B11
cccacgcgtccgcggcttcttggttcccccgtcgatttcctcctccctctcccgcgttcttgatccgaaggcgcgtgtgttttctgggcaatttccggcatcagattgtcaattggatccatttcgatccgttcctggtcttcttgaaccgagcggcgggctccgtgattggttcttgtgtcgccctggagcattctcgcgcgagaccaagatgctctacttgaagcagccgcagaggagctagctgaaccacgcggagtctccgtttgcttgctctgaatttctcaggctcggattcgttctggccctcttgtctgcctgcgtgttgatctgaatttctgatccgatggaggccatgagaggcggcaaattcctccagaagttccggctctacgaaaccagatcgaaattttatcttgtcggaagagacaagagcacgact

SEQ ID NO: 2537 - DNA, 429 bp, Triticum aestivum
  Clone ID: LIB3280-048-P1-K1-B12
cccacgcgtccggatgattcagataataacaagtgggagtacaccttgcatgatgttgtccgctcgtttgctcaatttatggctaaagaagaagcgtttgtggttcacaaggatcgagctgacattagaaatcttctaccagaaaacaaattattttgccgtctctcaataaaatcaattcattcagaactagagttgaccatcctagagaagcaagaaaaactgaggacattattgttgataggttgtaagattaaatctggtggctcattggcaaattttgctaatctacgggtactggatataagctctgagaaatctgattggttagtggattctttgagtgagctgaggcacctaagatacttgtcattctccaacacatacatatgttggcttcccggtgacatccataagatggggttcctt

SEQ ID NO: 2538 - DNA, 441 bp, Triticum aestivum
  Clone ID: LIB3280-048-P1-K1-B2
catggattgacagaccgagagcttcagcgaggacacgaagctggtgcagctgatgacgtcggccatcatccccggcctgcagggcgacgtctccaccaagcaccccaggggcgtccccttcgtgggcgggcccaagcacgtggccgcctgcgccaagcacttcgtcggcgacggcgggacgcaccacgggatcagcggcaacaacacggtgctcagcttccacgacctgatgcggatccacatgccgccctactacgacgccgtcatcaagggcgtcgcctgcgtcatgatctcctactcaagctggaacggcgtcaagatgcacgagaacaagtacctcatcacccaaatcctcaaggagaagatgcacttcaggggttttgtgatcacggactggcaggcggtggacaagatcaccaccccgccgcacatgcactacta

SEQ ID NO: 2539 - DNA, 342 bp, Triticum aestivum
  Clone ID: LIB3280-048-P1-K1-B3
ggagtttcaacagttctgagcttgctagatcgttctcgtgaagaattacacaagttgcttcaaccgttttctgctgcagagttgtatcaggatctgcaacatttccctcgccttgatgttaaagttaagctacagaatgaagataaggagcagtcaaaacctcaaatgctgaacattagaatgcaaattaaaaatacgcgtcgttcgccaagagtattttcctctaaattccctaaggcgaaacaagaagcctggtggctggtcctggggaatattacaagctcggagctatatggtctgaaaagaataagttttgcagatcgtgtgcttaacactcgcatg

SEQ ID NO: 2540 - DNA, 438 bp, Triticum aestivum
  Clone ID: LIB3280-048-P1-K1-B4
ggggggagcacatcaaattctatcaaagagcttatcagcaatgctactctgaattatagtgacaaccggataaagaagcctaaggctgtactcatcatggacgaagttgacggtatgtctgctggtgatagaggtggagttgctgatcttattgccagcatcaagatatccaagattcctatagtttgcatttgtaatgatcgttatagccagaagctgaagagccttgtaaattactgtttgctactcaacttgaggaaaccaacaaagcagcatatgggcaagaggttgatggagattgccagaaaagaaggcattcaagctcaagagaatgcaatggaagagcttgcagaaagaggacatggggatattcgcatggcacttaaccatttgcaatacatgagtcttctccagtctgtggtcaaatatgatgacata

SEQ ID NO: 2541 - DNA, 282 bp, Triticum aestivum
  Clone ID: LIB3280-048-P1-K1-B5
cccacgcgtccgcgtcggtgaaatggaagtaataagtggctctgattggtagcggtggttggggagaagtctcttttgacatgttgatttcctagaaatcaggatcttgtttccgaaagcggtgagcacctccccgcaacgaccattgtttgtgcctggaagttacaattcgtattatagtacgttgaggattcttgttgagtggctcgatctggtccgcttgcttttggaagactgcaatagcctcttcctcttgcgatgctgatgtttaccgttgtctgt

SEQ ID NO: 2542 - DNA, 430 bp, Triticum aestivum
  unsure (1)...(430): unsure at all n locations
  Clone ID: LIB3280-048-P1-K1-B6
cgccctgctgcctagggatggcctgcgcaagcttcaccactgcagcctcatcaagggcggctactgctatggccccttggatcctgtctcgaacatcatcctcaacaccatttggtatggcactgcattccccatgcaccaagatttcgagtttgactttcaggtggacatgatatgcacaaggacccttatgcgcatcgagtgctgctccctctatggcatcgtcgccttcctccgtgctcgcttcagttctctctcggagcatgatgctctctggcaccttcttttggccaatgtggacttacggttagccattgagatggtacaacagtctggtttccttatcggcggcactgaccttgatgcctataagaaagctgcggttgattcatggcactncgaccctgatgcactggtgaaattcacgaca

SEQ ID NO: 2543 - DNA, 389 bp, Triticum aestivum
  Clone ID: LIB3280-048-P1-K1-B7
atgtcaaggccaagatccaggacaaggaggggatcccgccggaccagcagcggctgatcttcgccggcgagcagttggaggacggccgcacccttgccgactacaacatccagaaggagtcgaccctccatctcgtcctcaggctccgcggaggcatcatcgagccatccctgcaggctcttgcccgcaagtacaaccaggagaagatgatctgccgcaaatgctacgcgcgcctgcacccaagggctgtcaactgccgcaagaagaagtgtggccacagcaaccagctgaggcccaagaagaagatcaagaactagagcgctactagtcagtttcatggaccggttgaatccattgctgtgttagcgtttatgctaattgtcgtctcg

SEQ ID NO: 2544 - DNA, 420 bp, Triticum aestivum
  Clone ID: LIB3280-048-P1-K1-B8
cgctcttatattagtttacagaggaagtactagtttggcactgtatctaacccgtactaaaatatttcagcagttcaacaggggcgtggggttcagttcgaaaggtgatgacccaggcagccgaccttcgcataacgaactggtgcagtttgatcttgtgtgaattggaaatcacctgatgctgagtgtgtcagtacaaccctacgctacaagtagagcaaatactattttttatgccaagtaagttcaaacagaactgaaagtggagtacttgcatcaactcattggaattggtgtgtgtgcttgtaacacaatcagttcagatctcgagagaccataagtttgttgacaaacatgtatattagttcatatctcgagagtcccttatttttgtaggccagataatgcaatggcttatta

SEQ ID NO: 2545 - DNA, 400 bp, Triticum aestivum
  Clone ID: LIB3280-048-P1-K1-B9
cccacgcgtactacaacatggaggagaagctcctgagggaactggcggacatgggcttcaggcaggttgacctgaacaaggaggtacttcggcagaatgagtatgatctgcacaagtcggtcgatgacctgtgcggcttccatgagtgggacccactccttgcggagctgaaggaactgggttttgatgattgacacagatgtagaaggagtgctcgagcaagaagcatgaagttccatgaagcgtgtggcgatggatcttctgtccagagagaaggaccggcgatggcctcctgcgctcatctgctggagcgctgctgcctagtagacctagatataaataaagtagtactagtataatggtatgcaagaataaccacaccaactgaagtggtgctgca

SEQ ID NO: 2546 - DNA, 287 bp, Triticum aestivum
  Clone ID: LIB3280-048-P1-K1-C1
cgccccacccaccaaacgccaaccctgcggcatcggaggagcgtgacgatgtcgaccgccagcggcggtgcaagccggcgacttgccggaccagatggtgaggaaccttctggagaaggagagtcttcatcggaggcaagaccacctgcagctccttcacctccatgctcgtagccatcgtccgcttgttcgtgcttgtccatcgattccgccagtaccacatcctcgccaaggacttctccaaccttaacgccatggtaattttgtattttctcccctctctcttt

SEQ ID NO: 2547 - DNA, 448 bp, Triticum aestivum
  Clone ID: LIB3280-048-P1-K1-C10
acgggcaactccacccccaatccccaaccgtaccggcggcggcgagcgccgtgacgaacccgcgcagcgcagcccaggcgccatggccgcgccggaggcacccacgtgctacgtcgggatcgcgcgccagtccgccgccttccgcctcatgaagcaaatgggatgggaagaaggtgaaggcctcgggaaagacaagcagggtataaaggggcatgtcagagtgaaacaaaagcaggacacactaggtgttggtgtggacaatcctcagaacaaatgggcgtatgataccacccagtttgatgatatactaaagaaactgaaagtgcaatctacaactcctgttaaagaaattgaggatgtaagcagttcacctgacagtacacccaagaaagataaacctgcaaaagatgaagtcgctaaagttacccggcctcaaggaagatacaag

SEQ ID NO: 2548 - DNA, 260 bp, Triticum aestivum
  Clone ID: LIB3280-048-P1-K1-C11
ctcagccctgaaatccccatctcctcccccgtatccctcctctctgcggtccctctaacctgcgcatggctcctccctagggttggggtctctgcttccacgaagccattatgcaggcaccgcccgcgaggcagccgcattccggcatgggcgcccacatgccggcacaaggcggcgggagggcagccaccacactggggcgcgaaaccgccgtcgatgcctgaataaaagccgccgcacacttaggatcagtcggcgcc

SEQ ID NO: 2549 - DNA, 291 bp, Triticum aestivum
  Clone ID: LIB3280-048-P1-K1-C12
gccacgcgttcgaccacgcgtccgcagctgcccaacttcaactggatcaccggcgtctccctcggcggcgctgtcatgtcgctcagctactccaccatcgcctgggcggcctcgctgcacaaagccggcaagggcgggcccggccatgtggttgactacagcatgacggcgtcgacgacccccggaaagaccttcaacttcctgagcgcgctcggggacgtggccttctgctacgccggtcacaacgtggtgctggagatccaggccaccatccccttcaccccaaagaag

SEQ ID NO: 2550 - DNA, 403 bp, Triticum aestivum
  Clone ID: LIB3280-048-P1-K1-C2
ctctcatggtatggtcatgcgtaatgatcatcaaagtcaagttcagtctcttgggacaaatgcatcatccaatttgattgaaagaagtgagagacctgggataaaccctcaaatggcaccctcttggtttgaacattatggaaaccaaagaaatggtcagaatcattctgtgtttaatgctcagaagaccccaactccaccatataatgttccaaaagcttcttggtgcatggaaaataactctctcgaggatagagctgatgccggccaagctgccaggcctttggtgcctaatatgaagacagctttggtgacaaggccaaagaagcgcaaaattacagaaacgtgctctttgtttcttggcataaaaataactgcagggcactcaaaagttgaaaaagac

SEQ ID NO: 2551 - DNA, 323 bp, Triticum aestivum
  Clone ID: LIB3280-048-P1-K1-C3
ggtttctgcagctgctgttatgtttcattgattcagacctatagttggatagttccagtggattttactaaatggttttgtagatttaattagtgaaaaggcctcaattggtttatgcaacattgcttgtctgctggcagttggagcatactaggtaaatgggccttgccgtgagtcgtggtgcaacagtgacctccattggcagggcaatggtcagatacgagtcagcaccaaagatgactgtgagcactcaaaaaagtttaccacgctagagctatgtcaggttgtacgggggcagggaatgaaaatacttgtgacacttt

SEQ ID NO: 2552 - DNA, 383 bp, Triticum aestivum
  Clone ID: LIB3280-048-P1-K1-C4
gtccgatagcccattggctaccaccacgcgcggtgatctgaagtcggatgagatcctgcgggctctcaaggaggtctccaaggcttccagcggctgatcggttgcccggaagctcgatgatgccgaacatcttcactcatgctatttaatatcttctgcttgttcataaccagagattcgaaccatttctctcttttcttcactacatatataatcttgtgagcactagcacgactacatcttgcagtgagaaataattaagacactgctgatgatgccactgtctggcttgaatgtttgtgaactaattcagcatatacgtttgcaatatatattgtgcttattcaacagctttgtttttttaagtcataaaaaattctttt

SEQ ID NO: 2553 - DNA, 388 bp, Triticum aestivum
  Clone ID: LIB3280-048-P1-K1-C5
tcgcggacgcgtgggcggacgcgtggggtcaaactcttctgagatgtgaattgggcttttaaggcataaaactagattgtcactggctgtgtttattgatcatacttcgtaaatgagtgatttaggtcagaaagttgtctcctgagctaaagtgtcaagaataatacccatagcagaactctgtgaatcattcacacacaaaaaagagtgtacttctgcaacgtgctgaaccattgagaaagtcatcaaatattcaagtgctctacggtttgcctattctactttcatatatgccaatcaatatcgggttgaataaagcaaaatgatatgatgctatggaatgctcaatccatcaccatactgagaaataagattggttttttggctg

SEQ ID NO: 2554 - DNA, 439 bp, Triticum aestivum
  Clone ID: LIB3280-048-P1-K1-C7
cttcaatgccccttccatagacgagaagtttgaactgcttggaatcatggctaatgtctttattgttgctccggaaagtctagcttccttgtttgaaggaacccccagcatccggaaggatgctttacggttcattcaactccgggatgactacaagacagcaaaaattgcttcgatgcttaacagtatagtgtctgaataaaattcacttgaaggttgatgattgtcaagcggtggaacgctatgaaatgctgcagggtcatcccaatctattttgaccatcagtgtagcctgtataattgagcttcaatattatgttaattcttttgggtccctttgtttatctgtttctaacttgttctgccttgctgaatcttagttttacatgtgcgggtccatgaaacccttgtagcatactggatagacaagcattattttt

SEQ ID NO: 2555 - DNA, 378 bp, Triticum aestivum
  Clone ID: LIB3280-048-P1-K1-C8
gcccaatcaatcaccggcggctccgctcaacgatccctagattacctcgccaccagaaagccaggaacctcgaagcggacagcgagagagatgggctcctgcgagatgacggccacggaggtagcggcgctgctggatctgaagccgcacccggagggcggcttctacgccgagaccttccgcgactcctccgtcttcctcaccaccgcccagctcccggcgcagtacaaggtcggtcgtgctgtgagcactgctatctatttcttgcttcccgcagggagtgtttcacatctgcatcgcattccttgtgctgaaacctggcatttctacaagggagagcctctcacggtctttgagctacacgacgatggccacatc

SEQ ID NO: 2556 - DNA, 342 bp, Triticum aestivum
  Clone ID: LIB3280-048-P1-K1-C9
actccctcggccttcactcacacaccaactaagcccacggagcaagcacactagctagtttctgccatggcagctcgccgtgcccacgccgccgcgaccttggccctgctggtggcggcgcttgtgctgtctgcggcaccggcgccggcggagggtgcggttgcgaactgcggccaggtggtgagctacctggccccgtgcatcagttacgccatgggcagggtgagtgcgcctggcggtggctgctgcagcggcatgcgttgtcttaacgcggcgggtgccacccacgtctgccgcaagaccacctggccctgacccaagcagtatgcgagcgggataagc

SEQ ID NO: 2557 - DNA, 411 bp, Triticum aestivum
  Clone ID: LIB3280-048-P1-K1-D1
ggactttgtcccgtcgagccgccgccgcctaccgtatcttcctcgggatccagatccatcccttcctcgtgttcaccaccacaccaacccaagccaccttctccttcctcgttttccccttgggtcaaccatctcctctccctcgatccacccattcccgcagctcctccccacggcttccagatcgagcgagctcgatcttcagcagcagcgccttggttgcccggagctcccttcgccgtcgggcaccaccagcaggtcaccgtctcctcgcgcccttctccctttttctctggtgctcctcctctaaccatctctctctgctgctcttgaaccagcgccggtcgccgccgtcccgttcgtcttccagcgaggcgaggcatcgagctccggcgcaagtcccctacaacc

SEQ ID NO: 2558 - DNA, 430 bp, Triticum aestivum
  Clone ID: LIB3280-048-P1-K1-D10
cgcgtccgccgcggacgtaaataaacaagcgattttgtcggtaccacacgcgcacgcacgcacaccaaccagaggctaggcttggccaggagtactggagcattatacattcgagagagagaggggaaaggcagaccgtcaaggctgggagagagggagagggagagcatattcgtcgtcatcattcgctcgctcacagaggagggagagagtcctacgaggtatggtggttcaggggcgtgaggaacgctacccattctttccccgaatatccgtggcaaatccgcggactcctttcccgagccggctggatggagagggacttcctgggcgccataggccacgagcagctgcagcagcagcagcagcagcagcagcgccagcgcgcctgcgtcgaggacgacgccaccagaaacgagtcagcttactt

SEQ ID NO: 2559 - DNA, 439 bp, Triticum aestivum
  Clone ID: LIB3280-048-P1-K1-D11
ctttgatgtttgttttcctcctgaatacccgcgatgtccaccgaaagttcatttccattcgagtgggcttcggcttaatccaaacttgtacgagagtggtaaagtttgcctcagcctgctgaacacttggttaggttctggatctgagaagtggggcaagtcaaattccaccatgctgcaggtgttggtctccatccagggccttgtgttgaatgataaaccatactttaatgagccagtcatctttagctctaaagaaaagcattcccttggatataatcagactgcatttgtcctaacctgcaagttgatgttgtatttacttcagaagcctccaaagcattttgagaccctcattgtgtgccatttccatgagcgggagcgggccatcctagaggcatgccgtgcatatggttctggcatggtcgtcggatcatcg

SEQ ID NO: 2560 - DNA, 400 bp, Triticum aestivum
  Clone ID: LIB3280-048-P1-K1-D12
gtcaatcttcagaaagcccatgtgccgtatgatcctgaggagatcgcgatcgccggcgagagctttgcgtcggagcttgaagagaccgccaacttgcaggatttgtatctgaatatgaacgaatggagcagcccgaggtatctctctcatataagctccaggattcaggagtatcaggacctggtgatggacctgcaggctgacatctgcaagaaagactctgaaattggttggcttcgacccgagctggacgagctggaaaggaagaacatggaactggaggagaagattggccgtaatggatcgtgcagagaaggatgcttcacaaccaggaagggggtgtcaactgaagtgttcatggatctacatgagcgttcgtcgaagtgcatccatgattttg

SEQ ID NO: 2561 - DNA, 439 bp, Triticum aestivum
  Clone ID: LIB3280-048-P1-K1-D2
cggacgcgtgggcggacgcgtgggcggacgcgtggggtcggggcggtgcaagggcggcaaggtgctcggcaagggccgcgccaaacccccccccaagggtcttggccaacaccttcaaggccttaaccaacccgccaatccgaaggctgccccgaagggccggcttaaaccccttttggggcttaatttacaagaaaaccccggcgtgcttaaaatcttcctcgagaacgttattcgcgacgccgttacctacaccgagcacgcccgccgcaagaccgtcaccgccatggacgtcgtctacgcgctcaagcgccagggccgcaccctgtaccgcttctgcggctgaagagacccggcgctggctggccctggcgcaccagccatggttcgcggtcaaaaaagtggagaagaggagaaatctgtagttgatctgggttct

SEQ ID NO: 2562 - DNA, 377 bp, Triticum aestivum
  Clone ID: LIB3280-048-P1-K1-D3
cccacgcgtccgcccacgcgtccgcggacgcgtgggccgccaccaaccagcccttcgcacgcccgccgctctcctctgccccaaccccaaccccgccgccgcctcaatcccaccgccgccggcctcctcctcctctagcgccgccgctccagcccctcaccttctcagcctggatccgcgcgacaaggtgtggggctatggcagagaaggctccatatcgcgcgacaaggtgagggggcgcccagatccgcagtggcaccaccgcgccctcgtctacctggccctcgaggtcggccatggaggtccggcccgaccaatggatggatggggatgaaaccctagcctaacacccacccatggatggatggggatggggc

SEQ ID NO: 2563 - DNA, 73 bp, Triticum aestivum
  Clone ID: LIB3280-048-P1-K1-D4
gctccgccgcaaccggggccttcagtccgactcgcccttcccttcccgtgccctatcttcaccccccttcttc

SEQ ID NO: 2564 - DNA, 416 bp, Triticum aestivum
  Clone ID: LIB3280-048-P1-K1-D5
cggacgcggggtttttttttttttctgtaatacgttccaaacttgcaataaaatgaccatgacaatagtcctagtagacctaggctgccaaactgccgtgagcatacacagctccagcagcaaacaatggtccgaacagacggcatatgcttaaatacatatatctactaataattcttactataaatgaataaccaacacccgattattgtcgcttcaaagctacgagtaaactacctgcactagtagtaaaataacatccacgctccccgtagatcaattgccctatagatgtggagcctggtcaagtgttcatcatgcatatctttcttgtaccgtcagtttgtcacttcttggcccagcccgagccaggagttgtcaccattagcttgcttggacggagcccgcgatgagcc

SEQ ID NO: 2565 - DNA, 302 bp, Triticum aestivum
  Clone ID: LIB3280-048-P1-K1-D6
tggacgcgtgcggagtcgttcgatcaataattcaatgcaacggctacctaccgtgctagctagcgtgcttgcagttgcgcatgctcctcatcgtgtcgttcagtgatctatgtgagcatgcatgtgagcgagagaaagaccaccatggatcggtgttttcacttgctcttcaattattacttcttgtcaccgaaaatgatgaccaactatattagttactgttagaggtggtgtcggatggatgatcgaacctgtgtaaaaccgctgagcgtgagttagttcatgggttgatttattgcgtg

SEQ ID NO: 2566 - DNA, 261 bp, Triticum aestivum
  Clone ID: LIB3280-048-P1-K1-D7
gaaaatgatgtttgcattacacacacagaacactactcactacactcttgtccgaacattcaggatgaggccatatgttttatcaacaagcaaacccccaagtctaaaacccgaagccaataaagtcctgactcttccctggaaaggacccaaaaaaacttggccgggggcccatcttgattaaaggccctaaccttttaccattccggttaaaaacaaaccctggtttgcaaggctgaaggacctaactttaatgggggg

SEQ ID NO: 2567 - DNA, 139 bp, Triticum aestivum
  Clone ID: LIB3280-048-P1-K1-D8
gcatccactcatccatcatcaccgaatctcacctcctccaccaagcaaaccaaaggaagcgaagcgaagcaagcatgtgcccgggcctccgcaacgcccatgggctggccttcggccgggccaagcaacgacacccctt

SEQ ID NO: 2568 - DNA, 360 bp, Triticum aestivum
  Clone ID: LIB3280-048-P1-K1-D9
gcgtttacatatgatgagcaaaccgcttccaaactggatgaacgggacagacagctaggtttgcatggggaaggagtactgaatgggtttctagagggtctgactgggctcctccaatcaccaatcagaggtgctgagaaacatggtcttcctggggttatctcaggtatagcaatgggaacagctgggcttgtggctaggcctatggccagtattcttgaagccacaggcagaactgcacagagcataagaaaccgaagcaatcctcatgaatccaaccgcctgcgtgtccgtttctcgaggcctgtggccagagatcgccctttgttcccatactcctgggaaagagcagtttgagta

SEQ ID NO: 2569 - DNA, 394 bp, Triticum aestivum
  Clone ID: LIB3280-048-P1-K1-E1
tctgtccacaccctagcatgcgtcgatgagccatgacacccacaccttgtagttgcttggtgtggtgatgaccgaacccacaccttgtagtggcttggtgtggtgatgaccgaacgtcacttgcgggatggcaatggcagtgtcctaacctccatgtcaggcaactacggctcggctgactaccgccttcttgaccactaccacgtctccccctgtagttgcggtggtggccgccttgtcttggttctgtaagtggctctatttagagtcaatgttgtaatccctgcctgccccagcttgtgccaacaaattgtggccctcacaccttgatgtggcatgctgggtggtgatcgaactgtcaccaccatgcacttcttgcgttggcacatggtgt

SEQ ID NO: 2570 - DNA, 198 bp, Triticum aestivum
  Clone ID: LIB3280-048-P1-K1-E11
aaaaagagtctcatttgtttaaaatattcatcgccccaaatgaaagaaggaaagattaggggcaaggggtcactaaaactaaggaatgctggggggtcgtcctagaggatccaaccttacgtgcgggtctgtgcaaagtataagctcttatacagtgtgacttaaataaaattcaatggccggtgtatcacaaaggat

SEQ ID NO: 2571 - DNA, 440 bp, Triticum aestivum
  Clone ID: LIB3280-048-P1-K1-E12
cggacgcgtggggtcctgaggcaaagctgctgtttgtcgtccgtatccgtggtatcaatgctatgcacccaaagaccaagaagatcttgcagcttttgcgtttgaggcagatttttaatggtgtgttccttaaggtcaacaaggccaccattaacatgctgcgtcgggttgagccatatgttgcttacgggtaccctaacctcaagagtgtcagggagctgatctacaagagaggttacggaaagctcaacaagcaaaggatccctctgaccaacaacaaagtcatcgaggagggtttggggaagcacaacatcatctgcattgaggaccttgtgcatgagatcttgaccgtcggcccacacttcaaggaggctaacaactttctgtggccattcaagctcaaggctccgctcggtggcctgaagaagaagaggaaccac

SEQ ID NO: 2572 - DNA, 442 bp, Triticum aestivum
  unsure (1)...(442): unsure at all n locations
  Clone ID: LIB3280-048-P1-K1-E2
gtggacattgaagtgggacttggcccagctggagagatgaggtacccatcgtatcctcagagccaaggatgggtcttcccaggcatcggagaattcatctgttatgataagtacctggaagcagacttcaaagcagcagcggcgaaggctggccaccctgagtgggaattgcctgacgatgctggagagtacaacgacactcccgagaaaacccaattcttcaaggacaacggaacatacctcacagagaaggggaagtttttcctgtcatggtactccaacaaactgatcaagcacggtgacaagatcttggacgaagcaaacaaggtcttcttgggatgcagggtgcagctggcaatcaaaatctctggcattcactgggggtacagggttccaaaccatgcaancgagctcacagctgggtactacaacttagatgaca

SEQ ID NO: 2573 - DNA, 399 bp, Triticum aestivum
  unsure (1)...(399): unsure at all n locations
  Clone ID: LIB3280-048-P1-K1-E3
ctttcgttgtccttccccgtcccattccctccgctccccactccgcagcagttccgcaccgacgccctcgccctcaccctccccaaagccctaaccgctcgcccgctccgccgccatgaggtccaaggccaacggagacaccgcgttcaaggcctccggcaagaacaagacggccaccggcggcgtcgccaagccgaagcgcgcccccacccccttcttcgccttcctggctgagttcaggccacagtacatggagaagcaccccgaggcaaagggcgtcgcggccgtcaccaaggcggctggngagaagtggcgcaacatgtcggatgaggagaaggcaaagtatggcgggaagaaggcagatgccccaacaagcaaggcggtgaacaagaaggagag

SEQ ID NO: 2574 - DNA, 344 bp, Triticum aestivum
  Clone ID: LIB3280-048-P1-K1-E4
cgtacttcactgacatgatcatccgcaagtacaagatgcgcagcgacatccgcaacgtgcacctctccgggatggggtgcagcgccgggctcgtctccgtggggctggcgcgcaacttcctgcaggtggcgccgcggggctcgcacgcgctggtggtgtccacggagaccatcacgcccaactactacgttggcaaggagcgcgccatgctgcttgccaactgcctctttcgcatgggcggcgcggcggcgctgctgttcacatcccgcgccaaggcccgcttccggctctcccgcgtggtgcgcacgctcaccggcgcgcaagacaacacgtaccggtgcgtg

SEQ ID NO: 2575 - DNA, 414 bp, Triticum aestivum
  Clone ID: LIB3280-048-P1-K1-E5
aatcggccaccccccacctccgccttccttcctggccagcgcggcggcttatggcctccatgaccacacctcggctccccttcctccccgcccgaacccgctccgccgtcgccgccacctcctcttcgtccccctcctccccgctaccacgccgctccatcaaatgcagcagctccaccaacgctaactcggcccccctcccttccacatcgcggcagccccgggcgcccgtggcggacggcgtaaggtccgccgacctcaacggcctccgggccccgcctatacctgtcgcggactcccctctacccgcgtaccgcgatccgcacgggctgcctcggcctctcactagtgcggatctgatggagtccagcggggaggggctcaaggtgcctaccaggggcttcctggagcgta

SEQ ID NO: 2576 - DNA, 396 bp, Triticum aestivum
  Clone ID: LIB3280-048-P1-K1-E6
gtgtgatagtatgtctgatgattggcagcctaagtcggtagggaatacatcaggatcagtacagcaattaccgaagtacagaagactccgcaaatgtggtgacaagatcaaacgagtatccttattgtctttgaatgaaagatataatggatctgtaggagaacaatgtgatcagatggagcatgatgttggaaacagaaggaaggccaagaggcgtatggatatatatattgacgaggaagtcgaagtgtctgaagatgctgacatttcactggatgaggatgatgatcggggtgaagataaatacgaagatagctatattgatgaccagacaactcctactggtcaattcactcagagtgaacaaggcggtgaatacagtaacactaacgacat

SEQ ID NO: 2577 - DNA, 438 bp, Triticum aestivum
  Clone ID: LIB3280-048-P1-K1-E7
aaacaatgccagaatagctggtatgcttcgtaatctttcgagttattactacaaagaggctgctcatgtattctgtgtaagaattgctcaagggcttgttcaccttgggaagggtttgctgacactttctccataccattccgaccggtttcttctttccccgatggcacttggagggattgtcactgttctgcatgcctgccttgatatgaagtccaccattctagggaaatatcactacattctttacattattgtactggcaatgcagccaaggatgcttttaacggtggatgaggatctgaagcctcttcctgttccagtgcgggttgggcaagcagttgatgtggtcgggcaggcgggacgacctaagacgataaccggctttcagacgcataccactcctgtcttgcttgcagccggggagcgagcggaatt

SEQ ID NO: 2578 - DNA, 327 bp, Triticum aestivum
  unsure (1)...(327): unsure at all n locations
  Clone ID: LIB3280-048-P1-K1-E8
gtttgtttgactcatgcgggtctcgtggccaccccgaaaacacgccacgcgaatcgacgcggccggagcctctttccaccctctccgcctccacgaatgacgtgacacgaacccgaccttggtagcgtcctagctcgatcctccatgggcggctccgcattactcggcggcggnctcgcccttcagcttcttcatgcggcccgcggcgagatcaaaacgacgccgatcgtgtcggactcgcggtcccgcattctgttggaggagttcggctttaagccccgcggcgttgcgcaggtaaacgtgttcggcgttttatggagcgtcccc

SEQ ID NO: 2579 - DNA, 430 bp, Triticum aestivum
  Clone ID: LIB3280-048-P1-K1-E9
cccacgcgtacgagtccatcccccgtcgccctcacgctcttcgtgctcgccgcctcccttcgcgtgctgcctcatggcttccatcgccggatctgccgtgtccttcgccaagcccgtcaaggcaatcaacacgaactcgctctctttctctggtccaaggaggggcaatgcatttcttcgcctgcagccagtgccgatgagatttgctgtttgctgctcagcaaagcaggatacagtggagaaggtttgtgaaattgttaagaagcagcttgctgttcctgaaggcactgaagtttgcggtaccaccaagttctctgaccttggagctgattcactggacacggtcgagattgtgatgggcctcgaggaggagttccagatcagtgtggaggagacgagtgcgcatgcaattgcgacaagtgaagatgct

SEQ ID NO: 2580 - DNA, 405 bp, Triticum aestivum
  Clone ID: LIB3280-048-P1-K1-F1
cccacgcgtccgcggacgcgtgggttccccaattaaaagatctctctctctctctctctctctcgtcacatccacctcactcgctcgctccctgctgccattccgcggccggacatgtcgtcgtcgggggccggcgaggagggcgccgccgcgccgcaggggccgctgcccgtggagcaccgcaagggcgccaacggcctcgacaaggtcgtcctccgcgaggcccggcgcatctcccgcgaggtgtaccttgatgggggccatgtaacatcatggaaagatgagcatggggaggagctgcttttcgttagtaataaggctattttcaaaccttcaaaagctatacgtggaggtataccaatcttgctttcttagttttccaacttcggacagctggaagctcat

SEQ ID NO: 2581 - DNA, 421 bp, Triticum aestivum
  Clone ID: LIB3280-048-P1-K1-F10
gcattctcaggttgatgccatgcttcataaattagagaaagagattgatgatgtttatgcacgaataggcaaccgctggcaggtgcttgatagggaccgtgacggcaaggtgaccccggaagaggtagaagcagccgcaggttatctcaaggacaccatggggaaggaaggcgtccaagagcttatcagcaatctttccaaagacagagaagggaacatcctcgtggaggacatcaagaagatggcgtcgcaaacggaggaaaacagcaagccagaagaaacggcgcgctgattggtagaagaagaagcattctctatcggatctgtatatatataccgacagctcattcttttcccagtttcagttcgtggcagcgcatacgcgcgaaacggtcagtatttttctcgtgaccgtctacag

SEQ ID NO: 2582 - DNA, 419 bp, Triticum aestivum
  Clone ID: LIB3280-048-P1-K1-F11
cggacgcgtgggcggacgcgtgggcggacgcgtgggcggacgcgtggggccgctccttcccccccacccccgccgcccgctcaagccccaccgcccgccggcgccgacgccgcgacccacccgctccggcaagatgaacaaggagaggctcatgaagatggccggcgccgtccgcaccggcggcaagggcaccgtgcgccggaagaagaaggcggtgcacaagacggcgaccacggacgacaagcggctgcagagcacgctcaagagggtgggcgtcaacaccatcccggccatcgaggaggtcaacatcttcaaggacgacctcgtcatccagttcctcaaccccaaagtgcaagccttcatcggcgcaaacacatgggtggtcagtgggacttcccaaaccaagaagctacaagatg

SEQ ID NO: 2583 - DNA, 438 bp, Triticum aestivum
  Clone ID: LIB3280-048-P1-K1-F12
cccacgcgtccgggccaaggttgatatcctcatccttggtggtggtatgatcttcacattctacaaggcccagggattagctgttggaaagtctcttgtggaggaagacaaacttgaactggcaacttcactgatcgaaacggcaaagtccaagggtgttaagctcttgcttccgactgatgtcgttgtggctgacaagtttgcagcagatgccgaaagcaagattgttcctgccactgctatccctgatggttggatgggtctggatgttggcccagattccatcaagactttcgcagaagccctggacaccaccaagactgttatctggaacggtcctatgggagtctttgagtttgagaagtttgccgcatgcactgatgcaatcgcgatgcagttggctgagcttactgggagggggtcacgaccatcattggt

SEQ ID NO: 2584 - DNA, 370 bp, Triticum aestivum
  Clone ID: LIB3280-048-P1-K1-F2
acggctgtggccttttcggccaaaatcatcgtattggcggttatagcaccgatcaggctgatatggcaactactgaaaaaaaaaggaatatatccatgttcagtgtcgcaactgaaagaaagacaagagtcaaaatagccgtagcaatacaaagacacgttacatcaacaaaagaagatggttcatataaagaccaaagtcggcttgctctgtccaattattagccattcaaattccgtcaacagaagaaatacacgacgaatgctcaagtttgtattcctcgtagcaaattttggggtatccaggtctgaaagccctattcatgccctcaaggcacgatgccatcctcgatgggctgaagcaagacctt

SEQ ID NO: 2585 - DNA, 441 bp, Triticum aestivum
  Clone ID: LIB3280-048-P1-K1-F3
gcaagccacccctcccgccgccgccggcatcgacctatccccggcggcgaccgacctcggccgggtgcacctcctgccctgcggcatcaggcacaacagcgccgccgccgtctccgactacttcaagcccagggacactggcgtggaggtggacggggtgaaggtggaggaggccttcttccgcgggaggaacctgcagggcgccaccgtcgcgctccccgatgactaccgaggttatgtattggagaagaagaagaacgaagaaaaggatgctcagggcatggatgaggaggctagcaattttgtatcccgtgcagaattccagaacataacttactggaatcatgacaccatgccatcagcagaggatcctctcccacggtgctttcattggttagccattgcgaatgcaatgcacaagccagtgactgctgaagacat

SEQ ID NO: 2586 - DNA, 435 bp, Triticum aestivum
  Clone ID: LIB3280-048-P1-K1-F4
gctgcgtcgacctgtctatgctgtgacaccccctgctcaccctctcttctcgcacgccacgacggcgaagtgatccagccagccaccggccgccgcggcaaatggcgttgtccagggcgcagacgaattccggcgagtccctcatctcctccaccttcgcgtcgcgctacgtgcgcaccgcgctcccgaggttcaggataccggagcagtccatccccaaggacgcggcgtaccagatcatcaacgacgagctgatgctggacgggaacccgcgcctgaacctcgccttcttcgtcaccacctggatggagcccgagtgcgacaagctcatccagaactccgtcaacaagaactacgtcgacatggacgagtaccccgtcaccaccgagttccagaaccggtgcgtcaacatgatcgcgcattttttaacgcgcc

SEQ ID NO: 2587 - DNA, 376 bp, Triticum aestivum
  Clone ID: LIB3280-048-P1-K1-F5
cccacgcgtccgcatcacctgcctgccaactagccccaaatctcccctccctcccccgctctcgaatccccccgagcatcgaccatgtcggcctactgcggaaagtacaaggatgagctcatcaagaacgctgcctacattggcacccccggcaagggtatccttgctgccgacgagtccaccggcaccatcggcaagcgctttgccagcatcaatgttgagaatgttgaggacaaccgccgtgccctccgtgagctcctcttctgcacccctggagccctccagtacctcagtggtgtgatcctctttgaggagaccctgtaccagagcaccaagggtggcaagcccttcgttgacatcctcaaggagggcaacg

SEQ ID NO: 2588 - DNA, 390 bp, Triticum aestivum
  Clone ID: LIB3280-048-P1-K1-F6
ctccgacccctcgccagcgacagcgagcagtgagcagcggggcgcgtgcggcggtcggtgcggagagcgacgcgaccgactccggcaggcgcctcccgatcaccaccgccttctccgcgggcagccgcaatggcgaacaggggagggaaggggtcgtaccccccgtccaagtcaggagcaccgaacggaaggcagatgggtctgatttctgatgattctgattctgattctgattctgattctgatgattttttgcgaagaagaggctccccccacacactccaagtcaaatgggaaagcttcatctgatagcctaaaaactggtggaaaggcttcatccttttctaatggagaaggcagcaaaggagggaaggcatttagtgctgggaa

SEQ ID NO: 2589 - DNA, 136 bp, Triticum aestivum
  Clone ID: LIB3280-048-P1-K1-F7
ccaaaccagaccaaaatcttcccctccccaactctctctccgcccctgcgtgaaccgcggagcaaggaaggaggagcccgtcgggctactaatctgggggtcccccttgatccggcgggttcggcgtagcttctgg

SEQ ID NO: 2590 - DNA, 416 bp, Triticum aestivum
  Clone ID: LIB3280-048-P1-K1-F8
gcgacccacagcggcgcaaccatggtgctcgagtcgacgatgatctgcatagacaactcggagtggatgcggaacggcgactactcgccgtcccgcttccaggcgcaggccgacgccgtcaacctcatctgcggcgccaagacccagtcgaacccggagaatacggtgggcgtcatgacgatggccggcaagggcgtgcgcgtgcttgtcactcccaccagcgacctcggcaagatcctcgcctgtatgcacgggctggaagttggagctgaagcaaacttggccgcagctattcaggttgctcagctggcgctaaagcatcgccagaataagaggcaacagcagagaattattgttttcattggaagccccgtgacatacaacaagagtgtttggggaccatagggaagaagctg

SEQ ID NO: 2591 - DNA, 419 bp, Triticum aestivum
  Clone ID: LIB3280-048-P1-K1-F9
cagagctattctggtcaagaggacctctactgtgtctatgtgccgaccaaccatctctacattggtgatatcttcatggtgaactcaaaggatgtgataaggcctaatctttctgtgcgtgaaggcattgagatcgttgtgtctggtggtatgtcaatgccccaggttttgtcaaccctggatccacatccacatctgcatgcaatccacacagaccgaggtggagcgagcagaagctgaggcaaactacctgcatacctgttcgtcgatatcaagtgaactctcaacacagatcacaccagtgcggcgaacaagatcctgagcgcgatgcactagcaatctgtcacgcccgaggatcaaaggatcttgtaattaagtagaagtaggtaactcacacgcgttgtcgatccgattgattt

SEQ ID NO: 2592 - DNA, 438 bp, Triticum aestivum
  Clone ID: LIB3280-048-P1-K1-G1
gttaatgagatgtggcgtgccagggagaaggaactggagctggaatcaaagatgaaaaccagaaccaatggtcgaattgactcgagatcccacaaacggaagaacgactcaagagaccagagccctgtctctaagacccagcgagacagaccgtatggcgcatcattttcgtcgagggattcacatagcagttcttattcggactgggaggatgggctaggcgatgatgaaatcgaagagtttcttcgatcaagggtgaagcgcggacgaggagccattggttctagaatggatgagcctggcccatacctcaagcctccatccggtgggcaagacaattcaataagtccggatgcacgagtgaaagaagaacggaagcgccaagtttatggcccagagaagccactatttttgagatctaagtcctcagacgaggag

SEQ ID NO: 2593 - DNA, 413 bp, Triticum aestivum
  unsure (1)...(413): unsure at all n locations
  Clone ID: LIB3280-048-P1-K1-G10
cccacgcgtccgggcgattttaatcgctggggtttgtcgctatccacccatgtcttcatccccaactcagcctgctcctccctaaccgccatgccatggaggcggtcgccgtcatctaccggccgacgccctcttctccccttcctctggcctcccgtgctgtaactcctgacgccttcgnctctccgaccgcccacacgctcgccgncttacacaccttttgtcgacgccatccccaagcagcgcttgatgatccctccacttggatcccgcccgtggccgcggcactagggatgtcgccacgatggttatcccgttcctgatggaaacaacgtttgagcagccgtcgccgaatctggcctcgatcctctacaagaacagtatcatgtactccctccgtatctttttagtct

SEQ ID NO: 2594 - DNA, 240 bp, Triticum aestivum
  Clone ID: LIB3280-048-P1-K1-G11
gccactcgttcgggcgcttaatgctgctcataattggggcgatgcgactcactgtgcggccgaagttagcgacggtgttggctatcctcatagccatggccgtagggcgttaccttctgcattacgttgtttactacactggcgctatagcttgcgcgctgttcttagtgataacagacaggatgacagacagaccgctctctacggcgggggcacgggttagggaagcggcacacaata

SEQ ID NO: 2595 - DNA, 373 bp, Triticum aestivum
  Clone ID: LIB3280-048-P1-K1-G12
cggacgcgtgggctttgaggccactctacgtcctgatgaaggatactatgtaggtgggacatttactttcaccttccaagtatctccttcctaccctcacgaggctccgaaggtcaagtgcaagactaaggtttaccatcctaatattgacctagaaggaaatgtctgcctgaacattctgcgtgaagactggaagcctgtcttgaacatcaacaccataatatatggtttaaaccttcttttctcacaacccaatgacgaggaccccttgaatcatgaagctgcggccgtccttcgagacaacccacagaagtttcagagaaatgttcaaacggcgatgtcgggaggctatgttgataatacccattttcca

SEQ ID NO: 2596 - DNA, 384 bp, Triticum aestivum
  Clone ID: LIB3280-048-P1-K1-G2
attaaactcgccctcaccccatctagggtttggccctgccaagagacccgcgacccccttaatccttctcccaacccttatctgtatccctctccatggccacggcggcggcggcgaagcggaagccggtgttcgccaaggtggatcagctcaagcccgtcaccagcggccacacgctcgtcgccaaggtgctcagctccaagaccgtcctccagaaggcccgcgccgctggcggccccggcccagccgacaagcccaccaggatcgccgagtgcctcatcggcgacgagaccggctgcgtcctcttcaccgaccgcaacgaccaggttgatgttttgaagcctggcaacactgtcatttatccgcaatgcaaagattgatatg

SEQ ID NO: 2597 - DNA, 314 bp, Triticum aestivum
  Clone ID: LIB3280-048-P1-K1-G3
acaaattctgagaaaaccgtggggcgaagttgaaaccctgcggctgcaatggaggcggcggcggcggccgtgggcggggaggacgacgggaggggtcggaagggaagctggtacgcggtgggggagcgcgcggtgctggtgccgtacctgcgggagcacgtgccgcggtaccacgagtggatgcaagacccggcgctactggaggccaccgcgtcggagccgctctccctcgcccaggagttcgaggtccaccgctcctggaccctcgaccctttcaagcatactttcatagtgctggataaggagttgatcga

SEQ ID NO: 2598 - DNA, 441 bp, Triticum aestivum
  Clone ID: LIB3280-048-P1-K1-G4
cccacgcgtccgcaaaaagcagaaaccccaaacacgccacaagaaagcagagcaaccgggagatgagacttccgcacatgagctcatcggatcaagacaccggcaaaactatagtgattagcaggaggactaagagaatcaaaagctacagaggcggctcgcagcagatctgacggattagcgattaacacaagacacaaccgatggaagactgcgtgaggcaaccgaacaagaggaataaatacctaggatcaggataaatagggaatctgcacgcttgagaagatccccacaaaagcacagaaaattggatttgatctaaaccgggagacaaaaatcaatcttgacctcttcctctacgaactgtggagaggaacagagaacagatgatttttcagatctggatggaccaagaggattggagaagaaagacagagaaga

SEQ ID NO: 2599 - DNA, 358 bp, Triticum aestivum
  Clone ID: LIB3280-048-P1-K1-G5
ggtgctactaggtatccagtacatccaacgtgtattgcaggatcctgaccatttggatatggaaagggatttgggcactgcaacaatgaaaaagacaagaaactacatgctaaaatattatgagcctgagattgacaaattatacaaagcattggagggtcagagggttgcgaacaaagcaaagttaagctatgtgttttgttaggtcacatgccggaatactattgtaaatctactattgatcgttggtaatcaagactacataaaagcaataaaatgcatattgtgcggtgcaaaataaaataaatatttatttatttattacttttataataatatatcatattctttagttatt

SEQ ID NO: 2600 - DNA, 372 bp, Triticum aestivum
  Clone ID: LIB3280-048-P1-K1-G6
acccaaccgccgctctccgagtctcctgaaagttgcaacctctccctctcggcgaatttggggtttctgaggcgcgcgaggtaaaccaaggttttgctcatggctcgtactaagcagaccgctcgtaagtccactggaggaaaggctccaaggaagcagctagccaccaaggctgcccgtaagtctgctcccactactggaggagtgaagaagcctcaccgttaccgccctggaactgttgctcttcgtgagatccgcaagtaccagaagagcacggagctgctcatcaggaagcttccattccagaggcttgttagggagattgcccaggacttcaagactgacctccgctttcagagccatgcggtgctt

SEQ ID NO: 2601 - DNA, 439 bp, Triticum aestivum
  Clone ID: LIB3280-048-P1-K1-G7
ccgagaagcggctgccggcggggaagtcggccgccaaggagggcggcgacaagaagggcaagaagaaggccaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgaggccgccaagctggcgcggtacaacaagaagccaaccatcacgtcccgggagatccagacctccgtccgcctcgtcctccccggcgagctcgccaagcacgccgtctccgagggcaccaaggctgtcaccaagttcacctcctcttaggctggtcgtcttcctgtgtctcgtaattagctgttcgggtgtgtttgtggccgtgttatcctgaagaatcgcaccgcgatgtt

SEQ ID NO: 2602 - DNA, 396 bp, Triticum aestivum
  Clone ID: LIB3280-048-P1-K1-G8
gccgctgacactggagctcctgtccaagggcggggcgaaacgcgggttcgcgggcgcggtggcggaggaggaggacgagaagaagaaggcgcagccgccggccgccaaggcacaggtggtaggatggccaccaatccgcagttacaggaagaacaccatggcgacgaacttatctgctcccagaagcaaagacgaggccgaggcgaagcaggcaccggcaccaggctgcctttatgtcaaggttagcatggatggtgctccttacctcaggaaggtggatctcaagatgtataagaactataaggacctctcgctggagctggagaaaaagttcagcggctttactgttggtcatggtgaatcgactggaaaatcgggaagagatggattatctga

SEQ ID NO: 2603 - DNA, 250 bp, Triticum aestivum
  Clone ID: LIB3280-048-P1-K1-G9
gctaataaaaccgtgatcaataaccccccaccacctcgccggtctccaccgcaccaccgtgcttgaagaatggggaataaaaaaatccgcttcgcccgtcctaatggcggttgcttggccaccgtcgtcatggcctccgaggctgctcctggcaccagcgatgccttcggggtgggaatcggcccccgcggccttggcggcttccttggcggatattttctttactggaacaacggacaagaggggaggg

SEQ ID NO: 2604 - DNA, 335 bp, Triticum aestivum
  unsure (1)...(335): unsure at all n locations
  Clone ID: LIB3280-048-P1-K1-H1
caagctacgaggttttgagtacatccaaggtgtagtgttggatcctgtgccttttgatattgaaagggatttggtcactgcaacaatgaagaagagaagaaactacatgctaaaatattatcagcctgagattgacaaagtatacaaagcattggagggtcagagggctgcgaacaaagcaaagtaaagctatgtgttttgttaggtcacatgccggaatactattgtaaatctactattgaacgttggtaatcaagactacataaaagcaataaaatgcatattgtgtggtgcnnaaaaaaaaattttatttttttttaaaatttttttttttt

SEQ ID NO: 2605 - DNA, 385 bp, Triticum aestivum
  Clone ID: LIB3280-048-P1-K1-H10
agccggttcatctgtatcagtcgaaaacatcgggctacttggattaacaaaagttggaagtaggagagtgatccagatatcaactggcttcatgatattcttctccatatttgggaagtttggggcgttcttcgcgtcaatcccgttgccaatcttcgcggcaatttactgcatcttgtttggtatcgcagctgctgtgggaatctctgccaaccagtttgcaaacaaacactccatgaggaacatctacatcattggactatcatgtgtccttggcatctcgatccctcaatatttcgcggactacaccgcttttgctggccgtggacctgccctaacaaatgcaggatggttcaatgacatcatcaacacagtttttgccttc

SEQ ID NO: 2606 - DNA, 350 bp, Triticum aestivum
  Clone ID: LIB3280-048-P1-K1-H11
cccacgcgtacgtccacgcgtccgcgggggtgctccccatcggctgcttccccatctacctcaccatctacggcacctccagcgccgccgactacgacgccctcggctgcctcaagaagttcaacgacctctccacgtaccacaacagcctgctgcaggccaaggtgtccgccctccaggccaagtacaagtcggcgcgcatcatgtacgccgacttctacgccggggtctacgacatggtccggagccccagcaaatacgggttcagctcggtgtttgaggcgtgctgcgggtcggggggaggcaagtacaactacgccaacagcgcgcggtgcggcatgttcggcgcc

SEQ ID NO: 2607 - DNA, 322 bp, Triticum aestivum
  unsure (1)...(322): unsure at all n locations
  Clone ID: LIB3280-048-P1-K1-H12
cccacgcgtccgcccacgcgtccgcccactgctcaccctctcttctcgtagcacgacacaacaacggcgagctgatccagccagccaccggccgccgtggcaaatggcgttgtccagggcgcagacgaactccggcgagtcgctcatctcctccaccttcgcgtcgcgctacgtgcgcaccgcgctcccgaggttcaggataccggagcagtccatccccaaggacgcggcgtaccagatcatcaacgacgagctgatgctggacgggaacccgcgtctgaacctcgcctncttcgtcaccacctgggatggagccccgagt

SEQ ID NO: 2608 - DNA, 350 bp, Triticum aestivum
  Clone ID: LIB3280-048-P1-K1-H2
ctctgctctctgtcccgcccgccggctcatccccgcgcgcagaggcagcgtcgcggcgagcacaccaccgtcgaccccctcctcctccccctagccgctcccgcgcgcggccggcggtgtcgtgatggcgaggtcgtcgtcgtcgccgacggcgaggttgccgctgccgctgcttgtgctgctgctgtgcttgtcgtcgctttccatggcggcggcgcagaagtacaatgcggtgtacagcttcggcgactcgatcacggacacagggaacctgtgcaccaacgggcggccctcggcgatcacctttacgcagccgccctacggggagacctactttgggagccccacct

SEQ ID NO: 2609 - DNA, 417 bp, Triticum aestivum
  Clone ID: LIB3280-048-P1-K1-H3
attgaacctttctttgatggtttcaacaaaggaaaatgaggagaagctatgtactgctttcaccattactgtggatgctaaagaaggcacaacaactggggtatctgcaaaggatagggcaaagacagtcatgactcttgcatccccttactcaaagcctgaagatttcaatcggcctggccatattttccctctgaagtacagagacgggggtgttctcaaacgagctggacacactgaagcatctgttgatcttgctgtgctggctgggttacctcctgttggagtactctgtgagattgtggatgaggatggctccatggctcgcttacccaagctgcgcttgtttgctgaaaaagaatatttgaagatcgtatcgaatgctgacttgattagatataggagaaaaagagacag

SEQ ID NO: 2610 - DNA, 368 bp, Triticum aestivum
  Clone ID: LIB3280-048-P1-K1-H4
aagagcacaagcgatctttacttcaatcctgacagcccaatgcatacaaccccagctgtgtcaagtaaactgaatggccatgacgatccaagcagtgctgcaaactttttttacccagacagtggtcagtcgtttatgacagatgatgctcttgatcaagtattctccccgccacttctgctggagtcttccttgttccccgacatgtacgaggacttgcttgcaccattatcagaaactgatgcagctttgatggaacattaggctttacgtgtacaccatgtaatactttaaccaccctgaagcttcagtgcttaactgcagcccagaggttctggtggcttattttcaagtgcggatggcacata

SEQ ID NO: 2611 - DNA, 183 bp, Triticum aestivum
  Clone ID: LIB3280-048-P1-K1-H5
cccacgcgtccgctcaagcttccgatgacgctttaactgacccgatgactatggtgtaacttgactaatattacgctgcgactaagaacactttgggtgatataaatgaagcgcaagactaacgacctggtgtggcgggtacatgaatatatgatagtctatatacttggagaagagcttttg

SEQ ID NO: 2612 - DNA, 398 bp, Triticum aestivum
  unsure (1)...(398): unsure at all n locations
  Clone ID: LIB3280-048-P1-K1-H6
gagacacccccatcgcctcgtctctcctctcctcgcagatctttcccgtctccggccaccatgaactcctactccggcgaccggtcctcctcccgtcccaccacaacctccttcgactcctaccagtttgacttcggggccaacgcctcccgctcctccacctcccgccccctccgcgaccagaggccaggtggcgccaccaacccttcaccgaggccaaccaccacaaacacatggtcacaccagccggtgaagacgtcctggactcatcagccatccccgtccgccgccgcggcgctcggatccgggcctgtgtccatggtcggcgacatctccggccggagctggtccgncactgcgccctcctncggcatcggccctcctcagtccaacaaccc

SEQ ID NO: 2613 - DNA, 298 bp, Triticum aestivum
  Clone ID: LIB3280-048-P1-K1-H7
tagaaagccgtgtacaagaagcgcgatgacgacgacgacgatgatgataggaagccacgttacaagcacgatgatgatgaggacgacgacgatgataggaagcagcgtcgcgggaacaaccgccgccgccacgattacgatgattgatcaaggcatcatgacatgagtttagctgacgctaataagcatagttgcggcggctttgcatcgatgaatctccatttcctaatttttttcaagcatttttcatttggctattcaccggtcaccatgctccaaaaaaaaatttttttttttt

SEQ ID NO: 2614 - DNA, 364 bp, Triticum aestivum
  Clone ID: LIB3280-048-P1-K1-H8
gcttgaagctcttaatgaagcatcatttgggacctctcgtcgtcattcagggacagagagagctctgaatgaccctttacgggataacgaaggaatgcttgtagatgaatatggaagcaatactggtttccatcttccaaatttgatctgcgtgaaactgcttgatgaggaaggaagctcctctgaggataggagctttgaagctgtcactcctgaacatgaatccactggtgctgagcaaggggagggttctcaattggatggggcgaagcatcgacttgtctttgaagaagtgaatggtgatcttgagatggaagatgtagccccatcatttgaagcggaagccacctctgcatgccaacaa

SEQ ID NO: 2615 - DNA, 360 bp, Triticum aestivum
  Clone ID: LIB3280-048-P1-K1-H9
gacttgttgaagaacatcagaactcaagtgctgctcaagctcattaagccatacacaagaataaggattccattcatttcacaggagctaaatgtcccagaaaaggatgttgagcagctcttggtgtcattgattctggacaaccgtgtccaaggccacatagatcaggtgaacaagctgctagaatgcggtgacaggtcaaagggaatgcggaaatatcaagccatcgacaagtggaatactcagctcaaatctatttaccagacggtgtccaacagagttgggtgagaagatggcaggttttcattagtacctgctggttgagttgttttggtatctggggggctaaatgtgaaggag

SEQ ID NO: 2616 - DNA, 291 bp, Triticum aestivum
  Clone ID: LIB3280-049-P1-K1-A1
cccacgcgtccggggggaatggatgatgctctgcataacgatataatcacatcagctatatgacgagtaccacgagtcctttgaggagtacatccgagccgcagtgagcggatttgccactcttgctgatacgtacatgagtgttgtgtgttcagattatcctcttttttatgtgtcggcgcttgcacagatgggtttatatttgtgtgcttttgggggttcaggtggaccgtgagaccaaagaatgatatcaagaagctggaaatgttaaactgcattctggatgctttt

SEQ ID NO: 2617 - DNA, 437 bp, Triticum aestivum
  Clone ID: LIB3280-049-P1-K1-A10
cccacgcgtccggcggcggcagcagcagcagcggcagcgcaagaggtagattggagtatcaccaccaccactcaagaaatggcggccgagactttcctcttcacctttgagtctgtgaacgagggccaccctgacaagctctgcgaccaggtctctgacgctgtgcttgacgcgtgcctcgcccaagacgctgacagcaaggttgcctgtgagacatgcaccaagaccaacatggtcatggtttttggtgagatcaccaccaaggccactgttgactatgagaagattgtgcgtgacacctgccgtaacataggctttatctttgatgatgttggccttgatgctgaccggtgcaaggtgcttgtctacatatatctgcagtctcctgacattgcccacggtgtgcactgtcatatttatcatctccctgaggattt

SEQ ID NO: 2618 - DNA, 436 bp, Triticum aestivum
  Clone ID: LIB3280-049-P1-K1-A11
cccacgcgtccgcccacgcgtgcgcatgccatcatttctctgctacccaaatcctttgatgccatgagagtgaaagatttcaggccaataagtctcatgcactccattgccaagattctatgcaagctgctggccaaccagctggctccattcctgcacatcctggtcccccagtctcagagcgctttcatcaagacacgtagcattcacgacaattttctctatgtcaagaatgcggtcagatctcttcacaagtcaaaaactgccgccttgtttctgaaactggacattgccggtgctttcgattaagtctcctggggttacatgttcaagctcatgactgccatgggttttggacacagatggtgtgatttgatggctgtcctttggcgcacctcctcgttccgtatcatggtgaatggtgggctcggcctac

SEQ ID NO: 2619 - DNA, 432 bp, Triticum aestivum
  Clone ID: LIB3280-049-P1-K1-A12
gcaaggaccaggccaggaaggagctccatatttttttaggagttgatgatagtgcattgtttatttcatggctgtgggatcatctatctttaaatttgcacttgtatgtgcaaacacaagagcaggaggtggagaacaaggacgatgaaatcccaaaagaactatctggaagacataaatcacctgaggtgtacgcgagaagagatcaaacgccttttgagcacacaagtgaatcaaatacgaccatcaggagtcggaataagagggattggaaaggaactggcagggagggcaacagaaactttccacttcgaagtgtactaacggatattttgcacggagaagagaaaaagctgcaaaagtctactgaaatacgacagcctccatcatctaatcaacggaatggcagaaagcgtgatcgggaggatgaac

SEQ ID NO: 2620 - DNA, 403 bp, Triticum aestivum
  Clone ID: LIB3280-049-P1-K1-A2
aagagttcagtcttcctatagaatcttcaggagtttagttaggcattctgaaaaagagaagtcttgttgatcagacggctaaacgctcatatcgctcctaaacttgatacactgttttccttttgatatgtcttgccaagcagagcgaccaatgcaaggaggaccaagatctaggacggtgagcctcgcctagctcttccacctcttccacctatcatggaggagggacgaagggggagaagattacagcatgattcaggatcagttgagggttgaatgcttcaatggttccagaaagcttcatccacaatcctgacaaatttttctttgatgtcacaaagcataccaaggattttgaagtgagtacctgttatccccactaaccctggcagctgttaccttt

SEQ ID NO: 2621 - DNA, 226 bp, Triticum aestivum
  Clone ID: LIB3280-049-P1-K1-A3
cccacgcgtccgcccacgcgtccgggtaattggtaaagtatgccttgaggactagctatctttctagatatatagctgttgttatctgaggtttcaagcagaatagaactgcactgctacaatgcatagtcctggccctgcgctcaaatcattgcaataccggccaccgtttgggacggatagtctctacctagttattctacctcttccacctatcatcgtatag

SEQ ID NO: 2622 - DNA, 408 bp, Triticum aestivum
  Clone ID: LIB3280-049-P1-K1-A4
cggacgcgtgggtgcggtgacccatggccgccgcttcgcctgccacgctcgtcttcctcctatccctcatctgcgccccctcccggttcctcaccggcgccctgccgccaccgccgccgacgccgcccaagcctgtcatcccataccccacgacgccgtccaagcctgtgatgccagcccccacgacgccgcccaagcctgtgatgccagcccccacgacgccgtccaagcccgtgatgccggcccccacgatgccgcccaagcctgtgatgccggcccccacgacaccgcccaagcctgtgatgccagtccccacgacaccgcccaagcccgtgactccacctccggtgacgccggctaaggatgcgccgaagcccgtgctgccacctccggggacgccgaccaagc

SEQ ID NO: 2623 - DNA, 403 bp, Triticum aestivum
  Clone ID: LIB3280-049-P1-K1-A5
aaaacttttctgaaatgaagcaaaacgttaagccttaaaaagtaaaattcaattcttgagtctcatagtaatggaaaccctttcttagaagtacaactatgtcacttgatttatttccaaatcaaatggcgaagctatacgacacttccatttgcacgtcagacatataagccatatagttgtatggtgccttctgcttatactagccaaggtagtccaaacaggcgaaaagtaataaggtgacataaattctgtggggtcaaagtacttcaattagagttacacctttaggaacatctttcatgtgtttaggtgtatgacgaaactaatatggacggtagcaaaattatcaatagtgctcattgcttggttttagttctaggaaggcatgggtaatggttac

SEQ ID NO: 2624 - DNA, 121 bp, Triticum aestivum
  Clone ID: LIB3280-049-P1-K1-A6
cctcggtgttgcggcggcgtcgagtgcctatatcgttctaatctcctcaagccagggcctcgtgcacaccagcgcctgccccatcggtagcgacctgtccactcacatgcgcggtgagcgc

SEQ ID NO: 2625 - DNA, 436 bp, Triticum aestivum
  Clone ID: LIB3280-049-P1-K1-A7
cccacgcgtccgcgtctttctcccgcgttacctccctctctccctccaaccctagacccgcgcccgtctccctgccccgccgccgtccagatccaaccccaccccgccgtcattctccttcgcccagaccaatcccatctcaacctccctcgatctttctctctcaaaaaaaacctcccccgatctcccgtacatcccctgtcatcgcgccgctgccgtcgctgccgctcgcctcagcccccgtccctgacctcacgctgcccggcgcctcctccccacaccgaggacctccccttgctccgcctcttcttcctatccggctagaactgcggcgcacggcctctcatgctcgctcgcgaccctcagccgtgtctagggttttgggctgggcagcgccttcgtccgcggcgcggcttcggtgggctctgacgacttc

SEQ ID NO: 2626 - DNA, 274 bp, Triticum aestivum
  Clone ID: LIB3280-049-P1-K1-A8
cccacgcgttcgccctggtcctcgccggatcaggccacaatttttggtcgcacgggccacccggtaccgggatgcggttgttcgttacatgcgatcctgccaacatccggcacattttcacgacgaactacaccaactttcccaagggcgcgaagtttgcttcattcttcgacattatgagcggcggcatttctaccatcgacggtgagccattttgttagcagcgcatgaaaatcatgagcgtgcttacatcccgctgttgggtgctaggttg

SEQ ID NO: 2627 - DNA, 362 bp, Triticum aestivum
  Clone ID: LIB3280-049-P1-K1-A9
ccagaacggaacgaacgaaaaatccccaaccaatctcgtcgccgatcaaccctaggcttgtcgaatcctcctcccccgccgcctcaagatgcagatctttgtgaagacattgacaggcaagaccatcacccttgaggtggagtcgtctgactcaatcgacaacgttaaggccaagatccaggacaaggagggcatccctccggaccagcagcgtctcatcttcgctggcaagcagcttgaggatggcaggacccttgctgactacaacatccagaaggagtccacccttcaccttgtccttcgccttcgtggaggcatgcagatctttgtcaagacgttgactggcaagaccatcacccttg

SEQ ID NO: 2628 - DNA, 376 bp, Triticum aestivum
  Clone ID: LIB3280-049-P1-K1-B1
gtcagacgggcgcgctgatggtggcgtggtattcttcaaattataacgcatatgtgaacccacttgtattggcagggcgagtataaggccttacactagctataacaactgccaaattcccaattcataaggaacgaacgttcgctcatacgtcttgcaatgtgactgggctggacaccggcctatcgaggtgtcatccggcatgggatgggactgggacgtgactagttactaatgtggcatgcattgactgatgcatgctaagctcctggctaggatactactaagggtactaatacggggcttgattcataaatggtgttactttaggagaaactataggaaactactttgggtattccttttggtattcaaa

SEQ ID NO: 2629 - DNA, 208 bp, Triticum aestivum
  Clone ID: LIB3280-049-P1-K1-B10
ctttccctcgcctagatcaaatccggtgaacgatcggctagggaggatgaggtgaggtgggggacctgttgagccggtagagcagaccagcctgaaagggctaccagcatcgccgccgacaacaacgtgctctttctatgatcaggagcaggggtggcccaaccgccggaaaggctagaggaaatggtcatcgctgtcctgctctccg

SEQ ID NO: 2630 - DNA, 351 bp, Triticum aestivum
  Clone ID: LIB3280-049-P1-K1-B11
cggacgcgtgggcggacgcgtgggtctagctcgatcgatcgatcgaatccttccgtcgcgttcgcgtttccgtttcgtgtgtttagaccaagtttccaatggctcctcttggtgacgctgttgcccccgcgtccgccgtcgtcccaggcctcgttgtctctttcggcgagatgttgatcgacttcttgcctgacgttgccggggtctccctcgccgagtccggcggcttcttcaaggctcctggaggcgcgcccgccaacgttgcttgtgccattttcaagctcggtggctccttttccttcatcggaatgtttgtcgttgacgagttctatcacattctggtggaaatcc

SEQ ID NO: 2631 - DNA, 431 bp, Triticum aestivum
  Clone ID: LIB3280-049-P1-K1-B12
cccacgcgtccgcccacgcgtccgcccacgcgtccgcctccccttcccttcctctgctctggacaccccatctccgtcgagccgggcgccccatccacctctacgtgcggcggcggcgtagcaaggtcagtgagaaatggcgccgcccgggtcgcgccggtgggcgtacgtgcggatcatggccggcaccatcctcggcggcggcctcggcttctacgtcatgcaccgcatcgagacctcctacaaggtgaggatggaggagaggctgcggaggtacgaggcgcacttgctcgccaaggagaaggaggcgcagcagctccaggacgaggggcgccgcgaggaccaagcgcaagtcttgccggactcgtgatttcctctcatcctgttgttccggctcgccttcccgagctgttaggtgagtagtactactt

SEQ ID NO: 2632 - DNA, 424 bp, Triticum aestivum
  Clone ID: LIB3280-049-P1-K1-B2
gttaatgagatgtggcgtgccagggagaaggaactggagctggaatcaaagatgaaaaccagaaccaatggtcgaattgactcgagatcccacaaacggaagaacgactcatgagaccagagccctgtctctaagacccagcgagacagaccgtatggcgcatcattttcgtcgagggattcacatagcagttcttattcggactgggaggatgggctaggcgatgatgaaatcgaagagtttcttcgatcaagggtgaagcgcggacgaggagccattggttctagaatggatgagcctggcccatacctcaagccttcatgcggtgggcaagacaatttaataagtccggatgcacgagtgaaagaagaacggaagcgccaagttttatggccagagaagccactatttttgagatctaagt

SEQ ID NO: 2633 - DNA, 205 bp, Triticum aestivum
  Clone ID: LIB3280-049-P1-K1-B4
cccacgcgtccgccagtcctgtgctctgcctggaaggatgacgggactactgttttttcgggaggttgtgacaaagtggtgaagatgtggccgctgctgtcttgcgttcagtccacgtccttcttttggcacgaggcgccggtctaagaacttgcctggattccatagatgatctcttttgttagtggtttttgggattagactt

SEQ ID NO: 2634 - DNA, 145 bp, Triticum aestivum
  Clone ID: LIB3280-049-P1-K1-B5
gttcctcctcgtcgacgtcgtcactcggcggaggtggccgcacccctccttctttgaggggaggaggaggaggtggacgaggaggaggaggcggtatcagtatcgctttcccactattcaacatcaacatcacccttgtcgtcgt

SEQ ID NO: 2635 - DNA, 282 bp, Triticum aestivum
  Clone ID: LIB3280-049-P1-K1-B6
gccttgatccagtttggaggattgcttcatctacagatatcacatccgctccttgcctcctacgctgtggacggcaaccccattcacgctgtcacccagcttgcagagactgttcagatgagggaaatcggcaagatgacccttgagcagagctttgagcagcgagaccagctcgaccgcaacattatgaagtcaatgaatgacgcatcgtgcgaatggggggtggagtgtatcaaatatgagttttgcattcaatgggagcgaaatatagttctgtattga

SEQ ID NO: 2636 - DNA, 286 bp, Triticum aestivum
  Clone ID: LIB3280-049-P1-K1-B7
attgatggagattctacacctcgaagagatccctaagcatcatatcgtgaaacggtggacgagagatgcaagagatatactaccagatcactaggtccagtaccagagagataattcagtaaacctatcgttcacgtgtaggcatgcaacgatgtacctgaaggccatggaagtcgtgcggatgggggatgcaagtgctacatgttatgaccatgtgtatgcaggtctcggctctttgttgctgagtggagccccgttggcggagaaaagggattgtattgtcatt

SEQ ID NO: 2637 - DNA, 430 bp, Triticum aestivum
  Clone ID: LIB3280-049-P1-K1-B8
gccatggttcctgtacgtgtgcacactgttctgatctccacccagcatgatgagactgtcaccaatgatgagattgctgcggacctcaaggagcatgtcatcaagccggtgatccctgagaagtacctggacgagaagaccatattccacttgaatccatcaggccgctttgtcattggtggccctcatggtgatgctggtcttactggtcgcaagatcatcatcgacacctatggtggctggggagcacacggaggtggtgctttctccggcaaggacccaactaaggttgaccgcagtggcgcctacattgccaggcatgctgccaagagcatcattgctagcggtcttgcacgccgctgcattgttcagatctcctacaccattggtgtgccttagcccttatttgtcttcgttgactcttatggtt

SEQ ID NO: 2638 - DNA, 423 bp, Triticum aestivum
  Clone ID: LIB3280-049-P1-K1-B9
ctcgcctccaccgcctcctgtctcctcgcgcgttccgtctcccagtagcggctcccgtcgttcccctcctcggttgctgagatggccggtcgtgggaaggcaatcggcgccggcgcggccaagaaggcgacgtcccggagctccaaggctgggctgcagttccccgtgggaaggatcgccaggttcctcaaggccggcaagtacgccgagcgcgtcggagccggcgcccccgtctacctcgccgccgtccttgagtacctcgccgctgaggtcctggagctggccggaaacgccgccagggacaacaagaagacccgtattgtgccgcgccacatccagctcgccgtgcgcaatgacgaggagctgaccaagttgcttggcggcgccaccattgccagcggcggtgtgatgcccaacattcac

SEQ ID NO: 2639 - DNA, 441 bp, Triticum aestivum
  Clone ID: LIB3280-049-P1-K1-C1
cttctgaggccttcatctctgcaggatcaatctgttgattttggcacttaataactacatcttgagcgttggaggaggtagcccgtggactggtaaagacgtgaagggggacacgaggaggcttgcggtggttctaggcgcatctattcggcgagtagcagtgcgctgtgttggacagttaccagccaagatggccggctgcctcgcaaggacactacttgtggtcttaagagtcctggagcggtgagcatccgggctttttatggcggatctgaataacgaacacgtggagatccttggcgtcaatgctggaaacagtagcaacggtagtactcgctttaggaacttgtcaaatcttggtctgaagggaatgttatctcctgagattggacagcttactaatatgcattttcttgtactgcacaagaacttgttctatgg

SEQ ID NO: 2640 - DNA, 438 bp, Triticum aestivum
  Clone ID: LIB3280-049-P1-K1-C10
tgaagctgttgctgctctagacaagatcgaagctgccctgtccaagttcagtgacggcccgttcttccttggccaatttagcttggtggatattgcgtacgtgaccatcttggagagggttcagatatactactctcacctgaggaactacgagatcgccaaagacaggcccaaccttgagagatacaccgaggagatgaacaagatcgaagcctataagcaaaccaaaaatgtcccgctgaccttgcttgatgctgccaagaggcatctcaagattgcctgaagaagtggtgattcgccaagaattacggcggctgccagggaacggcggcatttgagtaggccaagactgaactctcgtcaccgggggttggggcttcttttactaccattattatcacaatgagttgtagtagtatatgttctcttcccaataaa

SEQ ID NO: 2641 - DNA, 413 bp, Triticum aestivum
  Clone ID: LIB3280-049-P1-K1-C11
ggctgccatcagctggggtggcttcggaccggaccgtggacggtgcagcgggtgaaagttggggcagaaggcaagtgcggcggatgcggatgccgcctagcttctgttgatatcgacatggaggatacacagaagtttgctgactctatttctgggttggcccttgagagggagaccaaagcaaatttcagccaatttcaggagtggctggaagcacataaagaatacgaagctatagtcgatggtgcaaatattgcactttatcaacaaaattttgctgagggcggtttcagcttggttcagttggatgctgttgtaactgagctacgagatagatataatgggaaatggccacttgttatactacataataaacgcatcgctaagcttatggaaactgcatccaataggca

SEQ ID NO: 2642 - DNA, 426 bp, Triticum aestivum
  Clone ID: LIB3280-049-P1-K1-C12
cgcctctcgaactcgtggagcgccgcgaccgacgcacgcgcgcgcggcggcgagatgaaggtctccgagaagacgctcaagggctccaaattcgagatcgaagtgaaccccgccgacaaggtttctgatgtaaagaagctcattgagacttcacaagggcagaatgtgtacccagctgatcaacaaatgctcatataccaagggtcagttcttaaggacgagactacgctggaggaaaacaaagttgttgaaaacaactttcttgtgataatgcttagacagaataagggctcatcaagtgcagctccagctaaatccaaggaaccctcaaatcaggcaccccctactcagacagtgcctgctacttctgcctttaaagcaccagccacaccagcacctcaagcagtggctgcgcaagcacctatt

SEQ ID NO: 2643 - DNA, 311 bp, Triticum aestivum
  Clone ID: LIB3280-049-P1-K1-C3
agccgccgcgcctctccttcctcctcgccgccccctgccgcggcgcgcatccctcggatcatcgtgcccaactccccttcgtgtttctcctcctcccagaaccacatctcgtcgcttaggctccttggtggcggccggctcgaggcgagcctggcgcaggcggggagaagcagcggggcggcggatgcggacggcagagtgcctgacggcaccgttattgtcgccccgcctagacgcatcgaagagggaccaggatctcaccctggcccctactggatgcacctccccagtgagttcctcccggccaattc

SEQ ID NO: 2644 - DNA, 438 bp, Triticum aestivum
  Clone ID: LIB3280-049-P1-K1-C4
atccgccctgatgccacatacagcattctgattgacaatgaagagaagcaaactggaagcatctacgagcactgggatattcttcctcccaaggaaatcaaggacccagaagctaagaagccagaggactgggatgacaaggagtacattcctgatcccgaggacgtcaagccagagggctacgatgacattcccaaggaagtcaccgatcctgatgctaagaagcctgaagattgggatgatgaggaagatggtgaatggactgccccaaccattcccaacccagagtacaagggcccatggaagcaaaagaaaatcaagaaccctaactaccagggcatatggaaggcacctatgattgccaacccagactttaaggatgatccttacatctatgctttcgacagcctgaagtacatcggaattgagctgtggcag

SEQ ID NO: 2645 - DNA, 376 bp, Triticum aestivum
  Clone ID: LIB3280-049-P1-K1-C5
cacacacgtactgagaaacattaacttttgagctctggcgagtagggattcattggccgagtcgtgaagaggttaacacgtgttcaccacaatgtggcgatgtgacaggggtacacgtctgtgttagatacgacgacgagccgttgatctattctaggtctgtgacacagctcagggtaggactgactgggggttggacagaataaagattattagaccctcctttggcttttggtacagatggtatatcgaatatgcagtggtgactcttaatgactacagactaggggacgactttaaataaggccagtgagggggcaccctcttgttttactgcgcctgatggaagagtcaatattggacctcacaatgggca

SEQ ID NO: 2646 - DNA, 224 bp, Triticum aestivum
  Clone ID: LIB3280-049-P1-K1-C6
cgcggaccgaacgatacttttaccactgtgctctttcgtccgcaggcggtcggtgcatatggaatgccttctctacctgagcttttcatttgatgtagtatgacaggtggggctggcttggtaatggcgccaataaacgatgtggttttttgatgccttcagacacccgtgtctataccgatactcggattaacctatacactgattcttcgacgtgaataagg

SEQ ID NO: 2647 - DNA, 172 bp, Triticum aestivum
  Clone ID: LIB3280-049-P1-K1-C7
gctttcttcttcctctccacgccagccgccgcccgggacctagggtttccccgcgccgccgccgccgccgtcgtcgaatcgcagcaggaggaggaagatgggcacgccggagacctcgcgggagccgtgcccggaccgtattctttacgacgtgggcggtgcgttcggaatg

SEQ ID NO: 2648 - DNA, 423 bp, Triticum aestivum
  Clone ID: LIB3280-049-P1-K1-C8
atcgggagcggtctctcgtgacgcacatccctaacctttctctcatgccacgccggctgtccctctgtgcaccaggaacatccatggcggctacagctccctcgccgccgtttgcaccaggtccaaccgggagacggacggatccatcctgccgggtccaccccgcatctagttcataccagagcactcctgctacgccaagtccacaagatccatagctgcagggaacgaggcgcactccgccccgattgcatggaccccggccggatcgacgcagtccgccgctgtcctgcttccctagctcgggcacgagcgccccgtctttctcctcgttgcgcggatccaggaggagcccccgccagcaccgccgctcctctgcgccctcgctgcaccaagccggcatgtaccccgatgcctggagct

SEQ ID NO: 2649 - DNA, 423 bp, Triticum aestivum
  Clone ID: LIB3280-049-P1-K1-C9
gttttgaagtgtagatgttccgggattgctagctcctgccagaaatactacatggtagtcttgaagtaaataccaatcatgtgatccgatatgttgtttcagaacaatagaccatcaatattattttcgcctggggttctagaggaggacatctaattaagagaaaactttggtgggatagagacagaagtttgctatatttcacaatacccaaacagaatttcattgctgattcttctgccctgaactttgcccatgccaattacattttgtagaccctttttaaggaaactgctttgtttacaccatcccattagcatgtctattagctgtgatgaaacttaaacagacacttctagaattagcaagaaaattggtggggggatctagcaatgccggttgtgcctcctttaggattacaaa

SEQ ID NO: 2650 - DNA, 410 bp, Triticum aestivum
  Clone ID: LIB3280-049-P1-K1-D1
caaagatggacaagagcactgtgcacgatgttgtccttgttggtggttccactaggattcccagagtgcagcagcttctccaggacttcttcaatggcaaggagctttgcaagagcatcaaccctgatgaggctgttgcctatggagcagctgtccaggctgccatcttgagcggagagggcaacgagaaggtccaggacctgctgctgttggatgtcactcctctttcccttggtctggagacagccgggggtgtgatgacagtcttgatcccaaggaacacaaccatccccaccaagaaggagctggtcttctccacctactcggacaaccagcctggtgtgctcattcaggtgtacgagggtgagaggaccaggacccgcgacaactaccttctttgcaagtttgag

SEQ ID NO: 2651 - DNA, 438 bp, Triticum aestivum
  Clone ID: LIB3280-049-P1-K1-D10
cccacgcgtccgctcaccgatagatgcctgcggttgtcccctctatgacttcactgttggcctgtccctctacgaagcctggaccgtcgggcctccattttccctcccggtgctggccactccatcgcccttccgacgacgcctctcctccgcctccgctttgcgtatgagggatcacacaatcactgacaatatggccggttcctcaggtcgggcaccagatgctccgaacctgccatatcatgctcggctatggcgggaacgagacgatcgcctgggccacctcccatggtcctcggaagctccaaataagaggcaggacagacggcgtaggaaaggcgcgcgaccgagagacggccgccttcggataacaagacctcgatgttgccatggcagtcagacgcgtggtgcgtccggcaacgcgccgtcactcccaga

SEQ ID NO: 2652 - DNA, 407 bp, Triticum aestivum
  Clone ID: LIB3280-049-P1-K1-D11
ctcttcctctgcccacaaaaccctagccgtcgcctcacagctcgccgccgacgcagcgagctcttcctccaccgccgcaaccatggcgacccagatcagcaagaagaagaagtttgtgagcgatggcgttttctacgccgagctgaacgagatgctgacccgggagcttgccgaggacggctactccggcgtggaggtacgcgtgacgccgatgcgcacggagatcatcatcagggccacgcggacgcagaacgtgcttggtgagaagggccgcaggatcagggagctcaccttcgtcgtccagaagcgcttcaacttcccggagaacggcgttgaactttacgccgagaaggtcgttaaccgtggcctctgcgccatcgtccaggccgagtcacttcgatacaagc

SEQ ID NO: 2653 - DNA, 394 bp, Triticum aestivum
  Clone ID: LIB3280-049-P1-K1-D12
cccacgcgttcgcgctgtttctggaggcgagttcgtgcccaggggaagggctcaatttctcggcgatgaagtttctcatgcagccaattagcagaatctccttgattgaggaggttgacgagagcactacacccatggatctggtggcgtgcggcacaggaggtgtagttccacttgccgcggacgtctccgtgcctgtcatgaacgcggacgccagatccgtgagggagaagcggctggtgagatcaggcctgaagcgtcatcgcaggcatccgagctctccaccggcaagatgagcccgcagacccctggttggactaaaaggtgtgcgccgcaatcaagtaagctttttctgtgcgtaaaatgcacagtcaaaatgtatttgctaggaaaa

SEQ ID NO: 2654 - DNA, 288 bp, Triticum aestivum
  Clone ID: LIB3280-049-P1-K1-D2
tcgacctctcacctagcgcacatccatggcgcgcttcctcgtcgccctcctcgctgccaccctggtcgcggttcaggctggagggcagctgggccacgcagcgccggcgacggcggaggtgttctggcgcgccttgctgccgcactcgccattgcccgacgccgttctccggctgctcaaacaacctgcagcagaagccaccagcttcgtaagagaccccgaggacaggccccccttcgactaccgtgattacagccgctcgttgtccgatgatgaaccaagctagcg

SEQ ID NO: 2655 - DNA, 437 bp, Triticum aestivum
  Clone ID: LIB3280-049-P1-K1-D3
gaaagaactaaggatttgatgaagccacatgagcttgagagggtggaaaccggctgctctatcatgaccgatgcttggaccgacaagaaaagaagaagtattatgaatttatgcgttcattgcaggttagggactgcctttcttgaatcaaaggaggcgtcggctgatgcacacacaagtctatacatcttcaattatgtagttgggtgcattgagaaaattggtgctgaaaatgttgtgcaagtggtcacggacaatgcttcaaataacatgggggcaaaggatatgctcaaaggaaaatggccaaaaatcttttgacctcatgtgcaactcacaccctcaacttgatggtagaagcaattgcgaagctaaagcaatttggtcctaccatcactaaagccaggcaaatgacaatttttctttatgcacattataaa

SEQ ID NO: 2656 - DNA, 365 bp, Triticum aestivum
  Clone ID: LIB3280-049-P1-K1-D4
gtaaccttggtgattcctgtggaccaaatacattggctgaaagttccacagctcttatcaccaaaggatgtgatactcttgcagtagctacggtgcccaaaagccatgattctgtcgcaccaagcagtgtgcctgaaacatctactttttctggtggcatatgcctagcttccccaagtgtgaaacccaaaagttgggattctcctatacgaataatgtcacctgaaagctctgcatatgatggtgccaaaaatcaggatccttctgcagctagaatggcacctacacttcatgacgttctttggaggacagcttttggaaaatctgcatctcgtggtgcggaaggtagcaatggtgttgctcca

SEQ ID NO: 2657 - DNA, 427 bp, Triticum aestivum
  Clone ID: LIB3280-049-P1-K1-D5
ctcacatcctgggatcaccttacattgcataggcctctccaatcatttctttcgcgtgagtccattccctcccacataccctgatactactttttccaatgactggaatgtgaagacttctttgtactggagttgaactcttatttagctttacaatctagatttcagatttgctaatttttttgaattaccttaccaagctccagataagctttccacaaatataaagtagatagggaatacttggcctgctggccagtgaggactataattatgtgatgagggtaattccagaacatgacaggagcgcctgctcttgcaagattcacaaaggaataatattggtggctactaatgtttctttttgttcttgacattgaagtcaagcaaccaagtgattagtgttcaaaaaaattatagctatatt

SEQ ID NO: 2658 - DNA, 290 bp, Triticum aestivum
  Clone ID: LIB3280-049-P1-K1-D6
atccaacccccctacgatctcgccgagaaatctcctccgatcgaagcgaagccaaggctgtctcgtccccctcctcaagatgcatatctttgtgaagaccctcaccggcaggaccatcacccttgaggtggagtcctactacaccatcgacatcgtcaaggctaagatccaggacaaggagggcatacctacggaccagcagcgcttgatcttcgttggcaagcagttagaggatggccgcaccctggcagactacaacattcagaaggagtccacccttcacctggtgc

SEQ ID NO: 2659 - DNA, 433 bp, Triticum aestivum
  Clone ID: LIB3280-049-P1-K1-D7
cacacacccacacgcgcacgcgtttgacattttccgcccaccaccgccggagggagggagctccagccatggccgccaagtgctacccgacggtcagcgacgagtacctcgcggccgtcgccaaggccaggcgcaagctccgcggcctcatcgccgagaagaactgcgcgcccctcatgctccgcctcgcgtggcactcggccgggaccttcgacgtggccaccaagaccggcggccccttcggcaccatgaagtgccccgcggagctcgcgcacggcgccaacgccggcctcgacatcgccgtcaggctgctctagcccatcaaggagcagttccccatcctttcctacgccgacttctaccagctcgctggagtcgtcgccgtcgaggtcaccggcaggcctgagtgttccttccacccgtggagacagga

SEQ ID NO: 2660 - DNA, 439 bp, Triticum aestivum
  Clone ID: LIB3280-049-P1-K1-D8
tatgctcgtacgggcacacgtttctgtcaaccaaggtgaggagggtgtggatcaatcgaatcgaatcctaagctgaggatggctggcggtgctcaaggtgtatgcggaccgggtgtcgcagccgtggcgcgccatcattatcttgtgcaaggtcaaccggatcgacttccacgagcttaccgcagatctcgtcaagggacaacaccgcgcaccagaattcaccaaaatcaaccccatggcacaggtcccaacaatcgtcgatggaagattcaaactctttgaaagccatgccattctgaggtatcttgccaccgtgttccccgggggtacagatcactggtaccctgctgacttatttaccagagcaaaactcgagtctgtcttggattggcatcactctaatctgcgccgtggtgcagcaacctatgtactgcacacc

SEQ ID NO: 2661 - DNA, 357 bp, Triticum aestivum
  Clone ID: LIB3280-049-P1-K1-D9
cccacgcgtccgcagcaacttcgtcgtgccgcccggtgtcatcaccataccgcgcgccccgccgacgcccaagatgatgagctccgtgtcggccgtcgcgcccagccccgcgccggtgaggtccccgttcgcgttaatcttccctgtcttatgtccatcgctttctctactccgttcttattgtggttctcgtggtggtacctctcgtccctcctctttttctctttttcatcttttctgcttctttctcttctattggttgtttgttatttttaattcttttgtataagctattcttattttttgtttatcttgcttttctttgtgttgctttttttgtttctttattctcttttt

SEQ ID NO: 2662 - DNA, 439 bp, Triticum aestivum
  Clone ID: LIB3280-049-P1-K1-E1
gccagatcgtcgttcatgagctcgaaggagaagcccaccctcggaggccagcggattaagacccgcaagcggaatatcgcagctcctttggacccttcgtcgttctctgatgcaattgtccagatttatctggataatgctggagatctggaacttgatgccaaaagtgtagagtcatcagatctcaacttctcacgttacggtgacactttctttgaggctgttttcattggtgtgcgtactcagcctggtacgattaaacccgaagaagagggagagcgccacccctattctctcattgactgtgcagcacaacgtgaagcactattaccttatgtcctctttattcagaaaacattgcgcaggacgcctttcttaataaaaagtctagaaaatgttatgcgaaagtttctccagtccttggagttctttgaagaaa

SEQ ID NO: 2663 - DNA, 364 bp, Triticum aestivum
  Clone ID: LIB3280-049-P1-K1-E10
atccattgcattagttatatcgctttattgacatctgatggagaaggatacagatgaatcgaggaccagttcagataacatattgaaaatggagtaacataaaagtgtcgtgttcagtgagctctcaaagctattatggtctaaagatatgtacaggctgaaatccgaaagtgggatgtggcgaggtggccagtgcaatcgcgccatagatatcaaggacataataggacgtgttatgcccgtttagtggattgacaactgctgtttgatgcattgtatattggggtgtaccatcgcatggagactgcatagagactaagactataatgtggaaattttgcgtacactttgacagcggcaatgg

SEQ ID NO: 2664 - DNA, 399 bp, Triticum aestivum
  Clone ID: LIB3280-049-P1-K1-E11
tttctctctggagaaagaaacagaagcttcgagtacccctatcaaagtcgctacacacggtggaaatctcttggtctctctcccgacgcgagaggcggtttccaggcgtgctgcctccgctggtctccctcgcctccggtaagccgtcgggctctgggaggtgtgcgggacagtgtacgaccgcgacgcggttgtagataatgttgttttaggattttattctggcactggcgggcaggcaggggcgatgtcaacgctgtgggataaggtcccccctggctcctgttctgtctcggctgagctccctccgccggtggcactgtgtggtttgggaggtttgtacactttttctgcggcgatgttatctgggagattgtggtgcactaccttccttcagta

SEQ ID NO: 2665 - DNA, 439 bp, Triticum aestivum
  Clone ID: LIB3280-049-P1-K1-E12
cggacgcgtgggccacgggctcgtcgggctggtgaggtcgccggtgtcggccacgctgccgcagatcgggtcgcgcctcttcgtcacctggggcatcctctggagcttccccgagacgaggacacacatcctggtgagctccttggtcatcagctggtccgtcaccgagattattaggtactctttttttggcacgaaagagttgtttggatctgcaccatcatcgcttctatggcttaggtatagctcattcctagtcatgtacccaaccgacatcagcagcgaggttggcttgatatatattgcgttgcagttcatcaaggcatcggagaagtactgcatcagaatgcccaacaaatggaactattcatttgattacttctatgcatcaatcctggtactcctagtctacatcccagggtgatcgatgaggcctact

SEQ ID NO: 2666 - DNA, 398 bp, Triticum aestivum
  Clone ID: LIB3280-049-P1-K1-E2
cccacgcgtccgccaccaccaaacttctcccccacccaactcgactcgagcgatcttcaaagcctccacagcgagcaaagcaacaccaccctccatgccaccctccggcctcctctcctacatcccgaccagcctctcctccatcctcccggtgcgcggctgcgccgcgcccccctcgccgtcgcctccaactccgccggcgtccccggccccgagcaagatgtcgccctcggtgaaggcggcggaccgcgcggagctggcgcgcgtgttcgagctgttcgaccggaacggcgacgggcgcatcacgcgggaggagctggaggactcgctgggcaagctgggcatccccgtgccgggggacgagctggccgccatgatcgcgcgcattgacgccgacg

SEQ ID NO: 2667 - DNA, 420 bp, Triticum aestivum
  Clone ID: LIB3280-049-P1-K1-E3
catggctccactgttccacgtggaggctcttctcccgagctcgatctcacccaagatcgactccatcctccactcccacatctacccgcaggtaggtcacgtcttccgcgccgtcgccaggttcagggccctgctcgtcgacgtgatactcagcaagaagaagacggccgccgcgagagctggcagcggcgggtacggctactacggccgctcgacgaggaggagccgcggcaagaagaggacgagcaagatcgccggcttcgtgaagatgcatttcgtcggctcctccggcccggctcgggcaagggatcggctggacgccagccgcgcgccctgctatccgtcgtactcgtactacgagtactcggcggcgtggaacgctgtggttccagcgacgccggcggccgtggaggaggaggt

SEQ ID NO: 2668 - DNA, 335 bp, Triticum aestivum
  Clone ID: LIB3280-049-P1-K1-E4
gcagatctttgtgaagaccctgactggtatgaccatcaccctggaggtagcgtcttttgactcgatcgttcatgtcaaggcctacacccaggatggggagggcatccccgcggaccagaggcgtatgatcctgtttggctagctgatactggacgggcggacctcggccactacaagattcggaaggggttcaccctgcacctggggccgatgctccagggggggctgcagatatttgaggagacactgaccggcttgaccattgccctggagtttgagttctttgacaccattgacatggtcaaggcaaagattcaagacaaggagggctttct

SEQ ID NO: 2669 - DNA, 441 bp, Triticum aestivum
  Clone ID: LIB3280-049-P1-K1-E5
cgccatcctccatccccccctctccccaccgtctccctcctcatctccggcgccgctccgcgactcctccaaggaaagatggcgtcccacattgttggataccctcgcatgggccccaagagggagctcaagtttgccttggagtctttctgggatgggaagagcagcgctgaggatttggagaaggttgccgccgacctcagggccagcatctggaagcagatgtcagaggctgggattaagtacattcccagcaacaccttctcatactatgaccaggtgcttgacacaacggccatgcttggtgccgtcccggaccgcttctcttggactggcggggagattggtcacagcacctacttctcaattggccagtggcaatggcactgtccctgctatggatatgaccaagtggtctgaccccaactaccacttcattgt

SEQ ID NO: 2670 - DNA, 316 bp, Triticum aestivum
  Clone ID: LIB3280-049-P1-K1-E6
ctggacgcacatgatggaccgcacgctcccgacattccgctaccaggcctggaaaatagaaccctagaacggcgcgccagtagtaccgcacaatgaccatttccgaagactcgtccccaaatgggagcagaaatttgtcttggaacgttgactggatgatcagaaacaccttgtacattttgctaatggtgcaccagaccttagaggcgtgctcacaaaccggaactaagaggcgttggattaagcacgaagttagtcacacttttgttataacatggaacggctgctttgtgcacagcaggatattgcgttgatt

SEQ ID NO: 2671 - DNA, 423 bp, Triticum aestivum
  Clone ID: LIB3280-049-P1-K1-E7
cccacgcgtccgggaagagcccagcactactccacttcatttggcaaagtgggagttgcagaagaagaacttcttcatgcaggcacctgctaagttaacagcctgcgattaccaccgggatcttgacatggtggtggttgggttctctaacggggtatttgggctgtaccagatgccggactttgtgtgccactgccagctgtcaatatcaagggagaagatcactactgctattttcaacagcttggggaattggctagtttttgggtgtgccaagcttgggcaactgctggtgtgggagtggtggccagagacctacattttgtagcagttgggtcactacttttgagtgaaccgtattgcatactcaccagatttttagtttattgctacctggtgctgatgataacatagttaaggttt

SEQ ID NO: 2672 - DNA, 420 bp, Triticum aestivum
  Clone ID: LIB3280-049-P1-K1-E8
ctcagttgcagtggagaatgttggtttacttgctgtgacacatgttggcagcaggagagtggtgcaaatatctgccggcttcatgattttctttgctgacctaggaaaatctggagccctgttcgcgtgcattccactgcctatatttgctgggatgtactgtgttttcttcgcatatgtcggtgcgtgcggtctgagcttcctccagttctgcaacctgaacagcttcaggaccaagttcatcctgggcttctccttcttcatcggcatatcggtgcctcagtacttcaacgagtacgccttcgtctcgggccacggccccgtgcacacgggcgctagatggttcaacgacatgatcaacgtgcccttctcgaacaagccgttcgtggcggggctggtggcctactttctggacaactc

SEQ ID NO: 2673 - DNA, 440 bp, Triticum aestivum
  Clone ID: LIB3280-049-P1-K1-E9
attcaatgtcatcaatggtggatcccatgctggaaacaagcttgctatgcaggagttcatgatccttcctactggagctgcctcattcaaggaggcaatgaagatgggcgttgaagtgtaccacaacttgaagtctgttatcaagaagaagtacgggcaagatgccaccaatgttggagatgaaggtggttttgctcctaacattcaggagaacaaggagggtcttgagctcttgaagactgcaattgaaaaggctggatacaccggcaaggttgtcattggaatggatgttgctgcttcagagttctacaatgacaaggacaaaacatatgaccttaacttcaaggaagagaacaacgatggttcccagaagatatctggagatagcctgaagaatgtatacaagtcattcgtgagtgagtaccccattgtggtgattg

SEQ ID NO: 2674 - DNA, 443 bp, Triticum aestivum
  Clone ID: LIB3280-049-P1-K1-F1
gctccacctgtctgggttgaccgagttggattcaaagccaacataacagagagcttcacaaggcagagcaaattcacatatggcctcgtcgtggaagaaatcacaacacgtgatgaaaccaacagtatctgtacacatggttctcgggcaatgcctagtggcggcttgagcatggatggacctcccacaaccctcagtggtactggtgtagatcgaatggcatttctacaagcaaatattactcgagacaatacagagtttgtaaatggtgcagtcattggcgacagatgtattttccagttggatcaaggtcttgggatcggaagcaaaagcccactcttcaaccgtcatcagcttacattgacaaagttcattaatttaaataatcaagagaaaggtgttggcaagccgctgccagctgtgttggttctttatggtcatta

SEQ ID NO: 2675 - DNA, 390 bp, Triticum aestivum
  Clone ID: LIB3280-049-P1-K1-F10
gggtgccgtgcagctcgagtctgttgctgctcaacatgcacaagctaagctaaatgtggaatcacttcctcaaggcccttcgttgtttgatggaaatgacactgccaggatcaatggttccgagtctgatgagtatgaaaaatttgacatgggattaatgcagtttggatgtgcacattaccgaaggagatgcctgtttcgagcaccatgctgcaatgagatatttgattgccggcactgccacattgtatcaaataattcgatcaaaattgatacttctactctacatgaacttccatgccatgaactgtcacaggttatatgcacattgtgaggctctgaacatgtggtacgacaagtatgcatcaactgtggtgtatgcatgggaaa

SEQ ID NO: 2676 - DNA, 416 bp, Triticum aestivum
  Clone ID: LIB3280-049-P1-K1-F11
ccctcactccaccgtcgctccttctcggcccttccccgcctcctcgcattgcagggaggagactcaatcaaggtgatgcacatcgttatctctctctctctctcgcaatcagaagcatgcatttgatttaggactgcgtgtggatgattggttgatttgattgtgccatgccgaaccttgttgatggcggaagcgtgtgctttcaccaattaattccgtttctttttggagtgtgttctacgcttcgaactaccctttcttctcatcaattgtttccctcttttgagcctagcgaatagcgagaaccggttgcgatcggcagatggtttggtcgatcggtcccctatcttgctctgctcgcgtgtaattgatgcgcctctgtttcattctctacaactcttgttctgcgaaggaag

SEQ ID NO: 2677 - DNA, 442 bp, Triticum aestivum
  Clone ID: LIB3280-049-P1-K1-F12
gttggatccacctgtatggtctgctttggttcagaagtattcccttggtgatgatgttgatatggcagtttcatgcttccccgaaatgctggaaagaagaagtggcaatcaggttggtagcgctcttgaggtgcttgtgtatgggctgtgcaggaagaaagaagcaaaggaagcgttcaaagttctgaaggacctggtgttggaaaaggatgtggttccttggcaaagtacctacaagtatttgatccacaagttgatccgccaagggcatcttaaagaagcatttgatgtgctaggtttaatgaaaagtaatggatttccgccttatatcaatccatttatcacacacattttgaaatctggtactgaggacgatgccctgggtctgctaaacgcaatgtcttcagaggagttcccatcaagaacagtttacatgcgcttg

SEQ ID NO: 2678 - DNA, 436 bp, Triticum aestivum
  Clone ID: LIB3280-049-P1-K1-F2
aatggcctccatggtaaaggtgtttccgttgagaatatctcttctcaactttcaccttgggcatctgcgctatttgagtttttgccccaatttattaggcagcagctgcttctccgtcctgaatctgttgactcagctcaactttctcagattgaaaccgaaaagcttctagctcaattggtcgagaccgaattgaacaaacgtttgaaggaaggcactcacaaaggaaagatgttcaatgcaatctggcacttttttggctaccaagctaggggtgcaatgccttcaaagtttgactgtgatatgcctatgttctgggacatgtgtgctaccacatttttgcagctggtttgaacggttacatggttactgtgtcaaattttaagagtcccctgaacaagtgacgatgtggtgctgctcctatttcgttcatgat

SEQ ID NO: 2679 - DNA, 142 bp, Triticum aestivum
  Clone ID: LIB3280-049-P1-K1-F3
gcggtcttcgtttatattttctaccaaaaggtcatacctagagcataggtgctgtttgaggtaaccaccattattactatggtagaatggcgcttattcgcactgaatatgaagactaatcataatttatccagagcgttaa

SEQ ID NO: 2680 - DNA, 415 bp, Triticum aestivum
  Clone ID: LIB3280-049-P1-K1-F4
cccacgcgtccgatttctattgctctctccacagtgctgctacgctgtgggatgttcacaattgcgatgcttgtcaggaaacgcctatatgggatgcgtcaggagctgtttcaatacctgaagttggtaaaggattccaagggtaaaaaatcaatacaagaacttgcagatgcaggggatcctttggtcagaaaggaccttgcatgggtttctctaaattctaaatgctcgctcttgttcacacagtcttggttttctgccaatccttcaattcattgcgacgccgtatacctttgttactttttactgtgctatatcaaacatggttgagatagttccatctttaaaagggggtggagctttttggtttactgatctgacgtcttctgatgctctttgcatttttcccatgata

SEQ ID NO: 2681 - DNA, 378 bp, Triticum aestivum
  Clone ID: LIB3280-049-P1-K1-F5
cactcacacgcaacaacacacgagtccatcgatcgatatgggttccgtctcctacgtactggcggcggccgtcctggcggcgctggtctccggcggcgcgtgcatccccagcgtgccgccgggccccaacatcaccaccaactacaacaaccagtggctccccgccaaggccacctggtacggcaagcccaccggctcctgccccaaagacaacggcggcgcgtgcgggatcaaggacgtgaacctggccccctacaacggcatgatcgcctgcggcaacgaccccatcttcaaggacggcaagggatgcggctcccgctacgagaacaagtgccagaagccgtctccgagctccgacaagccccgcacccattcttt

SEQ ID NO: 2682 - DNA, 435 bp, Triticum aestivum
  Clone ID: LIB3280-049-P1-K1-F6
cccacgcgtccgcacctccacattctgcctcccacctctccggcgagatctccctcctccccgcgccgcagccagccatggacgccgtggactccgtggtcgacccgctccgggagttcgccaaggacagcgttcgcctcgtcaagcgctgccacaagcccgaccgaaaggagttcaccaaggtggccattcggacggccatcgggttcgtcgtcatgggcttcgtcgggttcttcgtcaagctcatcttcatccccatcaacaacatcatcgtcgggtccggctgatctcgtctccgcaggtgaggtgcggcaggactagaggatgttgtccattcatgggggcggcaaaccaattcatttaggacttcattgtagaggacattttcccttgtgttttcatttgaaacagttgttcctggagcagttatgaacc

SEQ ID NO: 2683 - DNA, 433 bp, Triticum aestivum
  Clone ID: LIB3280-049-P1-K1-F7
gttattgcaaagcatgatcagattgtgtctggaatagactggagtagatcttccaacaaaattgtgactgtttgacatgatagaaattgatatgtttggacacacgaaggacaagattgggtacctacgcttgttattttcaagctaaaccgcgcagctctatgtgtacagtggagtccaaaagaaaataagttcgctgcgggaagtggtgctaagtctgtatccatttgcttctacgaacaagagaacaactggtggattagcaaggttattaggaagaagcatgaatcttttgttactagtgtcgggtggcatactaacaatttacatcttgcaacaacttctactgatggttaatgcagagtgttctccaatatcatcaaaggtgttgataccatgggttcacaagccggtgccttagtggattggaaat

SEQ ID NO: 2684 - DNA, 57 bp, Triticum aestivum
  Clone ID: LIB3280-049-P1-K1-F8
gtcattgcaacgcactaacagagtgtgtatggatattactggtggagagcttgcaag

SEQ ID NO: 2685 - DNA, 286 bp, Triticum aestivum
  unsure (1)...(286): unsure at all n locations
  Clone ID: LIB3280-049-P1-K1-F9
gtcgctcccgagaggcgaccggggggcaaccactaaataccgccggtctnccgccccctaatccccttccccatccctcgcacgaacaccgtggagcgcaggatgaaaaaaaacaaataaaaatatattaattaaataataaatttataatataaataaattaaatattaaaaaaataaataaataattaattaaaatataaaataaaattattatatatctaatttataaaaacaaataaattattaaaaaaataataaatatataaaaaaaaaaataataataa

SEQ ID NO: 2686 - DNA, 387 bp, Triticum aestivum
  Clone ID: LIB3280-049-P1-K1-G1
cggacgcgtgggcggacgcgtgggctgacccgtgctgcatcagtcgttctacagagacaaccatcattcgctgaacttccaaatagaccagaaaatattcgcaccagcaagcactgatgggctgaaaactcgggcagcaatattgatatgtaattgtagcaatttgtatacgagtgcggcgtttctactcccgagctcatctgcacccgccctgacgaaaaaaatcaaaacaaatactaaaaaaattcaaaaaattccatatttttttgtgtggtagataagtttatgcgtgaggtgcgctccaagtttcaactcatttgaacatcggagcaactctgagcaataaagacaaattcagggtcgataaaaaaaatatattaaataata

SEQ ID NO: 2687 - DNA, 389 bp, Triticum aestivum
  Clone ID: LIB3280-049-P1-K1-G10
cccacgcgtccggggaggagttcgtcgcaaggtacgcgtcgtctcacgaagctggcggcggcactagctcggtcatcacgacggcggccgaggctgacggcatgtggtcgtcgggcggtggcgacgacttcttggaggctccgcttccgcccagcgtggactggagggccaaaggcgccgtgacgcctgtcaagaaccaaggctcgcaatgcttcagctgctgggcgttctcggcggcggcaatgatggagagtctctacttcatcaagacggggacgctggtgaccctgtctgagcatcagctgtaggactgctacaagttcgactgtggccgcaaccgatgctactaccacagggtgcttccagtggatcatggtgaacggccttct

SEQ ID NO: 2688 - DNA, 435 bp, Triticum aestivum
  Clone ID: LIB3280-049-P1-K1-G11
ctccctcgtcgcctactacctgcactgagacgcgcacgctcccacgcggcgccacgcagacgcgtcggttgatttgatttaaatttaatttaatttcaattcaatccaccgatcaacgaatgaccactctatgatgattacgccgcacatttatcggcactactacatgtaattcctcttttcgacccgtttggtaaactcaacccaatccgcgtctgtaacccgtggccaatggcgccgtgttatcatttcattcgaacaaattgaatgatatttgttgtgattctattctaaaaaaaaaaaagaatgaatttataaagaatcaataatttaataaaaaataaaattcaaccataattacttaaaaattaaaaagggcggctcgtttaaaggatccaagcttacttacccgggcatgggaagtgatatcttttc

SEQ ID NO: 2689 - DNA, 144 bp, Triticum aestivum
  Clone ID: LIB3280-049-P1-K1-G12
ctcacgcgtacgggccgacgaggtgctggacgcatccgagcgccgcgtgctcatcagagccctccccgtgccgccgtcggccgacagcctgctcggtcgtctcgaccagatcgacctacggttgaagcatctagaggaggagcg

SEQ ID NO: 2690 - DNA, 359 bp, Triticum aestivum
  Clone ID: LIB3280-049-P1-K1-G2
cggacgcgtgggcggtggaattactcggcaaccatggcgcctgcagccttgtccgcccccgtccttcgcgtctctccacagtcggctggaagggccgccgccgccgcgcccgccggcggtctccgcttcggccagacggcttgcctgcactccggccattctggccaaaccgtgctgcgatcgaaggtgctgctgcagaggcccgtggggcagaggtggcgctcggcgctgagaagcagcgtggatgactccaaagccacggatgacaaggtggagttcgggtactcgaggaaagacgtgctgctgatcggcgtcggtgtcaccctttcttggctactgccttaagtccggccttgagt

SEQ ID NO: 2691 - DNA, 412 bp, Triticum aestivum
  Clone ID: LIB3280-049-P1-K1-G3
ctcacctagcgcacatgcatggcgcgcttcctcgtcgcccttctcgccaccaccctggtcgcggttcaggctggtgggcagctgggccacgcggcgccggcgacggcggaggtgttctggctcgccttgctgccacactcttcattgccctacgccgttcttcgccttatcaaacaacccgcagaaggtgttgaactgctcacagaagccaccagcttcgtgagggatgccgaggacaggccccccttctactaccgtgattacagccgctcgccgtccgatgatgaaccgagcaagagcaccggcgccgccttcggggcgcgggactttgactacgacgactacagcgggggcgacaagcttcgttgtgccgcctccggggcgcggtacttcgactacgacgacttcagtg

SEQ ID NO: 2692 - DNA, 438 bp, Triticum aestivum
  Clone ID: LIB3280-049-P1-K1-G4
ctcctcgggtttgcacagtcgtccaccatgccgaagcagatccacgagatcaaggacttcctgctgacggcgcgccggaaggacgcgcggtcggtgcggatcaagaggaccaaagacgccgtcaagttcaaggtgcgctgctccaggtacctctacacgctctgcgtcttcgacgccgacaaggccaacaagctcaagcagtccctcccaccaggtttgagcgtccaggaggtttaagcatcaagccagacaatgccttttctagtagcgggaatgttctatccatcttgctttagtaactgttagcaggctctccttgtttacccccattaagagagttttgatgtcccaagaatggaatgtaatgttgggagctatgtgcttgaacctgtgaggatttttgtgtattttcaactttctggagaggagatcattatt

SEQ ID NO: 2693 - DNA, 446 bp, Triticum aestivum
  Clone ID: LIB3280-049-P1-K1-G5
tggaactacaacacactgctgacatgctatgtttctatctcttgggagaggcagtgaaatatattagttgactactctgttaatttacaagtatgttgcttgaggtaaccatggcactattcagactgaaattcattttattgcagatcacaggacgatatttcgggagtctaatgatcacggtgcatttggtacagcagaggaccatatttttgactgatttcatatgttctacaaaattatatattggttattccttgttattgcgaatttatcttatactatgttagagacgatgcttataactttatcaacaaataaacccttgcgcagactgttcttcaggttcagtgttcaaattgtcgaaaaggaaggtctagatctgcagagtttgggtgtttcttctcatgtgtacattccataaaatgcattcgcataatgcaata

SEQ ID NO: 2694 - DNA, 448 bp, Triticum aestivum
  Clone ID: LIB3280-049-P1-K1-G6
gccgccgccccccaccgccgccgccaccatggggaggcgatccggaggcaggaagctgcccttcttctccgccgcctccacctcgccctccaccaagcgcacccgctccgcgcgccgcctcccttccctgcccaagcccagctcgccgcctcccccctccccgaccactccgccccccgcgccgcagaccaccacgtctccgcctgccccctctcccgggggtggtgccgccctggccgccaaggtcggcaagaagaaggccggctcccgcttgtggatgcggctggaccggtggggctcctctgagatcctggagctcgacaaggcctccatcatccgccgcgcgggcgtgcccccgcgcgacctccgcatcctcggccccgtcttctcccactcctcaagcatcctcgctagagagaaggcgatggtcatcaacctagaattcatc

SEQ ID NO: 2695 - DNA, 351 bp, Triticum aestivum
  Clone ID: LIB3280-049-P1-K1-G7
tgaatggtggttggctgctatctactccactgcggaggatattactaggcagtaagctaggatcaatttgcgcctaacatacagctacaagctaaaccaagaggaccggagtcgcacgcagtcttcctttcctgcccaagcccagttcgacgtctccccctctcctgaccacttcgaccgccgtgccgtaaaccaccacgtatccgcctgccccctttgccgggggtggtgccgccctggtcgccaaggtcggcaagaagaaggccggctcccgcttgtggatgcggctggaccggtggggatcctttgagatcctggagctcagacaaggccttcatcattcgccgcgcg

SEQ ID NO: 2696 - DNA, 321 bp, Triticum aestivum
  Clone ID: LIB3280-049-P1-K1-G8
ggagagggcatgggctggtatctactccctggggtgtgtatgacatgctacttaggcaggatttgttccctgtcaacatcaagatgtttgtcctggatgaagcgggtgtgatgctttctctctgttttaaggatcacaattttgacatcttcctgctgctcccagggaagattcaagttggtgtcatctctactaccatgccctctgaagccctagtgattaccctctagttcatgaacaagccattgatgatccttgtcaagagggatgagctcatccttgtgggtatcaagcagttctatgtcaatgtggagaatgaag

SEQ ID NO: 2697 - DNA, 428 bp, Triticum aestivum
  Clone ID: LIB3280-049-P1-K1-G9
gaaggctttggctcactgtggagaggaaacactgctaacgtcatccgttacttcccaactcaggctttgaactttgcattcaaggattacttcaagaggatgttcaacttcaagaaggacaaggatggttactggaagtggttcggtggcaaccttgcttctggtggtgcagctggtgcttcctcgctgttcttcgtgtactcccttgactatgctaggacaaggctggccaatgacgcaaaggcatccaagggtggaggtgagaggcagttcaatggcctggttgatgtctaccgcaagactctcaagtcagatggtattgctgggctttaccgtggattcaacatctcctgtgttggaattattgtctaccgtggtctgtactttggactgtatgactctctgaagccagttctcctcactggcac

SEQ ID NO: 2698 - DNA, 435 bp, Triticum aestivum
  Clone ID: LIB3280-049-P1-K1-H1
atcgggttttggacgatatgggcaacccccctcgtatgctgggggctatgctgctggggtctaccagcctgcaccatatgcaggagcccaacagtggcagcagcaaccacctcatagttcctattctggaggtggggcgcctgctgctagacctaattcacgaccgcagcagtcacagaaccgctacagcaacttagataggacttcaaacaggagaccaccaggtcagggccgctactaggctcgcctcctctttggttctagccctggctttgctgtcactccttactagaacttaccttgacttaaatcaggcataggaatagacacagcatttgcaaagtctggtgatcttcaagcttcttgatcgtggtataaaaattacctagggggaagtgttgtatactataaattattgccatatcaccagatact

SEQ ID NO: 2699 - DNA, 118 bp, Triticum aestivum
  Clone ID: LIB3280-049-P1-K1-H10
tctagaggatccaaactgacatgcgcgcgcatgccacatcgttagtcttgtatcgagccacctaattgcaaatcactggccggcgtggtacacccccatgtctgaaaagcacccggca

SEQ ID NO: 2700 - DNA, 444 bp, Triticum aestivum
  Clone ID: LIB3280-049-P1-K1-H11
ggcaacgctgcggtgacccatggccgtcgcttcgcctgccacgctcgtcttcctcctatccctcatctgcgccccctcccgggtcctcaccggcgccctgccggcaccgccgtcgacgccgtccaagcctgtcattccataccccacgacgccgcccaagcctgtgatgccagcccccacgacgccgcccaagcctgtgatgccagcccccacgacgccgcccaagcccgtgatgccggcccccacgatgccgcccaagcctgtgatgccggcccccacgacaccgcccaagcctgtgatgccagtccccacgacacccgccaagcccgtgactccaccttcggtgacgccggcgaagtatgcgcccaaagccgtgctgccaccttcggcgacgccgaccaagccagtgctttctgccccggtgacggcgcccgaagccgtgac

SEQ ID NO: 2701 - DNA, 383 bp, Triticum aestivum
  Clone ID: LIB3280-049-P1-K1-H12
ttcatctccactgcggcacacgcgccgggctccacttgggttttgccgatccgtcttaccccacgccggccaccactagggttttgtcgatgcggctcacgccgacgccggccaccaccagatcgcctccggcctacgctctcaccgctgccgacgatggtgggatactgcattcagtcgatgctcaaggatgggcacaagcatctctcgggcctagaccaggccggcctgaaaaacattggcgccggccgcgagctatgcgtcatcacccgaaccttccttggcccgaacgggatgaataagatggtcattaatcatctagacaagctctttatcacgaatgatgccgccacaatcgtgaacgagcttgaggtccatcaccc

SEQ ID NO: 2702 - DNA, 238 bp, Triticum aestivum
  Clone ID: LIB3280-049-P1-K1-H2
aaaagagtctttgcagacttgcttctttctactattagtagatcctaatcatcattagccatgaaacttttgtagacttgcttatttttgctattactagatcataactgtcaatctttatgaagtttgttgggtcgctatgggtcttgagatgatgttaagtattggtgtaaatattagctatccggttacataaataggacgaagatctgattagctctaaaaaatgaacaatact

SEQ ID NO: 2703 - DNA, 414 bp, Triticum aestivum
  Clone ID: LIB3280-049-P1-K1-H3
cccgcatccccgaccctcccatctccccctcctcccgcccgcaccccccaccatcgccgcaccccggcgggcactgccctaatcggatccaaccatgatatccgagacgcagtgcgccccgttccggcgatattccccaattacttactctcgtcccagagcgcgatggcgagatctggcggcaagcgaggcgtgatggagcaccactgcctggaccggttccgccgccggcgactcctcgcctttctccgccgcaacaacctgcccgccacctttgacgcgctgaagcacgagacgagcgttttcttggacgtgcggttcctgcagcgcctggtggcgggcggccggtggcaggaggcgcgagagtacttgagccgctttctgccgtgccaggacgagtttgacgcgcccacc

SEQ ID NO: 2704 - DNA, 441 bp, Triticum aestivum
  Clone ID: LIB3280-049-P1-K1-H4
cggacttcgctcgccttaatgcacttgcagaaggtgaggtgttcccaccgatggtgctcggggtgacgaacttgtttttcctgaggagtcttaagagtgttccaaatgtggtgtccgtgggaagcccgaatccaaattctactagggtgctcccagcaggtgggcaatcaccagcatcaccaaatggatccaatgggacacctgtgaggctcaaactcgacaaacttgcaatcaataagttttcgcccactagtctattgaattcaatcaagttgagaagagaaggccctctttccctcatgacagagcataaagaggcgctatggagcacatatgtgccaactacaaaggctgacacctctgttctaaataaactcattgatgccggtgtgtcaccgagaattgaggagtccatgttagtcgtcaacaatgagatattga

SEQ ID NO: 2705 - DNA, 446 bp, Triticum aestivum
  Clone ID: LIB3280-049-P1-K1-H5
cacacacacacgcacgcgtttgacattttccgcccaccaccgccggagggagctccagccatggccgccaagtgctacccgacggtgagcgacaagtacctggccgccgtcgccaaggccaagcgcaagctccgcggcttcatcgccgagaagaactgcgcgccccttatgctccgcctcgcgtggcactcggccgggaccttcgacgtggccaccaagaccggcgggcccttcggcaccatgaagtgccccgcggagctcgcgcacggcgccaacgccggcctagacatcgccgtcaggctgctcgagcccatcaaggagcagttgcccatacttctctacgccgacttttaccaactcgctggagtcgaaagcgtcgaggtcaccggcgggcccgaggttccctttcacccggggagacaggacaagcccgagccttcttcaga

SEQ ID NO: 2706 - DNA, 265 bp, Triticum aestivum
  Clone ID: LIB3280-049-P1-K1-H6
cttatgacttcaggcgcttctccattgtcagcagatgtaatggaattcctaagaatatgctttggcggtgaggctctccgaagctatggaatgacagacacatcttgtgtcattactacaatggatatcggcgacaaattaattgcgcatggaggatcaccaaacctttgctgcgaggctaaacttagtggggcgccacatatgacttacacattctgaggatcaaccatattctcacggagaaatccccgttagaggacctaca

SEQ ID NO: 2707 - DNA, 427 bp, Triticum aestivum
  Clone ID: LIB3280-049-P1-K1-H7
agaagctggtgcgcgaggacggcaccgagtggaagtggtcttgcttcaggccatgggagacgtacaccgcggacacgtcgatcgatctgaccaagcaccacgtgcccaacacgatgctcgacaagatcgcctactacaccgtcaagtccctgcgcttccccaccgacatctttttccagaggaggtatggctgccgcgcaatgatgctggagactgttgccgcagtgccggggatggtgggcggcatgctccttcacctgcgctcgctccggcgctttgagcagagcggtggttggatccgcgcgctgctggaggaggccgataacgagcgcatgcacctcatgaccttcatggaggtggcgcaaccgatgtggtactagcgctccctcttcatcgacgtacagggcgttttcttcaacgcctactt

SEQ ID NO: 2708 - DNA, 436 bp, Triticum aestivum
  Clone ID: LIB3280-049-P1-K1-H8
accaaatccaatctcgagcccccctctcccgtacgcccgttccaacccgatccgatctgccccctactcctgcgacgtcatgggccgcaagttcttcgtcggcggcaactggaaatgcaatggaactgtcgaacaggtagagagcatcgttaatactctgaacgctggacagatcgcctctacggatgttgtcgaggtcgacgttagcccgccctatgtcttccttcccaccgataagggtaagctgcgcccagagatccaagttgctgctcagaactgctgggtgaagaagggcggtgctttcaccggtgaagtcagtgctgagatgcttgtcaacctcggcgttccctgggtcatccttggacactctgaaaggaggagcttgatgggagaatcaagcgagtttgttggagagaaagttgcatatgcactcgct

SEQ ID NO: 2709 - DNA, 435 bp, Triticum aestivum
  Clone ID: LIB3280-049-P1-K1-H9
cctgaacttgaagtcgctgatgatgtccgggttcgaggagaaagacaaggtgacaaactacataaggctagtcatggagcgagctgtgggattgaagagaatcgagatgtatggtgtacacccatgtgagaaatgcgatgccactgacccgacgagatcccaggtgaatgaagcttgcaggcgtggggtcaaggagcgactcacacatggatcctactcaaccgtggagatattaataatgtactacatcgtctcataacgctcgctgctgttgcagtgatgattctgcatgtggtgcgcccagtaggtatttaaatttttatgtactaatagcctgaggatactcgattgatctggaccttgcagtgtagctatattgagtgtactgcggactggatgcattcttttcttttcagaacttgccttttgtatgct

SEQ ID NO: 2710 - DNA, 362 bp, Triticum aestivum
  Clone ID: LIB3280-050-P1-K1-A1
gcgctccgctcggcctgtttgttcacctccctccccacccccaccgtagcacaatcctctcagccgcacggggggccctcgtgctctgcgcctgagatccccagcctccgcccggcgccctcgccgcattgccattcccccgagtcgacacctgctgtgtttccacataaactacgatgggtgcatctgcagctactggcatgcagatggtggcgccgcgcccttgcatcccggcttgccagcgaatgcttgggtcgagatctgtagtttctgcattcagaagggcgctcagcaccagaactggctttgcaagctgtgtttaaaccgcatcaactggaccgctcattttctgtaactcgcaa

SEQ ID NO: 2711 - DNA, 113 bp, Triticum aestivum
  Clone ID: LIB3280-050-P1-K1-A2
gtccttgatgagacactatagatcgtaaaatatgactcttcttgaccgatcgctgtaaaggtgatccccgacattacaattgtaaaagtttatagtccactcctttgcagggt

SEQ ID NO: 2712 - DNA, 209 bp, Triticum aestivum
  Clone ID: LIB3280-050-P1-K1-A3
gtctgccgtcacgcccttagcctgtggcttaccacttaccactcttggcctagagacgggaggccagcccaaagttaggctgtgtctgtcccccagccccagctcctctttccggcccctatctccgtaccaatcctactctcgagtctctcgctcctcataaagcaaggagcaggggtcataatatgagttcatgggctactactctg

SEQ ID NO: 2713 - DNA, 129 bp, Triticum aestivum
  Clone ID: LIB3280-050-P1-K1-A4
cttttccttgcctgtccaggttctttgttggttctttggcagcttctaatttttttcctgaggccggttgagggatttcaccattagcataaagatcatggctgcgggcggtggccgttgaaagcatgg

SEQ ID NO: 2714 - DNA, 210 bp, Triticum aestivum
  Clone ID: LIB3280-050-P1-K1-A7
cccacgcgttctgtaatctaagggagttggactggatcttgggcgccagagaggtttatatggaatattattatcttcaaaccaattcgtgcgatgcttggaggtcaatataatatttattttttgtggtggcgcacctatataatagtgatacacacttatttattattatttgtctggtgtgtccattttgacaaggttatggttttg

SEQ ID NO: 2715 - DNA, 69 bp, Triticum aestivum
  Clone ID: LIB3280-050-P1-K1-A8
gagtctcttgccttttataagaccaagcttattacctgtattacctacaccctggtcgtgatggatggc

SEQ ID NO: 2716 - DNA, 435 bp, Triticum aestivum
  Clone ID: LIB3280-050-P1-K1-B1
tcgcccacgcgttcgcccacgcgttcgtccacgcgttcgcctccccttcccttcctctgctctggacaccccatctccgtcgagccgggcgccccatccacctctacgtgcggcggcggcgtagcaaggtcagtgagaaatggcgccgcccgggtcgcgccggtgggcgtacgtgcggatcatggccggcaccatcctcggcggcggcctcggcttctacgtcatgcaccgcatcgagacctcctacacggtgaggatggaggagaggctgcggaggtacgaggcgcacttgctcgccaaggagaaggtggcgcagcagctccaggacgaggggcgccgcgaggaccaggcgcaggtcttgccggactcgtgatttcctctcatcctgttgttccggctcgccttcccgagctgttatgtgagttgcactactaa

SEQ ID NO: 2717 - DNA, 354 bp, Triticum aestivum
  Clone ID: LIB3280-050-P1-K1-B10
gggtggagcgtgcactagtgcggtgactacatgatggaccctgagaaggcatggtcggctgctatcaggcacggcttcgaccctctcactaaagcttgacttgggaaatgttgctaagatggtactaccgataatttatgctaaaaccgcagtctttttttcttttctttcgggaacacgcaggatatctgttttggtcggacagctaagactgtaagatttattagtgtgaacatcgaacatcaatgccattaacttactgcttatggagtgctgtacttctgatcatggttgatgatgtttggcgtctgagttctagtaggaaataatcggaacgctctgtttgtctgatgg

SEQ ID NO: 2718 - DNA, 172 bp, Triticum aestivum
  Clone ID: LIB3280-050-P1-K1-B2
cttcattgtgcctgaattgagcccatcaaccaatttcttatatgcttcacacaaggctgtgtctgaatacaatgaggcaaaggcgcttggtgttgacactgtaccagcgcttgtaggaccagtctgatacttgcaagcgttcaaggcagcgatgggtgtggagaaatcattc

SEQ ID NO: 2719 - DNA, 160 bp, Triticum aestivum
  Clone ID: LIB3280-050-P1-K1-B3
cccaaaccctattcttcaggcggcccgatctccctcccccggccgctgccgctgccggcgccggcggtggcggtcacgcccgacgagtgatggaggcgctccctgacgtgcacttttgtgcggaggcgggtcgtccccggggaggcgttggtggtgggtg

SEQ ID NO: 2720 - DNA, 162 bp, Triticum aestivum
  Clone ID: LIB3280-050-P1-K1-B4
cgccctgtcagagatgtgggagcttgaggcagcctctcgtgctgagatagagaatggaatggaggaaggcctgtgagacttcctcatacgagccgtccattgccttcccccaagagctgcatcatatggaagtggatctggaccgtgcctctatccacacac

SEQ ID NO: 2721 - DNA, 177 bp, Triticum aestivum
  Clone ID: LIB3280-050-P1-K1-B5
cccacgcgtccgcccacgcgttcgcccacgcgtccggcttgccggacaggcagtggagagtttccgagctgcagcagcagtttgaggggaagactgtgttgctcggtgtggatgattttgacatttttaaagggatcaatctgtagcttcttgcctttgagaatatgctgaggactc

SEQ ID NO: 2722 - DNA, 178 bp, Triticum aestivum
  Clone ID: LIB3280-050-P1-K1-B6
cggacgcgtggtcagattgctgctaggcctacagctttctgcgtatcatcacagaagctacgccttacgcgttggaggttagccccagcataatagattagttctgccatggcgaggcttaccggtctgctgtagatgagaccatgccgcgcgcggcttattttcttctatcgaacta

SEQ ID NO: 2723 - DNA, 193 bp, Triticum aestivum
  Clone ID: LIB3280-050-P1-K1-B7
caagtgcggtgcggagtacccactccgccatggtcgccggacagccgcagctggtcgccggcgtatgctaccggtgttactaattcaacatctacgtccacccgccgccaccgtacttcgtccaagatcctactcgctgaagccgtctctgccgtccccctcgtccttcggctccaaatacgaggtgctttag

SEQ ID NO: 2724 - DNA, 269 bp, Triticum aestivum
  Clone ID: LIB3280-050-P1-K1-B8
tcgcccacgcgtccggtgcgttacaaatggaataaactctttgaggcaagaacagaaaagctaaagcaagttgaagcaagaatgtcttgtagggctcaaaaacaaatatcaagcagcaaacgctgcgaaacaaagctaacaaattaaagtttgtaccaagatcccacccaacagcaaaagatgtttttggggatgaagtggtttcatcatcctatccaacttcagcttacaagagccctatactaaaaaaggcaaggattgggggttta

SEQ ID NO: 2725 - DNA, 380 bp, Triticum aestivum
  Clone ID: LIB3280-050-P1-K1-B9
ggcccataggcagttgctctcgtcgtatggttctggtggagacgaaaataaacctgaaggcatggaaaatctcgggtcccagagtagccatctcccatccatggtaacgagtgagtgagcgagcatcagccattcaccatagcagcttcagttgtttccaagagacgcttgagttcttcttggactggtcctgtcggcgtctagtctggctatttatgaatgttggttggggcagtgacatttgtacagtttccgagatgatgctctaaccttaggctagtgttgcttataaagttggtgatttatagccaggtatgtgtgtctaaactaattttttacactaggtgggggaatatttaagaaggttcttgtatttaata

SEQ ID NO: 2726 - DNA, 426 bp, Triticum aestivum
  Clone ID: LIB3280-050-P1-K1-C1
caacaatcctgagcttcacgatttctttgcgaaggtgtgcagcgagatggttggccccaacaacgtgagagagaagcagccactgatgggtgccgaggacttctccttctacaccgaggccgttcccaagacatactactactttgtggggatgctcaacgagactcgtggaccgcaggcgcctcatcactccccctacttcaccatcaacgaggatgcactgccctacggtgcagccatgcaagcatcgttggctgctcgctatctgcttgagcaccagcccgctaccgctgctaaggtggaacctcgcgacgagctgtagatggtgtccatgttgaatgaaacggtggaaggacaaggacgtgcacagcaattgttggttaaaaagggacgaggacctttgtatcgccaggtgattatgcaact

SEQ ID NO: 2727 - DNA, 259 bp, Triticum aestivum
  Clone ID: LIB3280-050-P1-K1-C10
tcgtccacgcctcctgtacctgtacgaatcttaaaagatgggaaagatgttttatacagggatatttggcctaccactgatgagattgctgagtgtgttaaggctagtgtgctcccagacatgtacaagggcacatatgatgcaatcactaatggaaatcctatgtggaatgagctgtcagtattagcaagtattctctacccatgggatccaaaatcaataaacatacatgttcctgcttatttaaaggatatgacaa

SEQ ID NO: 2728 - DNA, 160 bp, Triticum aestivum
  Clone ID: LIB3280-050-P1-K1-C11
actcgtccgataattaaaaatgagcacgaaaggtttatgtttgtttttttgtatagtctctctggtaatctggtctcaatgaaataatgtttagtacaacaatgccaatgttttatatactagtactacatataaaaggaccaatgttattgataaattg

SEQ ID NO: 2729 - DNA, 217 bp, Triticum aestivum
  Clone ID: LIB3280-050-P1-K1-C2
gatgtttattaggtgaagtgcttgtttgccgagtcgctaacaaacggcagctgggtgctgcaccgctggaatctttaattccttgctctagcattgatataaagctttgatatttattaggtgaagaagactttgtactcacaagaagttaactgcggcataattcttaaacacgtcgctccataatgcttgcagcattggattagctatgcagtgc

SEQ ID NO: 2730 - DNA, 334 bp, Triticum aestivum
  Clone ID: LIB3280-050-P1-K1-C3
cagctagccagctacagcagctcagaaccgagcacagatcgaagcggagccaaacgaaagaagggacctaacctagccagccggcgatcgaccgagagatggcgcggtggtgcctgctggcggtggtgctgctcgccgtgtctatggcggcgtccacttcggtgtgtcaggactgcgctgcataccatgtgccaggtggttctgctgaagcttgtggactgcttggactacgcgacggagtacgaggacacgccgttggtcaagttctgtgaggtcacgggggactttcagatagtttggtccgagtgcttttgtttcattattcagctggtgc

SEQ ID NO: 2731 - DNA, 73 bp, Triticum aestivum
  Clone ID: LIB3280-050-P1-K1-C4
ccgacggtctttttccctcccttctcgtacgcggccgattgctactgcccgcacgcgcatagaatatgctgat

SEQ ID NO: 2732 - DNA, 381 bp, Triticum aestivum
  Clone ID: LIB3280-050-P1-K1-C5
ggctcccacagctgcagcgacaaaggcgcgtcgatgcagaaagcttctgatgatgttgaagcacttctgaacctgccttcaggttctaccgtgtcacttctggacggggtcaccattgaagggggcactgcactccatgtggtggccacatatggtgagagtgatggattcttgaggagtgctgacatcatccatagcaaggcaaaccaccttctgttgcgcataacaagaacggtgacacgccccttcactgcgctgcacgggccgggatgtcccgaatggtccgttatctcattactctggccagagacgagaatacaggtgctaacagagtgaaggaacttctagtaggtgaaaactgccttaaagagacaagtattg

SEQ ID NO: 2733 - DNA, 158 bp, Triticum aestivum
  Clone ID: LIB3280-050-P1-K1-C6
tccacgcgtacgtccgaggaggccgtcgccttgacctgagagcacactcacgcaccatgtggtgccgtctacaaaccctagcccccgacctccgccgtgctgccgtcgcagacggttcggtcttcttctcggacagcgctcggtcctgtttttttttt

SEQ ID NO: 2734 - DNA, 250 bp, Triticum aestivum
  Clone ID: LIB3280-050-P1-K1-C7
cccacgcgtccggacgagtgcctgaaggaagggttccagaacaaggtgctgcgccgagggtgcgaggcgctcgggctgtctgacgacgccgtgccacgcaactcgttggcgggacactactgcgggagctgcaacttcggctgccccaccggcgataagcgcggcaccgacacgacttggctcgtcgacgccgtcaagcacggcgcggtgattctgatcgggtgcaaggccttgcggtttatatttatac

SEQ ID NO: 2735 - DNA, 218 bp, Triticum aestivum
  Clone ID: LIB3280-050-P1-K1-C8
agcgcatctcgtctagatggcctccgaggcggcgaaggtgccgtgtgccggagtcggtgaacttcaagaggttgaggtgagaggtctggtccttctctaagaagcatatggttgcctcctagaagaagaaggacgctgataacaccaaggacttcttcttccgtgccaaggagtacgcctgtgtgtatgaggcttaagacaaggatctgtttcaactt

SEQ ID NO: 2736 - DNA, 236 bp, Triticum aestivum
  Clone ID: LIB3280-050-P1-K1-C9
agcaagccctctaaccgtacgccatggcgcacgccgccgccgccgccgccgtgccgctgcgccgaccgctcctactctacctccggcccgcccgccttctatcctccgtcgcgccccgctcgatgtacgggcgtgcctacacgcgcgccctacgacctcttgcccccctaccctccgacgacgaggacccggacgacggagacggagcgcccagccgtaacgagaagaagcggaag

SEQ ID NO: 2737 - DNA, 408 bp, Triticum aestivum
  Clone ID: LIB3280-050-P1-K1-D1
cccacgcgtgcgaaatacttatgcaggggtgaacgctctcagggacacaccataagtgcacttgtaataagaagttcttacatacacagagcaaagctttacatggtgggactgcatacaaaatctcttgatgcagggagttggtggaaaccagcatatggggattgccaggaggtaaggcaggcgaaacattcagatcagtgaaaagaggcaccctgtaaccaggaaatatgtgtggcctacgctcgggttttggagggcttgtctcacctcagtactgaggatctgatttaagcagtcgcaggtgatcttgccaaccgatacatctcattcctagctcacatatatgacactgcgaacttgagaggatgatgatagtagaaggctggaacacgtgttgctaaggat

SEQ ID NO: 2738 - DNA, 417 bp, Triticum aestivum
  Clone ID: LIB3280-050-P1-K1-D10
actatctatttcttcattatattaaactccataaccctttgtcgctccattttcgacgtcggcgacgacccccaacctctgctgctgtccgcgttagccgagggcggtggtagccatggacagtgccctagcaagcgccgaggcgatcgtcgaccagctccagaagaacgagcagtaccgtcacatcctagtctacgttatcttgtcttccccgccggacatgccccaggccatgcgctttctcaaccacatggtttcggatgaggtgccgatcgtggagttgtggcagctgttgtatacgtttgtgctggagctggggaagcttgagccagactcttagagggaggttgcccactacgcgcttacgcagatccagtctgtagtggggttcttagtggagcatgtagttgttgatta

SEQ ID NO: 2739 - DNA, 240 bp, Triticum aestivum
  Clone ID: LIB3280-050-P1-K1-D12
tactacaccaacatcaagcggctgatgaagataggcgtgctcgtcgacgaggcggatattatggtggccgacgagcttgatgtgctttacggtgcccacacccacaagaagcgcttcatgatcgtaggcatcctttgcgtaatcttaggaaccattatgtatgactacccgctcaccatcatgggtaaggtgatcaagaccaagagtgtggagtacatgccatacaccctgtcgctggga

SEQ ID NO: 2740 - DNA, 218 bp, Triticum aestivum
  Clone ID: LIB3280-050-P1-K1-D2
ctccaacgtcggccagccatcctgatacaacatacaacaccgagaaagagtctttcctctctgctgcttcttcttttgacatccgccggcggtcactcaacaatggcggccaccctgttcgactgcgcctgggagtggcagatctccaacttcagcaagttccagttggccaccgttatcaccttcgtcctatacgagagcgtgttcttccagcttcg

SEQ ID NO: 2741 - DNA, 304 bp, Triticum aestivum
  Clone ID: LIB3280-050-P1-K1-D3
gaattattcagaaagaagtaaagacaatggctcaattccagaaagagtatattagattcctgcagtataatgtcaagtgagaaaaatagaatctcaactgtgctatttgtttatcatttagagtaatatttctcttcattgccaatttatcgttgctgctggatgcacttactgctaacaattcatgaactattacaatctatcatatgcaggtttggctatttgacaaacacaaaggtcaaatctttaatggttactactgttcttgatgtgaaagatgcagatgccctcaaatgttaagctc

SEQ ID NO: 2742 - DNA, 434 bp, Triticum aestivum
  Clone ID: LIB3280-050-P1-K1-D4
cttgatgatgccaacattcaaatggatcaagatattctcgttgaagtcaccactgatgcaaatggtagtttggatggtgcgtgcatgagttcaatccaagaagattattttggaagcacatcaacttatttgatgacaaatgcttcaaaatcaggatgcttgaatgagaatttagcatcactctgttatggttccagaagctacagctcgagtctcatgcaaagccagtacctgcgctcttccagtggtgacttggataatgttcctggtactgttggtatgaccaccaggggatctccgtcaggtcttactgggctacttaacttgggaaacacatgtttcatgaacagtgctgtacaatgtcttgtgcacacaccagagtttgctagatattttcgggaagattaccactgtgaaattaattggcacaatcc

SEQ ID NO: 2743 - DNA, 251 bp, Triticum aestivum
  Clone ID: LIB3280-050-P1-K1-D5
gccgacaattaaaacacttaaaactgtgaaaagatttttttttagattatcaatgctgcgagcgggagaagggctagggcgtgcttgtgatcgctacaatacaagtgttacgctagctcataaatgttagttgatggcctaagcttacaaaaggcggacgctcatacgggacaattgcctccatctggtgtgcttagacatgcttcagtgtgtgaacgatgccatggacgatgctctgctttcaaagtggt

SEQ ID NO: 2744 - DNA, 276 bp, Triticum aestivum
  Clone ID: LIB3280-050-P1-K1-D8
tgattggcgccgtcatcttcaatacttgcatcaaattcagcaccaatttgttgctggtaagtctccatcttctttgaattatataacacaatcggatcctgacttcaacatttactcaactggacaccgtaattacctttgtgaaatcagtaaaaaaacaaaaacattttgcaaaattccagtcatttgctggaacgtattgatgaagattttggtattggtactctttttctataagatatcgatctgtgctgtatctatgttgtcacttggtat

SEQ ID NO: 2745 - DNA, 186 bp, Triticum aestivum
  Clone ID: LIB3280-050-P1-K1-D9
tccacacttgcctcaaccttccatcatatatacaggcggatagctacaaggcatggggtacgaaatgtttcattaacctcccacatcccggtccgaacccgggtccaaagtcgtttttacctatgaagccgatgccaccgccaggaccttcgaagggaatgccaacgccgtcgttgccgatgccgt

SEQ ID NO: 2746 - DNA, 410 bp, Triticum aestivum
  Clone ID: LIB3280-050-P1-K1-E1
tccggttcggttcaactgggtctggcgctagtctcgggtcctgggggatcacaccctggcctacttcctctccggccagagatggaggtccgtgctaaccacccgcttgtcatgcacaagtacgcagaacaggttcaccttgcctgcaattacttggagggtgaccgagctcacaacatactcccttttgggccatacaatgagaggcgcatcaccacaagcagctacatgactgataaccttggcatcagtgtcccaatgatgccataccttccattgtttgccaatgcacccgctgagaagaaaggtgtcaagaactttgcaatgacttactcatgggaggagtgtcagctgcaattggcaagattgatgcagctactattgagcgtgattagctgctcatccagaac

SEQ ID NO: 2747 - DNA, 256 bp, Triticum aestivum
  Clone ID: LIB3280-050-P1-K1-E11
tttacatcttatccacgatgacaagtagatcttgaacatggtagtggtcgtcaatgacttcctgactgcagaagatgcctatgaggccatccaacactccatggattatgggtgagggaaggcatggaggaggcgtccaacatgttccggcagttagtgatcagttgtggccctcattgagacgcttgacaagatgatggtcagtgacatgcacagccacgagctcgtcatggccgttgttgtgctgtgcgacaag

SEQ ID NO: 2748 - DNA, 309 bp, Triticum aestivum
  Clone ID: LIB3280-050-P1-K1-E2
gcgaattcataaccatgaaattaaagggcaggatattttgatccccagcctttgttactgaatcattcgccggcgatctagataaaacagactctacagcgcctgacgaagtcggacacgacggccagctccttggcggcgttgtctgtgtccgtcttgtacaagaagtatacatgcccgtcgcccttggtctggtataactcgagctcgtcgccccacaccgacgccttgacgcccgccgcgtaggcgcgcgacctttttacgaaccagctaagttccgccgtggtgaccagttcacggtcgcaccct

SEQ ID NO: 2749 - DNA, 193 bp, Triticum aestivum
  Clone ID: LIB3280-050-P1-K1-E3
ggaaagggagccgaggaaagctctccccccctccccaaatttcatcttcgttcttccgctcctctcctcgcctcgcctcgcctcgcccggaccccggccggattctcgtcaaggaggaggaggaggaggagggggaggggatggggagggaggacagtttcccggtctggatagcaattctattaacctttgg

SEQ ID NO: 2750 - DNA, 335 bp, Triticum aestivum
  Clone ID: LIB3280-050-P1-K1-E4
cactccctacctgccccacgttcaatccccttgcccgcactgcttcctccctcctcgatctctctccctggccagccgccattggtgggaaaccctagcccattatcccaatcaacacagccgctgttgctgttctacttttttccttgtacccctgcttccctcaccacagccgcaacctaggggcttctgcgttcgtttcgatgagattcaccaccttgcgaggttctcatctgccctaggttgcgaggatgccacgggaggaggagtgacctttttgctagattggttcggaggaggagctcaaccagcgcgtcttttggcggtggaaggaa

SEQ ID NO: 2751 - DNA, 435 bp, Triticum aestivum
  Clone ID: LIB3280-050-P1-K1-E5
agagcaacacaagcaaaggtgggctacattggtcctccagcagacttcaactatgacacttggcatcttggcacagggccagatacccttgttgagatcgctgagggccgacatcctttctgttcaatactgaagtctgcaaagaacccagtaatcattgctggagctgggttatttgaacgagaagaccaaggtgctgtgttctcagcatttgaaaccgtagccaataagttcaatgtgacaagaccggactggaacggccttaatgtcctattgctccatgctgcacaggccagagctcttgatctgggccttgttgctaattccaccgagagtgtcaagtctgcaaagttcttttacctgatgggagccgtcgatgtaaacctggacaacctttcagcggatgcatttgtggtttaccaggggcaccatggt

SEQ ID NO: 2752 - DNA, 249 bp, Triticum aestivum
  Clone ID: LIB3280-050-P1-K1-E6
gcggaggcagagaaggagagcggcagctctcgcgcgcgcgcccccattgccgccgtagcaggagcccgccgattccaatccaaggaggagctttgaaggtttgtcagggcggtgaagtatggttctcaagacagagctttgccggttacagtggtgccaatatatacccagtgattgtgatcatattaatactttctatactcttacgtcatttctttttatccatcataaatttcatgagctactttt

SEQ ID NO: 2753 - DNA, 324 bp, Triticum aestivum
  Clone ID: LIB3280-050-P1-K1-E7
cccacgcgtccgcctgcttcttacattggttcacgaagctactgaccctgaaagagtggtgatgcgagtgagattctgagagatttctctcggatcaaaaggagctcgacgttatgcttcacagatctctttctgctcggacagtatatattgcttcataggtattttgcagctcgcattggcatcctggtaggcatttagtcttacgtagttaatgagcaccctctcctgttaatcacaacatgttgtcactgcccttatattgaggtcagttaggataatacaaatagtttacccttatgatatctatgagttagccattat

SEQ ID NO: 2754 - DNA, 412 bp, Triticum aestivum
  Clone ID: LIB3280-050-P1-K1-E8
tcctcttcctcccttcacggacatctgctccatccagcagctagcttgcaatggcacctcagcggcagcagcatcagcacaaggccgtcgtggtcgcgctcttcctgctgtccgtcctcgtggctgcgcccgccgttgctgcttccaggcccgaatccggcggctacgcacccgccacgcccttctaggccgcgactccggccgagcccgccgccagcacgccctccaagaaggcggcaggctacactgactctacgccggccgagtccttagccagcacgcccgtcgacacggcgactcccgtcaagaaggcgggaggctatactgactctacgtcggccgagttcccattcagcacgcccgtcgaggctgcgtcttccgtttatgaaggctgggaggcttcacttatttt

SEQ ID NO: 2755 - DNA, 430 bp, Triticum aestivum
  Clone ID: LIB3280-050-P1-K1-E9
cccacgcgttcgggcgacttcaccacccacctccacaagccggaagatttcctgatcatcatcggctcccgcgcctccaaggaccgcatgaacggcgaccactacatccgctgctcgcgcttctcactgtcgcttcgcccatggtgcaaacttgcccacgccggctccggtgggttcgaataccgcgtcgagctcgagctccgcggcatccccgcccatgcctggcacttagcgacggcggatcacatcctcgggaccggtgtctggattgagcgcctccattcgcagacgcgctcccgcgccgacctggccacgttccgcctctctggtctcgcgcacgaccctgccgacatccgtcgcgctgcgacgctggaaatcgtcgaggtcactccgggacgcaccgtcttcttcgtccccatagtctccaccc

SEQ ID NO: 2756 - DNA, 343 bp, Triticum aestivum
  Clone ID: LIB3280-050-P1-K1-F1
ctcttatgcgcatagaagcatgttaagaatgtagaactggaaaggcatttgcaagtgcctggtggaggtggtctctgaagagactgacgcgtttctctatatattaagaaatgcattgaatgcttgttaccatggctgaatgtatggcatgagcgtcaacacaagaatccgaggatgagtggactgctgctatcaagcgtctgattgaagatgataaaagttcttcgcaagatacgttacagttgcacagcacaacatgcttaagtgaaggaatacatgagtatccttcaaggaacattattatcaggacagggttgtgttttgctgtctgcttatctgcact

SEQ ID NO: 2757 - DNA, 109 bp, Triticum aestivum
  Clone ID: LIB3280-050-P1-K1-F10
cgggtagtttggggtctgccagtataagcatatctccgcacgggggcgtagtcatcagccagagcatgaggggatggaggtcagatgcatagggtacgcctattggatg

SEQ ID NO: 2758 - DNA, 405 bp, Triticum aestivum
  Clone ID: LIB3280-050-P1-K1-F11
cccacgcgtccggcccgagcctgaggctgctcggctcttccgctccacctcttctgcctccctctgtttctcccccgctccaaccaggcaccatctgataggaggaagaagagaaaggtcctgtcactgcatcgcgtcgcgtgatggcatttgggctgccccccgcggcggcggctgtggtgacgctggtgctgggcctcgccgcggcgttgccgtggcggacgatgtggagatggtgtttctgaaaagcgcggtggccaaaggagcagtgtgcctggatgggagcgccccggtgtaccacttttcccccggctccggcaccggcgccaacaactggattgttcacatggagggaggagggtggtgcaagacccctgaggagtgtgtgatccggaagggcaactt

SEQ ID NO: 2759 - DNA, 303 bp, Triticum aestivum
  Clone ID: LIB3280-050-P1-K1-F2
aacgacctcaccctttgttaggtaggcttattattctccatgcatgaaggggggaatggatctggttacaaaataaatattcacttcatgttgcatcttcgataaaatcgggcatgaatgaactgccgatgtgtttcaaactggccttcaaattcggagtatggtgcctgaaaacaagagctccatctttgatcaatggtttatattggaagtctaacataacaagatttcgctctaaattaaagctctgcattttctattccagtctgtcatggttccctgtgctaacttatcttaattaaa

SEQ ID NO: 2760 - DNA, 366 bp, Triticum aestivum
  Clone ID: LIB3280-050-P1-K1-F3
cgcacgcttggggagacaagtggaagccaagtatcccgttttactgtttaaacagaaacttacggcatatagtagagaagatatatggaatgatacgggataatttgtagaaagagatctcttctttgctcggattgtgcattcaggccccaagaacataaagagcaagcgtgatgaaaggatcttctacgtcaaacacatattcagttgcacagcaagctttgattgcttattgacaagggattgtgaaaagcctcggaatttttcttaaacatacttaaagtgaacaatgttcctccattcttggggcggaaagtatttacttcagatttctccttctcaatgtaccgctatttaacagtcttt

SEQ ID NO: 2761 - DNA, 422 bp, Triticum aestivum
  Clone ID: LIB3280-050-P1-K1-F4
cccacgcgtccgccccaccccccgacctgggtttcggccgaatcgatcccaggaaacgaatgactgcctaccacaccaattcccccgcagatcctccgcgattgatgagtattcctcccccactctcttggtggagcgacttggatttggatgcgagggagctcccttctcttcgatctccccgccccccgtaaacgcctttcgcctcctgccgtctgagatagttttatggtctagggactccacctgcagccaccatcggtggtccggagccttttacgttctgcccgttttctctatttggtctagaagccccttagctgtgttgttggagcctagagcagtatatcacaagtgttgtcaatagtttcttacagcttccgattggccacgcgaatgctttgtcctgatccctctttagg

SEQ ID NO: 2762 - DNA, 301 bp, Triticum aestivum
  Clone ID: LIB3280-050-P1-K1-F5
gtctaccttatgaaaaacaaatgatgataatctaagcagcctactctcagagtacttgggaatagacaatatgcttggtctcgtttgcaagacttatgatggcataaagagtcttgaaacataaggcacagaaggcaacattgataagaaaagtggctttcatggactgggtggctcatttggtaagttgctgcatgggaggtttaccgtgttttgtcttgaaaacataaggcctatttcttgagaagttgggatctgtgatccacactgatatcttatgctgcgtaaactcaatgttgcc

SEQ ID NO: 2763 - DNA, 151 bp, Triticum aestivum
  Clone ID: LIB3280-050-P1-K1-F6
tttcggggaagtgtcaatggttaatggtgttatagacattatcggcatagcactcgatgtggggtcatcattccattgtgtcggttctaggctgtagtcttcattttttattgctggatgggctagaaaatgttttaattcatatgttgat

SEQ ID NO: 2764 - DNA, 210 bp, Triticum aestivum
  Clone ID: LIB3280-050-P1-K1-F7
cccacgcgtccgcggacgcgtgggcgcgtcgcgtgactcctcccaactagtaaagcagcacagatggtggagatcccggtggtcgacctgcggctcgccggcgcgcagcaggaggagtcggcgcggctgcgggacgcgtgcgagcgcctgggctgctctcaagaggtcggccacggtgtcccctgggctctccatgcggagatgaatgtc

SEQ ID NO: 2765 - DNA, 52 bp, Triticum aestivum
  Clone ID: LIB3280-050-P1-K1-F8
acgacaactcttataacaaatctattgttattacacatctggataaggatct

SEQ ID NO: 2766 - DNA, 327 bp, Triticum aestivum
  Clone ID: LIB3280-050-P1-K1-F9
gtcggccatgctccgcccggtcttctttctcttcttcgccgctccgagcatggcgtccctcgcctggtgctccatattcatgtccttcgacaccggctgcaagatgctcttcttcctctccatgttcctcttcgcctccctggtgtcccggccgacgctgttcaagcgggcgatgcggttgttcatcgtggcgtggtgggcctactcgttcccgttgacgttgtatggcgctggcgttagcggagatcgctcatgaagtgagggagccggctgttagcgatctgatgcttccgctttccatgcttatcattattttaaccctatttc

SEQ ID NO: 2767 - DNA, 323 bp, Triticum aestivum
  Clone ID: LIB3280-050-P1-K1-G1
attccacccagacagcccgacccgctcctcagctcacctcacgccgtaacctaagctaggttttcctcctccacctccaccggcatcacatcggacgcgcggcggcgtgcagccatggcgatggtggcacaggcgggcttcggcctcacccgcgtcgtcatgctcgtcggcgcgggcgtggccggctccgtcgtcctacgaaacggccgcctctcggagatcctcaccgagatacaggagtttctggagaagggggagatgggtaagggaggtggtggtggtgctgtccacggtatcaacgacgcgctcaacgtggtgcgcca

SEQ ID NO: 2768 - DNA, 353 bp, Triticum aestivum
  Clone ID: LIB3280-050-P1-K1-G10
cccacgcgttcggcaaccaggagctcaagagcgacctcaaggacctgtacattaacactgcaatccagatggatgttgttggcaacaggaaggccgtggtgatccatgtgccgtaccgtttgcgcaagccctttatgaagatccatgttaggctcgttagggagctggagaagaagtttagcggcttggatgttgtctttgttgtaacatgaaggattgtgaggccacttaagaagggttctgttgtttagcgccctttcaccaggaccctgacagctgttcatgatggtatcttggaggatgttgtgttcccagttgagattgtggggaagcgttgcagattccttttggat

SEQ ID NO: 2769 - DNA, 366 bp, Triticum aestivum
  Clone ID: LIB3280-050-P1-K1-G11
caatggtgaactgcatgacgtcaaacccaacgtgtcgggttgcacttgtgagctgccgcaatgccttcaccatggtcgcaaatcttagcttgtatggcattgccttgttgatatttactctaatgcactcagtgagtgtattagttcagtatcggtggattgcttatacggccatttccatcggatgttgttatgttgttgcgttcttgattggaacaaaagagccagggttaattcaaccttcttaggataagagcctgtccagaatttcatgggcccactggttcaagaaagtattgtactacctagttgttttagtctacatgtgctctagattggtttcctattgtttacaggctatttttt

SEQ ID NO: 2770 - DNA, 210 bp, Triticum aestivum
  Clone ID: LIB3280-050-P1-K1-G2
attacacccacacagcccgaccctctcctcagctcacctcacgccgcaacctatgctagggtttcctcctccatctccaccggcatgacatagcacgcgcggtggcgagcaggcgatggcaagagtggcgcaggcggtctttggactaacacgcatcggtatgctagtaggggcgggctggggcggatcacgcgtatctacgaaacggac

SEQ ID NO: 2771 - DNA, 435 bp, Triticum aestivum
  Clone ID: LIB3280-050-P1-K1-G4
ttcccatccgttggctttctgttcatacattcttccctcccggcgccgcctccagcctagggttttctcccgccgtccgccgccatggctcgccgcagcggaggaggaaggtcttcccgccctgctccacgtgctgctccagtgagaaacccaccagcgccagcccgtcaagctcctccacctgctactacccagaatagcggtggtggtatcatgagtggaattgggtccaccattgctcacggcatggctttcggtactggcagtgccatggcgcacagggctgttgatgctgtgatgggttccccgtccattcagcatgagactgtagtcggtgaggctgctgcatttatgactccaatggacaatgctgctgatgacaagtgtggcaaccctttcaaggtctttcaaggattgcattaaccactacggaag

SEQ ID NO: 2772 - DNA, 353 bp, Triticum aestivum
  Clone ID: LIB3280-050-P1-K1-G5
caagctcagtgagtgagtgagcacgcaagccagtgtttgtagccagcatccacaatggccgggaacatgctagccaactatgtccaagtctacgtcatgctcccgctggacgtcgtgagcgtcgacaacaaatttgagaagggcgacgtgatcagggctgcagctgaagaagctgacggaggccggtgtggacggcgtcatgatagacgtctggtgggggctgttggagggcaaggtccctaaggcgtacgactggagctcctacatgcaggttttcgacctggtgcacgaggctcgtctcaagctgcaggctcattatgacattccaccagtgcggtggcaatcgttctgac

SEQ ID NO: 2773 - DNA, 246 bp, Triticum aestivum
  Clone ID: LIB3280-050-P1-K1-G6
atctcctatttaaattatttcaccacataagcgtcttgggcgctagttaaacatgtttgtcttctgttgctcgtacacacacaatgatgttctaatagggaagatgattgtattcgtgtttgcggacgcagagacttataacttagagtccgaactaaagcctggaattgatctacttggttcagtagatgaattgatttttgttattgtatgactgatatgtactcatcaatgaactctctattg

SEQ ID NO: 2774 - DNA, 380 bp, Triticum aestivum
  Clone ID: LIB3280-050-P1-K1-G7
taccctcccttctcccacttatccacccctctttcttggcaagaaaagccgctctcggggtgttctcatcagccgtattctcatcatgctagcgagatggtgtttgtgaagaactagtatgaccagggcctactccaagcggatctcaagtgaagtttaagtgttggaatactggcgaagtccgtttactgggtctggtttaggctcactatccaagactagttacttaggtcaatctcgtctaagtactggtttgttgtttaagttattaacaaatatgttattgtccaaattgaggactcttccattgctggtgatttcgttgtggctgcttcttatatccatgagctatctcgggttgtgtcttgaatttggctttc

SEQ ID NO: 2775 - DNA, 370 bp, Triticum aestivum
  Clone ID: LIB3280-050-P1-K1-G8
tgaatatggtgaacaagctgaataagagctcctttctggtgggagagagatgcgtgttactaattataatgttattacgtttatccaccttgttgcctaccatcgattaaactatcagatccgtggacaaggtatacattttctatgaggattttaaaaacttataccaaaggaatggattgatatgttcaatgaacatgtaattcagcttttcatatctgtctctttggaaagactggatattgttgacttgtgcttaaacaccaactattttggaggttattatccggaccatgatattatcgatatgctgtggtaggttctaaagagcttctagtcagattttcagtagacgttatttaatgttttt

SEQ ID NO: 2776 - DNA, 199 bp, Triticum aestivum
  Clone ID: LIB3280-050-P1-K1-G9
ttaactctttcttgaaattttaatcgaactcttatgtgaggaaactacgtatgttgcagagtcagatttagttttagtgctgcttttatgtctgtcgtcgtaatggtcgttgtcatgccggttaaacttccagcctagcttgcctacatgtattcgtatacctacaactccaaggtgatatgactaatggagctgttga

SEQ ID NO: 2777 - DNA, 378 bp, Triticum aestivum
  Clone ID: LIB3280-050-P1-K1-H1
ccaaaatctgaaccccgtcgtgatgggcgacgccgtcgacgccccccgacggcaacggctggcctcaattctccttgcccggaaaccgcgcctcactgacagcaggaacgagaccacggccacagccgtatccatggatggcttcaccatggcggactgcttctggatggccgccccgccggagctgggcatgttatacatatactgctgcacaccccctgatctgcaagccgggccgtactgcaattccaaagatttgccacgcgtggtcagcgtccgttcggcgggacggtttgaactctatcgcgcctgattataccgacggtacacattcgaatattgactgtgcaacgcctgtgagccggcttgcgcgtcgag

SEQ ID NO: 2778 - DNA, 371 bp, Triticum aestivum
  Clone ID: LIB3280-050-P1-K1-H2
cccacgcgtccggggactgccacgacaccaaggggaacaagaacgtgtgcgtggtcggggccatcaacaactacaccgccgcgctccaagactcgtccagcccatttgacccgacggagagcctgatgttcctggcgcacttcgtgggcgatgtgcaccagccgctgcactgcggccacgtcgacgacctcggcggcaacaccatcaaactccgctggtacaggaggaagagcaacctgcacaaggtgtgggattcgtacgtgatcacagaggccatgaaggacttcttcaacaaagaccaggacgccatgatcgagttcattcagcgcaacatcaccgacgactggtccagcgaggagaagcagtgggag

SEQ ID NO: 2779 - DNA, 244 bp, Triticum aestivum
  Clone ID: LIB3280-050-P1-K1-H3
cggagcggaagaagacggtggaggagttctaccgtgtgaaccacatcaaccagacgtacgagtttgtgcagcggatgcgggatgcatatgggcggctggacaagacggagatgagcatctgggagtgcattgagctgctcaacgagttcatagacgacagcgaccctgacctggacatgccacagattgagcatcttcttcagaccgtcgaggccattcggaaggactaccccgatgaggactg

SEQ ID NO: 2780 - DNA, 427 bp, Triticum aestivum
  Clone ID: LIB3280-050-P1-K1-H4
cttatggagcgagatccaaaccttaaaacccaaccttgtcggtccattcgcagacgcacgcctggagagaaatcctgcggcgaagaacgctggcaaatttatgacactggctgagttccttgattttgcaaaagccagcaacatcactggtatactgattggcatagagcatgctacgtaccttatagccagaagccttgacgtggtggatgcggtctccaaagcgcttgtcaagtccgggtacgacaaggagacctgtaagcagcgcgtgctcatacagtcagaggacgccccggtgcttgcggcgttcaagacgttccccaagttccagcgggtgctgacgatcgagttcgacataagcgacgcctccaagccttcggtggatgagatattagagtttgcaaacgcggtgaagctcaggcgcagc

SEQ ID NO: 2781 - DNA, 304 bp, Triticum aestivum
  Clone ID: LIB3280-050-P1-K1-H7
cttcatcaagggggtcagcaccatcactgccgtgatgcgctacaaggggtccaacaccccgcctgcggccaagctgcccgacgcgccggacggatgggcctggtccatcaaccagtggaggtccttccgctggaacctgacggtcagtgccgtcaggcccaacccgcaggggttctaccactactggcagatcaacattacccgcaccatctagctctccagcatgccgtggcaaggtcgacgtgatggagaggtacgcccttaacggtttgtcccacaccgatcctgaaacgcctcttaagct

SEQ ID NO: 2782 - DNA, 404 bp, Triticum aestivum
  Clone ID: LIB3280-051-P1-K1-A1
cccacgcgtccggttcggagggagaaggcagagagcgatggtgagtcctgcacctctgggtggaagcagcagggttggtcgagcagtgaatgtggtcggggtcagcagttgaaggaggctcgccagccggagcagcaggaggagcgcctcgaggagtggaagggggaggtcgtgcaggacatgccaacaagagcattatagcaaggaggatagaatattcgatcagccatatatcttcttctcgatgcagccccgcatgaggagtcattctaggcatcctggggtgattcaagatgctcaggtgtatcacactgcattctacacagaccagctcatggtgtgagaagcatctcatattgttcaccgaattaattgatgaatttgaagcgattcaagagggggag

SEQ ID NO: 2783 - DNA, 416 bp, Triticum aestivum
  Clone ID: LIB3280-051-P1-K1-A10
taatgttgagctcgtcatacagactgaactgggccagtgctgaagaacagcgcgcagataccccggactatacaatctttgttggggatttggcagttgatgttacagactacatgttacaggagacattcagggtccattacccttcagtaaagggtgcaaaggttgtcactgacaagatgacaatgcgttcaaagggttatgggtttgtgaagtttggtgatcctacagagcaagctcgtgccatgactgaaatgaatggaatgccctgttcttccagacctatgcgcattgtgccagcatcaaataggaagacaacaggggttcaggagagagtacctattccaaatacatatacttaaggtgcttagtctgacattgattctaacaataccaccatttttgtttggtgcctt

SEQ ID NO: 2784 - DNA, 395 bp, Triticum aestivum
  Clone ID: LIB3280-051-P1-K1-A11
atacagagcacctccacttccccactgctcctcctcctcttcctcgctctcgccacagcagagcagagagcactcactcactgtggactatccatccacgcccctactccagtccgaggacacaacgtgagtaggcgcggtggtgctctgcttcttgattgttgatatccattccatatgcgctgtgcctgtccccggttttcgctaagaatgcatccgcttttgtgttcgccgcccaaaattagactcatttcgtccacacaaggatctttgctttcctttttttttctgctaattgatcctgccttctttagcttccggatttaaaactgttcttttgttgctcggattttgcaggatattctcgagttcagctgcgcgtgcatggaaagatt

SEQ ID NO: 2785 - DNA, 122 bp, Triticum aestivum
  Clone ID: LIB3280-051-P1-K1-A12
ggacaacccacagagcatcagccggagcactttatccttctctgcgttcttgtccggatccggtgctttagtactgcgcgttcgttcgataccaccaccttgtcgaccaagaagagatggag

SEQ ID NO: 2786 - DNA, 402 bp, Triticum aestivum
  Clone ID: LIB3280-051-P1-K1-A2
actgcgaccacacatccaagcggatactgaagagtggcaccatctagcaactactccacactactcaacagccttgagcgcctccggaaccagagggaacaggttccgtcctcgcgccaccaggttttgccgtcctggtgctggttggagagccggtacttcccatcggccttgttggtatcgtaaacgccggagaagagctacgccgcaagcatgaagtcctttctggtgaccaggtattcgtaggggactcagaacgtcgaccatatgactgtgtcgtcagtgcggaacaacacaaagttgttgttatcgtgcagggcgcccgcgactcaggcagatctgattgagcgaccacgttaaaggaggagcggccacccactctaggtgcggtgcaaggtggca

SEQ ID NO: 2787 - DNA, 430 bp, Triticum aestivum
  Clone ID: LIB3280-051-P1-K1-A3
ctcgtgtgcgcgctgctcgccgccaggcctgcagaggcgaccggcggcttggtgtgcaatccgctccaggacaagacgtgcaagtcgggggaccccaaggcgtctgagaacacggaggaggggggcgggttcggcgcgaagctgccatcgccgcccgttccgggccacggtatgatcgacggagacatcgacgatgagttgccgtcgttcagcacccacaagaccatcctcggtcactgggaggatccggtgctcgaagtctgacatctacgtgcatggttgtgtcttcttgcattcgcattgcttgtgtagttgtgttgttgtccagaagaaagaatgagacaaaggaagagatgagagagtgagcgtgccacgataaatgatttgccacttgtccctgttaatatcgtggacgctcaggaagaagtta

SEQ ID NO: 2788 - DNA, 418 bp, Triticum aestivum
  Clone ID: LIB3280-051-P1-K1-A4
cggacgcctgagggttgaaactgaatcggagaagagaagagcggcggggaagtactctgcacatttcagaggccagtctcacttcttcggatatgaaggaaggtgcggcctccctaccaattttgattccagctattgctatgcattaggctatggtgctggtgctcttctccaatttggcaagacaggacttatttcgtcggttggtaacctggctgctcctgtggaagaatggactgttggaggaactgcactgactgcgttgatggatgttgagaggaggcatggcaagaacaagccagtgatcaagaaggctatggtggaacttgatgctgcgccatttaagaagtttgcctcgctgcgagatgaatgggccagcaagaaccgatacatcagccctggtcccatccaattcagc

SEQ ID NO: 2789 - DNA, 429 bp, Triticum aestivum
  Clone ID: LIB3280-051-P1-K1-A5
ctgacgttgggttgccaaggattgaaaatagcatcagtgtacttgtatgttcaaagggtggcggcggactcttaaacgagcgcatggaacttgttgcagaactttgggaagctaacataaaggcccagtttgttccttaggaagacccaagtcttcaagaacaatatgagtacgccagtgatcatgacatcaaatgccttgcgtttatcactgaagcaggtctttcgcaaacagatcttgtgaaggttagacatctcgatgcaagaaaggagaaagatgttgaaatggatgaaattgtgaagttcctgtctgaagcaatatctttacagttcaaaaatcctacaatctggagttgattggcaatctgctcgttagtgaattttgttcaggtttgctattccaaaggatcaatcgatatcagacttttta

SEQ ID NO: 2790 - DNA, 249 bp, Triticum aestivum
  Clone ID: LIB3280-051-P1-K1-A6
gagggacgccggctcgtgccaagcaggttcatgctctcccgccagctctccaccaagcatgctggcaagatcccggaggaactggtgccgtctgaagtggacgctcaatataagctggcgagggcgaagctgggtgcaacgttagataagttggataaggaacaggctattaatattatgttgtgcttgaaatccattcgacgtgcggttgtcggtctgttcaatggagttgtcaagtttgctgctttt

SEQ ID NO: 2791 - DNA, 417 bp, Triticum aestivum
  Clone ID: LIB3280-051-P1-K1-A7
cgccggcgcgtactgtcccggaatgcccgctgcgaccacacgtccgcgtggctcactgaagagtggcacgacttagaagctcttcaaccctggcaaggaagatgatgtgcgtcagtatgctaacactaacctcacagttcttcagaaacaagatgggcatgaccgtgagcagggctctcaagatccagcgtattgttacacccttgaccctccagaggaagcgcgcgagaatctgcgtcaagacgaagaggattgcaaaggataagtcagaggctgtacattactagatgctgcttgcacagaggcttaaggagcatagagaccgccggagtgagagcatggccaagagggggcccaagctttctgctgttaccaaggcttttgctgcctatgcttaagatgattacagtctttaat

SEQ ID NO: 2792 - DNA, 350 bp, Triticum aestivum
  Clone ID: LIB3280-051-P1-K1-A8
ctgagaccggccctcccggccgccgtcagttccactctcccactcatctccgatgtcggggccgtccgccgctggtgctcaatccccgccacgggcatggccggagtctccgccgcctctcctgccgcagcacagatcggcggcgtcctctccaagaagccctacgcgccgccgtcctgggcctcgcacctcgccctcgtcccatcccacactatctcccttggccactttgcgacctcgattcacaaatggaatctgccaaatctgccggagggcactgaagtatggatcaagcgggacgatctatcgggtatgcagctagacggaaacacggtccggaagctcgagtt

SEQ ID NO: 2793 - DNA, 424 bp, Triticum aestivum
  Clone ID: LIB3280-051-P1-K1-B1
taacaaataagcaaccaaccatcaatctaacttggacagatgctcagtcctcacaatagtgtgtgctcttgatcaacacccaactcacagaaactcagccgtcagaaatttagaatcctcctaatccacaagcagtttgataaggtgttcttgtggtacccgcaatcccctcatttctattgaactaactttgagatttgcccacctcttttttgttgttctacacgaccaatcagtcaaataattagggggaatcgattgattgttcttgcccacctcaacctggtatgcttatatagtggatgcttaggcccttgacctttctaatacacttggattcctggtatcccacagcaacatgtgaaatgttattgtggtcttttttaatttactattttgtcttatttttggtacacctattgat

SEQ ID NO: 2794 - DNA, 361 bp, Triticum aestivum
  Clone ID: LIB3280-051-P1-K1-B10
gccccttccacctgggctagggttccatacgcctccgtcttcgggcagaccacatacgccgacgtcgaggtccgagaggagagggccgccggaccgtctttcttctccacagacctccgaggcgccctactcgtgggaagacgccgccgccgccttgcgagaccccaaggcagggcagggcgcggtcgcgttgcgggcagcgaggagcggcgcgccggcgccggcgcatgtgtagccagttagcgagagaggaagggagtggctacgatatctttatgcgaggacaagtactttgccgttcgcgggccgcggcgaccacgaacgtggagctgctgaagcggatttggccattggtcgtgtg

SEQ ID NO: 2795 - DNA, 392 bp, Triticum aestivum
  Clone ID: LIB3280-051-P1-K1-B12
atcccctcctccgtcgccatgggccgcaagttcttcgtcggcggcaactggaaatgcaatggaactgtcgaacaggtagagagtatcgtcaatactctgaacgctggacagatcgcctctacggatgttgtcgaggttgttgtcagcccaccctatgtcttccttcccaccgtcaaggctaagctgcgcccagagatccaagttgctgctcagaactgctgggtgaagaagggcggtgctttcaccggtgaagtcagtgctgagatgcttgtcaacctcggcgttccctgggtcattcttggacactctgaaaggaggagcttgatgggagaatcaagtgagtttgttggagagaaggttgcatatgcactcgctcagggcttgaaggtcat

SEQ ID NO: 2796 - DNA, 418 bp, Triticum aestivum
  Clone ID: LIB3280-051-P1-K1-B2
cccacgcgtccgaaaacaaagaggtccccacaaacattcaaccttctgatatgttggagaagcaaattggactattgccaggtgttatgtatgactctactcctcctggtgttcactttggggatgttagctcggacgttgcagcaaactcaaacttcaggaagggcactactgtgaatgctacattctattcagcctgtccaaggaatgaccttctaactgagggcaccttcgcacttgttgagaagctaaatggtaacgactggattcctatctatgatgatgatgattggtcattgcaattcaagtggtctaggccttcaaaattcagtccaagaagtttcgcaacgctggagaggaccattcctgaggatgctgcctttgggtttataggttgaggcattctggtgcctttaag

SEQ ID NO: 2797 - DNA, 368 bp, Triticum aestivum
  Clone ID: LIB3280-051-P1-K1-B3
tcgctccgcctgatctgtgctctcgagcctggcgtcttttcaccgtaccatggggctgccggcactcaatcggctcatgtctatgcagcgcgatcggcgtctccggccaactcaaggccgtaatggactggtgacttcatccctggctaaaaggaaggactcaccctgcatacatgatgaaaattctcgacttgataaaaaatcgagatattcaggaccacccctactagaggacatttggcatcatattacattctctgctttctttgcgagatgctgcacgtgttgtctgcgtgtctttattcatttagtaagttcttggagttgtcttcccaatcttaactttaactaggtaaacacttgggttt

SEQ ID NO: 2798 - DNA, 353 bp, Triticum aestivum
  Clone ID: LIB3280-051-P1-K1-B4
tctgtcaaaatggctccaccagaccgggcttgttgtctgcctttctcatggatatgacggtcaagggcctggacattctagtgcgagaatggagcgcttccttcagatgagtgacgataacccctatgttatacctgagatggatccaacactgaggaagcagatccaggagtgttactggcaggtttggaatgtgacaactcctgcaaactatttacatgtgctgcgttcccagatacaccgggattttagaaagcctttaattgtgatgtctttcaaagaatcttcttcttcacaaggactgtaaattcagactattttgtatttggatgatctttgctggtcacctctgg

SEQ ID NO: 2799 - DNA, 369 bp, Triticum aestivum
  Clone ID: LIB3280-051-P1-K1-B5
acgcgccgcccccttcccgatccacatctcccctcgccctcccacatcgtgccgccatccacctcgtcgcctcccagatggttgcaggcgattgaatccggtccgggtccatggcatccacgaccgtggcggtgctcgcggtgacggacgagctggacctgccgctccacacggtgggggacctggcggccgtcaccggcgtcttgcaggaggaggtcgtcgtcatcacgtactgcacctcgctcgggggctggcgttatggcggctgtgtacagcgatgaccacaagttctcccgtgatttgccttcatcttctacttctagctccctctttttttgctccttattgcagttagaaaggcttttaaat

SEQ ID NO: 2800 - DNA, 415 bp, Triticum aestivum
  Clone ID: LIB3280-051-P1-K1-B7
cccacgcgttctacagagggagcggttccgtctagccgggaagagccaccatcccatcggctccgtttccgaagggtcagagatggcggaccgtgctaaccacccgtctgtcatgcagaagtttggtggacagttccaccttgccttcagctactctgagggtgttcgtgctcgcaacatctgcccttctgtgccatcctatgagaggcgcgttaccacaggcagctacatgactcacaaccttggcattagtgtcccaatgatgtcatcttctccattgttcgtcaatgccccctcctgtgaagaaaggtgttaagaactttgcgatttgactttctcatgggaggagtgtcagcttgagatttcaagactgatgcagcttctatttgagcgtgttgagctgcttttcctgaac

SEQ ID NO: 2801 - DNA, 194 bp, Triticum aestivum
  Clone ID: LIB3280-051-P1-K1-B8
tcgcttgaaaccgaggtgtcatcacttctcccacaattcccttacgaatcacatgagacatgggttctactttaagtggaaacgctaagcatactcaggtaccatggagttcatcgtgaagaattaaggaaacatggagatccggatgcggaagacatgcatgaagacggagaggaaaaagctccaaggaccag

SEQ ID NO: 2802 - DNA, 157 bp, Triticum aestivum
  Clone ID: LIB3280-051-P1-K1-B9
gcgcctgcggtaccttcccggtacgcccggatcgtcccacgcgttctaatcttctagcgatcagtcctaccctgtttccattatcttcgagctaggcatcaggggcagtggtcttctttgctcgtggctcttgttatggtcttatcgtgcttactgg

SEQ ID NO: 2803 - DNA, 429 bp, Triticum aestivum
  Clone ID: LIB3280-051-P1-K1-C1
gcgggacgcgccggcgccggcgcccccaggctcaagctccgtcgcgctttcgacggcgagggatggatccgatggacatcgtgggcaagtccaaggaggacgtctccctccccaaatcaacaatgaccaagattattaaggagatgctaccgcctgatgttcgagtagcaagagatacacaggatcttcttgttgaatgctgtgtagagttcatcaatcttctttcttcggaatccaatgacgtgtgcagccgggacgacaagaaaactattgcccctgaacatgttattagggctttgcaggatcttggcttcaaggagtatgttgaagaagtttatgcagcctacgaacagcacaagcttgaaaccctggactctccaaaagcaaccaagttcactggcatagagatgacagaagaagaagctgttg

SEQ ID NO: 2804 - DNA, 459 bp, Triticum aestivum
  Clone ID: LIB3280-051-P1-K1-C11
gaagagatggcgttcaccatgcgcgccttgaaggtttcgccgaactcggcgtctataggggagactcttttattaatttattatatatattattttataattttatataaatattattttttaatattatactattttttatatttattttatttattttttcttttattttattctataatatatataatttattatttttttttatatatatttataattttttatatttttaatatatatttataaattaatatattttttaatataatatatatttcatatcatattatatatttattactttattatatattatataatttaatatttatttatatattttcttaataaattacaatttctattaattttatttttattaatatatatttatttaatataatattttatttaatttttatttatttatatattttttttagttaaatattatat

SEQ ID NO: 2805 - DNA, 262 bp, Triticum aestivum
  Clone ID: LIB3280-051-P1-K1-C12
ccggccgagtcctcagccagcactcccgcccaggctgcgacaccgaccgatgccgttgccagcatgccctctgagggggggacacctaccgactccgccgccagcacgcccgccgaggcggcgaccccgatcgattttctcgtcagcactcccgtcgaggggggaacgcctgacaaggccgcggtgggctacagttacactacgccggccgtgcagccctccgtcgatggcactaagacggttcccggggaggggtaggcta

SEQ ID NO: 2806 - DNA, 430 bp, Triticum aestivum
  Clone ID: LIB3280-051-P1-K1-C2
cccacgcgtccgtcttgatccagctgcaaaagctgctgcagcttcggttttggcatctaagctgggagcggattctggcttaagagtacatcttggggaagaaccaaattctgatgcagcagtggttatgagcaacaatgctgagatattgccatcagatgggctgagaaacaggaagcaacccaatgcaagaggcagcaggactggtagcactacagctgctcatacttcggcacaaggtgctgaatctagcccagctcttaatgctggcctggaaaacgtacagcttacaagggctgtagaacattatcaaggctctggggcaagtgatggtggatggattgcaaaaatcgctgccttacttggtggggaggacccgtcacagtcgtacgctttgatctgcggcaattgccatatgcataatggcttg

SEQ ID NO: 2807 - DNA, 233 bp, Triticum aestivum
  Clone ID: LIB3280-051-P1-K1-C3
gttccaagtgagcagatcatcctcacattgcgagctgtcgtcagtttcctcattggcgccctgtcatggataggctcgtcgtcgccgtcatccttggctttctactgattgcgtctgtaggaagccatgcccatgcagctagtgctccgtagcaatactggaagtttgttctttccaacacccctatgccaagcttcctctctcaacttctaaacaatcaagccggaggcacg

SEQ ID NO: 2808 - DNA, 420 bp, Triticum aestivum
  Clone ID: LIB3280-051-P1-K1-C4
tcgctgtcctacgccatggcgcctcctcagtccgacgagcagcttgtcgacgatcctgccatggtggacattactcctcctcaccccgacgagcatttcggtggtgagccggccgtggaagacaccgcccctcctcgattctccgacgagcaacaactcgggtgcgtgccgcaaaccacgctgatgccgtacgcggccgtggactcgtcgctgcgcgccatggccggccaggccgagggcttcggccggcacgccatcggcggcctccacggcgacgtttaccacgtcaccaccctcaatgacgacgggcccggctcgctgcgggacggctgccggcgccaggagccgctgtggatcgtcttcgacgtgtccggcaccattcgcctcgcggtggggcttgcgcgtgttgtcccacaagac

SEQ ID NO: 2809 - DNA, 394 bp, Triticum aestivum
  Clone ID: LIB3280-051-P1-K1-C6
cccacgcgtccgggcgagcagcgaccaccttccggtgagggtagcagcgatggagggcaaggaggaggacgtgcggctcggagcgaacaagtactcggagcggcagcccatcggcacggcggcgcaggggtccgaggacaaggactacaaggagcccccgccggcgccgctgttcgagcccggcgagctcaagtcctggttcttttaccgtgccggcatcgccgagttcatggccaccttactttttctctacgtcaccatcctcaccgtgatgggctacagcggcgccaccttcaagtgctccaccgttggcatatagggcattgcctggtccttctgcggtttgatctttgtcctagtttactgcacctttgtcatttttttgagggcacat

SEQ ID NO: 2810 - DNA, 421 bp, Triticum aestivum
  Clone ID: LIB3280-051-P1-K1-C7
cccgcgcgttcgataggggtcccaactcttctgcacccgccgccgccacctcccctcctcaaccacaccctcagccatggcggtcgtggagcccgagcccgggggcgacgtgaagctcttcaaccgctggaccttcgaggatgttcaggtgaccgacatctagctgaacgactacctcgcggtgacgtacatgaagcactacacgttcctgccgcactcggccggccggtactcggtcaagcgcttccgcatggcgcagtgccccatcatcgagcgcctcatcaactacctcatgatgcacgggcgcaacaacgggaagaagatcatggtcgagcgcatcatgaagcacaccatggagatcattcacctcctcaccgacgccaaccccattcagatcatcgttgatgccatcataaacagg

SEQ ID NO: 2811 - DNA, 409 bp, Triticum aestivum
  Clone ID: LIB3280-051-P1-K1-C8
ggtaaatgatgttggtgctgtggtgaacaacgatgctgacgtcaacaaatatctgaaggtggtgttcattccaaactacaatgtatcagtggctgaagtgctcattcctggcagcgaactgtcacagtacatcagtactgcaggcatggaagcaagtggtacaagtaacatgaagttctttctgaatggctgtgttatcattggaactctcgatggagcctatgttgaaatcagagaataagtgggacaagacaacttcttcctttttggtgccaatgcatatcaatgatgcttttctgaggaaggatagaaaaaatggcttgtttaagccagtcccacgcttagaagaagctcatcagtttattcaggagtggtgctttcggtacctacgactacattcctctcttgg

SEQ ID NO: 2812 - DNA, 427 bp, Triticum aestivum
  Clone ID: LIB3280-051-P1-K1-C9
tcgaccaggactacggctgcttctccgcgttgaccaatacgggctttcgcatctacaactgcgaccccttccgcgagatcttccgccgcgacctcggcccctcccccaccgccgttcctggggaagaggccgcccaggccctccaccagcccgccgtcgcgggcggcggcggtggcggcatcggggtcgtcgagatgctcttccgctgcaacatactggcgctcgtcgggggcggggacgcgccacactacccgcccaacaaggtcatgatctgggacgaccaccagagccgctgcatcggggagctctccttcaagtcccccgtgcgcggcgtccgcctccgtcgcgaccgcatcgtcgtcgtcctctagaacaagatcttcgtctacaactttgccgaccttaagtctgtgcagcatattgagac

SEQ ID NO: 2813 - DNA, 413 bp, Triticum aestivum
  Clone ID: LIB3280-051-P1-K1-D1
ggaatattgccgttgtttcagtagcccacttagaaccatcttctttaacacaagaatcaatcatgaccaatagcgacttgttgcagcaacccagtagtcagaacgatatagaagacatggtggtttcttgtagctccggtaatggctacgaaagctctaaattgacccgagctacatatggacaggagaaacctgcatagccaaacctgcctatggaatctctgcaaaacagagtacacagtggagccatgcagcctgaagtcatcatagggaagattatatgaaacaatttgatccaattaaattaagaatcttttgcttatgaatgttcagccccatccatgcatacaagaaagactacatgagaggcagagctaacaacgtttctaactgaaataagctccattatcata

SEQ ID NO: 2814 - DNA, 428 bp, Triticum aestivum
  Clone ID: LIB3280-051-P1-K1-D12
gtgttctgttgctcgtacgctcacaacgttgcgccgaaaggcaagttcgtcgcctttgtgtcgactgaagctgagaccgacaagcccgagatcgagctgaaacccgggatcgacctgctcggcccagtggaggagacattcttcgacatgtacgatcgattcgagcctgttaacgctgctgaggaggacaactgcttcttgacaactagctacgacgcgaccacgcattttgagacaacggtgaaggatgtgctcgccttgtacagcaagatcactggaaaggaacttgatctttccgtggatctgaatgctgccagtgccggtgaaaacgatgccgcttgaacatctgttgctagtagataatttcagttttcgttctttctttgtccatcgattcgttcgtagatggatcggttccattcgatcca

SEQ ID NO: 2815 - DNA, 412 bp, Triticum aestivum
  Clone ID: LIB3280-051-P1-K1-D2
gaacactttcagatcaggagttgttcaaattcttaagggcattgggatattgaactgcagatagctgcggcaggtttgttaggctaatataaagtagggacctttgctacataatgatacaaagatgataccgaaggttgttttgcaactagcaagtttcaaggtcacatggatgctgacagctctcaggtgtatggcctatttgtcgctgggtattgttgcctttcttcctggaatatacagcggaggatcctgagttgaagcatatattggctcaaaaagtaactaggctttgaagtgcagaatgacaagagccatccaggggccagggcgattagatgcccatcactcacgggggcaagaagttccgtgtcgagttgatgaaccagcaccagctgggagcccggatgaa

SEQ ID NO: 2816 - DNA, 410 bp, Triticum aestivum
  Clone ID: LIB3280-051-P1-K1-D3
ggccggagaaaaatgtagccatcgtgtgtacaccaaggggcagggcctctacgcaaagctcttgtgctcttccttggtgtgtgtgtgtgtgtgcgtgtgtgtatgtagagtttctccatggtgtgtgttcatgagagatgagaggaagaagaagaacggcgctgcgcggaggcggcggcaacatttggtatcatgagctcggtgtcttgggcgtgcttgccgtgtcggaggcgtggtggcggtggcggctgttcgccggcggctgcgcggtgaagctccgggctatgtgtcggtctatggaggtgcgcggcgcggcgaggaggccgcggtggccgctgcggactcggcgtgcgcggactacatggaggcatatgcggacggtgacgttgttcgtgctgcgagcgcggatg

SEQ ID NO: 2817 - DNA, 323 bp, Triticum aestivum
  Clone ID: LIB3280-051-P1-K1-D4
gtgatccgaaggcgagctgaagcaatggagcggctgcagagattctttagcggcgccaccgggatggggcagccggggagcgactcgccgctgctcgactcctccgagcaggtctacatcttctccctcgctctcctcaagatgctcaagcacgggagggccggcgtgcccatggaggtgatgggcctgatgctgggcgagtttgtcgacgactacacggtcagggtggtggatgtctttgtcatgccgcagagcgggaccgtggtcagcgtcgaggtcgttgaccacgtttttcagaccaacatgcttgtcatgctttaagc

SEQ ID NO: 2818 - DNA, 123 bp, Triticum aestivum
  Clone ID: LIB3280-051-P1-K1-D6
cgaccacgcgttcgttttttttttgatacccaaaaactcttagcatatcacaaaatttactaggataccatgtgaaaaagtggttaagtaatatgcatactctctcatataaagaccatttgt

SEQ ID NO: 2819 - DNA, 364 bp, Triticum aestivum
  Clone ID: LIB3280-051-P1-K1-D7
acggctagctggggctcgtcggacctagacagtaacacatgaactggagaaccaatgatgtggggtactggacgcgctcgtttgaccagaacctgtagcgagcgtgcaaggaccatttctggagggggaatagtaggattggtttctggatgagatctaaggagggggcgcttggaccaaatttgaagcggctttacgatgagcacattgcgccgttgatcaggaagacagacaaccggttgatcctcacggactacgacgggactgtgatgccgcagagcttcatcatcatggcacggatcagggatgtcaactttgcctaagaatggtcgttgcaagaccctaagaacaatgtgtatattgt

SEQ ID NO: 2820 - DNA, 146 bp, Triticum aestivum
  Clone ID: LIB3280-051-P1-K1-D8
tttgaaggcacaaagtattatgttaatctccaatacattttgcgtgaaaaaattgcaaaccttctcacgcaaaatgtattggagattaacataatacttcgtaggcacaatggtacttcttaaaagaagcttgcatcataacacta

SEQ ID NO: 2821 - DNA, 245 bp, Triticum aestivum
  Clone ID: LIB3280-051-P1-K1-D9
ctcttggcaaagcaccagctggtcttctccttggttgcgtgtgtgtgtagagtggcatatgtggttttgtgtgctctcgtagagtaagaatattgctagagacatagagtgatggtgactcgatttgagagaggcacttcatgatgaagaagatgcgtcgctgcaaggagagatggctccaacaattgacatcatagccttgactatccgatgcgacaactgctgcgcgtcctactctatgttag

SEQ ID NO: 2822 - DNA, 427 bp, Triticum aestivum
  Clone ID: LIB3280-051-P1-K1-E1
gattttccttatcctcctgatgccgcttctcatgcgtctctccccaccggcggcggcgccgtcgccgccgtaccggcgaagccacggaggttctaccacgagattatacgccgtactccccgagacctcagagcgaatgtttcttgtagctagacatgcctcgtcgtcgactgatccggtgcgtcctgggagcgacaactttgatatagctaatggacatggtcatgtccttatcaagtctacatctgatcttcaggtatgatgaaagctgtatcttcttgtttcgggaaagcattggtgaccagcagtgctgtcatgcttgtgatgccgcccagttgcttggcagaagaatgcgacccggggtactctctttctaacatgccgctgttgtttgcgatagccatggtcggtgctactgttggagggc

SEQ ID NO: 2823 - DNA, 416 bp, Triticum aestivum
  Clone ID: LIB3280-051-P1-K1-E10
gttcaggaaacaaaatttgtgggtgcctaaattaattggggagtcagatttaatgagaactgagatgctgatatttttctagtcaacctcagcagggaggtttctttacgcttacaaggatgtggactacagggccgtactattacccttatggtgaaaacaagaaggaaaggtgcttgtagagccactaaaattcatgtggtgtggggtctgtgaaaccaagagtctgttctatcacgattacaggtgcaactgacattttagttacacttcagagaattgcaagacaaatgtttgcagcttttgcttgttgatgtgaacgatgtgcggtgtagtttgactaaaaatgtcaaagtcttggtcattcttatttaggtcgtggagcacacaaggggatattgctttaatcatggctt

SEQ ID NO: 2824 - DNA, 269 bp, Triticum aestivum
  Clone ID: LIB3280-051-P1-K1-E11
tccacgcttccggtgcgtacggtgtgttggtgggtgccaactacctggccacgggcaagatggaggtgctctccgagcatcagctggtctactgcgaccatgagtgcgacctaacataacctgactcatgctatgctttatgcaactgtggtttgatgacttcagcctttatatatatgttgaaatcttggtgtctttgagagagaaaaggattacctttactccggttaggacgtctcttgcatatttgtgaagtccaatgattgttg

SEQ ID NO: 2825 - DNA, 331 bp, Triticum aestivum
  Clone ID: LIB3280-051-P1-K1-E12
ggatttcagtcgcaaaactatgaagatctcagctgttacaagaacacagctgagtgtaccttttggagacactgacagagtcgtgtgcttcactatagtcagcaccactcattctgctggtttttgtgttggtgctggtctttttgatttggctgaacatagaagatttagggtggcagatcactatgtgaaggacactgttctagatgcattttatgattgcatttgatgtgcttctatgtgctggctacgactacagtgtttgtcctgaagcactaaatgactgtttcttgggtgttctaagttagagccttatgtacctcgacttggg

SEQ ID NO: 2826 - DNA, 420 bp, Triticum aestivum
  Clone ID: LIB3280-051-P1-K1-E2
ctaaaggtggacgatgaacttaggcagaaagggcctacaagtgatatgatattcaaggttccttttctaatcagttatatcagttcgatcatgacgttgatggagggtgatgtgatattaaccggaactcctgagggtgtaggccctgtccgaatagggcagaagatcaaagctggtataactggtctcatcgaggccgagtttgatgttcagaggcgcagtctgacattttcttcctgatgtatcaagcaagaaactgtggtctgaatgtatcgttggatttgatctgcctgtcgacttgtgttgtccgcaagtgaaacaagatcccatttcttacgattgtccggaagagcaatttctcgccaaattgggagtctcctattatgtgtctattcttgtaagctggatatatttatggtc

SEQ ID NO: 2827 - DNA, 370 bp, Triticum aestivum
  Clone ID: LIB3280-051-P1-K1-E3
cccacgcgttcgcccacgcgtccggagactctgtgcatgcttagtctgggagcatgtttctggattgtcgtgttggaataacattttaaggcaccagttgttaacctgaaaaccaagaaatggaagagcttctggaaaactatcaaggtcttctgatggtttattcgatttgtccaacaacgacgagttcagactgggcaaattttggttggtagatttagtttagtgggggatggctgatggagtaatagtggtgctggtgcacatgttgagttgtattttaccgaaattgtcttggttgacgtgcgagacctaatcaacttttttttttttttgaaacaaggcaaaagattatccattttcgtcgatt

SEQ ID NO: 2828 - DNA, 428 bp, Triticum aestivum
  Clone ID: LIB3280-051-P1-K1-E4
acccacgcgtccgcggacgcgtgggctagaggcaaaaaattcgttagacggaagaagcataccgaggtatctactggctcaacacgtcagcatttgtcacctgcgcattacattttctgcgcacaaagatttgtatattaaatttcaatcacattgcatcagggattacacaaattcttatcttcctgttaatccaactgcaatcgatggaatcgcacagcccatgttaggctctgatgggaagattaaggtaccagagagcaatgtacttttagcatcaatcgagaacatgcagtttgctgggggagtggttgttctacacactgggttcttttctattggggctgtccgaaagattgcaatggtccgagaagaatggtggaatgcaggcttttattcagtttccacgtatgtgcgaacaactgtaa

SEQ ID NO: 2829 - DNA, 429 bp, Triticum aestivum
  Clone ID: LIB3280-051-P1-K1-E5
gtcgaccgtacactataccaactgcgccttctacttgaacggcaagagcatgggccacgaggaggcccccgccgtgaacggctatagcaacggccatgccgaggccgtccccgcgaacggcaacagcaacggccacggtgaggtcgtcgccgtgaactgccatgccgaggccactgcgaacggcaagagcaacgggcacggcgaggccgttgtcgcgaacggcgagagcaacggtcatgaggtggcggcggcagtggcggcgccggaggaggcggtggagtggaatttcgtgggggccaagggcggtgttctggcggcgactggggcgaacatttgcatccgggcgatacggtacaagatcagtgcgagcgtgcatgagaactggccgtggtccgtgctgtccctggcccacggggacccgttcttttt

SEQ ID NO: 2830 - DNA, 263 bp, Triticum aestivum
  Clone ID: LIB3280-051-P1-K1-E6
cccacgcgtacttccactgttcgggcgaggcctctttgtatgcgcaacacaaggaggagcacgaggaggacggctacatggttggagtggtgaagctgttcagcgcctagggttttgagtttgtcatcgacaagaaggtagtcatggtctacaacatcctttggaacttgcttacctcacctggtggttattcgttgactcgccgatgtgaggtgaggtttcctgagattatcactgtatttctattagttttgccaatattt

SEQ ID NO: 2831 - DNA, 223 bp, Triticum aestivum
  Clone ID: LIB3280-051-P1-K1-E7
attatcatttacattccggaatcatgtgagagagatttctttaaagaatataaaaaaaatacaccgttggtgcatgagctactaggactgactgtctgtccctccgatctgactactagctttaagtgatgagagttctacattcttgatgacagacacttactacttctatgaagtgctaattaaattgggtttagcttaagtgtccacgatcttttggcct

SEQ ID NO: 2832 - DNA, 373 bp, Triticum aestivum
  Clone ID: LIB3280-051-P1-K1-E8
actgacgcgtggtctcatcctgaggaacagactgaaatatgctctcatctaccgggaagtgcggtctatccttatgcagcgtcttatcatggttgatggaaaggtccgctctgacaagaccttccctgttggtttcatggacatctttctcattcccaagactggtgagaactacaggtctttgtatgacaccaagggccggtttcgcttttactctgttaggggtgtggatgctaatttcaagctttgtatggtcatggtctgttcagtatggcctgaatggcatccatctacttgaacacctatgatggcctgactcatcctatcccataccctctcattaaggccaatgtcactatcaagcttgatctgg

SEQ ID NO: 2833 - DNA, 240 bp, Triticum aestivum
  Clone ID: LIB3280-051-P1-K1-E9
tcgcctccttctcgccattccttctccaacgctcgcttgagtcggacgacctagctggccagtgggtccgttcgtggtggcgcgcgcgattgctgggtctgtggaggaggatcgtccggctagagatggggctactggaagatcgataaaaagcgttttgagaacgccaccaacaggccggtgatcatcttcaagcgccggtcggggatcatgattaatgcgtgttggcttactgagctt

SEQ ID NO: 2834 - DNA, 414 bp, Triticum aestivum
  Clone ID: LIB3280-051-P1-K1-F1
gttatggaaaacatgtttgcggcgctttcgatcgattctagagtgacaagtactgcttccacgagatcgggaaaaggatcttttattattcttgatgacaatattcttgctggaggtaattcagattgcaccacttccactgactctagcaggccaagatcagaggtattcattgaaatggcaaatgacctgttgctgcgccatgatggaactggtgttcgagtgttcgaggtttgttttgatttgaactccactcatgctgcccaccttgacaaatgggtccagtttgcgttagaggcgggtgcacaagatgtgaaacttagcttgtgtaaaaacatgacattttgtccggagcatttggtgactgcaaatcgctaatactttcctatgcattgctttggcgatgggcgacta

SEQ ID NO: 2835 - DNA, 102 bp, Triticum aestivum
  Clone ID: LIB3280-051-P1-K1-F11
attgattggctgtcatttggctcatgtgtccttgtacctttctagcatgttgcgatgccaaaaaatgatgatgattttttatgtcaatgaaatttgacggct

SEQ ID NO: 2836 - DNA, 376 bp, Triticum aestivum
  Clone ID: LIB3280-051-P1-K1-F12
atcgatctcattcttctcatgttttcccctagtggaaggcctaccatatgcgtcggcgacaaaagccccatagacgaagtcattgcaaagtatgcacaacaaactcctcaggaaagggctaaaaggaagctggagagtttagaagcactaaagaagacattcaagaagctagaccatgatgtcaacattcaggacttcttaggctccgggggtcagacggtcgaggaattatctagtcatcctggcgcattgcaatgtcaaatggcagatgttcaaaagcgtctcaattattggagcgatcccgagaaggttgggaatatagaccatataagagcgatggagcaatctcttaaagaatcttcttaatcgcatcggc

SEQ ID NO: 2837 - DNA, 360 bp, Triticum aestivum
  Clone ID: LIB3280-051-P1-K1-F2
cggacgcgtgggcggacgcgtgggctgacgcgtgggctcgctgccgccgccgccgccggcggcgcccgcccgatccctcgatccggctccgccgcgatgctctccatgtcgagggtgctcgcgaggcggctcttctccaccgccgcgcccgagggcgccttcgccgccttgacgtcgctggcgaggaaggcgcataaccccctcgaggagttgttcgaggtcgagcggagcacctaggacgaccagcccgcttcccactacggtcgtggttggaaggcttctgaatttctcctaaagttttgggactacctttaataagctgtggtatgttctgctaaaggagaagaacaagctcatgtc

SEQ ID NO: 2838 - DNA, 434 bp, Triticum aestivum
  unsure (1)...(434): unsure at all n locations
  Clone ID: LIB3280-051-P1-K1-F3
tcgcctaagagattgacaggatggtgaatattaagaatcattttataccattcaagnagtggattgttaggaaattagaaccttcagatttcttagaacttcacttggatttatgtgaatataagctataagaggtttagtggcaatgctacaaaatcactgtaggcgatataataacgtgtctgataggtggtgattgaatcatttgacaccaccttagatgtgtatcgagccaatgggacaacaaagaaaagaatgatccggaagcggggtatctattctttactagcaagattggcgattgtaaaccttcactggagccatatcagcttttttaaagtcacaaggctgaggatgttgtagaacctaataccccaactggtgtggagcatgtttgcatcgagaggactagggctaccattagggacctgtag

SEQ ID NO: 2839 - DNA, 270 bp, Triticum aestivum
  Clone ID: LIB3280-051-P1-K1-F4
tttcggctgtggaaggtgcatttgaagcggatcgagaacaatatcaatcggctggtgacctctttcaagcgccgttcggtgcttcttatgaaggcgcacgagatctccgtgctctgcgacgtcgaggtcggcctcattatcttctccaccaagggaaagctcttcgagttcttcaccgtgacatgtatggacaaaatttttgaacggtttgagcgctattcttatgcataaaagtgtcttgtttcatgtgtatcttataatctgggtaac

SEQ ID NO: 2840 - DNA, 447 bp, Triticum aestivum
  Clone ID: LIB3280-051-P1-K1-F5
ttcctactatcttcatttttcaacctaacatgtcttctttcatctatctatcgccaagcagtgcgcctgtcctcagcttgtaagctcctactgtaccaacaaagccagccattcaacaatggtctgtgcagctgttttcatagttgcccttctcctggtcgccgtcgcggtggcgctattcgccgaagccaagggcaagaaggccaatgtcgagaagaaggcctaagcgcctgtgcccttcttcagcgcgcccgaggacgcgctcgtcgtctactctgtagccttcgagcccttcgttgttgatgcaccggagcccattagcttcagcaccttctactgaggattcacctgacagagatgagatgagatgagattggtttagagcaattattcatccgttcgttcttccgtcgtcatggtcttttttcctttatcagttgtaataat

SEQ ID NO: 2841 - DNA, 161 bp, Triticum aestivum
  Clone ID: LIB3280-051-P1-K1-F7
gctttcttgcacaaccggcttggacaatgagcgtacttaaaatttaacacgcattatgtcgtccatggacctcgtgcacaatagatagggaggcatgcggttaccacatttgggattatatcatggtgagttcaccttgcgagccatgccggaagcctgga

SEQ ID NO: 2842 - DNA, 245 bp, Triticum aestivum
  unsure (1)...(245): unsure at all n locations
  Clone ID: LIB3280-051-P1-K1-F8
agctgggacgcctgcaggnnacccggtccggtattgcccggcttctatccacgcgttctcccactcgttcgggcaaaggatggacggcagggaaaaatcaatggaaaaggtggttatttttataagatgggagggaagccaaatcctgaccttatagttcaacatgtgattgactagtactgtaatatagacatagacaattttctgtggatatcttgtttctttattagtattaagatatattg

SEQ ID NO: 2843 - DNA, 419 bp, Triticum aestivum
  Clone ID: LIB3280-051-P1-K1-G1
aaacggaaaaactaagaagctgaaagcctaccagatccggccacctcgagatgcaccggtaacttggtacacgacagttgctttagagaagatgaagagttatggggctatctatttaactccattttcacatcgcttggcagaagatataaatgatccagagatccagagacttcgatgccgggtgcattgatatatttacacctcaggaacagaaaattctgatcaagtaccgcaaggaaaattttgcagaaaaagaacttgtctatagggaaagacggctcattggaaagtgccctttaactccagaagagggaggtcttatccttcgtgcactgggctttgataatacaacacacatttaccttgcttctggagagctctttggtgggaaacgcttcatgaggccctttaaggct

SEQ ID NO: 2844 - DNA, 389 bp, Triticum aestivum
  Clone ID: LIB3280-051-P1-K1-G12
gtggaaaccagatcgttgggaatttagcttctaccattactcaaactcaaagtgagatcataacactaatactaggtgatagcagaagaaagcagggccaaaatggccaccacaagcgcggagcttctgcaagctgaggcagagcttgtgcgccactccttaggctacctcaagtccatggcgtagcacagcgctttaaagctcggaatccccgacgctctccaccgctgcggcggcgcggcgtctttgcccgacctgctatccacccttgccctcccctgtagcaaacggccatacctggcccggctcatgaagatgctagccgtggaaggaatcttcacggctgtggctgtggatgtggatgctcctgccccctgcgagggcgaggg

SEQ ID NO: 2845 - DNA, 292 bp, Triticum aestivum
  Clone ID: LIB3280-051-P1-K1-G2
tccctcttgcctcgcggatctcagttctataacttgtcaacttggctttggtaattcctgggactgacggaaccactgaaaatggtggttctggcagctatctatataatcaaagtctggaaagggacttgctttaaggcaatatgttgtcatgttttggataaggatcgagggactgcctgcagcataatccaaagtaggttggaactgggaagctacattcttatgtagggacgggatatgtcctgtttggttattaaccaattgaagagctgtattctgtctctcatta

SEQ ID NO: 2846 - DNA, 435 bp, Triticum aestivum
  Clone ID: LIB3280-051-P1-K1-G7
ttgacgtcccatgcacgcttacgtacgctcacactatgtagagtggccatcctaacctttcccaaatttgcattaagacacaggaggggaagccaccgtgatggtccgtgacgaagcataccgaccgcaagttcaccggcggtaaggcgccccgcaagcagctcgccaccaaggcggagaggaagtcggcgccgaccaccggcggagtgaaaaagccccaccgctacaggcccgggaccgttgccctccgggagatccggaagtaccagaagagcacggagctgttgatccgcaagctgtctgtccagcgcctggtccgcgagatcgcgcaggacttcaagaccgacctttgttttcagatccacgccgtgctggcccttcaggaggcggccgaggcgtaccttgtcgggcttgtttaggacaccaacctgtgcg

SEQ ID NO: 2847 - DNA, 426 bp, Triticum aestivum
  Clone ID: LIB3280-051-P1-K1-H1
ccacgcgtccgcattcctgctggtgcggtagcccctatggctgctccgacacttgttgacagcgtaccgaagccaaccgtgccgattcctcagcaatatatgaagcctgaattgcagcaacctggcatgtaccgaaccgcggcacctgctgccgctgctccagggcctaacacgacccctaattatgctggaatggggtaccaccatgtaatgcaatcccaccaccatcctgcatcgcagccttcgccgaccatggcgggaaactatgggtaccccgagtatgctgctgatccccgcgcacaggtcttctactcccaggcaggagcaccaccagcattattggcaacctaatatcagcagcccatgggagcacctgatgccggcggtcaggctgacatgaatcagaaccgtggtggttcatagcga

SEQ ID NO: 2848 - DNA, 130 bp, Triticum aestivum
  Clone ID: LIB3280-051-P1-K1-H7
agacataaagggcataggaggttttaataatgaatataagattaagttctgtaaaatactttgtagagtactgtgtgaaatatataaagcatggcacctataattacacaaactgtatggccaaaatact

SEQ ID NO: 2849 - DNA, 358 bp, Triticum aestivum
  Clone ID: LIB3280-053-P1-K1-A10
tcgcgtcgtccccgccgagctctcggtccccgtggaggaccgcaacaataaggaagcggctgatcatctgttgttggtgaaggagagcgatctgtcatatttcgactgtagctttcacgcggccatgaagcccgtccggtccgactgtgacgtggcactggacaccttgggcgacgctgcgggggcggacacatcgccgaagctgaagcggccttgctccaacatcgagactaagcgaccaggctcgcgttccgcgcccgagatgccggcccggccgcgctcctacggcgatctggactacctggtcgtcggccttgtcctggacgcgacggcaaccccgcacggctcgccggaggcc

SEQ ID NO: 2850 - DNA, 415 bp, Triticum aestivum
  Clone ID: LIB3280-053-P1-K1-A11
cccagacggcccgccagacccagcggtcgcttactcgcatcgcagcgcactcgcgccacagtcggcatcacagaccagatccctgcgggtgcggcggccatggccgagaactttcaactccagggccggcacggcaagtcccgcgtccgcgtctcccgcgtctggcgccgcccggccgcggcggggggcgacgtcatcgttgagtggaacgtcgccgtcagtatcgtctccgactgcctcccctcctacaccttcagcgacaacttcggcatcgtcgccacagattccatcaagaacaccgtgtttgtcaaggcgaaagaatgcacggaagtggtgtccatggaggaaatcgccgggattcttgggaggcatttcacctcgctgtaccctcagggttcagaggccacggtgacta

SEQ ID NO: 2851 - DNA, 390 bp, Triticum aestivum
  Clone ID: LIB3280-053-P1-K1-A2
cgcccgggtgccaggtgcgcggcgcagggaggtcgtcgacggattccgggcaagtgcatgtgagatccgatggtggcggctgcagcggcggccggcggcggctgcctacgctgtatgctgaggcggaggcggaggcggagggaaggacgcgctgttcgtggagctgtggaaggcctgcgcggggccgctgtccagcgtgccgctactcggtgagaaggtttactacttcccgcagggccacatctagcaggtggaggcatcgacaaaccatcttgccgagctttagggcacgcccctctacaacctgccatggaagataccctgcaagctcatgaacatggatctgaaggcttgtccagattctaatgaagtgtacacccatctcacttt

SEQ ID NO: 2852 - DNA, 438 bp, Triticum aestivum
  unsure (1)...(438): unsure at all n locations
  Clone ID: LIB3280-053-P1-K1-A3
cccacgcgtccgctcgctcgtcccagctgatcatgtcgagcacctagtagcgacctgctcgatcatcagtgtagagtgtcggtaggtgtctgtctctcttggtggctggttgcaacggtcatggcgacgtcgtctcgtcgggtgcccttgctgctgctgtgcctgggcgtgctggtgtcctgctccttcgcggcgggcagcttggaccaggagctggacatcacgtggggcgacgggcggggcaaggtccttgacaacgggcggctgctgacgctgtcgctggaccgcacgtccggctccgggttccagtcccggcacgagtacctgttcggcaagatcgacatgcagctgcggctggtgccgggcaactccgccggcaccgtcaccgnctactacctgtcgtcgcaaggcggcgcgcacgacgagatcgatttcgag

SEQ ID NO: 2853 - DNA, 225 bp, Triticum aestivum
  Clone ID: LIB3280-053-P1-K1-A4
cggacgcgtgggcggacgcgtggggtttccgtcttattctcatccccgacccccgcaccggagcgtataccctagtccccggcggtgaccttgcggcctccgttgcgctctgtctggtgcgcgtttagacgtggagctgcggcggccaagaccaatcgaccatggccttctccggattccagttttgagaaccatcttgtgaatttttggtggtttttctctcaa

SEQ ID NO: 2854 - DNA, 336 bp, Triticum aestivum
  Clone ID: LIB3280-053-P1-K1-A8
acgtcggagctctcccgaccgacgctcaccatgatcattttcaagaagaaccgaaatagtgatgtggtagttcttctataaggagggcgtgctgtttgccaagaaagactatcaacctggtgaagcacccgcagatcgatgtgcccaacctccatgtgatcaatcttatgcatagctttaagttctaggagtatgtattggagactcttttcctggatctcttctactggcattttaccaacgttggcattgatcacctactcatctacctgaacctctcgtttgagatcgtgcctgccacgctcaattagtttgccaagccaccttgctttttat

SEQ ID NO: 2855 - DNA, 395 bp, Triticum aestivum
  Clone ID: LIB3280-053-P1-K1-A9
acagccctagctgctgccctcccacccgcctgtatctcccctcttcacggagcaagctggcaggctggctgggattcccgtcgaagcagggcaggagctagggcgggtggaggatcctttgcccggtaacgaggagaggaggtggcagtggctccccgcggctagggcagctagagaggggcgaagaggaaggcggctgtcgcttccgccatggctagcgaggaagtactccacaaggtccataatcttatagagcgctgccttcagatgtacatgaacaagaaagatgtggttgatgccctctcccaccactccaggatagagccttgtttactgaacttggttgcaacaacttgagaacaaaattctttgttttcaaagcatacgattgaggt

SEQ ID NO: 2856 - DNA, 430 bp, Triticum aestivum
  Clone ID: LIB3280-053-P1-K1-B1
ctcgtcttcttccccgtgcttgccagcacccgatgtcggcgagctctccgggagcggcggcgatgggttccagccaggccgataagccactgcgtcgtatagcggtgtgcgtcgaggagctcgccgccgtcgctaagcaacaacccgcggtgcccatggacgctggggccttctcgcgcgcctgctccaacgtctccgtcctcttcggctgcctcggcatcgctttcaagttcgcggagatggactacgtcgccaaggttgatgatttggtggaggcgtccaagtcaatttcaacattgccttctatgggtgagcgagacattcagaccgacactgtcaggaaaccagggagccatacaaggaatctgcttatagtgaaacgcgggattgatatggttaaagtcctgtgtgagcaaattcttgtcacaga

SEQ ID NO: 2857 - DNA, 379 bp, Triticum aestivum
  unsure (1)...(379): unsure at all n locations
  Clone ID: LIB3280-053-P1-K1-B10
ctgcaccgcaagtaacccaacactgtcttccaatgcaagtgactgccccgacccatcatgcgccaggcgaatcaaaccactacctgatttgtttaccccccgaaatttgccgtctcctcgtctcgctcctctccctgcgcagcccccagatccggcaccgcccgctcctcgatccccgcaccccacgcccgcaggccgggaccggcggggtcgcgcgccgggtaggaggaggagaagaggaagggtggtatagcggcgccgccggcgagggccagggccgactacgactaccttatcaagctgctcctcattggagacagcggtgttggcaagagttgcctnctgntgcggttctctgatggttccttcactacaagct

SEQ ID NO: 2858 - DNA, 377 bp, Triticum aestivum
  Clone ID: LIB3280-053-P1-K1-B11
ctgcaccgcaagtaacccaacactgtcttccaatgcaagtgactgccccgacccatcatgcgccaggcgaatcaaaccactacctgatttgtttaccccccgaaatttgccgtctcctcgtctcgctcctctccctgcgcagcccccagatccggcaccgcccgctcctcgatccccgcaccccacgcccgcaggccgggaccggcggggtcgcgcgccgggtaggaggaggagaagaggaagggtggtatggcggcgccgccggcgagggccagggccgactacgactaccttatcaagctgctcctcattggagacagcggtgttggcaagaagttgcctccgtcgcggttctctgatggttccttcactacaag

SEQ ID NO: 2859 - DNA, 429 bp, Triticum aestivum
  Clone ID: LIB3280-053-P1-K1-B12
ctcacgcgtacgtatgcatacactgctatcacatgcaaggatctggccgctgctgcggtgctgccggccaaccaaaactctgaggggcgtgtgaaccctctcactcgggctaactaccttgcctcgccgcctctggttgatgcctatgctcttgccggcactgttgacattggctttgaggaagagcccattggagttggaaagggtggcaaggcaattttcttgagggacatatgggcttcaaaccaagagatcgatgaggttgtggagtccagcgtgcatactcacttgttcaagaaagggtacgactccattatggaacgtaaccctaggtggaaccagctgccggttccaaaggaggcactgtaccaatgggacgacaggttcacctacattcgcaagcccacttacctggaagggatgtccatg

SEQ ID NO: 2860 - DNA, 440 bp, Triticum aestivum
  Clone ID: LIB3280-053-P1-K1-B2
cccacgcgtccgcccacgcgtccgcgcaacatccaaatggaggaggacgaggacgtcgacggtgactgggaagatgactttgagttcaggcctgatgttcggtttaggcgaggttcaacgtattctgttcgggaccttgaccttagaaaacctgcagccgcaaagaaccctcctagacgacagtttgaaacaactacagcggaggtactgaagaaggctgattttaggaatgttagattcctctccaactttcttacggaagctggaattatcatcaagagaagccagacccgtataagtgcaaaagctcagcgtaagattgcaagagagatcaaaactgcgcgtgcgtttgggttaatgccttttacaacaatgggtagaagaccattcttctttggcagaagtgcggaggagcattattcggatgatggatattttgg

SEQ ID NO: 2861 - DNA, 265 bp, Triticum aestivum
  Clone ID: LIB3280-053-P1-K1-B3
gacgccacgcgtccgcccacgcgtccgtccacgcgtccattcaacattttaatggaggaggacgaggacgtcgcagtgacttttaaaatgactttgacttcatgccttatgttcggtttaggcgaggttcaacttattctgttcggcaccttcaccttagaaaacctgctgccgataagaacccttcttgacatctgttttaaacacctacagtggatgaactgaataaagcttattctaggaatgttagattccttttcaactt

SEQ ID NO: 2862 - DNA, 352 bp, Triticum aestivum
  Clone ID: LIB3280-053-P1-K1-B4
gtttttagttcgaaccggctccaagttggtatcttataaagcgggaatgacccgtttatcgaaatcgtggagaacatggaatactcctgaattgacctttgtgtcaccaattgctgttgttggtggacagaagatctccctcattcttaaaggccgcaatctatctattcctggcacacagatccattgtacaagtacaggaaagtacatatccaaagaagttctgtgctcagcatatccaggtaccatatatgatgattcaggtgtggagacttttgacttgccaggacaaccagattttattcttgggcgctgctttattgaggtggaaaacaggttcaggggtaacagc

SEQ ID NO: 2863 - DNA, 421 bp, Triticum aestivum
  unsure (1)...(421): unsure at all n locations
  Clone ID: LIB3280-053-P1-K1-B5
cttgactttgaagagcgagatcgggtatgagggcgtcctttacaccatcaacaccgaggagtccagcatcgggctttgcaataatcttggaaatgaacactgaggattaagctgaggaggatggtgctaacattgatttaaactcacaaggaaaggaaaatgtgttgttctaaaaacctccacaagacaactatcagctaggaacttgtgagatgatattattgataaggattacaacacacatggatatgtgaacttaaggtgcgaaggttgacttggaagaaattgtggcagcaccagttcaggatggacaacaaccaaaatctcctacaaaagttgtttctaatgtgctatcgagctccagtgtgttcctatgcaatctggtcttcataccgcctncaagaaaagctccgcaatgaca

SEQ ID NO: 2864 - DNA, 339 bp, Triticum aestivum
  Clone ID: LIB3280-053-P1-K1-B6
gcaccgtccgactttaaggtttctggtgcggaggtgatcttggaccagatctgagctcctcaatgaacttcggccatcttcagtttgtgcggcatacttcctctgcagcagccgaataaaattaaatctcttacgacccgtgtaagatgttaaagatacgatgcgccccagactgtatggcctcggcctcggtttttctggaatgaattgatcagtgttcactgtgtgcgttatttctatttgcattggcttcaattggagcaatgaactagatttacaggccggacaaagaacatcgacctgaacagcctgcctgtggattatactctttcttggtgg

SEQ ID NO: 2865 - DNA, 300 bp, Triticum aestivum
  Clone ID: LIB3280-053-P1-K1-B7
cccagacggcccgccagacccagcggtcgcttactcgcatcgcagcgcactcgcgccacagggggcatcacagaccagatccctgcgggtgcggcggccatggccgagaacttccaactccagggccggcacggcaagtcccgcgtccgcgtctcccgcgtctggcgccgcccggccgcggcggggggcgacgtcatcgttgagtggaacgtcgccggcagtatcgttttcgactggcttcccttctacaccttcagcgacaacttcggcattggtcggcacagaattcattaagaacac

SEQ ID NO: 2866 - DNA, 419 bp, Triticum aestivum
  Clone ID: LIB3280-053-P1-K1-B8
tggtgagacccttgaggagagggaggctggttcaaccatggatgttgttgctgcacaaacaaaagcaattgctgagaagatcaaggactggagcaacgttgttcttgcctatgaaccagtctgggctattggaactggcaaagtcgccaccccagctcaagctcaggaagtgcacgcctccctgagggattgggtaaagatcaatgtcagccctgaggtctctgaatctacaaggatcatctatggaggttcagtaactgctgcgaactgcaaagagctggcagcacagcctgatgtcgatggtttccttgtgggcggtgcttctttgaagcccgagttcatcgacatcatcaacgccgccgccgtgtgaagtccgctgaagatgttccaacccttcaccctgttgcggtgtgtgctga

SEQ ID NO: 2867 - DNA, 416 bp, Triticum aestivum
  Clone ID: LIB3280-053-P1-K1-B9
cccacgcgtccgttcaatgtatttttattaacacattatcacaatttgcttactgctgctatgcaaagtcaggattttgctgcttttttgttccttgctgggttgtaaagctgctctttctttgctgattggatgtagtgccaactgcggaactgcgaaggcagtactcatgaggtgctatgctggtacattagtccatgccagctgtctcataggttgcctcatgcattggcattttgggttttaggtgatgtggaggagaggaaaggaagtgaggcaagatgctgttttctcatgatacaattaacctcgtaagctaaattagcgctataagacgactcacatacttttcttcccctgacacacaaattaaggggacatagagttgctatgcggcaactaaaaaagcaacctat

SEQ ID NO: 2868 - DNA, 279 bp, Triticum aestivum
  Clone ID: LIB3280-053-P1-K1-C1
ctcgggtctcgacgtctcgtctcgtctcgtctcgcctgcccgcagccccttggcttcgttccatccggcttctcggcggcggcggagaggagggggatggcgcaccggctgctgcgggacgcgcaggcggacgggtgggagcggtcggacttccccatcatctgcgagtcatgcctcggcgacaacccctacgtccggatgttaagagctgaatatgacaaagaatgcaaaatttgtgcacgtccttttactgtattccgtggcgtcctgtgcgagatg

SEQ ID NO: 2869 - DNA, 321 bp, Triticum aestivum
  Clone ID: LIB3280-053-P1-K1-C10
tcttctcgacccacgcatccgcggtcgcttgttctgttcgcgagtttcgactcgcgagtgcccgcttttgctccaatccaatcggtgccgcctcgggcgagatccgctccgcgtgccccgccgttgtcgagatagagggtgtcgtccccactccccagcatctgggtccacggagagttgttgatcttggatacctgatccgcaatttggggctgattgagtcacttgacctttatcaacatctgcctcgttcctgctgccttgctcactataagaggctggcctggttccagatatgattctattgtgagtggagatgga

SEQ ID NO: 2870 - DNA, 295 bp, Triticum aestivum
  Clone ID: LIB3280-053-P1-K1-C11
tcgacggcacttgcacatgggtaagccgatccctgacgtgagcgactcgcacatccaggagctaggcgggtgggcgctggggcaggcgaagcaccagaagctggccgtcgacgggctgcggttccgccgcgtggtgcgcggcgagcagcatgtcgtgtccgggatgaactaccgtctttacgtcgacgccgtcgaccccgccggccgcaccgtgccctacgttgccgtcgtgtacgagcaggtctggacccgcacccgtcagcttggctttcttaacccggtgcccctcgcccac

SEQ ID NO: 2871 - DNA, 435 bp, Triticum aestivum
  Clone ID: LIB3280-053-P1-K1-C12
cccacgcgtcctagccaggtggctaatgatgcattaagcagcataagaacagtggcctcattctcagctgaagagaaggtcatggatttgtacaagaagaaatgtgaaggtcccctaagaacaggaatcaggacagggattataagtggcatcggttttggagtttcctttttcttgctgtttggggtctatgcagctagcttctatgccggtgctcggcttgtcgaggacaggaagacaacctttcctaaagtcttcagggtaagtaccttatggtagtactgaggatttttttaacttcatctggttttcgtattaaggaagaaagaaatgcttgaagtgaagtcaaagcaacatggtttggggtatcctttcttaaaaaaggagattttggtatactaaaaatgtggtctactatatgcaatccaagttttt

SEQ ID NO: 2872 - DNA, 412 bp, Triticum aestivum
  Clone ID: LIB3280-053-P1-K1-C3
cccacgcgtccgctccgctgggccaccagctttgaccgccgcctcccttcccctccgctactgctcctccccaccccactcccccgcaggagcggcggcggcggcggcgaggtcgtaccccacatcggcgagcggcggcggcaccgccggaggcaaaggcaagatgttcgggcgcgcgccgaagaagagcgacaacaccaagtactacgagatcctcggggtgcccaagtcggcgtcccaggacgatctcaagaaggcctaccgcaaggctgctatcaagaaccaccccgacaagggcggtgaccccgagaagttcaaggagctcgcacaagcctatgaggttttgagtgatccagagaaacgtgagaattatgatcaggatggggaagatgcccttaaagaaggaatgggc

SEQ ID NO: 2873 - DNA, 351 bp, Triticum aestivum
  Clone ID: LIB3280-053-P1-K1-C4
cccacgcgtccgcgacggcatcccgctgccggcgcagaccgggttgggcgccatccgcagcatcgtcccgcgcgtggtcaagctggtggaggacaccaccgagcacgtcctccgcttcgagctgccggacatgatagagagagaccgcttctcgtggttcaaagacgaggagttcgcgaggcagacgatcgcggggctcaacccgctgtgcatccagctcctgacggagttccccatcaggagcaagctggacccggaggtgtacggcccggcggagttcgccatcaccaaggagatcctggagaagcacatgagcggcggcgccgccatgaccgtggagcaagcgctcgc

SEQ ID NO: 2874 - DNA, 199 bp, Triticum aestivum
  Clone ID: LIB3280-053-P1-K1-C8
tctctgtcttactgggcttggctatcatggatacctaagtggatgttgacgatacatatatgggaattccatcacttgttatcggtttggatgaaaattgctctaagtttacccgctggtgtggtaatattggcagctgtcatactatgttgaacgctcgtgtttttgcttctaaaattggattctggtataaacattg

SEQ ID NO: 2875 - DNA, 287 bp, Triticum aestivum
  Clone ID: LIB3280-053-P1-K1-C9
tcgctctcagtcaactccaagggccaagaccccaatttcccctagaggttgggattgtgtgggttcagtcatgctcgagcggcaccgctttcatcgtgacgccgacggcgatctccctgtcgttgtgaccgccccccttattgcgcactcaccgtcgtctgctgagccttggtctgtctaactctggtgcatcggatatatccgacgtggagattgtacgccgcttcgtcgactgtttgccgcatctgcctagaattcgagtccgtgcctggtgatgtgctaatatc

SEQ ID NO: 2876 - DNA, 426 bp, Triticum aestivum
  Clone ID: LIB3280-053-P1-K1-D1
cgttcgggcggcgccatggtgcccgtccgcgtgcacaccgtgctcatctccacccagcacgacgagaccgtcaccaacgacgagatcgccgccgacctcaaggagcacgtcatcaagcccgtgatccctgagaagtacctcgacgagaagaccatcttccacctcaacccgtccgggcgcttcgtcatcggcgggccccacggtgacgccggcctcaccggccgcaagatcatcatcgacacgtacggcggctggggagcccacggcggtggcgccttctccggcaaggaccccaccaaggtggaccgcagcggcgcctacgttggccaggcaggccgccaagagcatcgtggccagcggcctcgcccgccgctgccttgtgcaggtgtcgtacgccatcggcgtgccggagcccctgtccgtgtt

SEQ ID NO: 2877 - DNA, 417 bp, Triticum aestivum
  Clone ID: LIB3280-053-P1-K1-D10
gggtgatgggaattctaagaaaaatcattcaccagacgttaagaaaaggagaaagcgtatgaagcatgtcaatacatcaacggacagagatgtcttaaacctgcaggataatgtgtcaagtgtcatggcaagacagtgccttcatatctcaagtcatagaacgtcccagagcacatcaaagcataagggaaacttgtcacacttgcttcacaatgaagttcctatccggatgggagaaaggaacaatcttactgaaaactctgaaaatgatagtttgtctgacagcttcagtgaacctcagacttcagatactctgtgtatagaagctcaaagaaaatcaagtgcaccatcatcttcacttagacaaaggaccctagattctctatatgaatttggtgaaactagtaggcatgaacc

SEQ ID NO: 2878 - DNA, 442 bp, Triticum aestivum
  Clone ID: LIB3280-053-P1-K1-D11
cacaagcgcactctagcaatggcttctgaggttgtccgccctagcgacgccgagctactaaaggcacaagccgacatatggcggctcatcctctcctacctcacgcccttgtcactgaggtgcgccgtggagcttggcatccctacggcgatctaccgccatggcggggctgcctcagccgctgagctggtcacggcgctgtctctcccctccactaagctgccgttcctccgtcgcctgctgcggctcctcgccgtgtcgggcgtgttcaccgtcgacaagcagagctcggaggaggagcggttccgcatcagccccgtgtcctacctcctggtggacggcatccctcacgaggaccacatgaaccacaccgttctggtgctcacctgcaccttgacgcgctacatcaaggcggtgatagggctggcggattggtttcaag

SEQ ID NO: 2879 - DNA, 314 bp, Triticum aestivum
  Clone ID: LIB3280-053-P1-K1-D12
tcggtcccctcgccgagcatctccgttacggcatttttttcctcgacaagccgtcgaacccgtcctcccacgaggtggtcgcctggatcaagcgcatcctccgcgtcgagaagaccggtcacagcggcacgctcgaccccaaggtgaccggcaacctcatcgtctgcatcgaccgcgcaacgcgccttgtcaagtcgcagcagggcgctggcaaggagtacgtctgcgtcgcccgctttcacgccgccgtgccggacaccgcgcgagtggcccgcgcgcttgaggcgctcactggcgcggtgttccagcgcccg

SEQ ID NO: 2880 - DNA, 414 bp, Triticum aestivum
  Clone ID: LIB3280-053-P1-K1-D2
gttctttttccggatacctgaataccgaaagactgtacaactgtagtttctgattcctactccttgtcgctattcaatcgctaaaggatctgtccctggtggagaagaaccggcagattcaatgcaatgttcttgactgacgtcatggattttgttcttcaacctggtagctctgaagacgaattgaatagctgctagtttctgctaatcatctacagtcaggtgcagagtgttctgggagctagttctgaatatcactgtcacgctgtaatctgcacgtttctgagctcctaacttctaagcatgccactaccgtatccctttgtaatttaatcagctgtaccatccagtactctgtttacatttgtagaaacgctctgcaaagaagctattatgtgggaggttctttgctat

SEQ ID NO: 2881 - DNA, 414 bp, Triticum aestivum
  Clone ID: LIB3280-053-P1-K1-D3
cccactcgtccgggaggagcagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgaccttctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaagttaagtccaccccgttgcagccctacagcgaggtg

SEQ ID NO: 2882 - DNA, 450 bp, Triticum aestivum
  Clone ID: LIB3280-053-P1-K1-D4
ctctttcccaaatccaccgccggctcggctcgcccatcttcgcgccaagcaccgaatctccgatggcccgcacgaagcagacggcgcgcaagtcgacgggcggcaaggcgccccgcaagcagctggccaccaaggcggcgcgcaagtcggcgccggcaaccggtggcgtgaagaagcctcaccgcttccgccccggcaccgtcgcgctccgggagattcgcaagtaccagaagagcacggagctgctcatccgcaagctgcccttccagcgcctcgtccgtgagatcgcgcaggatttcaagaccgacctccgcttccagtcctccgctgtcgccgcgctgcaagaggccgccgaggcctacctcgtggggctcttcgaggacaccaacctctgcgccatccacgccaagcgcgttaccatcatgcccaaggacatccagctcgcgcgcc

SEQ ID NO: 2883 - DNA, 194 bp, Triticum aestivum
  Clone ID: LIB3280-053-P1-K1-D5
cgcctgtgtgcccacccgctccacattttgatagtagttgactacaccactgtcttcatcttccgcctcctaatgtacgttgataacggtcttcctgcacgaatgggattagatctcggatggcaacacatatatgctccgttttgtggtacaattattgtcctctcagttcaagtgctacttctttaccctct

SEQ ID NO: 2884 - DNA, 428 bp, Triticum aestivum
  Clone ID: LIB3280-053-P1-K1-D6
ctacccgatgcgcccgcggcggcggcagcgccggcccagccgcctctgacggccgggaccctctgggcgaggtctatggccaccttcacgcgcacgaagccccatgtgaacgtcggcaccattgggcacgtcgatcacggcaaaaccactctcactgctgccattaccaaggtcctggccgaggcagggaaggccaaagccgttgctttcgacgagatcgacaaggctccggaggagaaagccagaggaatcaccattgggacagcttacgtcgagtatgagacggctaaaaggcattatgctcacgttgattggccaggtcacgcagattatgtcaagaacatgatcactggagctgctcaaatggatggtggtattcttgtcgggtcagcttctgatggcccgatgccacaaactaaggagcatat

SEQ ID NO: 2885 - DNA, 394 bp, Triticum aestivum
  Clone ID: LIB3280-053-P1-K1-D7
aacaaatacagagaggcagaggcgccatcatctcccttcttcttcacccacatgcctctaggtgcctcacaagtcctcctccgctgtcatctcccctctccactcctccctggtttgttcaagaaactttctttggacaagatgggagtgcagaggtacaggttcttctgctgcgggtgtggcgccaatgcggcggccgacggccgggaacgcgacgaggacgggggcttcggggtgtccgacggcaaggccgagaagggggtcgtggccggcccgcggtggctgtcgtgggcgcaggttgaggcgatgacgggcgtgttcacctttgccgtggtcggcgagggcggtttcagcaccaggtacctggcgcgcctatccggcgcgcttgtcgtcg

SEQ ID NO: 2886 - DNA, 448 bp, Triticum aestivum
  Clone ID: LIB3280-053-P1-K1-D9
cacgtcgttcttgtctgacactcagcaggagcatttctccttgtcaactccttcaacatcgcgcggctacttgctactagcttcttgttttctttgatcgacgcattctacagctttgcttatcccggctagagcggctagggtatcggtagtgcgcggtgagacggcatgacaacgcggggagctaagcgcgcggtcaccttcgaccctgtcgtacccgatggcggtgttttcccatcagcaagtgatggcaggacccgctagtttagatccttggcgggcggaggctgttagcaaacatgtgagggcacttaatacccagtttgcaagctgggtgcaagtgcatgggcaaaatcatgcagcttgaactttgtgaggacggtcttaaggattacatattacatgcgtgtgaaattatggaaatattcaaggatgttgttaactggtt

SEQ ID NO: 2887 - DNA, 391 bp, Triticum aestivum
  Clone ID: LIB3280-053-P1-K1-E1
ttatatacctaatgtagactgtccccttctttcccacgcccgcccgccgtaatccccaaccgcccttcgcaatcccctaccgtctgtcgtgatccccgccgccgtggcagccgcccgccgtaacctctgcctatataatgatagggggcgccctcctccctcgatcatccgcacttgtgtagccatcgcgccatctacaccggccaccgccacacggtggttcgcctctggccttgcggcttgcgacctcgaggtgaccgaacccgtgggctccatgactacatctgtgacgcctgaagaaaagatggcggctcatcatcaggcccccgcgttgtgctccttctcccgacctctccgtagaatccctatttccgccggacctctatttctt

SEQ ID NO: 2888 - DNA, 412 bp, Triticum aestivum
  Clone ID: LIB3280-053-P1-K1-E10
atttgaaaggaattgggaagaaagcgctgcatatagtgttgcaagtaatgatgtggtatcactcctgaattcttcaattgtttcttcaaaagcagatgctagcaattctgtcttagagaaccctgtagtgggaagagagatgtggagaattaaaacgaaagattctaagcctgccaagtctggacgtctatctcacgaataaaagaagcttgggtagtctaatgattaaaagaagacaaaaccttttttggcaatggtatttcatatcatcaagattggcaaggttgtactttttgttacatatctgggatcaaggcttattattaatgacctaaggttgcttattgattcttaccacaatgcttatattacttggacatggatgccactattctctagattctaaatacat

SEQ ID NO: 2889 - DNA, 420 bp, Triticum aestivum
  Clone ID: LIB3280-053-P1-K1-E12
aggaggacaaccataaggttcgctgatatcaaacagaagagatacagtgttccccttgtgataggaatcggtctccttgtcctgcagcagctaagtggtgtcaatggcattctattttatgctgcgagcatcttcaaagctgctggtattacaaatagtaatctagcaacatttggtttaggggctgttcaggtgattgctactggagtgacaacctggttgactgacaaagctggtcgaaggcttcttctcattatttccaccacaggaatggtcattactcttgatattgtttctgtgtcattttttgtgaaggacaacatagctgctggttcgcacttatactctgtaatgagtatgctttcactggctggacttgtggcatttgagattgcattttctcttggcttgggagcgatt

SEQ ID NO: 2890 - DNA, 436 bp, Triticum aestivum
  Clone ID: LIB3280-053-P1-K1-E2
gtagttcccaatcctctcttacgccgatttctaccagctcgcgggagttgtggccgtggaggtcaccggtgggcctgagattcccttccaccccggtagggaggacaagcctcagcccccacctgagggccgtcttcctgatgccactaagggttctgaccacctgaggcaagtttttggcaagcagatgggcttgagcgatcaggacattgttgccctctctggtggccacaccttgggaaggtgccacaaagagcggtctggtttcgagggggcctggactacaaaccctttggtctttgacaactcttacttcaaggaacttctgagtggtgataaggagggccttcttcaacttccaagtgacaaagccctgctgagtgaccctgtctttccgcctcttgtcgagaaatatgctgcggatgagaaagctttt

SEQ ID NO: 2891 - DNA, 382 bp, Triticum aestivum
  Clone ID: LIB3280-053-P1-K1-E3
ctactttgttgctgtttttattcgttagtcacataagcagtggtggtcggtcggccggcgacaatgagcggccgtgtgttcgtcctggccgctgccttcggcgtgctgctcgccgcagccgccgtgtcctcgaggcccgtcctgactccgctgggtactagccgccctgctgccggcgacctgtccgtgtacttccacgcggactcgtgcccgcagctggagacgatcgtgcggtccagcgtggacgcggcgctccagcagaacgttcgtctgacggcggttctcctccgcctcttgttccacgactgcttcccgcagggctgcgacgcgtccattctcctggacaacggcgagcgcggcctcccgcccaacgtggggctgc

SEQ ID NO: 2892 - DNA, 372 bp, Triticum aestivum
  Clone ID: LIB3280-053-P1-K1-E4
cccacgcgttcgggcttctcctccccctccggttcgggttcgggtttttgaggttctccggggttcgggtgcgtgggtgagcggatcgagatggcggcgtctgatgttgagtaccgctgcttcgtcggcagcctcgcctgggccactgacgaccactcccttcacaacgccttcagcacctacggcgaggtcctcgagtccaagatcatccttgatcgggagacgcagaggtccctcggtttcggtttttcacctttttcacggaggatgcgttgcgtaacgccattgagggcttgaatcggcatggagctggacggccgctacatcaccggcatcgaggcccattcccgctggcggccggtggaggctgcg

SEQ ID NO: 2893 - DNA, 431 bp, Triticum aestivum
  Clone ID: LIB3280-053-P1-K1-E5
tccgccccacggaacaggggtccgcgtccgcgccccgctggtggagtctgtctcctgctactgcagattagatacaggccttaaaactgttgttgaggccaggaagtttgttcctggcgcgaaaatgtgcatgcaacctgaagtcaaacaaaacaagcgcaagtcaaggggctcaaaaaaggaatggtgcaggactcaagcaccacttttacctggccttcctgatgatcttgctattgcctgccttatacgagttcctcgacttgaacagcccaaactcatgatgggttgcaaaagatggaaccgtcttttgtctgggaattacttttactccttgcgtaagaaaattggtgtggcagaagaatgggtttatgtcttttaaaggggaccgggaaggaagaattcctgggatgccttttatccactccacc

SEQ ID NO: 2894 - DNA, 300 bp, Triticum aestivum
  Clone ID: LIB3280-053-P1-K1-E6
cccacgcgtccgtccactcgttctatggcttctacattcgctgccacttctactggcggccttatggctgctccaacagggaagaatgtgcgccttcataggagggtgaacttcagagttagagcagctaaggagctgtacttcaacaaggatggctcagctataaagaagctccagactggagtcaataagcttgcagacctagtcggagtttacactcggaccaaagggaaggaatgttgttttggagagcaagtatttttctcctaaaatcgttaacgatggtgttacagttgccaa

SEQ ID NO: 2895 - DNA, 302 bp, Triticum aestivum
  Clone ID: LIB3280-053-P1-K1-E7
tcgcagtcgttctaccgagacacctgtttcgaaccatgctgaccacatctagatgaagcgttgtcgtcgtcggatggaaaggtgcggatcatgatgtcttgggaggcgtacgtttacgagctcctgatgtgtgagatctaaggacagtatctcagcgccggtgtcatcgtttgtcacgacggctgcgtttgttcgcatttcgagagctttcccgagttatagcctgtggagggtgctggtttcataaaggactttgatgaacctggtatcttttgtccaactgttttttttgttggtggtac

SEQ ID NO: 2896 - DNA, 193 bp, Triticum aestivum
  Clone ID: LIB3280-053-P1-K1-E8
tcgctcgcactcgcccctctgcatttaccacattgccctcgtcggcggcgccgaccagctgccgccgcgtccagcaaaacaaccggccgctaggtccaaaatagttccccatggcgtccatatcgtcgcttccctttgcgccgctgcgcggagccgccgagtggaggccgtcgtcgacggattctatttgttt

SEQ ID NO: 2897 - DNA, 197 bp, Triticum aestivum
  Clone ID: LIB3280-053-P1-K1-E9
cagttgctacctttctcttctgctgctcgccctcggtatctgatcgcgaccatgggaccccgcggcgtctccctagcgctccttgcggcggcgctcctacaggccctcgcccccgcgttggttgcggcggcggtagtgctgcggcatggggcctggtgcgggtcagcgctgaaaaatcatcccgttgtccagaacgc

SEQ ID NO: 2898 - DNA, 447 bp, Triticum aestivum
  Clone ID: LIB3280-053-P1-K1-F10
ggaacaggaaaggcgtgctgcaggtgcaggacggctctgagatccgggctctcgtggagaacatggcggagttcgctaggttcgtcgacgacaggttccggaagctcgacgccgatggcgacgggaggctgtcggtgaaagagctccagccggccgtcgctgacatcggtgccgccatcgggctgccggccagagggtcgtcgccgcaggcggaccacatctacgcggaggtcctaaacgagttcactcgcgggaagcaagagtcggtgggcaaggccgagttccagcgcgtgctgtccgacatcctcctcgggatggcggccggtctgaagagggacccgatcgtcatcctcaggataaacggggaggacctgagcgagttcgtggagagcccgaggtactagccttgtaccgtggccatattttcgcatgccggggggggcccta

SEQ ID NO: 2899 - DNA, 451 bp, Triticum aestivum
  Clone ID: LIB3280-053-P1-K1-F12
ggttacccttcctcttggtcttaatagctctgtggttgccgcggccaagggcgtccgtggagaagcgggagcaggtggcggcgatggaagagcaaggcggccaggcggcgctcggttgggcggccagggacgactccggcgtcctcttcccctacagcttctccagaagggttcctaaagacgacgatgttacgatcaaggtgctctactgcgggatctgccacaccgacctgaagcgtatcatgaacgactggtgaaacgccttgttcccatgttgtccggtgttaccgattcatttttgttagcctagacgccccggatgctgttgcaaaactaacaggctttgtctgtctgaccccgtcgtcttgcgaggcgtgtcgagcaggcacgagatcgtgggcgtggtgtaccgcgtcggcggtggcgtcacgcgtgttaaggtcgtctacac

SEQ ID NO: 2900 - DNA, 424 bp, Triticum aestivum
  Clone ID: LIB3280-053-P1-K1-F2
tcgcggacgcgtgggcaacggcactggaattaacaagccggattaccttgcgacggtggatttggatcccagctctcctacatactcccaggtgatccacaggctcccggtcacccacatcggcgacgagctgcatcactctggctggaactcctgcagctcctgccacggtgacccatcggccaagcgccgcttcctgatcctgccttccttgctgtcaggccgtgtgtatgtcgtcgacacagcgacagacccaagggcgccatccttgcataaggtggttgagtctgaggacattgctgagaatactgggcttgggttccctcacacgtctcattgccttgcgtctggcgacattattatttcttgccttgtggacaaggaggggaatgcagcttgcaaatggcttcctgctggtggattc

SEQ ID NO: 2901 - DNA, 413 bp, Triticum aestivum
  Clone ID: LIB3280-053-P1-K1-F3
cccacgcgtccgcccacgcgtccgggagcggccctccacctttatcgccgccgccgccgttgctgtgttccgtctcttcgccgatggcttcggccaagttcggtgctgcccagcaggtggagaaccgaggcgcgctgtccaaaaggtcacgtaacgacgtgtctgtaagggagggggactggaattgtcctcagtgtggtaatgtcaacttcagttttagaaatgtttgcaaccgtggagcctgtggggcaccccgtccatcaccgagtccaagtccaagaatgatgtcaggacctcctgcttctggatatgaccggtcacctctattttacggaggaggtgggggcgccccaccttcaattccgcttggaactgggagctttggggctccatatccacaccctgggatgcga

SEQ ID NO: 2902 - DNA, 320 bp, Triticum aestivum
  Clone ID: LIB3280-053-P1-K1-F4
aacacaaattccagaaacaggtcctgtaaatccacatagtacttttttctaattctacaatgacagcaaatttttttgaaattagccggcaccatccttaaaacatttgagccacatgccgcactaccacacttggggaacattacacacaattccttgccttacaaacagaatcttttatttttggcattatgcgggggttaggcatgggctgagaaacgtatcatctcaattttttttacggaagaaccttttatgctttaggagccttttttgaaggggtggtttcacccttttgccccatttttgactttttgggt

SEQ ID NO: 2903 - DNA, 410 bp, Triticum aestivum
  Clone ID: LIB3280-053-P1-K1-F5
cccacgctttcggagaaagataaggtcctccataacttgtaaacatctgagcttcagaaaggtggcgctacttaccctgacttttttgtctggtttaccacattgatgttagaggagatgttattggtggtgtccctggtgtttctaaagctcaatttgcaaagcttttaaaactggttggttctaaattttggcttgaccactcaggccctgttcgttttttgtcaaacaatggggatttgatggggaacaattccccttttagtcaaattccttctaattgcctttcaatgccccctccccaaattcccatgatttttgggatgaaacgaacatggtctttatggggtgatgatattcaatgatgtttgtcattgtatggagctgatatactggtagtcccttttttt

SEQ ID NO: 2904 - DNA, 291 bp, Triticum aestivum
  Clone ID: LIB3280-053-P1-K1-F6
tcgacccatccttcctacatcagttgccagctcatgatccgtgccttttctgggtagccaatcccataccggtcctctcccggctgtttctccctccgcaccgtggctccggctatggcggtcgtaggcttcgctctgtgtaggtctaccttttcgttacaactgggtatttttttcggtgggcgcatgtgctgactactcggtcctgacgctgagtttgagcggcacaaggccgttatgccgacgtgagaggtcggtgcatttgcgcagactgtcgtcatcatggagatt

SEQ ID NO: 2905 - DNA, 424 bp, Triticum aestivum
  Clone ID: LIB3280-053-P1-K1-F7
gctatgggagtgaacatggaaacagctcaattcttcaaacgtgattttgaagagaatggttccatggagcgggtcaccctttttctgaatctggctaacgaccccaccattgaacgtattatcacccctcggattgctctaacaacagcggaatatttggcatatgaatgtgggaagcatgtacttgttatcttgacagatatgagctcttatgcagatgcacttcgtgaggtttctgcagcccgagaagaggtgccaggtaggcgtggttatcctggatatatgtatactgatttggcaacaatatatgatcgtgctgggcgtattgaaggaagaacaggctccattacccagattcctattctaacaatgcctaacgatgatatcacacacccaacttctgaccttactggattcatttctg

SEQ ID NO: 2906 - DNA, 368 bp, Triticum aestivum
  Clone ID: LIB3280-053-P1-K1-F9
ttctcgacctaggcattcggatccaattgtcacttgctctccctccaacaagctaattaaggccggtcatgcctcttctagctcgttttattatccatggcggaggagatgcaccaccaccaccacctgttccaccacatgaaggacgtggagcagcttgccgccggcgggtacggtgtgtccgccgagttcacggaggccacggtgacggaggtggtgttcacgggcgagaacgagtacgacgagttcaagatggaggagaaggagcacaagcacaagcagcaccttggtgaggccggcgccatcgccgtcggcgccttcgcactctacgagaagcacgaggcgaagaatgacccggagcacgcgca

SEQ ID NO: 2907 - DNA, 389 bp, Triticum aestivum
  Clone ID: LIB3280-053-P1-K1-G1
agtagcctcaccaggcatctgattaaatttgattgaataaaccgaacatatgtgtccaaaatcacaagtgagaagcacaagtaggaatagatattacagtctttgaataggagaaaacggtaaccgattggccagccgaaaactttgtccacgctaacaaagaaacagcaacaaaatagagagacgaagcaggagggtcgcgataaaggctcctcttggctttctttcttgggtccgaagaattagaagcatttcctgtgcacaatggatgggccagactcgtcgtactcagcctttgcaatccacatctgctggaaggtgctgagagatgccaagatggatcctccgatccagacactgtacttcctttcaggaggagcaacaacctt

SEQ ID NO: 2908 - DNA, 139 bp, Triticum aestivum
  Clone ID: LIB3280-053-P1-K1-G10
gctgcgggcatattgctgccaacactatgacaggccgacgctttatcagcataaccgatgctaccattggtggacaaattccggtcgacaggacctatacaagatgcgtagagtactattccctgccattcaatccgat

SEQ ID NO: 2909 - DNA, 480 bp, Triticum aestivum
  unsure (1)...(480): unsure at all n locations
  Clone ID: LIB3280-053-P1-K1-G11
aacccccncntcgacccacgcgtccggtctaaaacatatctgctactacacttcagtatttcaattgatcacacacaagaagttcagatcagaaagcaggctgtcgctactcccgtcaggttctcggatggttcccgtcaagggctgaccatggagaagagcacagtggtggtcagtgtccctgttgttgtcatggccgagactgctgagaccgactacagctcgagcttctcgcacctttgcaggatgcagagtcccagaaagatgttgggaagggtgataaatcaagggataagggaactgctgagaagtttgcaatatatcagaagcatcgttcttcgttggcagacactgttcaattcatgaggccagctgctccaacttccagtgtgaatgctgatattgtgggaacatccactctgcagtctgcatctctaccgaaacaagaaccctcaacagctacatccaagagctatactt

SEQ ID NO: 2910 - DNA, 443 bp, Triticum aestivum
  Clone ID: LIB3280-053-P1-K1-G12
ggcaacacggcgtacttgtatatttccgtggccttcattcagatgctcaaggccttgatgcctgtagcaacatttataatggctgttttctgtggtactgacaaattaagatgggacctcttcttgaacatggtattggtcagtgttggtgttagagtttcatcttatggtgagatccactttaatgtgattggaaccttgtaccaagtcactggtatctttgcggaagccctcaggctggtcctaactcaggtccttctccaaaagaagggcttaaccctgaatcccattacaagcttgtattacatagccccttgcagttattggaagaactggagctgtcaccattcgagttgctggtgttctgaaggactggatacttattgctctcttaactattatcttccctgaatccgttttacaagtcttaacataattggata

SEQ ID NO: 2911 - DNA, 223 bp, Triticum aestivum
  Clone ID: LIB3280-053-P1-K1-G2
tgtgcttaggcttcgaacagaacactatgtgtatgagcttccagatgcacatccacttctacaacagctaggacttgacctacgggaacatgatgatcctaccccatacttattggccatatggacaccagatggaataaaggaaattactaagacaccaaaaccatgctgtgaccctcaaatgggaggcgatttatgcaataatgaaatgtgccacaattgt

SEQ ID NO: 2912 - DNA, 241 bp, Triticum aestivum
  unsure (1)...(241): unsure at all n locations
  Clone ID: LIB3280-053-P1-K1-G3
ccttctactctccgttgcgacccactcttttcttctgcagccgcattaaacacttttttttacaacaaggctcgagaaaatgcctctttcattatnctcttgaaacactattgacttgcttcaaacttcatgcaggaaagaccgaagctaccattggtgggacaaatttcggccgtacaagaccgacacaagaagcgaggagttctattccctgccattcaatctgaataaagccttccca

SEQ ID NO: 2913 - DNA, 412 bp, Triticum aestivum
  Clone ID: LIB3280-053-P1-K1-G4
tcggccaacccgccgcttcccgcggaggatcccaaccttaccgcggccatgggcgacatccctttcccgggcctgccacaggcgccgccggtcgtggcacctccggaagtggcgagctccagcggcgcgggtgggtggttcgggggactgattggcaggaaggacgaagagaagaaatccagcgcgggcaagtcggagatcttggagagcttcgacacgcccagcagtccgataccatcgttcgagtacaagtgaggaaaaggttggctgatgccactgttgcctgcacggccttgcagatgctgtgatgggggctggaattggtgatgcatgtcaacaatacattaaccgacaggacaaaagaaatggtatgcggcttaagcctttttcgaaacgtggcatcttggctact

SEQ ID NO: 2914 - DNA, 446 bp, Triticum aestivum
  Clone ID: LIB3280-053-P1-K1-G5
cgcgtccgcccgatagggatcatcacagcgacgacgaaccagactccaggcctgaacatcatcaccgaatacatcatggggtacctgtacccgggccgtcccgtcgccaacatgtgcttcaaggtgtacggctacatcagcatgacgcaggcgctggccttcctgcaagacttcaagctgggccactacatgaagatcccgccgaggaccatgttcatggcgcaagtggtggggacgctgatcgcggcgctcgtgtacatcgggacggcgtggtggctcatggacagcgtccccaacatctgcagcacggagctgctccccgccgacagcccctggacgtgccccatggaccacgtgttctacgacgcgtccgtcatctggggcctcatcggcccgcgcaggatctttggcgacctcggcacctactcggcgggcaactggttctt

SEQ ID NO: 2915 - DNA, 165 bp, Triticum aestivum
  Clone ID: LIB3280-053-P1-K1-G7
acgcttgcatactccagaccggccgccctatttttctttttcatggcagagacacagcttcttggtgcaaatgtactcatgatactgtcagtccgtttatccccctcgattccatgtccaaacctttccataccatcactgtgtctgatggcccttccgcatttg

SEQ ID NO: 2916 - DNA, 409 bp, Triticum aestivum
  Clone ID: LIB3280-053-P1-K1-G8
gctgcagccgccactacgccggtcgcagagtcgccagctgcctagacgcccggaggcccgggggcgctccctcctgggctgctggcctccttcacattattggagccagaggagcgggcggcggcttgcactccatcccatcgcttgggtgcgtcgccccgaatccaatcgcctggtcaagtctgttgctgccggaggtagacggacgccttatcgtgctcgtggccgcagctagcgcgccggagccacagctggagcgctcgccggcgacgagtcgccgccccgcatggagcctacgcaggcacgcaccgccacgtctaggcgccaggcggagacgttattaccacaacattaaagggagtgccttcactccaaaaagcatagcctcataacttgctgatatgtgctc

SEQ ID NO: 2917 - DNA, 363 bp, Triticum aestivum
  Clone ID: LIB3280-053-P1-K1-G9
cggacgcgtggggtgaatgtgatattctcgtccaaggcgtttgttgctggcttcgtggcatatttgctggacaacactattgacaggcatgaagcttcagtcaggagagaccgaggctaccattggtgggacaaattccggtcgtacaggaccgatacaagaagcgaggagttctattccctgccattcaatctgaataagttcttcccatcggtctgagcttttgctgtggttaatgtgagatgctcttgttactctggaactgcccaccccctgttctccggcggtggcaccgtgatctggattttctcggtacatgaaaaaattactgtatattaaaacccgctcagctcgggtttcacc

SEQ ID NO: 2918 - DNA, 349 bp, Triticum aestivum
  Clone ID: LIB3280-053-P1-K1-H10
gaaccaacgaagcactggttgttggtaggtgcactcaccccatccccccacccaatccctcgcggcggtcggacgagagagcgagcggcgatggcggcactggaggcggtgaggtcgtgggcggtgtccgtcatcccgccggagctcgccgccgccgcggggggagacccgctcgccgcgctggcagcctccgccgcggcccttgtcgcggggctgcttatcctcgccgtctggttccgatccggaggcggggcgccgtccaagccggtcgccacgccattacggccgccgccggtgaaggtggacgccgtcgccgacgtggacgacgggcggaagcgcgtcaccatct

SEQ ID NO: 2919 - DNA, 458 bp, Triticum aestivum
  unsure (1)...(458): unsure at all n locations
  Clone ID: LIB3280-053-P1-K1-H2
ttcccgnncgaccccgcttccggtgagggttggcagcactcaaccgctgacagcggcagttgcgcgtctagggttgctgtgctcgtgtgcgggagcgggagtcaccaagtatagcgaatgccatacaggtaagttgtccgctcttcaaagtatactacttatccccaggtaacccgtgtatccgctttttaaattaaatttctacttattccgatatgtataggatatgtatccgagctgtttcgctatccgatacagatacgagctctttgggaatgatcctggtattcataggcattattgtagcgacttttctgatttgttgcacttcccttttttgctccatacacctctaacaatacttttttcttgatatgttttaatgaatagttttttcacattaatcaatcttttggttctccatgtaacttttataaccatcatagtactttcaagac

SEQ ID NO: 2920 - DNA, 357 bp, Triticum aestivum
  Clone ID: LIB3280-053-P1-K1-H5
tcgacccactcctccgcccacgccttcgagaagaaaccataagcgacttcaggttcgtggtctttgctgcgcgcgggagctaggcaggtccttgccccggggctccggcggctcggtctgggcaccggcgccgccggtcatgtgggcccggccgccgcggcggcggtgatgagggcgtaccacgagcgggtggtggaccactacaacaacccgcggaacgtcggttccttcgacatggaggaccccaacgtcggtactgggctggtcggcgcgccggcctgtggcgacgtcatgatagtgcagatccgcgttgacgaggactccggtataatcggcggacgcctgcttcaagacctt

SEQ ID NO: 2921 - DNA, 425 bp, Triticum aestivum
  Clone ID: LIB3280-053-P1-K1-H7
tcggtcccttgctggtggcatcattgggaagggtggtgctaacattaagcaaatatcttccgtgacaggggccaaggtggtcattcaggaggaccgccatgaatcagacaccagcttgaaaaacattgagtttgagggcacctttgatcagatcaggaacgctagtgctatggtcatcgagctgtttgttagcatcagtggcataggaagcaacttcaagaccaagatgtgtgagaacttcgtaaaagggtcatgcttttatggcggcaaatgccactttgcccatggtgagagtgagctgcgcaagcctgccgcttgttgagatccatgccctgtttcttacctcatagtcattagtcaatgtaactcaaaatctggcctttgatgatggatatgtaggcttctttaggtctacgctatatgaa

SEQ ID NO: 2922 - DNA, 434 bp, Triticum aestivum
  Clone ID: LIB3280-053-P1-K1-H9
tcgagcgagcgagcgatgagcggtgagcccggccaccatcgccggaggccgtcgtcgtcttactagccgacgctcgacttgggcatgaattgctagccgcgcgggtgagagattgctaggtagccagctaggtacggtgtggggagttgaatcggaggtctgccgctcgaggcggcggcggcagaaggccggtaggatgaagaagctccactggctggtgcggttcctgttcgggccgtggccggtctacttctcggcgctggccatcctcatcgtgctcaccaacgcgcatttcttcgggctggtgggcgttggcgtggctccgcgcaccgcgaagctggccttctcggcgcccgtggtcatgcgtatgaattactgcgacatcttccgtggcgagtgggtgccggacactgttgcgcccttctacaaccaca

SEQ ID NO: 2923 - DNA, 420 bp, Triticum aestivum
  Clone ID: LIB3280-054-P1-K1-A1
cggacgcgtgggggaaagctagcttctgctctggcagtttgatcgatggccacacatccagtcgagagttagttgctttgcctggttcattgtaatctgttgccgtattattattgcttgcatgcacggctggttggattggatccatctgcgctcctagctggacggtggttggcagatgtgatgagacgagaacgagactacgacagtgagaagagagatcctagccaaatgcaaatgttacaactgccgccgccgccggataggcttccaatttcatccgttgcatacatacgagtgctctcatccgcctattattttaaaatggagatgaagaatcgagatcgtccatgatccgtattcctccctcctcgttgactgccgcggccagcgatctggtcgtcaccttcctggaccgac

SEQ ID NO: 2924 - DNA, 271 bp, Triticum aestivum
  Clone ID: LIB3280-054-P1-K1-A10
ttctcctcttcgtcttcggttgcaagaaagaaaaagcatcatggacggcttccccaagagcgtcggcggtggcggccctaacattccggcgggatcccaccccgcaggcgggagccaggcggcggcaggaggaggcgcgacgcagcggacgcagtatccgtatgtgactggtaattcagtcattgccttgaaatacaaggatggtgtgatcatggcatgtgacactggagcctcttatggatcaactttgagatacaagagtggggaacgc

SEQ ID NO: 2925 - DNA, 443 bp, Triticum aestivum
  Clone ID: LIB3280-054-P1-K1-A11
cggacgcgtgggcggacgcgtggggttatagtgccatgtctccaaaaaaaaaaaaaaaaaaaaaaaaaaaaaaaaaaaaaaaaaataaaaaaaaaaaaaaaaatttaaaaaaaaaataaaaaataaataatattaattttgtgtatcaaaatatttagttttacaaattaatatatattgggggggccctttattagtatctatggttgtttgcgcttatgtcttcgagtttcattttttttttagggctcttattttaatttcctgggggggtgtttccataaatggtgatggaaaatatctcgttcttcccatatttatttgtttgggataatttctctttttttctactctttttttaatttactaaattttttctcattttgtgttttatatatgtttacctccctcttatctctttaatggttccctctctttttttg

SEQ ID NO: 2926 - DNA, 219 bp, Triticum aestivum
  Clone ID: LIB3280-054-P1-K1-A12
ctcccctctctcccgcgtccttggagagtcgcggaggatcacctttctttattgtggccatctcgatagcacattcctgggcacccgtctggcgaccctgctccacaaacgggcgcattgtggttcggttcgggttcgggtgagcggcaaggctaatcctgctccgaagaaggtggcgttgacatcgtcctcctcttaccggccgttgtggttccccgg

SEQ ID NO: 2927 - DNA, 506 bp, Triticum aestivum
  Clone ID: LIB3280-054-P1-K1-A2
ccgcacgtgccggtccggattgaccgactcgtcccacgcctcctggcgttgcctaagaagatccagaggtctagtcttggccagcttaaaagattttcactacgagaattacaagttgcaacagatggcttcagcaataagaacattcttggaagaggtggatttggcaaagtctacaaaggacggctggcagatggatctttagttgctgttaagagactaaaggaggagcgcacgcctggtggagaattacagtttcaaacagaagttgagatgattagtatggctgtacacagaaatctattgcgtcttcgtggattctgtatgacaccaacagaaaggttgcttgtgtatccatacatggctaatggaagtgttgcgtcacgtttaagagaccgaccaccagctgaacctccgctagattggcaaacaagacaaaggattgcattgggttctgctaggggcctgtcttatttacatgatcattgtgatccacagattatttt

SEQ ID NO: 2928 - DNA, 429 bp, Triticum aestivum
  Clone ID: LIB3280-054-P1-K1-A3
tcgcccacgcgtccgcccacgcgtccggagcagtgaaaaaaaatgatattttaccgtagctaggctttaacttctcttagtcttctggctttgctctgttcacgtttagcacaacagtgcctactctttcgtgtgatatcatgtttgtaattgctctccgcagagagcaatacgggagcaaaagaacattcttttggattctgagaagctagactcagctaggaagaggcttcaggaaaactaccaggaagcgcaaaacggtaagatttcaatggcgcgctccgtgtacttagcactgacttagagctttacatacaaagttaaatagtctctcactaggaataattcgttgtctgatctcccagtgaacttgtcaaaatgacgtgctaaattcaggccaatgctatgccagtgagatccaacagcagt

SEQ ID NO: 2929 - DNA, 444 bp, Triticum aestivum
  Clone ID: LIB3280-054-P1-K1-A4
cccacgcgtccgccactcccaatcttatcgtcgcctccctcgacgtcgctgctgcctccacttcaccatggcgcttcacgccccggtcctcgttctgaaggactcgctgaagcgggagtctggcgcgaaggttcaccaagccaacatccaggcggccaaggctgtcgctgacatcatacgcactacattgggtcccagatccatgctgaaaatgcttctggatgctagaggaggtattgtggttactaatgatggtaatgccattttgagggaaatagacattgcacaccctgctgccaagtctatgatcgaactaagtcgtacacaggatgaagaagttggtgatggcactacatctgtcattgttctagctggagagatgctacatgttgcacaaggcattcatcgacaagaactaccatccaactgttatttgccgagcat

SEQ ID NO: 2930 - DNA, 283 bp, Triticum aestivum
  Clone ID: LIB3280-054-P1-K1-A5
cccctatcagactgcgacggaacatgagcatagttttctaggcttgcagcttaggtaggacgagtagaatttcttcttttgttttttggcttcaaaaatattcttttcatccgttgggcagagactacaggtggtgtggggcacttctttcactggtctttctcctagttaggtcgtatgcatcgggaggatctgctggaaccccaaaagcgattcttggttgattgattcgcttggggggatattcaaaagcttaagcttctttcttctccttccacaaaaa

SEQ ID NO: 2931 - DNA, 407 bp, Triticum aestivum
  Clone ID: LIB3280-054-P1-K1-A6
ttcccggattgccggccccatcctgggcgcgtcgctgccgtctccggcgggcggtgaggatgcgcaccgccgccgcgtcagctatttctacgagccgtctatcggagactactactacgggcaaggtcacccgatgaagccccaccgcatccgaatggcgcactcgctggtggtccactacggcctccaccgtctcctcgagctctcccgcccctacccggcctctgaggccgacattcgccgcttccactccgacgactacgtcgctttcctcgcgtccgccaccggaaacccgggtgtcctcgacccgcgcgccattaagcgctttaacgtcagtgaggactgccccgtgttcaacggtctttttcccttctgccaggccttcgttggggggaagcattgggtgc

SEQ ID NO: 2932 - DNA, 473 bp, Triticum aestivum
  Clone ID: LIB3280-054-P1-K1-A7
tccgcgcgtgcgtgcatgaatcaatcccacggtcttcctgccgcttcctagggtgcccccatcctccgaatgctgcctcgcctcgatctgcccgttcctcgtgttccgacggagggtggcgggcgactaatggggacgggggcggggagcgcgcgggctctggccgtggcgttcgccgtctcgcttctcgcctgctctggcgccgtcgctgtcgccagggcgcaagacaccgagcggatcgaaggaagtgctggtgatgtgctcgaagacgatcccgttgggaggctcaaggtgtatgtctacgagttgccgaccaagtacaacaagaagatggtggctaaagactctaggtgtctcagccacatgtttgccgcggagatcttcatgcaccgcttcctactgtctagcgcgatccggactttaaatccagaagtagccgattggttctatactccggtatacaccacgtgtgg

SEQ ID NO: 2933 - DNA, 145 bp, Triticum aestivum
  Clone ID: LIB3280-054-P1-K1-A8
ctttgctcttgttcacgtttagacaacagggcctactctttcgtgggataatcatgtgttgaattggtctccgcggagagcaatacgggagcaaaagaacactctcttggggtgtgggaagccagactcaaacaggaagagggtt

SEQ ID NO: 2934 - DNA, 457 bp, Triticum aestivum
  Clone ID: LIB3280-054-P1-K1-A9
cgtgcgcgcaaacatccatctgaggctaccacagatgggaatagagctaatggacaaccgttgcttgtcaatgagcagaacaagtataaatcaatgcttatccgtacatattctacagtatggatgattggaggctttgcctttattatttatgcgggtcatctatatatctgggctctggaggtagggattcaaatattcatggcaagagaacgtttcaacctactcacaaaatggagcgtagagaaacacccccctgggttcaggctactgaattggttctgtatggtttatttagactctcaagaaaaagacatataattaccagttcaaacagtatgcctggacgcacatgatacttgtaacggtttttgcacagtctgctttcactgtggcaaacatatttggagggatattctggtttcttttgcctgcttcacttattgtgatcaacgat

SEQ ID NO: 2935 - DNA, 460 bp, Triticum aestivum
  Clone ID: LIB3280-054-P1-K1-B1
cttcatctggagtatcacatctgttggagagaatggccttcaagagcacagtgaatcggactcacttacggttagttcgtgaggtagaagccattggaggaaatgtctctgcatcagcttcccgtgaacaaatgagctatacctatgatgcattgaagagctatacaccagaaatggttgaagttctcattgacagtgtgaggaatccagcattcctcgattgggaggtcaaagagcagctccagaacataaaatctgaaatagctgatgcgtctgctaatcctcaaggtctacttctggaggcccttcattcggttggatattccggggcactggcaaaacctttgatggcttcagaatctgctgtaaaccggttggatgttagcagcttggaggaatttgttgctgaacattacactgctcccaggatggttcttgcagcatcaggagttgatcatga

SEQ ID NO: 2936 - DNA, 315 bp, Triticum aestivum
  unsure (1)...(315): unsure at all n locations
  Clone ID: LIB3280-054-P1-K1-B10
cctgcattnnccnnncccccattcccccnttcctcccacccttttcnctttttgcttatccatatctgttatccctgtcacttagctcctattccgttttcttcttactagccgtctctcttattttatcatgaattgcttgccttgctttcgagatttttcttttttttcatctttgctcagttttttgattttattctctttgtctgcctttcttttcgttatcttcttatttctctttgtattaatactttttcactgtctttgatcattttccttgtttatgtccattttccctgttctctacttttttct

SEQ ID NO: 2937 - DNA, 233 bp, Triticum aestivum
  Clone ID: LIB3280-054-P1-K1-B11
cagggagcttcacagtgatggatctgaagagaagtgggaaatggcagaaaagacccggcgggtatgtattgtgcacgtctctgtgtccgtccgtcgtcggatctggtcgtagtggagacttattgtttgatcaggcagctacaacagcgactctgccaatgatctatttgccgtaggggtgctgtggctagggcatgtttgtgttggacttacgacgcggtgcccattgccgt

SEQ ID NO: 2938 - DNA, 327 bp, Triticum aestivum
  Clone ID: LIB3280-054-P1-K1-B3
tcggcggcgtctgcctcgtcaaggcgttccagagcgcctacttcgacaggtacggcggtggcgccaactcgctcgcctccggctactcccgctgtaccggcctcggcgccgagatcatcgtcacctttgtgcttgtctacaccgttttctccgtcaccgaccccaagcgcatcgcccgtgactcccacgtcccggttctggcttccctccccatcggcttcggcgtgttcatggtgcacctggccaccattcccgtcaccggctccggcatttacccggcctggagcctgggcgccgtcttcatctacaacatggtcttgccctggg

SEQ ID NO: 2939 - DNA, 449 bp, Triticum aestivum
  Clone ID: LIB3280-054-P1-K1-B4
acccacgcgtactgatattttggtatccttgcgcggtcaggcttcacggtatctaaagccctattcttcaatttcctctctgcgttggatgctcttgctggaacagcactagcattgtctttgggtaaagatccgggacattcctccctgattgagggtttcaccgccggtggtttcatttacattgctgtcgcgggagtcctaccacagatgaacgaccagataacaaccatgaagagctcattagctcagctgatctccctggctatggggatgctggtcgctctaggcatttctctggtaataataatttgaaaccccatttctcacacttggtgcattaggttcaacccagttaccccaagttgatataatgctctagcagctccaaactagaaacagggttttctgatcctctcaatatatagaaccaaaaagtattttttttt

SEQ ID NO: 2940 - DNA, 254 bp, Triticum aestivum
  Clone ID: LIB3280-054-P1-K1-C1
aggcatagcactggtcagcggtatgggcaccagccccgacatccctgcgacgatgctgtgcgttgctctttttgtcgctggctgcttcggcgccaccgtctgcaggtacagccacgcccgccacaccgacgccgacttcgcgattctgttccccagcagctttggctcttgtggccgaccgaggaattgctgcgactccggtataaaggacgcctccctgtcggtgtggcactttaacaatcgtggtggacaag

SEQ ID NO: 2941 - DNA, 402 bp, Triticum aestivum
  Clone ID: LIB3280-054-P1-K1-C10
cgacccacaccttcttcctacgcgttgcccacgcgttcggtatcgcaggagtgcccccaaccccatgtcggttgaccctgacatgctcaacgagagcgggcaccatcacgccatagcgttcgtggagggggacaagtactacggcgccaaggctaccatcaatgtgtggcttccgaagatcgagcaggccaatgagttcatcctgtcccagctctggatcctgggaggctccttctgtcaggacctcttcagcatcgttacatgatgtgaggttagtccagaccttgttgtgtacaacaacattatggtttttacctacttgcctagcgattcctatcatgctacatgttgcttcaacctgttgtgctcgggggtcattctaattaacatccatgattgtta

SEQ ID NO: 2942 - DNA, 240 bp, Triticum aestivum
  Clone ID: LIB3280-054-P1-K1-C11
tccggtactggttcgccggctcctgcgccgtccctgccgcgggcaccggctggttcgcctgcccccacagcgtggagagcgagcagttcatcacagtcctagtgccgagctccgacggcggtcacgagatgaactaccacggcatattccacgtttgcggcgagggctcctccgacgggacgttccctttgttccctttctcgtggcagtatcttaccgttgtagcggtcagtggtatga

SEQ ID NO: 2943 - DNA, 264 bp, Triticum aestivum
  Clone ID: LIB3280-054-P1-K1-C12
ttcaccagcttgctctagcatagcactcgccatctaccgaccgccgcatttcaatcagcccgacgagctagcagagcggctggcaccttcctcctcaaggaacatggcccgcatgcagaatgttggcagtggctacggcggccgtggtggccttgttgctgctggctggcggcggcgacctctgatgctgacatctgctgctggctggtggcgtttgccattgtgccctgcatctcctacttgcgcggacagtgctaggggccc

SEQ ID NO: 2944 - DNA, 84 bp, Triticum aestivum
  Clone ID: LIB3280-054-P1-K1-C2
ccagcttgcattgcatttcaagttaagatcgttgtcgcttcctgaggtagcccctcctcggattctggatctcggaccatgcta

SEQ ID NO: 2945 - DNA, 290 bp, Triticum aestivum
  Clone ID: LIB3280-054-P1-K1-C3
tttcgaaaaggtaaagggcagagttgctgcacgaactgctcaagaccggagctggcttcgaccccctcccggttcttacccaggaaacactgatcatctggggcgacaaagaccaggtgttccccgtcgacctcggccacaggctgcacaggcttctgggcgagaggtccaggctagagatctgtagggacgcagggcacgcgcttgcagctggagggcgccgaccacgtcatccgctccatcaagtcgttccttctggactatgcggtcggtccgggagccggcgcggt

SEQ ID NO: 2946 - DNA, 251 bp, Triticum aestivum
  Clone ID: LIB3280-054-P1-K1-C7
caagcccccaacctgcgagctgcgacaagttcgtctctctcgtggccacgactggccggcgtccccgcctccgtcccctcgcagattcccaggtcttcgccgctcccttcgccgccaaagagcacccacttggttaaatccgcctgggggaaatcttcatcaagcgtgtcgtgctaattatgcgatcttcatgggctgactcagttgcgaacgccgatgaattggtgcccgcgacttgctgctgcttatgg

SEQ ID NO: 2947 - DNA, 410 bp, Triticum aestivum
  Clone ID: LIB3280-054-P1-K1-C8
cggacgcgtgggcgcgaatcacagacgcgtctatctcagcttgctgcactgcactaccctgccctgccatcatattgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgctccaccgtgtacagcacgcttgatgccgtgcctgccgttcgtccagatgggcggggccatgccgccccagccgtgctgcggcggcttccgcagcctgctgcagcttgccaacaacacccccgaccgtcgaaccatttgcgggtggctcaagaacgtcgccaacggcgccaacgggtgcgggacctacattagtcgggccgg

SEQ ID NO: 2948 - DNA, 163 bp, Triticum aestivum
  Clone ID: LIB3280-054-P1-K1-C9
aaactgtagtcttctttatgtccgactattaacaagaagatggcagcggcttgggggcagatgttgccctgggcatcgatccttgctccgatgacaaggagctgattgttgcagtttgctgaggaaatacagggggtgtttgggcaacctgagaaaggtgctg

SEQ ID NO: 2949 - DNA, 273 bp, Triticum aestivum
  Clone ID: LIB3280-054-P1-K1-D1
taatcctgtggcgactccttgttcgggggctgtgctgctcacgggagctatgcagctccttgccccggggctccggcggctcgttctgggcaccggcgccgcctgtcaggtgggcccggccgccgcggcggcggggatgagggcgtaccacgagcgggtggtggaccacttcaacaacccgtggaactgttgttcctttgacaaggatgaccccaacgtctgttctgggctggattgagcgccggccctgtgcgacttcatgaagttgcaaat

SEQ ID NO: 2950 - DNA, 388 bp, Triticum aestivum
  Clone ID: LIB3280-054-P1-K1-D10
tgcgacgactgggttgggtaacgccgttcgccgccgccgccgccatacgcaggtgccgaggccttcgtcgatctcttagccgtcgacaagcacccaagagatgcaggatagaatgagacggcaggggcaatatggtgaagcggatattaactctatggttgctgcccagttgcatcactaccagtcacagcatagggtacagaaacaccctgagaattgctacactggaagagatcctgcacaagctgctgcggagcttcagtacactcccccttaatcaagacagagtcaatgggatcgatgtggaccaaatgcgccaagccaggttccattttatgcatataacgaaacccaaagggctggaggtgcgctatccttttatgatggg

SEQ ID NO: 2951 - DNA, 439 bp, Triticum aestivum
  Clone ID: LIB3280-054-P1-K1-D12
cgtccgcggacgcgtgggcgggagcgctccctattcgcgggagcgagagaaatagagtgccccccgctctccgctctccgccgcggatcagcgccgtcgccgatcggaggccctcgcttccgccggcgggcggcgcgagccgggagatggacggcggcgcgggtgccggtcggtggagcgtcccctcctcctccggattcaggaggagggtcccgcccgccgtgaacgggcacggtcatgacgccccgccgccctccaggcggtccttcggctccctctcccgtggccactccacgccgctgactggcgagaggaccgtgaaaaggctgaggttgtacaatgcacttgctataccgtatcacacgaccgtgcactaggcttgtcagaggttggcatttcgcatggtatatgccgtgttactgaccgtattccatgcttt

SEQ ID NO: 2952 - DNA, 472 bp, Triticum aestivum
  Clone ID: LIB3280-054-P1-K1-D2
ccacgcgtccggcaggtatgatcttatacgagtggagattggcaacaaagatataaagcttgaatacttagtggaggcatttacaacttcaaatgagtaacattccttgatctgaaatgtgtacaataatcctgatgaactactaaaacacttgccttaatctgaaatgagtacaataaaacatatataaggaaactcaaataagtaaagtcttgcttggccctcacaccataacatgactgatgatctactaaaacacctgcgaggtcttgtagcgtagcctcctcaacaccttctgcttatgctaactccggtgcaaggtacgccgctgccatcccaatccctacccccaggcaagctttgttgattgcttttctggtagttgatttcgtagctagctttttataagtcaaaaattgggtgaaatctgattaaccaaactaccgtgggtagaaataaaattggatgaatc

SEQ ID NO: 2953 - DNA, 330 bp, Triticum aestivum
  Clone ID: LIB3280-054-P1-K1-D3
cccacgcgtccacccacgcgtccgcccactcgtccgcccacgcgttcggccgttgtcgctctcgtcccacccctcaccggccgccggtcgccgccggcttctcgcgtaccgcagatttgccgcagaagaatcagatccaaaccccgtatcttctcttcttgcccctccttccccattgtccccggcgctgccatggcctccggcggtgccgcccccaccggctcctatgccgggtccatgaagaagttgctcatcttcgactccgaggtaggatcttcgaggttttctctttgcggaagtacctctggaggaggctggtcggagaaagtt

SEQ ID NO: 2954 - DNA, 278 bp, Triticum aestivum
  Clone ID: LIB3280-054-P1-K1-D4
cttcctgcctctaaccaccagcccctcgagtccgtcccttccccttgttcttcttgcaaccgagcagcgaccaaccaagcatgcgacaccgatcgagagctccaccgatctggcgaccgtcatgcccggaaagcaccagcagcacatgacggcaacggcaacggcggcggcggcggctgcaacacccaaggggtgcgtgacggagcgcgtggtcctggagggagtggagcagctccgtttctatgtgccgtttgggcatccttaagcactcgcttctt

SEQ ID NO: 2955 - DNA, 281 bp, Triticum aestivum
  Clone ID: LIB3280-054-P1-K1-D5
gccgggaaccccaacctagcatcagaccgtcttcaagtcaggcactattctgtgcccgcgtcatcttcttggattcgcggcgatcaccaccgtcgtatttctgacaactgctgccgttgccgcgctcctcaccgtctccacgtcgtctctcgtcgctgccggagctggctcgaggccctcttcctacatgatctcggagccatcaagaaatgtgctgaggatggcgtgccacatccaaatcttttgctctgtcaagatggctgtcggccaacctgccgatc

SEQ ID NO: 2956 - DNA, 255 bp, Triticum aestivum
  Clone ID: LIB3280-054-P1-K1-D6
aagtgagacgacggcggcggcgatgacgctgcttggtctgcaggccctgatggggtcggaaggactctttatctttctagctaattaataagctctagctagtatataatattctagcagagtcgtttgctgtgtgttgttcgagtcaatgagacagtcagtcgcgtgccatgggccatgcccatggtataacaagccgtgctctatctgttccatcgacttgttctagtggtggtactgatgggggaacaaata

SEQ ID NO: 2957 - DNA, 360 bp, Triticum aestivum
  unsure (1)...(360): unsure at all n locations
  Clone ID: LIB3280-054-P1-K1-D7
gtatttctcaaatttgcgcaggacattgggtcctggaattgatggctgggaagtatctttgaaaggaatgatgagcatagtggttctccttggacttgtcataacttccatctattggggagtgaacaagtatgttttgaatgatccttcactttcaaaggctgatcgtaagatgaaaaaggaattgcctaaacttggcatgaaagagagtctgaaggttctgctctcctcgaggtatgtgagggatcctatctaccctagtggttgcttatggcattagnnnnaatcttgtcgaattcacgtggaaatcaattctaaggcacagttccctttgtccaaaagaatttttattctttcatg

SEQ ID NO: 2958 - DNA, 248 bp, Triticum aestivum
  Clone ID: LIB3280-054-P1-K1-D8
tcggagattgactacgaggaggtcgccgttgagggcggcagtgatgacggtgacgaggaggaggaatactgatctgcttgcatgaatctgtttggctgtcgagccaggttgtggtgttgaaaaacctttgtttgtgtcctgtcccctctgggaaatgtttgggtgtttccttccatcatcacttgctgaactgttctagtatttgcatttgtaatttgaagtctgttactttaagcactcttggttct

SEQ ID NO: 2959 - DNA, 337 bp, Triticum aestivum
  Clone ID: LIB3280-054-P1-K1-D9
tcggcgccggcgcctccacttcgttatcctcactctctcctccagctcggggtccggcggcgaagggaaggcaagatgtacaccgcgaggaagaagatccagaaggagaagggccttgagccctccgagttcgaggactccgttgcccaggctttctttgatctggagaacgggaaccaggagctcaagagcgacctcaaggacctgttcatcaacaatgctatccagatggtagttaccgggagcaggaaggctgttgtcatccacgtcccataccggctgcgcaaggccctcaggaagatccatgtcagactcgggagggagctggagaagaaat

SEQ ID NO: 2960 - DNA, 386 bp, Triticum aestivum
  Clone ID: LIB3280-054-P1-K1-E1
ttccattaattaattttttgtactggatttaatgtgctgctattttgaaggttttttctgccggaaattttcacatcccgaatcgactggaaattgaagtagccatttgatgctgttacctgggttcataagttgttagacttgttgttatttgtttgttaatcctatagctattgcatattgtgtgcctgatcaggaccacagaaacctctaggcgacgaatcgagcaggttgaggagtaatcaggcatccatggctgatcatcttgcgtccatctttggcacggagaaagaccgcgtgaactgccccttctacttcaagatcggcgcatgccgtcccggtgaccggttcttccgtctgcacaacaagtcttccatcttcccgac

SEQ ID NO: 2961 - DNA, 436 bp, Triticum aestivum
  Clone ID: LIB3280-054-P1-K1-E12
atgcaaagcttctgacatcgatcaacaatagcaagaatggtgaagcagggggtgatcttcagtcgtatccaaactacccagacagcccaattgggcgcctgatatctccaagctcgggctgttctggcacatcctccccattccctgaccctgagatgcaggctttttcacgcagcgctttacgcttgttcccagttcgtgagccccctaagatattggatggcgagggcgttgcgacacagaagttgatacctcgccatatgcgcaacggtgggtccctcttggatggccagatctcagcagctgtaccagttgtggacttctctggccgacttcaacccaacgagcacgcaatggatcaccgggtgtcattcgagttgaccggcgaagatgtcgcgcgccgccttgagaagaaactgcaatctcccgggattct

SEQ ID NO: 2962 - DNA, 295 bp, Triticum aestivum
  Clone ID: LIB3280-054-P1-K1-E2
cggccccacccacgcctccgctcacaaccagggtgcggaggatgatgctcgccgtgattttgaggaacgatgttgggtggttcgatcaggaggaaaacaactcgaaccttgtcgtctctcgcctctccacagacgccgtcgatgtgaaatcggcctttgccgagcggatatgtttgatcctgcagaacatgacgtccctgctcgtgtccttcgtggtgggctttatcattgaatggtgggttgccctccttattctcgttacctttccttttctcgtgctctccaactttgccca

SEQ ID NO: 2963 - DNA, 267 bp, Triticum aestivum
  Clone ID: LIB3280-054-P1-K1-E3
gtcttaatttagcttcctcctcctcacctactagcaggcacagcgggcagcagcatcgatcggatcggagcagcacagggcgcgtcaccggaagctcaagtgtcttcttccctgcttggttggctgctgcttacctctcaggtccccactcacgtgccttggcgtacgtacgtgcgttcaacacaccaggtgaaattgggctcggagacggtgacggtctacgtggaaggcattccgttcccggcggagatcaccgtcgggaaccct

SEQ ID NO: 2964 - DNA, 454 bp, Triticum aestivum
  Clone ID: LIB3280-054-P1-K1-E4
cgcgtccgcaacggctacgcccccgcttccgccgcccatgtccgcctacgcccatcctccaccgaccgccgcgtacccgcctccttcaggcaaggctgacgcctacgcgcctcccgccgcgtacccgcctccttcgggcaaggccgacgcgtacgcgccccctgccaccgcatacccgccggcagccaaggccgacgcgtacccacctccatacggcgcctacccgcccgccggcggcaaggccgacgctgcttacccgccctcatccggctacccacccgcggcaggcaagccagccaaggggggcgaaccggtgacggcctacccttcgggcggtcccagcacggcggcgccctacgctgctcctccgccgcagtacggcggctacgggtacccgccgcagcatgccgccgggtacggctacccgcccccgcagcaagccgggtacgggtac

SEQ ID NO: 2965 - DNA, 425 bp, Triticum aestivum
  Clone ID: LIB3280-054-P1-K1-E6
ttcaaattcttcgatcgcgcagcgccgcccgccctctcgcagctctctccgatggcccgcacgaagcagacggcgaggaagtcaactggcggcaaggcgccgcggaagcagctggccaccaaggcggcgcgcaagtcggctccggccaccggcggcgtgaagaagccgcacaggttccgccccggcaccgtcgctctccgcgagatccgcatgtaccagaagagcacggagctgctcattcggaagctgcccttccagcggctggtgcgtgagatcgcgcaagacttcaagaccgaccttcggtttcagtcctccgctgtcgccgcgctgcatgaggccgccgaggcgtatctggcgggtctttttgaggacactcattccttgcgccatccacgccaagagggtcaccattatgcccaaagaca

SEQ ID NO: 2966 - DNA, 288 bp, Triticum aestivum
  Clone ID: LIB3280-054-P1-K1-E7
cgcgtccgtccacgcgtccgcgacgttcctggggcatgtgcgagcgctgcgccagctgcgcgtcggagcacagcaacgtgtgcgacgcggtgccgttcgtcatcggccccggtatgcggcgcgactgcaccacccggttccgggacgcgcggtggagcccgctgcacgacctcctcgccgtcttcagcttcatgcgagtacaccgtcgtggacgtgaaccaggtggtcaaggtcgaccccgccgtgccgaccaagctcgcctgccttcttagctgcggtgccggcacc

SEQ ID NO: 2967 - DNA, 391 bp, Triticum aestivum
  unsure (1)...(391): unsure at all n locations
  Clone ID: LIB3280-054-P1-K1-E8
cgcgtccgtccgatccctcctccaccaccgcttcctccgcgtcacccatctcgtcgtcgcctcacgaggcgaccagcggcggaccctccgcggcgcaaccatggggctcttcactgtgacgaagaaggccaccacgcccttcgacggccagaagcccggcacctccggcctccgcaagaaggttactgtattccagcagccccattatctgcagaactttgtccaatcaacattcaatgcccttcctgtggatcaagtaagaggtgcaacaatttgttgtctctnnttaataccgctatttctcaaaagatgctgttcagatcataacaaaaatggctgctggcaatggaattaagacgtgtttggggtggacaaaaacagctcatgtcta

SEQ ID NO: 2968 - DNA, 337 bp, Triticum aestivum
  Clone ID: LIB3280-054-P1-K1-E9
atcaaccaccattcgctgcctttctcacccaagtgcacacgtgcgcgcactcagcatgtgtgtcctccgcgacatcctgagcaacggatccgtgaaccccaacaagacaatccaaggggaacagctgcggtacggcatccagagcccgtcctaccggtgcctggccgcaggcatcatcaactggcaagcggacgtcgagaggtgcatagagtgggaagcccacagccgccgcgccactgggctgacgctcgcctttctcagtgccgtagcgaaggagctcggctgccctctcccgtcatgacatggccattcctggatctgacatcggctttcaaat

SEQ ID NO: 2969 - DNA, 339 bp, Triticum aestivum
  Clone ID: LIB3280-054-P1-K1-F1
tttctcttcatatccatgcatggatgaacaagatacggtttgtgacagatgcaaacatcgagactggggttgttatctgtctttgtagcagaagaaacagtcctaataaagaatggagagctccttatataggagcaacgttttttaggggaaccacctgggttttgcgagaagcacatccatggattccactggtcctcagttagctggtaggtctagctcaatgttgagtaggagaagtttcagacagggcttaaggggatccattagctctttcaagggagatgggggactccatactgaacgaaatgaggcattctcttcagtcggcggttcaat

SEQ ID NO: 2970 - DNA, 334 bp, Triticum aestivum
  unsure (1)...(334): unsure at all n locations
  Clone ID: LIB3280-054-P1-K1-F10
tcccnncccttcccacccgtcctcattatcccttcctaagaattctattaattccaagatagggagcaacctaaacttgaggaggtctgctggatgtggatcatgtcttcatgatgtggtggagctgatggggaagatctcacaagtgtgtgaagactacacagtctcgcgcactctctaacccagtgcgcgctgcggtctttcttttttcccaccttcttggatcggggaggttggccatgatgaggttgtggcctgctgtcctgctggtctgcgcattggctgtgtcctttctggtggccaccgtggaatgctctgtgacttactacaagaa

SEQ ID NO: 2971 - DNA, 457 bp, Triticum aestivum
  Clone ID: LIB3280-054-P1-K1-F11
ccacgcgtccgtgacatgattgatgacactgccgattcaattgtttctgatatgctcttgtggccacacaggcatgttgttaaacttggtgtcaatgttgatacgagtgacttggagcttaaacctcagggaagactttctgttactgtggtaaaagcaacttctttgagaaataaggagatgatcggtaaatcagacccttatgtgaaactgtttgtgcggccaatgtttaaggtcaaaacaaaattcatagatgatgacctgaatccggaattggtatgaaacatttgacttgattgtctgaagacaaagaaacccaatctgtgttttttgaggtttacgacgtagacatacttcaacttgacaagagactaggtgtggcataactagcattaaacactcttgaatctgagattacccaagacgccacttttaagctgttcattcactggattcc

SEQ ID NO: 2972 - DNA, 435 bp, Triticum aestivum
  Clone ID: LIB3280-054-P1-K1-F12
cacaactgcgactaataaccatctttggggcccttcgccgcgattagcttcgcttctcggactaggttaagttgccttttcgattctcagaaaaagactggctctgcactcggataattttaaaatggatagtgcacagcaccccactggggaattgatcaattcgtacgatactcttatggtttctggaggtgaccagagtcgacagcctcaggatgctggcaatgaaacgagcttcacgaattggaaagacctccccatggagctgctcctgcgtatcatttcactagttggagatgacaggatagtcattgtggcctccggtgtatgcacaggatggcgtgacaccttggggtggggggttgcaaatctttcactattatggagccaggaccgcatgaatgacttggtgatatcactggctcacaaattcac

SEQ ID NO: 2973 - DNA, 350 bp, Triticum aestivum
  Clone ID: LIB3280-054-P1-K1-F2
tcctccttccacgacttgctcctacagtcctacctagactttagccggcgccgccatggtgatctcggggcccgcggcccggtgctccaccttcgtacgcgacgccgtgctgggcggcggcgggcggcagctggtccagccctttcgttgcgccttctacaacggcctggccgccgcgctgtccgagtccgaggagccctccgactcggacgccgccgcccgcgtccccgctggctgcaagcggcaggcggtgaggaacgtgctgatcctgttgagcgacaccggcggtggccacctcaccttcgccgaggccctgcgcgacgccttttcgattcgtgtttggcgacgcc

SEQ ID NO: 2974 - DNA, 372 bp, Triticum aestivum
  Clone ID: LIB3280-054-P1-K1-F3
ctccctccgagtccagggggcaggggcaccattaccgagttgtttaattagtgctagttgtattaccattgttagtgacttaattaccctcacgcgaagcaccttacctctgctagtcctcctacgtctcttctcttcgcttaatcttggtcggtgatttgattcttcacttcttgcgcgcattgcagagggtgctcggtctgcagctatcttaggttaaccagtcgtgtgtgtgctatcgatttcgatatagtactactgctctgttataatcagcgggaaggaggaagatgacggtgacgccacggatcacggtgagcgacgggcgggtgacggtgcgcggccgtacggtgctcaccggcgtgccggaca

SEQ ID NO: 2975 - DNA, 460 bp, Triticum aestivum
  Clone ID: LIB3280-054-P1-K1-F6
gtcccacgcctcctcccactcgttcgcccacgcgtcctcagcacattagttgctgtttcatttggttatcttgcacctgagtacgccatgagaggtcatatgaccgtgaaagttgatgtgtttgcatttggcatggtcatattggagaccttagccggaagaccaaattttgacaatatgctagatgaaattaaggtttatatattagaatgggtctggcaactgtacgaagataagcaccctctggacatggtcgaccccaagctcgaagaattcaacagtggcgaggtgatccgtgccatccacgtggcccttctttgcacccagggctcgccacaccagcgttcttccatgtcacgagcggtgtcgatgctggcgggagacgtggaggtgggcgtggtggtgaacaaacccagttacatcacggagtggcagatcaagggtggcaacaccagcagtt

SEQ ID NO: 2976 - DNA, 261 bp, Triticum aestivum
  Clone ID: LIB3280-054-P1-K1-F7
acccacgcgaccgagcaagggctagatgccactacaggcccaaatttagcccatacccactctgccatccacgagaccacaagccacaccaaacccgcgttcatcgacggacgagctcgccggcgagagagcaactgagatggaaggccgcagcagcggcggccggtgtggagctgggctcctcgaagccccagatcgcgacgcaggcggagatggcggaggcccggatgccgctcgcctaccgcgatcagagcgcgcacc

SEQ ID NO: 2977 - DNA, 443 bp, Triticum aestivum
  Clone ID: LIB3280-054-P1-K1-F8
tagagaatcctgctgaattggaagattggcttggcgatcttaacccacactcgaaagaggtgataaaggatgcttatgctgtaccatcacttgccactgcggttctgggtgacatgttccagtttgagcggcttggttacttcgccgtggatactgactccacacctgataaactcgtgttcaacagaactgttacccttcgagatttgttctgtaaagctggacccaagtgactgttcagtgtaattaaaggagggctcttgttttgatcggttgcagaggcgcacctgtactatactgtttgtgaagaaaatggttgtctaattcagaacaatttaaaggcctttctctttataaaatctaaggtgttttaaatgttgtgccctcatttatgggtgatgtttttatttgttccccttggtgactttgattaatattttgta

SEQ ID NO: 2978 - DNA, 229 bp, Triticum aestivum
  Clone ID: LIB3280-054-P1-K1-F9
cggtcgcgtggttctgcaccccagaaagctagtacgatcttggggggacatggagcgcctgctgtgcttcatgcagagcatttgcggctgtaatggtggcggtccggggaagcgcctggagcgtcggcttgtgctgggcgagtacaaaaaggcatgtgttgtggtccaagtaccttgtagcgccgccgggggcttggatccggtgcgggggggaggagctgtggagcgc

SEQ ID NO: 2979 - DNA, 417 bp, Triticum aestivum
  Clone ID: LIB3280-054-P1-K1-G1
gcatgggaagaaggcataggaggggagaagatgtatctcacccacttaaagtttctctggatgatctttacaatggcaccttaaagaagctctctctttcgcgcaatgtcatctgctccaagtgcaagggcaagggctcgaagtctggtgcctcaatgaggtgccctggttgccagggctcatgcatgaaagtcactattcgtcagctgggcccttccatgatacagcagatgcagcagccttgcaatgagtgcaaggggactggagagagcatcaatgagaaggaccgctgtccagggtgcaagggtgagaaggtcattcaagagaagaaggttcttgaggttcatgttgagaaaggggttccacacaaccagaagattacctttcctggtgaaatctgatgaaacgcctgatact

SEQ ID NO: 2980 - DNA, 302 bp, Triticum aestivum
  Clone ID: LIB3280-054-P1-K1-G10
tcgggctcgattaccctggcgttggacccgagcacagtttcttgaaggacattggacgtgccgaattcgatagtgtgactgaccaggaggcactggatggtatgtctcgctctctttccattgtctgttatgggttgaactatttttctttttgacgaagttgatttccaatgaacctacaaattgctggttggtgtgatatcagctttcaacatcttgacttatcttttaatgactgggtgttatatatattcagttgatgtagcttgtcatgatattgagatgccaataatgtttttcta

SEQ ID NO: 2981 - DNA, 446 bp, Triticum aestivum
  Clone ID: LIB3280-054-P1-K1-G11
cggacgcgtgggcgcgccgctgacgttccgtggcttccagcagtaccgggccctcacagtccccgagctcacgcagcatatgtgggatgccaagaacatgttgtgtgccgctgaccctcgtcatgggcgttacctcaccgtctaggccatgttccgcgggaagatgatctccaaggagggtgacgagcagatgatcatcgtccagatcaagaacttgttctactgtgtggagtggaaccccaacaacgttaagttcagcgggtgcgacatcccgcccaggggcctgttcatggcgttcaccttcatcggcaactggaccttcatccaggagatgttcctgagggtgagagatctgttcactgtcatgttcaggagagatgggtatcttgcactgggacactggcgagggcatgggacgagatggagtttaccgaggccgtatatgc

SEQ ID NO: 2982 - DNA, 281 bp, Triticum aestivum
  Clone ID: LIB3280-054-P1-K1-G2
gttgaccaatgtcgttgcaatgcatccttgaactttgccggccactgtcgatccaataggataccatacataggcttgatcgaaggggtttgttaagcccaaagtgccttctagagcataaagctttctcctctattcagcatgtcacaatgttattgccccttcaatgaggtcaatcagtcaacgaataatacgcagctttaactctataaggctggtttatggcccacaaggaaagtgaaggcctagcttatggatttgatagagaacattcttgcatg

SEQ ID NO: 2983 - DNA, 351 bp, Triticum aestivum
  Clone ID: LIB3280-054-P1-K1-G3
cgacccagcctcctccgttcggactttctggagcactcccgcgtgtggtcggtcttcgaaagcgcagcgttcggtcatgactcgcctgctggagcggtcggggctcggggaggagacgtgcctgccgtacgcgcagcactacatcccgccgtctcgcgacctggtatcctcccgcgccgaggccgagctcgtcatcttcttggccatcgacgacctgctcgccaagaccggggtctcccctcgggacattgacatcctggtggtgaactgcagtctgttcgcgccgacgccttccttcgcgtacatggtcgcgctcctggtcatgcttcgcggtgacttgcgcaacgtgca

SEQ ID NO: 2984 - DNA, 451 bp, Triticum aestivum
  Clone ID: LIB3280-054-P1-K1-G8
tgtcggcccgccttttttcgttgtcctttctttctgatccaatggctctgtcccttggggcgctattctccctatcgtgtattcttttctttctttttgcattatcgccgtgtgctagcttggtttttgacttattgtgcgttattcataatccggctcactgttttttcattcctctgtcttttcatcctttctcgatgtctcttttgtgtgtattaactgtttctttttttctaggttgtttttctttttcggttgcgtcttcatttttggttttactttcctgtcttatgtcgttcttatcccttttccgtttccttttgttggctgatcattccctcattttgttgtattctgctttcctttgatttgttgttgccttttttctattttttcaaatttcttctctattttgttacactttgttttcatcatctcttttttctttttg

SEQ ID NO: 2985 - DNA, 230 bp, Triticum aestivum
  Clone ID: LIB3280-054-P1-K1-H12
tcgcccacgcgttctgtgacgcgtgggttctaaaaagactttttcattccctcggcgcccgccgtccgccgcgattcacccccggcaggtcgccacgcccgcattccggcgacgcaaagccgcgcgcgagggctctcccctgcgttcgcggtgatgaagatcgtgcaccgggaccctgtttgcgacgggcccggcttcgccaagttggtgccggaggaggaggaccactt

SEQ ID NO: 2986 - DNA, 438 bp, Triticum aestivum
  Clone ID: LIB3280-054-P1-K1-H2
cccactcgtcctctttcaatagcattgctacaacaatattttgtccgtgaagtgacaatacttttcaacctgtgcaacgagccatggttaaaatatagtataagcattgcggcagacaatggattgaaaatgttactttatacttctgctagactgaagaaaggagaagtaatatttttggagacacatttttattggtactagctgtgcttcagtggagagaagcctcggggtattggatctgagctctaatgcatttgatgcagaacctgagaaacaccagagcattagtcaccattcacaatacggctctgtggagcatgaactccgggatgtgtttcgatggtcccggtgtaagaaggccatgcctttatgagccatgctcttcactgctttcccactaccagcagatcagctcgagggtgtgcatgattacct

SEQ ID NO: 2987 - DNA, 386 bp, Triticum aestivum
  unsure (1)...(386): unsure at all n locations
  Clone ID: LIB3280-054-P1-K1-H3
cctccgtgcagtgcacggaccctgccgggcatcttccgtgccctctggtgtcgccgacggaccccgtggacttcaagccggaaagcaaggtgactcgcatccggcagccggtgcatcttctgagccgggagtaccatgagaagtacaaggaggccgtcgcgaaaatgaaggcgctaccggaagagaacccgttgagcttcgcggcccatgcggccattcaccaggcttactgcgacgcctactacaagtacgacccgacggccaaggacgcgccggtcgacgtgcacttttcgtggatcttcgcgccgtggcaccggatgtacatctactnttacgagcgcgcccttgggcagctcatcggcgacgacaccttctcgcttgcgttt

SEQ ID NO: 2988 - DNA, 440 bp, Triticum aestivum
  Clone ID: LIB3280-054-P1-K1-H4
gtgttccgtgtccgcgtccagtgtgtccgctactccgctccccctcagtcctcagttcctcacctagcggtagcgtgcgcgcgggagacgtagatggcggcttcggaggcggcagcggcggcggcaacaccggtgacgccgacagaggggacggtgatcgcgatccacagcctggaggagtggagcatccagatcgaggaggccaacagcgccaagaagctggtggtgattgacttcactgcaacatggtgtcctccgtgccgcgccatggctccaatttttgctgatatggccaagaagtccccaaatgttgttttcctgaaagttgatgtggatgaaatgaagaccattgctgagcaattcagcgtagaggccatgccaacattcctgttcatgagggagggcgacgtcaaggacagggtcgttggcgcattaaatga

SEQ ID NO: 2989 - DNA, 378 bp, Triticum aestivum
  Clone ID: LIB3280-054-P1-K1-H5
caactatatatataaaaaagcaaaaccccacatggctcgggggcggctctgcaagaatatttcagggctatctgttgacacgagggaaaacaaacaacgcctatctccgtcagaagagaggctataacacatagcctttcagcaacacactcccattgacatccttgagctccaagttcttcaacgggatcgattggctgccaccaaatgccatgttgctgagcccgtcactcgttagccaaatgggcaggaccttatcgatgaccttcttgaccaacttgtgctcctggatgtcagtgtatatacgacgcgtagcttttgccggcctttttgaattccaccagcacgctgcagaacctttgctgcgtaagaagctgg

SEQ ID NO: 2990 - DNA, 440 bp, Triticum aestivum
  Clone ID: LIB3280-054-P1-K1-H6
ttcctatcccaccgtattccctgcgattcctctcccctctcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgacgccgtcatggagccggttgttgctggcagcaacacggtagtagctgttgcccaagttgagttgcaaacaatgaacgtgcatcagcccgctgatgttgccggacccagcgagggggtggcggcgatctccaaaggggggaa

SEQ ID NO: 2991 - DNA, 459 bp, Triticum aestivum
  Clone ID: LIB3280-055-P1-K1-A1
tctctgagttctccctcttcggttcattatctaatgtaggggcgatggtaggcgccatctccagtgggcaacttgcagagtatatcggccgcaaggggtctctcatgatcgctgcgattccaaacataattgggtggctcgcgatatcatttgcaaaagattcctctttcttgtttatgggtcggctgctagaaagatttggagttggtgtaatatcgtatacagtaccggtttatattgcagaaatcgctcctcaagatcagaggggagctcttggttctgtcaatcagctctccgtcacgattggtatattgcttgcctatttgtttggcatgtttgttccctggagaattcttgctgttctaggcattttaccctgttcaatcctgaattctagactgttctttgttcctgaatcccaaggtggttggcaaaaatggggaagatggaggattttga

SEQ ID NO: 2992 - DNA, 453 bp, Triticum aestivum
  Clone ID: LIB3280-055-P1-K1-A10
gccgaaggaaaacaatcctgaaaccaagccatgggtctgcaggaggaatttgaggagcatgctgagaaggcaaagaccttgcctgagagcacgagcaatgagaacaagctgatcctctacgggctctacaagcaagccacggttggagatgtgaataccgatcgtccgggcatattctaccaaaaggacagggccaagtgggatgcctggaaggctgttgaaggcaaatcgaaggatgaggcgatgaatgactacatcaccaaggtgaagcagctccaggaggaggctgccgcctcttaaaagtctcttaatagtgttgccaaacagctatttgtcagatgagctttgtgccatttcctcattagaagtatatcattcgatccattggggatctgtgaaccatgtacctgtttatgtaacttttttttttttcgaaagagcgcaggaggactg

SEQ ID NO: 2993 - DNA, 456 bp, Triticum aestivum
  Clone ID: LIB3280-055-P1-K1-A11
aaccattaacatgctgcgcagggtggagccatatgttgcgtacggataccccaacctgaagagcgttagggagttaatctacaagagaggttacgggaagctgaacaagcagaggattccacttagcaacaacagtgtcatagaggagggcctcgggaagcacaatatcatctgcattgaggaccttgtccacgagatcatgacggtcggcccgcacttcaaggaggccaacaacttcctctggccgttcaagctgaaggcacccctcggcggcctcaagaagaagaggaaccactacgtggagggcggtgacgccggaaaccgtgagaactacatcaacgagctcatcaagaggatgaactaggctctctcttgtatcctgagagaatgcttttctgtgtcagcgtggttgtttttgctctagtaagttgacggataatgatggatatgcaattt

SEQ ID NO: 2994 - DNA, 426 bp, Triticum aestivum
  Clone ID: LIB3280-055-P1-K1-A12
agccgtggactgtggcagtcttgcgtccatgcctgattctcccatcggactcgggggacgctcgcaaagctgattaatgtagttcaggggagaatcagccgtggactgtggcagtcttgcgtccatgcctgacattgcgttcaccattggaggcaagaagttcaagctgaaaccagagcagttcattctgaaggttggtgaaggacaggctgcccagtgcatcagcggattcacagctatggatattccaccaccccgtggccctctctggatcttgggtgatgttttcatgggagtctaccacaccgtcttcgactatggcaagctgagggttggcttcgcagaatcagcctatggatatggtttggcagcaacccgtccagaggcaaacgcgtaatttgtgtgtttatgcgaccggcgatgtgt

SEQ ID NO: 2995 - DNA, 454 bp, Triticum aestivum
  Clone ID: LIB3280-055-P1-K1-A2
tcgcccacgcgtccgtagttatcatcgtgtattgtttataaagattaatgttaaagagttttaatagttttttccttcctacttccaatgtctgaatttatacacgttacacgtatgatgtatgcatcatgttgagagctttcatcttaatgaagccaacaccaccatgtaaaatgtagcagtcggcatcctgagactgtttctgtaatcaattacatctgttgggagattcttgtcggtcgaacttatttgtttcttaacacacattcattaccttcctttaaggattgcgcttggacattccgggcagcgtgcacccaagattgaccaagctgattcgacggtgctaggacaaagatcctgatgcgtgtctgacttttgcagagattactatagaactccaagatagtctacaccatatcgaggcacccaagggagccagccgtcgttcttg

SEQ ID NO: 2996 - DNA, 441 bp, Triticum aestivum
  Clone ID: LIB3280-055-P1-K1-A3
ctccgcattcccccggatgaccccgccagcctcgctcgcgccgccctcgtcagtaggcactggcaccgcgtgatcaccggccccgtcttccgccgtagattccgtgagttccaccgctcgccacctttgcagggctacatctccaacatccacaattccatccagttcgtccctatatcgtcgttccgcccgcgccatgctgacctcgacgacgtgatagcgatccactcaagccctggtcgcgtccttctctgtcgccgccccgggaagggtctggatgtcttccccgggaagggtctggatgtcttcctctccgtgtgggatcccatcaccgatgagctgcgggatttgcccgcgctgccgctgccggtggtcccaggcccgtgcacatgtaactgggacgcggccgtcatctgcgccgtaggcgagggctgcaaccat

SEQ ID NO: 2997 - DNA, 461 bp, Triticum aestivum
  Clone ID: LIB3280-055-P1-K1-A4
ggcacacgcaaaattccccatcccccaaggaagccacgccctcgcgcaccagcgcgaccggaccacaccggcaccgcccgtctgaccgacgcaacccagccgtccagacgcgccgccgaccgtccttccaccaccacgcccgcgccgtcgcacgctccctagggttccgcagggccggggatcgccggagatggactggagcgcggtgacggcggaggacttggtggacgcgctgcgggaggtggactggtccatgccgccgcggcctgtcccggagttcttctcccgcttcaccgtcccacgctcctactccaagtggaccagccgcctcaagtgcaacctctactactacaggacaaactatttcatcttgatcatgttcatccttgggatgggcttcctttggaagccagttgctatagttgctgcttttatgactggacttagcatcgcatttctca

SEQ ID NO: 2998 - DNA, 464 bp, Triticum aestivum
  Clone ID: LIB3280-055-P1-K1-A5
cccacgcgtccgagccagtggtgcctcccatggcacgccgagcttcttcttctgccatggcacagccacggcggattcagcctcgctggagacctcgtctggtgttctcgacacctccccacgaggcacttcttctgacgacaacaaggcctgcaggaagcacaaggaagatagtggtgccagcttcagctctgctcgctccaaggactcaaactcaaaggaaagcagcgaaaggagcggaggaaaaagagacagaagcaccaagaaggtggacgaggaggagcccaaggggtacatacatgtcagggcgaggagaggacaagcaacggacaaccacagccttgcagagagggtgaggagggagagaatcagtgagaggatgagggtgttgcaggccctggtccctggctgtgataaggtcactggaaaagccctcattttggacgagatcatcaattatgtgc

SEQ ID NO: 2999 - DNA, 459 bp, Triticum aestivum
  Clone ID: LIB3280-055-P1-K1-A6
atctgtgccttccagtccagcgtgccgcacggtatgcgtctgccggccgttctcattcccctccaaacttaaagccctaaacccatcttgctcccccctcgtctccactgctctgctgctcctcgcgccgccgcagcgacgtaatggcttccgccgcggtgctccggaacgccggctcccggcgcctcttctcctaccctactctccgcgccgctgcgatatatgtaccttctgcgctacccgatgcgcccgcggcggcggcagcgccggcccagccgccaccgacggccgggaccctctgggcgaggtctatggccaccttcacgcgcacgaagccccatgtgaacgtcggcaccattgggcacgtcgatcacggcaaaaccactctcactgctgccattaccaaggtcctggccgaggcagggaaggccaaagccgttgctttcgacgagatcgaca

SEQ ID NO: 3000 - DNA, 457 bp, Triticum aestivum
  Clone ID: LIB3280-055-P1-K1-A7
tcggctgggccaccagctttgaccgccgcctcccttcccctccgctactgctcctccccaccccactcccccgcaggagcggcggcggcggcggcgaggtcgtaccccacatcggcgagcggcggcggcaccgccggaggcaaaggcaagatgttcgggcgcgcgccgaagaagagcgacaacaccaagtactacgagatcctcggggtgcccaagtcggcgtcccaggacgatctcaagaaggcctaccgcaaggctgctatcaagaaccaccccgacaagggcggtgaccccgagaagttcaaggagctcgcacaagcctatgaggttttgagtgatccagagaaacgtgagatttatgatcagtatggtgaagatgcccttaaggaaggaatgggcggtggaggatcccatgttgatccatttgacatcttctcatcattttttggaccctctt

SEQ ID NO: 3001 - DNA, 389 bp, Triticum aestivum
  Clone ID: LIB3280-055-P1-K1-A8
ggattcctcatcgttagaccggcaataccaatttggtggaggtggtactactgggcgaaccccgtgtcgtggaccatctacggcgttgttgcgtctcagttcggcgagaaccaaggcgagctttcagttcccggtgggaagcccgtggtggtgaagcagttcttgaaggataatctcggcatccagcatgacttactcggctatgtcgtgctagtccatttcgcctacatcattgcgttcttcttcgttttcggttattccatcaagttcttcaacttccagaaacgttagctgcacctctactctctgctgtctcacacggacggtcatttgtaatctactttctcgtacgtcgaagcaaatgcttgtttgggaaaaaaaatattatt

SEQ ID NO: 3002 - DNA, 457 bp, Triticum aestivum
  Clone ID: LIB3280-055-P1-K1-A9
cgccctcttctgactcccgtaggccgtggtgccgccgccgactgctgggactgccctacaccaagtgcccaggtcatcttcgggccattcgccggcgacgagcaccaccaggtgtgccaggttgaccgagctatggacagcctgtggcatcttggggacgagctccgcgggcagcccaaggtggtggaggaccgccagtggtctctcatgacgtccaagctggcggagatcaccaggtccaagggcgagaggatgaacaccgtccctgacgccaagcagtgggacaagacgtcctaccagcttcacgacgacagcaggatcggccacatcggcctcatgaacctggatctcaagatgaacgaggctgccgccatgaagctccccttccgtggcatgccgtataacatgaaccagatgtacctcaaggagagcaatgccaatttcaatgtcaatgcgt

SEQ ID NO: 3003 - DNA, 348 bp, Triticum aestivum
  unsure (1)...(348): unsure at all n locations
  Clone ID: LIB3280-055-P1-K1-B10
cggacgcgtgggcggtgacgggcgcgggggtctgcgacccgggcctggtgcacatcgccatgacgctcgacgcgcactacctcaggggctccatggcggccatctactcgctgctcaagcacgcctcctgcccggagtccatcttcttccacttcctcgccgcggagggcggcggcgcgccngccgncgccgagctccgggccgccgaggccgnctgcttcccgtccctgcgcttcaagatctacctgttccgcgcctacgcggtcgtcggtcttatcttcagggtccgtgcgcgcctcgctcgaggcgccgatcaactacgcgcgcaatcaccttgccgacctgctt

SEQ ID NO: 3004 - DNA, 455 bp, Triticum aestivum
  Clone ID: LIB3280-055-P1-K1-B11
gaagcttgcagatgtatggtcatgtggagttactctttttgtcatgcttgtgggagcctacccgtttgaagatcaggatgatcctaaaaatattagaaagaccattcagcgaattgcagcaattcaatataatatcccagacaacattcgcatatctgatgattgcagacaactcatttcacgtatctttgtcagcaatccattaaggagaatcaccatgagggaaataaaaagccatccatggttcctaaagaacttgccgagggagctcacagaggcggtgcagttatcctacttcaggagggacaacagtgtctctgcattttcagaccaaacaaccgaagaaatcatgaagattgtcaaggaggcaagaaccttgccaaaatcgtcgagatcaagctatggttacagtgaagaatgctcagatgaggaggaaaaggaagtggagagcgaac

SEQ ID NO: 3005 - DNA, 407 bp, Triticum aestivum
  Clone ID: LIB3280-055-P1-K1-B12
cacaagcgcactctagcaatggcttctgaggttgtccgccctagcgacgccgagctactaaaggcacaagccgacatatggcggctcagcctctcctacctcacgcccctgtcactgaggtgcgccgtggagcttggcatccctacggcgatctaccgccatggcggggctgcctcagccgctgagctggtcacggcgctgtctctcccctccactaagctgccgttcctccgccgcctgctgcggctcctcgccgcgtcgggcgtgttcaccgtcgacaagcagagctcggaggaggagcggtaccgcatcagccccgtgtcctacctcctggtggacggcttccctcacgaggaccacatgaaccacaccgctctggtgctcacctgcaccttgacgcgctacat

SEQ ID NO: 3006 - DNA, 354 bp, Triticum aestivum
  Clone ID: LIB3280-055-P1-K1-B2
cccacgcgtccggattctaaaaactaagaacaagaccatagtgatttagacattcagtttgaagaaccacaaggcatctgctgcatcctgctatgcatgcatacactgcatccttaccttgatatgcaacaagtgcttaatctactactgaaccgcgttaagagcaaagagctacacctacacttactatgccatgatcaagtcatatgctacctgctgagttatgcagacactacatacactaccgatgccatgaaaaagcccccaactcgctgaatgagtatggacagtcagtcgaattgactacttgatgatgtgagtcattgcgctcattcttatgatctgtgaggacat

SEQ ID NO: 3007 - DNA, 464 bp, Triticum aestivum
  Clone ID: LIB3280-055-P1-K1-B3
atcgagtacagtcggctaggtaatctggtggtacgacgacatggcggccaccagcagcaagtcgtcgtcgtcctcgagctcggcgcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggacctcaagtgcctgtgcggctacaagaactcgccgtggatgggcgtctacaacatcgaccccaagcgcgccatggagcttccggccaagtgcggcctcgccacgccgtccgactgctagcagtgtgctagccaagccaagccaagcaggaaagcccccggcattgctagctgtacgtgtctgtgtgtgcatctgc

SEQ ID NO: 3008 - DNA, 460 bp, Triticum aestivum
  Clone ID: LIB3280-055-P1-K1-B4
cgcttcgagatccagctagctctctatcaagcatccggcggagcgagcagcggggggctcggcgagagagaagatgaagcggaagacgcggaacaagatcatcgtatggacgctggccctggctgcagtggcgattctggtgggcggcacgattgcgctggtgctcacggcggggacgtggaaggccaagataaagaagtcgcaggagaagatctgtaacaaggggtgggagtgctcggggagcaagtactgctgcaacgacaccatcaccgacttcttcaaggtgtaccagttcgagaacctcttcgtcaagcgcaacacccccgtcgcgcacgccgtcgggttctgggactaccaggccttcatcaccgccgcggccctcttcgagccccaggggttctgcaccaccggcggcaagcagatgcagatgatggagctctgcgccttcctcgggcacgtc

SEQ ID NO: 3009 - DNA, 462 bp, Triticum aestivum
  Clone ID: LIB3280-055-P1-K1-B5
ctccttcaaacactcgggtttggcgaacaagaagactgtgacgatccagccagctgcaaaggactcggctgtggtcctctctactaccaagaccaagaagcagaacgcacctgcgaagctcagtcacaagtctgtgatgcgcaaggagttccgcaagatggccaaggctgtgaaaaaccaggttagtgacaactactacaggcctgatctgaccaagccagctcttgctaggctaagctcggtgtaccgcagcctccaggttgccaagtccggtgtcaagaagaagaacaggcagtcctaagcgctaagtttgtgttctgtcagggggcatgttggtgctcgtagtcccagcttatatttatctatgttccaacagttgagacttgttagaactgagcaaaccatgttaagatgctgctgtgtgtcattccttaaaaaattgccttgcactttgtgattact

SEQ ID NO: 3010 - DNA, 460 bp, Triticum aestivum
  Clone ID: LIB3280-055-P1-K1-B6
cccacgcgtccgctcaggtgctgttggccacattccactgggccgtgggaagtaccagcttaaccgcggccgacactactattccgctttcaagaaaagtttgcgaccaacaagtacattaaagaagagcagtagctctggaatcgataaaaatttgaagtttcagatctctggcttaacatctcaaatagttgaatctgaaacatccagccttggtaagttacaggatttccaatgcttagatgttgcacaaactttattttccaagattcaaaagacaagaccccatccaagcaactttgatgttttatcggttgcccgctctgtatgctgtaagacaagtcttcttgctgcgttggaagttaaatacggacctttacctgagaacatatttgtgaaagctgcatagctttgcagtgacaatggcattcaaattgattggcatcaagagggattcata

SEQ ID NO: 3011 - DNA, 429 bp, Triticum aestivum
  Clone ID: LIB3280-055-P1-K1-B7
gcatgctgtgtatacgtacgtacgtacgtatgtgtggacagaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatcctcttcgaggagacgctgtaccagtccgccgtcgacggccgcaagatcgtggacatcctggcggagcagggcatcgtgccggggatcaaggtggacaagggccttgtcccgctcgccggctccaacaacgagtcgtggtgccagggcctggacggcctggcgtcccgcgaggccgcctactaccagcagggcgcgcggttcgcccagtggcgcaccg

SEQ ID NO: 3012 - DNA, 454 bp, Triticum aestivum
  Clone ID: LIB3280-055-P1-K1-B8
aaaccaacaaaatgatgaggccactgctcgggcacttcaggctgcaatgaacttgcaacaaaatctggcaaggatacaggcccatgcagttccagaacactatgaggctgaacttgagattaatgatttcccacagaatgcccgttggagaatcactcacaaagagacactggcccctattcaggactggactggtgctgctatcactacgaggggaacatatattcctcaaggaaaaattgttggtgcaaatgagcgcaagctttacctgtttatcgagggcccgacagagtcttctgtgaagaaggcgaaagcagaattaaaacgtgtccttgaggattgtgcaaaccaggctctaaatcttcctggatctgctcaaactggaaaatattctgttatttgagttgcagagtagataacaaagtggccgagtatttttttaggagcttataat

SEQ ID NO: 3013 - DNA, 422 bp, Triticum aestivum
  unsure (1)...(422): unsure at all n locations
  Clone ID: LIB3280-055-P1-K1-C1
taccgctctcgcacgagcccacagatgcggcaagatcgaatccatggcgagagctagcagaagccgcgggcttggtgcttgaaccctcgatcattcttggaggtccccgttccttctccttgcattgctcgcgttcctcgacgcgagagcagaccagcacagagagaagaaaagaaaaaggagggttctttctcgcgtttcttctgtctattctgcggttctttcttgggagcagtaatgaggcggcatgggtggcagctcccgtaccatcctctccaggtggtggccgtgtccgtcttcttggcgctggccttcgcgttctacgtcttcttcgcacccttcggtgggaggaatgtgttccagtacgtggtcatagggctctacactcccctggntttatgtgtcttctttctatacatctg

SEQ ID NO: 3014 - DNA, 282 bp, Triticum aestivum
  unsure (1)...(282): unsure at all n locations
  Clone ID: LIB3280-055-P1-K1-C10
atcactcgctaattaatggatgcggtggcttgtgggtttgctttgcttggccttggatgctgtctgttaaaaaaaacgcgggcactgggcacttgtcagagttgtcttgtgtctctctgacagtgctgtgtagtagtttggttggatgcgcgagaggagggaagatatcagcagcagcaggcggttggtcgatgaatggctgtaaaaggcactgtcaaaagtgttggggttataaaaaaagcggcgcttttaactttaaaaaaaagaactntttaaaaagtt

SEQ ID NO: 3015 - DNA, 389 bp, Triticum aestivum
  Clone ID: LIB3280-055-P1-K1-C11
ggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcagcagcggtgggtacagtggtggccgt

SEQ ID NO: 3016 - DNA, 354 bp, Triticum aestivum
  Clone ID: LIB3280-055-P1-K1-C12
ctcgaaaagccttaaaccccgaccacagcctgtccgagtcacccgaccgttttccatcttcactcccaaccgtttcattcccacctaacttactttttccgatttcgactcgattcgtcattccaaacaggacaccgaatgcacgatcgatcccacaagccgcagccgccggaggctggcgagggcgccggcggcgggaacgtggatcgagtgctcttcaagaacctcgtcgagatggtgccgctcgtcgagtcgctcatggaccggagggtcaactcggcctactcgcgacgcacttcgctagtctacacgccggcgcccgccaagaaggcgagcgaattgggaagtgtcaaa

SEQ ID NO: 3017 - DNA, 433 bp, Triticum aestivum
  Clone ID: LIB3280-055-P1-K1-C2
ccggagtacgccatgacaggacacttgcttgtaaaaagtgatgtatatagctatggagttgttctacttgaactactaactgggaggaggcccgttgatatgtcacagccctctgggcaggaaaacctagtgacttgggcacggccaattctccgagaccaagatagattaggagagctagctgatcccaggcttggcggccagtacccgaaagatgattttgtgcgggtgtgcacaatcgcagcagcctgcgtttcgccagaggcgaaccagaggccaacaatgggcgaggtggtgcagtcactcaagatggtgcagcgctctgtggagttccaggaatctgtgccaacaccttccgctcgccccaacgtccggcaatcgtcgacgacctatgagtctgatggcacctcgtccatgttctcttcgggcccct

SEQ ID NO: 3018 - DNA, 441 bp, Triticum aestivum
  Clone ID: LIB3280-055-P1-K1-C3
cccacgcgtccgaagagctgctgcatcagttccttctgttgggggtgactttgaaaagcgtactgaatctattgcagcaaaatcacggttgaagactgaggttcggtttaaggctgatattgtttccccagaacaatgggaaaggtgcatttcctttgatgtatatgcattgtgtcctatactctatatctaacttcaactagtagcaagactgtttttcacaagtacatatttttttctaacatagcacaataagtcaataacataattaaggtacatagattgtgtagcagcacagaagggaaattattagaaagatatataaacttacaatccaccctaaagtaaaggattatgatcttcccctctatagcacacaccatactttgaacttggaagccatattgctcactcaggtaaagaaatagggtttttttttgg

SEQ ID NO: 3019 - DNA, 456 bp, Triticum aestivum
  Clone ID: LIB3280-055-P1-K1-C4
cttcatccatgcggttgagcgatctatagctgggatagagaaaaagcatgcaaaattgaagggtaatgaaaaggctgtcgttgcacggcatgaagtaggtcatgcactcgtgggaactgctgtagcgaaccttcttcctggacagccacgtgttgagaaattgagtatattgccaaggtcaggaggtgcattaggctttacatacacccctcccaccacagaggatagatatttactctttgttgatgaactacgtggccgtttagtaacacttctgggtgggagggcagcagaggaagttgttttagcaggacgggtttccactggtgcacttgatgacataagacgtgctactgacatggcctacaaagctgtagcaaaatacggtcttaatcagcgcatcgggccaatatcacttgctacactgtcaaatggtgggttagatgactctggtgg

SEQ ID NO: 3020 - DNA, 457 bp, Triticum aestivum
  Clone ID: LIB3280-055-P1-K1-C5
cccacgcgtccgcccacgcgtccgagatattcgggcccctgctcccgatcatcacggtcaagaacatcgaggacagcatcgccttcgtgaaggccatgccgaagcctctcgccatctacgcgttcacccgggacgccgccctgcggcggcgaatcgtggacgagacgtcgtccgggagcgtcaccttcaacgacgcggtagtgcagtacgcgatagacgggctcccgttcggcggcgtcggccagagcgggttcgggcagtaccatgggaagtactcgttcgagatgttcagccacaagaaggcggtcatgaagcggggctacctcgtggagctgacactcaggtacccgccgtgggacgagagcaaagtcaccctcatgcgctacctctaccgcttcaactacttcgccttcgtcctctctttcctcgggctcaggcgatgaacttcactccagca

SEQ ID NO: 3021 - DNA, 436 bp, Triticum aestivum
  Clone ID: LIB3280-055-P1-K1-C6
cggacttcctgggcatcagcccggagatcagcgacagcatatggtccgccggcctggccgaccacgacgtcgtcgtcggcgtgctcgacaccggcatctggcccgagagccccagctttagcgacaagggcctcggccctgtcccggccaggtggaagggcctgtgccagaccggccgcggcttcaccgtagccagctgcaaccgcaagatcatcggcgcgcgcatcttctacaacggctacgaggcctcgtcgggccccatcaacgagacggccgagctcaaatctccgcgggaccaggacggccacggcacgcacaccgcggccaccgccgcgggcgcgcccgtgccggacgccagcctcttcggctacgccagcggcgtcgcccgtggcatggcgccccgcgcccgcgtcgcggcgtacaaggtgtgctggac

SEQ ID NO: 3022 - DNA, 404 bp, Triticum aestivum
  Clone ID: LIB3280-055-P1-K1-C7
gccggcagccgccgcaaccttctttctacgatgcctcgcaagcccaaacggaaggctccggcctcaccggcgaggcacgacccttcgccggagccctacccttcccatgcctccccctgctcggcacaatgcctggtagtccgcgacgccctcctcgcgttccacgggttccccgaagagttcgcggccttccgcgtcctccgcctcggtggcctctcgcctaaccgtgaccctcggccttcgtcccccacagtgcttgacggcctcgtcaccacgctcctctcccagaacactaccgacgccatctcccgccgcgccttcgcctcgctcaaagccgctttcccctcctgggaccaggtggtggatgaggagggaaagaggttggaggacgccattcggtgcgg

SEQ ID NO: 3023 - DNA, 110 bp, Triticum aestivum
  Clone ID: LIB3280-055-P1-K1-C8
gcgtccgtcacgcgttcgtggactcgttgttttacgcgtcctcgcaagcccaaacagaagggggcggcctcatcggtgaggtacgacctttcgtcgtagtcttacctttc

SEQ ID NO: 3024 - DNA, 456 bp, Triticum aestivum
  Clone ID: LIB3280-055-P1-K1-C9
cggacgcgtgggtgcactcgatgcatgtatcatccggcaaccttgtctgtcatggtgacattaagccggccaacatacttttagacgacaatctgacagcaaaattgacggattttgggatctcaaggcttctggttggtggcgtcactcgctacactaccactgtgaaaggaagcataggttacatggatcctatatacattcaagagggacgccttactccaagaagtgatgtttatagctttggattagttctatgtgaactaatggctggaaaaggggtaagaaaaggtgcaatcaacctcattctatacgccaacaaaggctgtgcaagtggtaaagggttcagagagatttgtgatgctgcaatcgcaaacgagaacaacatgaagatccttaaagagatgcagaaactggcagccgaatgcctatcgctgaccatttctaggcgtcctc

SEQ ID NO: 3025 - DNA, 449 bp, Triticum aestivum
  Clone ID: LIB3280-055-P1-K1-D1
cggacgcgtgggatctgctgagcatgtcattgctacattgcgaggtgtgcacccagaatcaactaaatactttcttggggctgctgagaaattaacagaagaattgggacctcatgctcttgcttctgcactggcacatctgagtggattttctcagccaccttcgtcacgttctctcatcagtcatgagcagggatgggtgacgttgcaactaactagagaacagggatttggcagaggcttcttttctcctagatctgttactggttttctatctgatgtttgttcagctgctgcagatgaagttggcaaaatatacctaacagcagatgagaacgtccaaggagcagtcttcgatttacctgaggaaattgcaaaggacctgcttactatggagctccccccaagaaacacattaaccaaaatttccaagctgtctgcgttgcaag

SEQ ID NO: 3026 - DNA, 385 bp, Triticum aestivum
  Clone ID: LIB3280-055-P1-K1-D10
tcgccccccacacctgccctccccgccgccgcggaccccctcccatggcaaagctcccgcgtctacgctgtccgtttgccgtgctcgcgctcgtgtgcatcctcccgctctttgcgccgcggcccgccctgtcctcccgcgccgcgccgaaggacggtgtctccttcgccggcgcaggcaacacgatacatcaactccttaaagatcacggccttcccggaggactgctcccgcgcggcgtggagtcgtacaccctggacgaatcaagcggtctgctgcaggcgcggctgtcggcgccgtgctacgccaagtacgacaacggcgacctggcctacttcgacaacgtggtccgcggcaacctgagcaagggtgcgctccgcggcgt

SEQ ID NO: 3027 - DNA, 438 bp, Triticum aestivum
  Clone ID: LIB3280-055-P1-K1-D11
ctcttggatcagttactagaacttgagaagattcgtcagagagaatctgacataacaaaggagcggatcgataaaattctcaagtctggagctaatgttgtgttgaccactaaaggaattgatgatatgtccttgaagtactttgttgaggctggagctattgcagtaaggcgtgtgcgcaaggaagatttgcgccatgttgccaaagccactggtgcaactatggtgagtacatttgcagacatggaaggtgaagaaacatttgattcatcattccttggacatgctgatgaagttgtggaggaaagaattgctgatgatgatgttattctggtgaaaggcacaaagaacaccagcgcggtctctataatacttagaggcgcaaatgacttcatgcttgatgaaaatgaccgatcattgcatgatggcctgtgcatt

SEQ ID NO: 3028 - DNA, 439 bp, Triticum aestivum
  unsure (1)...(439): unsure at all n locations
  Clone ID: LIB3280-055-P1-K1-D12
gatgagctcagtgaggatgacaagctgacagtcgcccgtgcaagaaagattcagcgtttcctgagccagcctttccatgtcgctgaagttttcacgggtgctccaggaaagtatgtggagctgaaggaaagcgtgaagagtttccagggtgttttggatgggaagtatgatgacctccctgagcagtcattctacatggttggtggcattgaggaagtcattgctaaagctgagaaaattgccaaggagtctgcttcataaggaggcttcttgcttgttcaaccctgtacaagttccatttttggattntaagcgtttatttatgcttttcccagttaggcatgacgagctggagagttcatttcctgctgagagatgtttggtttacccttctttgctttctccaccttacacccaaataagcaactgcagtgacgtt

SEQ ID NO: 3029 - DNA, 90 bp, Triticum aestivum
  Clone ID: LIB3280-055-P1-K1-D2
gtaactttttaattcccggccgaacaggtttaagagcccaattccgagtttacattcccaaaggcggccaaggttattccaggccgacct

SEQ ID NO: 3030 - DNA, 460 bp, Triticum aestivum
  Clone ID: LIB3280-055-P1-K1-D3
cccacgcgtccgcccacgcgtccgggcgcagagacaggcgtcttcgtactcgcctatctccgcgactcaaagcttcttccatttcctaccgccgccgctgcagctccaccccattccgtcgacaccatgagggagtgcatctcgatccacatcggccaagccggtatccaggtcggaaacgcgtgctgggagctctactgcctcgagcatggcattcaggccgatggtcagatgcccggtgacaagaccattgggggtggtgatgatgctttcaacaccttcttcagtgagactggtgctgggaagcacgtccctcgtgctgtttttgttgaccttgaaccaactgtcatcgatgaggtgaggactggcacctaccgccagctcttccaccctgagcagcttatcagtggcaaggaggatgcagccaacaacttcgcccgtggtcactacaccattggca

SEQ ID NO: 3031 - DNA, 426 bp, Triticum aestivum
  Clone ID: LIB3280-055-P1-K1-D4
ctggaagctgaattgagaaaactgaagaaggaactcgacaatgagaaggtaaaaatgttccagtgaaatgagcacacacataggaaggttatttgtccattacttacaagttgacaggacatatccttctgttagcaggctgctcgagaagaagcatgggcaaaggtttcagctcttgagcttgaaatagctgcaacgattagagatctatcaattgagaaacagaggtattagggagctagagaacggattattctacgggagactcagctgcgtgctttctattcaaccacagaagaaatctcttttctgtttgcgaaacagcaggaacagttgaaagctatgcagagaactttggaggatgaagagaactatgagagcaccttaatgggtgtggatcttaataaaggtcctctaaccactgat

SEQ ID NO: 3032 - DNA, 452 bp, Triticum aestivum
  Clone ID: LIB3280-055-P1-K1-D5
ctttcgccccacaagctcgattcctcgctcggccatggctgcacccgcggaggagacgcttgccgccgaggatacggcgtcaccaccgccgccggcgaggtctgcggggttctggttccttggcgaggataagtctgtccacaaggctctcggcgggggtaaaactgctgatgtacttttgtggaaagacaagaagacctctgctgcggtagttggtggtgcaactgtcctatgggttctgttcgaaattgtagaataccatctcctgaccctggtttctcatgtgctgatcgctgcactgaccatcttgttcctgtggtccaatgcgactgtctttatcaaaaagagtcctcctgatgttcctgaagtgcagatatctgaagaccttgctgtaaacattgcgctagcattgcgtgctgacatcaacaaggcacttgccctgcttcgggaga

SEQ ID NO: 3033 - DNA, 458 bp, Triticum aestivum
  Clone ID: LIB3280-055-P1-K1-D6
cccacgcgtccgggcgaaggggccctcgagccaggccatggcgatgtggccgtaggcggtctcgttgagttgggcgcagtcccagttccggtggaggccacaacccgacgccgaaccccgacgctcagcttcgctgggaactactcgcaacacgccctcaccatctggaggccctccttcatgcagcagatccgcttcgacgcccacaccccgctccgggaggcctgggagatcgacgcgcacatgcagtccgcggtcaggggcccgggcgccttcaatgtctacggccgagcaggcgagcaccctgctccctggacggatccaccaggacctctcgatcgagctccagcagtaggcaccttccagatcgagctccagcagcaggcgcaggtgcgcagcgatcaatcagcgagcaggacgagcggcaggggagaagcactcgagtcgagagcagatca

SEQ ID NO: 3034 - DNA, 450 bp, Triticum aestivum
  Clone ID: LIB3280-055-P1-K1-D7
aaatggtctaatttattggaagttgtttttggctgattgcgctacaggctgaccttgctttggttagcaaattcacttgctaagtttgtactatgttcactctaattacgttatggtggtgttgaccggtgagacaactaaggcaacacatattgtttactttgtttcgtagttaatttttaaattaaaaccaagtatccgttataaatggtctggtttataaatgctatctattttcccaaaaaaaatatttttgggtgactacgctacagcttgatcctgctttgattagtagattcacttgctaagtttattctatgttcactctcattacgttatggtgagatgttgacataatgacatgtgaccacaattatggcagcacatattgtttcagttactaaagtaccaactgctgatacatagggatcttaaataggaaaaaacaat

SEQ ID NO: 3035 - DNA, 435 bp, Triticum aestivum
  Clone ID: LIB3280-055-P1-K1-D8
caagcctcagatctcagtcacctgcgccgccgcttcgttcgtgtggaggggagaagagaggaaatggcggcgaccgagggcgtgctcctggggatgggcaaccccctcctcgacatctccgccgtcgtcgatgacgccttcctgacaaagtatgacatcaagctgaacaatgctattctcgctgaggagaagcacttgcctatgtatgacgagttggctagcaagagcaatgttgaatatattgccggaggagccacccagaactctatcagggttgcccaatggatgcttcaaacttctggtgcaacaagttacatgggatgcattggaaaggacaagtttggtgaggaaatgaaaaaaaacgcttaaactgcaagagttactggtcattactacgaggatgagactgcttctactggcacatgtgctgtatgt

SEQ ID NO: 3036 - DNA, 449 bp, Triticum aestivum
  Clone ID: LIB3280-055-P1-K1-D9
cccacgcgtccggagctagctccctcctcctcctcaggtagcgagcgagcgagctcctctgcccctctgcacacctggcctccccttctccgctgcaggaccgccgttgacgactgctccaccagtactgcgcgcgcccgcgctgcctacccttacctagccagagcgcggcgcgcgagagggagaacgaccaggaggggaggagatcgatcgatcgatcgatcgagatagatggctttcctcaacatggagcagcagacctgggccttcaccttcggtatcctaggtaacataatctcgctgatggtgttcctttcgccgctgccgacgttctaccgcgtgtaccgcaagaagtcgacggaggggttccagtcgaccccgtacgtggtgacgctgttcagctgcatgctgtggatcttctacgcgctgctcaagttcggcgccgagct

SEQ ID NO: 3037 - DNA, 448 bp, Triticum aestivum
  Clone ID: LIB3280-055-P1-K1-E1
gccacctcactcttcactagcctctgctcctctgaaatggcggcggcgacttcctcttccacctacctcgccatcggccgcaaaaccctaaaccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgacttcgagacctccgtcttcaagaaggaaaaggtgtccctggccggccatgaggagtatattgtgaggggtgggagggatctgttcccgctgttaccggaggccttcaagggaatcaaacagatcggtgtaatcggctggggctcgcagggtcctgcgcaagctcagaacttgagagactcacttgttgaggcaaagtcagata

SEQ ID NO: 3038 - DNA, 288 bp, Triticum aestivum
  Clone ID: LIB3280-055-P1-K1-E10
cccacgcgtccgcccacgcgtccggtttagcctagccacgctcgctctacctcctcaatcctgattagcttcaaaccgccatggccatggggctccccggcctccgctgccaccgcctcctcgctcgcgggtcactccctccactcggtcccgccctctatcgcaggcccctggagcgaacctaggctctccgctactcctccctccaagctcaagctggggacagtattggggaggaggccctgcgcatgttccttgaggacaggcaactgcacggcgatttcgtca

SEQ ID NO: 3039 - DNA, 440 bp, Triticum aestivum
  Clone ID: LIB3280-055-P1-K1-E11
gaagttaggccttcttgtccgcttgtgttggcggcggcgatggcgacgtcggcgagcacgtccggcgagtggctcaagggcgcgctgcaagaacttcgggagcgtaagggcagctcgctggagttcgactcggatctcatctcgggcctcgtctccttctgcgagctcgcgcctccctccgacgccaccagctatctcgagaattttattgggaaagaagctgctcaggacatcattcaagaatacttgcggaggaggggtcacattggttcctcaaatggaactgagagctttcagtcatctaaccttcagccttatgttaagccttcagctgatgcagcaactacacaaacaaagaaacaaacacgcacgcaaaaagattcagcatcttcttctagtcagagttctaagagtcaatcagaaattgcagaatcacaagt

SEQ ID NO: 3040 - DNA, 424 bp, Triticum aestivum
  Clone ID: LIB3280-055-P1-K1-E12
gcaccttcccaaaaaatcccccattttcttcgaggcgaggagagcgtgaaagacagggcaccggcagcgacgatgtcggggcgcggcaagggcggcaaaggtctgggcaagggcggagcaaagcgccaccggaaggtgctccgtgacaacatccagggcatcaccaagcccgccatccggaggctggctcggaggggcggcgtgaagcgcatttcggggcttatctacgaggagacccgcggcgtcctcaagatcttcctcgagaacgtcatccgcgacgccgtcacctacaccgagcacgcacgccgcaagactgttaccgccatggacgtcgtctacgcgctcaagcgccagggccgaaccctttacggcttcagaagctaggctggatgccttttctccttgctgtcgaggatgcctgttt

SEQ ID NO: 3041 - DNA, 338 bp, Triticum aestivum
  Clone ID: LIB3280-055-P1-K1-E2
gcacgccatcttactctcacatcccctagagcggtcgcccgctctttttttatggcgcgcgtcaacttgctctttcaggtacgggggggattagccgtaaaatcctagaccctgccccctccgtaaccacagccgacacctccgttttcttgctcgccacgaagcacccatgcctgggtgtcgtctttgtggaccgtcgtcgagccgaggctaggaaagtatcgtcaccgccggtcatcggcaccgccatgcctgagctcaacttatagacctcccactacaagaaagaaaaggtgttcctgggccgccgtgaggagtatattgagtggggagggagg

SEQ ID NO: 3042 - DNA, 461 bp, Triticum aestivum
  Clone ID: LIB3280-055-P1-K1-E3
gtgatcctgaatatgatgccacttgcaatgcaatagaagagatcaaatccagtctaaaagagtacttgaaggagcaacgaaagcttttgagacctgcatcggttaattatgttaatgttggaaaagatatgtacctaattgaagtgcctgagagtttgggaggttcagttcccagaaactatgagttgcagtctacaaaaaagggtttctatcggtactggacgccagaactgaaagagctaatattagaactttcaaaggctgagtcagagaaagaatcaaaattgaaagccattcttcagaatctgattcagctatttgttgagcatcacactgagtggaggcagctggtttctgttgttgctgagcttgatgtattgacaagtcttgctattgcaagtggttattttgagggaccaagttgctgtccaactataaaagaatcaaatggcacagacgat

SEQ ID NO: 3043 - DNA, 200 bp, Triticum aestivum
  Clone ID: LIB3280-055-P1-K1-E4
gtcgaagcagggcaggagctagggcgggtggaggagcctttgcccgggaacgaggagaggaggtggcagtggcaccccgcggctagggcagcgagagaggggcgaagaggaaggcggcgggcgcgtccgccatggctagcgaggaagtactccacaaggtccagaatcttatagagcgctgccttcagatgtacatgaac

SEQ ID NO: 3044 - DNA, 459 bp, Triticum aestivum
  unsure (1)...(459): unsure at all n locations
  Clone ID: LIB3280-055-P1-K1-E5
ccctagcaccgccgccaccatgtcctcatctccatcttcagtgaaccgccgtcccccgggcccgctagcgttggggctggagtccttggggaagaagatcagcatcggctggtctccgtcccgggcggcatcctctccatctcgtgtcgcacctacgcgaccccactgggccatggcttctttccccgtggtgcaggtcttttcggtcctcaggcttcatccctgtgcaagtgcagggataattgcttctaatctcccgaggctgcataacctaattcagaggcagagcaagggggcgtgagggagatgagggagatcatcagcatccatatcgcgtaggcaggcatccagtgacacctctgtcgggatcgcgagggatgcgttcaacacgttcttcagtgaaacgggcgcagggaagcacgttccaagggccctgtntgtcgacttggagcccactgg

SEQ ID NO: 3045 - DNA, 458 bp, Triticum aestivum
  Clone ID: LIB3280-055-P1-K1-E6
ctacttcttgctgccgcattctttggctacatgcttgcactgctccaacgccgagttttagggatgtattcaaatggagatgagcaggaagacgagagtccagtgaaagctaaactatctagcatcccacctccgtaccagaagccactgaagatctttcattgatcaccgctgatcccaaatgatagactaactcgtgaaacaagaggaagaaggactcttcacgttatttgccaaactaccgggtgtagcatgatcatcagtcgcagagatcgtctgcgccacattctccagaaagaagcgagtgaacgttcaccaccaccagctgggcaggccgacctcgtggccagtgcaagagagctacgccatcccgagggacgagaccgcgccgccactggacacgagggcgccgaccccacgcaagagctacgcctttatgttaaaggagccggagaaga

SEQ ID NO: 3046 - DNA, 456 bp, Triticum aestivum
  Clone ID: LIB3280-055-P1-K1-E8
ggaagagctcaagaactatgtatgttactggatgactattgggagaggatgggcttgaaagttcctatttatttttcagctggtttaaccattcaagctaatgtgtactacaaaatgttgattgggtggactagtcaaaagatcaaggacagccatacagtgcataatccatttgacttcaagcatgtttgccactttgaacgttccttcattaacaaccctggtccctgtgtactttttgcaacacctggtatgattactgggggattttcccttgaggcgtttaaaaaatgggcaccatcagagaagaatctggttacacttccaggatattgtgtttctggaaccattggtcataagttgatgtgtgggaaacctacaagggttgattacgaggacactcatattgatgtcagatgtcaggtcgattttcacgtcatttcatatcttgcaaat

SEQ ID NO: 3047 - DNA, 449 bp, Triticum aestivum
  Clone ID: LIB3280-055-P1-K1-E9
cccacgcgtccgcacaattgccccaaaagtaaatgtcataataggagaaaacaactgtcttgcatcaccacgagcgtgggctctctctctcctttctcgacgacgactgggccaccgtcgctgccgcctgccgccctacgccaggtgccaagcagccaggtgttcttggggcccttcgccggcgacgagcaccaccagctgaaatatggcgaggataccgtctctgaagagcctcaatgcgtttccacatgcggaagagcacttgttgaagaagacttactctggcgctgttgtgacaatttttgggctacttataatgattacactgtttgtgcatgagctgcagttttatcttaccacctacacggtgcatcagatgtctgtagatctgaaacgaggagaaactctgccaatccatatcaatatgtcattttcttctttgccatgtg

SEQ ID NO: 3048 - DNA, 500 bp, Triticum aestivum
  Clone ID: LIB3280-055-P1-K1-F1
cgcctgctgtaccagagctatgacgtccgatgcgaccacgcgtacgctggcaccctgtatagcggaacacataaaggagagagaaagagaggagaggcaacacataaacaagagaagaagaagaagaaggggagatcgagatcgatcacgcaccgggggagcagatccttcgccttgccatcagggataaagattcatgcgaaatgccacctgaacttggaatgtcttctagaactgttgctggtgctgttgtaaataggaggcctcgccgcctgtttgggagatcatcagagaggaagaacccactcaacctttagtttgagcgtcaagtagctcgcctcgaggcaaggcagcaacaacagaggtgtgttattgagacagttattcccttcaatttctgttacgacttcaaatcactatcgctcaccgagagtgcaagtgaggatccttcatctcgacctacatcttcagaagagaacccttgaacatcgttctcacca

SEQ ID NO: 3049 - DNA, 409 bp, Triticum aestivum
  Clone ID: LIB3280-055-P1-K1-F10
attcttagtcgtagattatatgacactcaagttagtgtcttccatacctggcaaaaggcatagctgcaactgatgctgttcatgaatactaacatgctaagctttgtgatttatacgagaacgattcagttgtcgacaaatgtgagtgctgtctcagcggcgatggactccatgctgcaactggttcttatagtaatttgcttcgtgttttgggttgctctcctgaaagcgtgggggcatcaacgttggaagccagcagaaatcccatgaggcgacaggttgctgatccaacaaggcctgcacggactctgaccggtgctgtgaggagaggtggagagaacacaagcgttgactccagcggaaacttttgcgaccttctaacaaagctggttcatcttgcgtggcaccc

SEQ ID NO: 3050 - DNA, 456 bp, Triticum aestivum
  Clone ID: LIB3280-055-P1-K1-F11
gcagcagctgcggcagccaccaaaggcagtgctgccactgcttttaatcctccaatgagcacttctgtagcagctggacaagctcaggttgttgctgaccctagctcaataagcaagcttcaggctgatctccccattgccaggaggcactctctccagcgcttccttgagaaacgtcgtgacagggtcgtgagcaaagctccgtacagccccgccaagtcgttcgatggcatggagtcagcgggaatggagatgactgcggacggcaagcagggcgcaaggcccagtatcttgaaaggttggggagccgcgaagtctgaagtctgaacggtgaaaggctggctgacgctgtggggaggaagggacagggacgtgctagtgagtttattatattggtatttatgttattatatactgtatgtgggagcagcagcgtggaaccgcactaataatggg

SEQ ID NO: 3051 - DNA, 363 bp, Triticum aestivum
  Clone ID: LIB3280-055-P1-K1-F12
ggatatcggagtcgctgaggcagagcctcaggtccaaggggatcaagtcactgttccccattcaggccaccactttcgatctcgtactcgatgggcagcgacttggttgggccgaccgcccccggtcaagggaaaaacttggcttttggtctggccaatatggaatctttgggtaatggggccaacaagggatttaaacggactgaacatggcaggaccccaagtgttctcgttctactaccaacaagagagctggccaatcaggtgcacgctgactttgagttttatggtgcaacatttgggctctctgcatgttgtgtgtatgggggatcaccttatcggcctcaagaaatggcattgaga

SEQ ID NO: 3052 - DNA, 272 bp, Triticum aestivum
  Clone ID: LIB3280-055-P1-K1-F2
gtgatccataagggcgggccgtgctactacccggacaacctggtgtcgcgcgccgccgtcgccatgaacctctactatgccgccaatggcaggcacccctggaactgctacttcaacaactcggcgctcgtggtgcagtccgatcccagctatggatcctgcacctactactgatgtctgtctgatgctcttttgtagcagagatcggtcgatgaaaggaaatataatccctgtgtatgctgtgctgggttgtgtctagagatgacaatagg

SEQ ID NO: 3053 - DNA, 463 bp, Triticum aestivum
  Clone ID: LIB3280-055-P1-K1-F3
cccacgcgtccgcccacgcgtccgcggacgcgtgggttcaagacagagtaatggaagaaacaaaggagaagaagaatgctgttgaagcttatgtgtatgacatgcgtaacaagctatatgacaagtacagtgattttgtcacgtctgaggacaaggaaggtttgattgctaagcttcaagaggttgaagactggctctatgaagatggcgaggatgaaactaagggggtttatattgctaagctagaagaacttaaaaaagttggtgatcctattgagctgcgcttcaaggaatgggagattagaagttctgctgttagccaactggtatactgcatcaatagcttcagagaagctgcacagtctaccgaccagaagtttgaacacatagacatgtcagaaaagcgaaaggtcattaatgagtgttcggaagcagagacttggctaatagagaaaaagcagca

SEQ ID NO: 3054 - DNA, 424 bp, Triticum aestivum
  Clone ID: LIB3280-055-P1-K1-F4
attcttagtcgtgattatatgacactcaagttgtgtcgtgaagaacattttagtaatttgagtgctcattcagttggtgctccctcctcatcacgcaaataggtactgaagcccatatgactatgcagatctaggacagaatgtttgcaataaatactgacatggatatctagctttggctttgaaagatgtaaggatcttttgttaaattgatttacctaaggtcctgctacaagagcttacctagtacctcggtatatctttgtgagattacaacaaaagtattcaatttctacatattttactgctacacagatttgtctgtctgtttgggcaaagatattggtcggttttactgctggaaaaagggattaaaaaatctgcaacctgatttcaatttttattttttaattgcatcacgatg

SEQ ID NO: 3055 - DNA, 461 bp, Triticum aestivum
  Clone ID: LIB3280-055-P1-K1-F5
ggcgcattccagcctggtgtgacagagttctatatcgagacagccgaactagttcacagattgagtgttctttggaatagtcctgtagtctgttcgatatcactgtactactcttgtatggaagcaacagacagtgatcataaacctgtcaaatgtgtgttcaatttatatattgctcatagtggacaaacaaacaatgaggcagaagtatggagaaataatgggttcaaataaggaagtgcttgactcacttcaaggcttggaggctttgcctgaagtagatatcagcacgaatgacatcattctgcaagatcaaaacccttttgttgtgaaactgcacaacagaagtacaaaagagttggcttgttttgagatcattggtcagacaccaaagtcatctggcacacctttgtcaggtttcccttcttggctgaaaagttctccggcaatcggtataattt

SEQ ID NO: 3056 - DNA, 428 bp, Triticum aestivum
  unsure (1)...(428): unsure at all n locations
  Clone ID: LIB3280-055-P1-K1-F6
ctagactgtagcatgtaaagagtatatggtttttgtagggcatggtccagagtagttgctggaggtgtttcccatgcacgttccatgttcaattatacacaatcttatcttgcacaatccattcccacatcagcatgggcattccgcattatctccttgcgcaaactgcattctctatcgcagacagtgaagcaagagaagtttcttatttcgagaatatcataatatctgcatttagcatgagcataacattagcaatcgctctttcttttcgatggatctcctatggaaaaagaagagcagccaagtaaaccgtgggaatgtttttttagtgttgtcttgagttcgatggcaacacccangtcgtgaaagcatcgagacgcgatccccggcagtccggtgcagcggactgagtgcggctgactact

SEQ ID NO: 3057 - DNA, 441 bp, Triticum aestivum
  Clone ID: LIB3280-055-P1-K1-F7
cagagataggcgtcttcgtactcgcctacctccgcggctcaaacctttcccccttctcccaattccttccgccggccgccgctccacccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgagaactggcacctaccgtcagctcttccaccctgagcagctcatcagtgggaaggaggatgcagccaacaactttgcccgtggtcactacaccattggcaaggag

SEQ ID NO: 3058 - DNA, 435 bp, Triticum aestivum
  Clone ID: LIB3280-055-P1-K1-F8
cccagccgcgacctgtctctgtctgttcttctgccccgatcggccgatcccacccacgcatctctctccgcgcccgcggtagtgttcgtgttcctcactcctcccgcttccttccccgacactgcctcagctcagatccgcggcggtttcccggtccctggatctaaagcggccggtgagcaggcctccttccgccgacgcggaccacctggagggaatttatcctggagccgtcttcctcctcgcctcctctcgcggcgcggcgcggaggccggaatcacttggaggtctagctgtgtgtggattgatttcttcgtttgtggtggctagaggcacctggtttgtttcttgccgaagcccgtggtacatgtgaacagcagggcctgtcttctgcttttgcttcttagcaatggcgaatgcaagcaacacttgcac

SEQ ID NO: 3059 - DNA, 454 bp, Triticum aestivum
  Clone ID: LIB3280-055-P1-K1-F9
cccacgcgtccggcctgacccagagattgatgcaccctggtttaccaggggcacgttggataggtttgttcgatttgtcagtacaccagaggtcctggagcgggtcacaaccatagagtctgagatattgcagatcgaggatggcattgccgtccagggcagtgacagtcttgggttgagatctgtggaatactataatgggaaattggtggactgcatggaaggtagtaaggcaagttacaatcctgatgcagatagggcacttgttccatacaaggctggtacacaaccaattccaccattgcagaatcatgatgctacacaggaggagaattcaaaggatcaattgctcagagtgctagagactcgcaaaacagtcttacgtaaagaacaggctatggcctttgcacgtgctgtagcagcaggatttgacatcgacaacttggtgtatctg

SEQ ID NO: 3060 - DNA, 459 bp, Triticum aestivum
  Clone ID: LIB3280-055-P1-K1-G1
cccacgcgtccggctccctccaccaagcccccgactccccgaggccccgacctgcgcacccacgggatccctacctatccggccgtcacccctccccctgcccctcccgagttggattgttcgcggaattggcggaggggcagccggatatgtcgtcgtcggttgggggcggcagcgcgggcggcggcggagtggacatggtcagcctgctggagaaggccaaggatttggaccagctaaagaaggaacaggacgaaatcgttgccgatatcaacaagattcacaagaagctcctcgcatccccagagatggttgataaaccagttgacaccattttgctcaagcttcgtggtttatatgcacgtgcaaaggagctctctgagaatgaaatcagtgcctcaaatgctttgattggattattagatggtttgttgcaatctggagcttcaactgcacaaa

SEQ ID NO: 3061 - DNA, 425 bp, Triticum aestivum
  Clone ID: LIB3280-055-P1-K1-G10
cagaagggcactcaatcttggtgtcaatgtcaagatgattacaggtgatcaacttgctattgggaaggaaactgcacgtcgtttgggaatgggtactaatatgtacccttcttctgctttactcggacagaataaggatgagtcaattgcttccttgccaattgatgatttgattgagaaggctgatggctttgctggtgtttttccagaacacaagtatgagatcgtgaaacgcttgcaagcaagaaaacatatatgtggcatgactggggatggtgtaaatgatgcaccaactttgaaaaaagctgatattggtattgcagtaacaaattctactgatgcaactcgtaatgcttctgacattgtcctaactggacctggccttaatgggattattaatgctgggctgaccaatcgggcaattt

SEQ ID NO: 3062 - DNA, 455 bp, Triticum aestivum
  Clone ID: LIB3280-055-P1-K1-G12
ctaaacatccgatccgaccatggcggcagacgcacttcggggccttctccccggcgtttacgccgtgctgatggtaatcgccgtcacaagcgccgcctccagcgacgcgtcctcggtggtcgtcggcctcgccaaatgcgccgactgcaccaggaagaacttgaaggccgaggcggcattcaagggtcttgaggtggcgatcaagtgcaagaacagcaaaggcgagtacgagagcaaggccatgggcaagcttgatggcttcggcgccttcagcatcccacttagcacggacctccacggcgctgactgcgttgcacagctccacagcgctgtggagaacccgtgccccggtcaagaacctttcagaattgtgccacaatcgtcaaagggcaacttcgtcgtggtccctggaaagacagactacccatcgaaggaatgggcggtcgcaaccctgt

SEQ ID NO: 3063 - DNA, 458 bp, Triticum aestivum
  Clone ID: LIB3280-055-P1-K1-G2
aagaaagctttggcactgggtctgaccacattcgtgagaaggatggcatctgggctgtgcttgcatggctttcaattattgctttcaagaataaggacaaccttggaggagataagcttgtcactgttgaagatattgtccgtcagcactgggccacatatggtcgccattactacacacgctaggactatgagaatgttgatgcaggggctgctaaggagcttatggcaaacctagtaagcatgcagtcatcactttctgatgttaacaagttggtcaaggagatccggtctgatgtttctgaagtagttgcagctgacgagtttgagtacaaggatcctagtgatggctctgtgtccaagcaccagggcatccgatacctctttggagatggttcacgactggtgttccgcctctctggaaccggttctagtggtgccaccatccgtgtctacatc

SEQ ID NO: 3064 - DNA, 452 bp, Triticum aestivum
  Clone ID: LIB3280-055-P1-K1-G3
atgctgctaacatgcacatggagattggtagacgcatatacagagagaggttggatacgagtgatcgggatgctgtcatggaacaaagacgggcatttcagaagttaatttatgtgtccaatcttgtctttggagatgcatctgtattcctacttccttggaaacgtttagttggggtgactgattctcagattgacattgctatgagggaaaatgccaagattttatactcggtgcagctcaagtctattggaagaggtcttgacataagcacactcattgaagtaaggagagcacaacttgcatataaactgtctgatgagattgctgctgagatgtttcgtgagcacgctaagcacctagttcaagaaaacatttcattatcattagacatctagaatcacgtattccggatatgtctaactcaagctgtggaagaagtgaatattgta

SEQ ID NO: 3065 - DNA, 457 bp, Triticum aestivum
  Clone ID: LIB3280-055-P1-K1-G4
cggacgcgtgggcggacgcgtggggtcttcgtactcgcctacctccgcggctcaaacctttcccccttctcccaattccttccgccggccgccgctccacccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgagaactggcacctaccgccagctcttccaccctgagcagctcatcagtgggaaggaggatgcagccaacaactttgcccgtggtcactacaccattggcaaggagatt

SEQ ID NO: 3066 - DNA, 457 bp, Triticum aestivum
  Clone ID: LIB3280-055-P1-K1-G5
ttcacctaatctacaagctgcaattgatggccctggcaaaaggactggtcagccccttgtacaatgcacttcccacatgtgcccgataagaatccactggcatgtgaaactcaactacaaggattactggagagtgaaaatcactatcacaaacttcaacttccgcatgaattacacgcagtggaacttagtagcccagcatccaaactttgataatatcactcagttgttcagcttcaactacaaaccacttactccatatggtggtggcataaatgatacggcaatgttctggggtgtaaaattctacaatgatctgctgatgcaagccggcaaacttgggaatgtgcaatcagagctgcttctccgcaaggactcccagactttcactttcgaaaagggatgggccttcccacgccgagtttacttcaatggtgataattgtgtcatgccatct

SEQ ID NO: 3067 - DNA, 459 bp, Triticum aestivum
  Clone ID: LIB3280-055-P1-K1-G6
cccacgcgtccgtaaaaatatagcatcgcccgcgctctggagagtctggatcctcctgaacctccaagcagcaagcgatgaaaggagggacgcaagcaattagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtctccagagcctacttcgtggcttacgtag

SEQ ID NO: 3068 - DNA, 456 bp, Triticum aestivum
  Clone ID: LIB3280-055-P1-K1-G7
ctcttccttctcgtttcgtcctgcacagcgcacgcaactgccaccggccaccgcgcaaactccattgcgcgcagatcaagaccgccacacccaccaccagcgcttcagcgggagacgtgacgactgacgagacgaagcctctccccacggcgcctccccctccacatggcctgggctcgccttgcctcccgctcccgtctgcgccccgcggcctccgccgccggccgatcccgacacgcctcaacaccggctccgcctccgcctccgtccccacctaccacacgcacggtacctgcggccacctccgcgccaccgctccggcgtctcctcctgcttccgcggcaccggtttgctgacgccacgccctcagcatcgaccgcgtggctgctcggtgcccgctggcgccaggggcacggcaggaggtgctttgcgagcgccgtctacccggcgcaggcg

SEQ ID NO: 3069 - DNA, 441 bp, Triticum aestivum
  Clone ID: LIB3280-055-P1-K1-G8
cctccacctccccgctcgctctcctgcctccgcgcgggccgcggatcccttcactcgccacagcaagcgctagaagagggaatggagcccggcctcgcatcccgcgtcgcccgttcagccgctcagccgctttccggctgcctgtcgcggcactcgctctcgccgtggctcaagatccagaaccacatttatccgatgccaagtctctgtcacaaggttcctagcacggcaaaatgccacacttctatgacaacaagttacatggaaacatcagatgtcactgatttggactgggaaaaccttggctttggcctcatcgagactgactttatgtatgttgcaaaatgtggaactgatggaatcttttccaaaggtgaagtcctaccatttggtcctatagcactgagtccttcagctggagtcttaaattatgggcaggga

SEQ ID NO: 3070 - DNA, 449 bp, Triticum aestivum
  unsure (1)...(449): unsure at all n locations
  Clone ID: LIB3280-055-P1-K1-G9
tgctgtgctgtgctgtgcatgcaaaggaaagagagaaagactgaaagagagactgagaggagaggcgctttgctgtcgtagtgttgctgccgcaacgccacaaaaagggtcaggggcagggaggtcatgtgaaagacaacacgacgcaggcctcctcctctctaatctttggcccttctttaaggggggctactcctgctaattccaatggggcgcatttagtggggggaggaaaagggatccttgcgaagacccagacgccagaggggagtgagggagaggggagggagaaataaataaacccgaattcagccaaacttctctctcccaccgcgcttgcattctctcatcgccaccccaccctcctcctncctgtctttctccccccctctctctccccctcttagacaaattttcctccacccattcccttcctcccctcttcttct

SEQ ID NO: 3071 - DNA, 445 bp, Triticum aestivum
  Clone ID: LIB3280-055-P1-K1-H1
cccacgcgttcgccgaggtcgacgcaaagacgggtctggagaagccgcgggtgacggcgttcgctcacaagacgctgcgggagggccactacgaggcggagttcaaggtgccggcgtcgttcgggcccgtgggcgcggtgctgctggagaacgagcaccacaaggagatcttcatcagggagatcaagctcgtcacgggcagcgacagcagcaccgccgtcaccttcggctgcaactcctgggtgcactccaagttcgacaacccggagaagcgcatcttcttcaccctcaagtcctacctgccgttcgacacgcccaagggcctggaggacctgaggaagaaggacctgcaagcgcttcggggcgacggccacggcgagcgcaaggcgtccgagcgcgtctacgactacgacgtgtacaacgacctgggcgacccggacaagaa

SEQ ID NO: 3072 - DNA, 366 bp, Triticum aestivum
  Clone ID: LIB3280-055-P1-K1-H10
gccagcaccagccaccatgggtcgcgtccgcaccaagaccgtgaagaagacctccaggcaggtgatcgagaagtactactcccgcatgaccctcgacttccacaccaacaagaaggtgctggaagaggtctcgatcctcccctcgaagcgcctccgcaacaaggttgccggcttcaccacccacctgatgcgccgcatccagcggggccccgtccgtggcatctcgctcaagctgcaagaggaggagcgggagcgccgcatggacttcgtcccggagaagtcagcgctcgaggtcgaagagatccgcgtcgacaaggagaccatggagatgctcgcggcacttggcatggccgatctcccgggcgt

SEQ ID NO: 3073 - DNA, 405 bp, Triticum aestivum
  Clone ID: LIB3280-055-P1-K1-H11
gcgtcgatttagtcgcgcgacgtctggggttcaagatgagtccacctgcttacctctcgttgacaccggtatcaaagtttgacctgttcacgtgccgaattggtgccaattacgcgtgtggcggatctggcattctcaacaccacgggaaacgggacactcacgctgcagaaacaaatcacgctgtttttcaaaactcaagcaagaatgtcgtgggcccgctgcaagctcaaatctatgggatcaaggtccttggtccttgtcagcgccggcggcaatgacttctccgccttcagtgaaatgggcatgggcgaacaagacgccccaggctacatcagtagcatggtctcaacctatgtccagcatatcgacgcgttgtacaaagtgggagcacggagggtgggga

SEQ ID NO: 3074 - DNA, 287 bp, Triticum aestivum
  Clone ID: LIB3280-055-P1-K1-H12
ccgccgccgtcgtcctcctcctcctcctcctgccgcgcttctgctcaccggccggcgacaagttgacccccggggagtcgctgttgcccggtgagaccatcgtgtccgacggcggcgccttcgcgctgggcttcttcgcaccgtccaatgccacgccaggcaggcagtacgtcggcatatggtacaacaacatccccgtgcaaacggtggtgtgggtcgccaaccgggacgcgccggtcaccgtcggcgacgcgcgctccggcaactcctcgtcgtcgtcgtcgtct

SEQ ID NO: 3075 - DNA, 448 bp, Triticum aestivum
  Clone ID: LIB3280-055-P1-K1-H2
cccacgcgtccgctcgatcgatctcactctcagctggtcgctcactcttgcagctccacccttcactcagtcttaggctcttagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgaggctgctgctcctgctgatcccgaggagcttcccgcggccgagcagcaggcagccgccgagcccgaggccgctgctcctgctggtgccgaggagcccgcggcggccgatccggccgccgaggctgaggctgctgcttctgctgggcccgaggagactcccgcggccgagca

SEQ ID NO: 3076 - DNA, 471 bp, Triticum aestivum
  Clone ID: LIB3280-055-P1-K1-H3
gagctgacaaagaggatactagactcgccgcgcacagtagcgtgagtgagatagcacacagagcgtggtagcactgggctatcggtgacgccgtgtctcatgcgaactatcgccaggtgctcagatgtcgagcggaggctccatgtcgcgtgctgctaggctaggcagatccacgatgatgcatgatgtgcacaccttgctcaagtgtgagataactgacctgccattcttcgcataaagagtcaagtcgggcaacaacggtgttaactgcgtcatttttcgccacctgcacgaaatgactttttatgaggccgacgcacttgaggcgctttacgccgagttgacagcaagcatttagaatggtattgctttattgaacaaacaaagaaaagctggttcatctgtttgaggcgaatcatgttaaacagaaagaacaatcgtcttgaatggctaataaacagtgcagtctat

SEQ ID NO: 3077 - DNA, 492 bp, Triticum aestivum
  Clone ID: LIB3280-055-P1-K1-H4
attcccgaatcgaccgatgcactccacgcaggcaatccagcgccaaccaacatggcagtagttctaaccaaaaggtaccttgatgtctcttacaagtgtgcttctcaggaccggaaattcaagctattcttcagaggctaggcacaattacactgagactcccaaagagattcaaacacaacatcataccataaacggaagcccatcgtacaattctgtacaggatcgatatgaaagagggaccgcccattgtgaatcatccactaagctggattgcagaaagagaaggctaatcttccagcaacctcaggcgatccctgttataaaccttgaaccacaaccagcaccagaaccatctgcacacgtcgccagcagagtcgctgatcacctatattttgatgatggtttctttgagaaccttaatcttgatgcaattgaagctcaagcaaccgaacagtggagacagaagaccacacaatcgacgcataaacc

SEQ ID NO: 3078 - DNA, 461 bp, Triticum aestivum
  Clone ID: LIB3280-055-P1-K1-H5
cccacgcgtccgcccacgcgtccgctcccggttcttcccctctcttgcgacgacagggttgggtaacgccgctcgccgccgccgccgccatacgcaggtgccgaggccttcgtcgatctcttagccgtcgacaagcacccaaggatagaatgagacggcaggggcaatatggtgaagcggatattaactctatggttgctgcccagttgcatcactaccaggcacagcaaagggtacagaaacaccctgagaatagctacactggaagagatcctgcacaagcttctgcggagcatcagtacactccccctaaagcaagacagagtcaatgggatcgaggtggaccaaatgcgccaagccaggttccatcatatgcatataacgaagcccaaggtgctggaggtgcgcaatccttttatgatgggcagagatctgatacaaaggttggtctagaaaagcag

SEQ ID NO: 3079 - DNA, 426 bp, Triticum aestivum
  Clone ID: LIB3280-055-P1-K1-H7
cgcctttcctcgtcaagggcgactacagggcgctgtacaagtacttctccacggtggcgaagcaggcgctggacaccgccgagggcctgggcctgtcgcgcgaggaggcctgccacaacctcctcttcgccaccaccttcaacagctacggcggcctcaaggtgctgttcccgggcctgctggccaacgtggccagcggcggcgagaagctccacgagcggctggtggccgagatccgcggcgccgtggccgacgccggcggcaaggtcaccctcgcggcggtggagaggatggagctggccaagtcggtggtgtgggagtcgctgcgcctggacccgcccgtcaagttccagtacgggcacgccaagaaggacctgctggtggagagccacgacgcggtgttccaggtgaggaaaggcgagatgc

SEQ ID NO: 3080 - DNA, 318 bp, Triticum aestivum
  Clone ID: LIB3280-055-P1-K1-H8
ggggagagaaaaacctcagaccccttaaatcgggtttgcctgcggggaaaaaacccctgttttttttttttggcacttttaaacgggcgggccgggccccctagtttggttgcccccaagcaaactcacaacaatttacagaaccttctaacccatgggggcctggccccttgataacaacctttattcaagggggtggtcgctccaccccctcccgaagggttatcgggagggggggtacccaaattttaaagcttgttcacccatggggggggcccccaacccagggggggttggtgggttttttttcccaaaccc

SEQ ID NO: 3081 - DNA, 423 bp, Triticum aestivum
  Clone ID: LIB3280-055-P1-K1-H9
cccacgcgtccgcccacgcgtccgcccacgcgtccgctcccgccgccccctcgcgccgtcaaggcctccggaaccggtcacaggcggcgtaagacccccgccgctacagagccctcgtccgtcgcacttcgccgccgcgtcggagtcatccagctcgtcgacgcctggcggggagatccccagtgcgaggggaacctccacgacgcgagtacttctctacttcctgtcacaaaaaaagatttgcaatctagcatatttatggaagcctttgctccggataaaatttgcgggtcagggagatcagcggtcaccacccaagaaagagtgatggaagcccaaagtagtacttgcttttcaaaagttgtgggacctaacctatggtatggcgatcgcacaagacttacacccaagcaagaagaagct

SEQ ID NO: 3082 - DNA, 416 bp, Triticum aestivum
  Clone ID: LIB3280-056-P1-K1-A5
gactcgcgctccctcggcaccactaaaaaaaaatagactcgtgctccctcggccgacgccggcatcgggagccggccggcgagcatccccatcagtcccctcccctgctccgacgccgcgcgcggttgccggtgagactggggatctagcgccctcaccgccaccagctctgcgccgctgttgatcggcagcacgcacacgcagatctcataccccatcttcaccgcttatggagatgggttcgacgccttcgcggcagcgtgttgtgctattccagtactcgtatccgttctggccggccgcgtcgcgtacgtgctttgccgcagcggcctaccgccgtcgaggtctcgtgcccccgggctgcggtgtctaatcgtcctcgggtctggagggcatactgcagagatgatgaatat

SEQ ID NO: 3083 - DNA, 425 bp, Triticum aestivum
  Clone ID: LIB3280-056-P1-K1-A6
atcggtagatgacatggctcacctgacggcactactcctcgcgtccgttctcgtcttcggcttgagcgcgacacccacgctaagcattatcactggcggaggcggtgcgacagcgaggcagagtaccagcctcaaccatggcgccgctcgaacttacgtagtgctcgtcgagcctccggcgcacgcgcaccacgacgacgaagccgcgcaccggagatggcatgagtcgttcctgcggcggggtcgcgccctggcaggaaggccggcggcgaaacacccaccattcgccactcgtacacgggcgtgttttccggcttcgccgcaaagctgacggaggacgagctcgcagcggtgtccaggaagcgcgggttcgtgcgcgccttcccggagcggagggtgccgctcatgacgacgcgcacgccggg

SEQ ID NO: 3084 - DNA, 421 bp, Triticum aestivum
  Clone ID: LIB3280-056-P1-K1-A7
cccatctccaccgacgcatgtgcccgccgtcgcgttgatcgatccgccgacgcagccggagagggagcgcatctatccgtatatacacaggaggagccggagagacgaggggacgatgacagccgggcccaagatgcgcgccggcgccgtcaccgtagtgctggcgctggcgctgctcgccgtggcggtgctcgccgaggacccctacctctttttagactggaaggtggtgtacgggacaagttcctcatgggcacgccccagaagatgatcctaatcaacggcgagttccccggccccaccatgaactgcacctccaacaacaacatcatcgttaacagttttaaccagatcgaccaggcgttccttttaacctggcacgggatccagcagaggaaggcgttgtggcaagacggcatgc

SEQ ID NO: 3085 - DNA, 426 bp, Triticum aestivum
  Clone ID: LIB3280-056-P1-K1-A8
cccacgcgtccgttcctcccggtgcctcccaccgtgaccgtgttccagatccccaagacggtgagagaaggcgccgtatagctcatcaacaagtggcagctggtcgcgccggccctccccgacgacctcatgatccgcatcatcgctttcggcgacaccgccaagttcgagggcatgtacctgggcacctgcaaaaccctgacgccgctgatgagcagtaaattccccgagctcggcagaacgcctcgcactgcaacgagatgccctggatcaagtccgtccccttcatccacctcggcaagcaggccactctttttgaccttcttaaccgcaacaacaccttcaggcccttcggcgagtacaagtccgactacgtttaccatcccgtccccaagaccgtgtgggcgcaaatcttcgtctggctcg

SEQ ID NO: 3086 - DNA, 92 bp, Triticum aestivum
  Clone ID: LIB3280-056-P1-K1-A9
ggatattgtgatccagcttatgacgaactcaatgtaacttccaatgtactccctccatttgtttttactgtgcatattatatctgtctgtcc

SEQ ID NO: 3087 - DNA, 291 bp, Triticum aestivum
  unsure (1)...(291): unsure at all n locations
  Clone ID: LIB3280-056-P1-K1-B1
acccctccggaaccggnccgtaatcccacgctcgacgccacgagtacgccagattacacattcctcttacgccactaggaaccagctagagaccccggggccacagggggaggaggaggagatgatctactacaaccagcatccaaacagaagggccccgccggcgcatgggtacggggacaagggcggttacccgccgccggggtaccctccgggacggatacccacccgcggggcaaggctacccgccaggcggctaccctcagcagggctaccctgcggagtcacgca

SEQ ID NO: 3088 - DNA, 412 bp, Triticum aestivum
  Clone ID: LIB3280-056-P1-K1-B10
gctggacagatactcaacctgatctcaaccgtacttccgtccggcgcatctacacattggggtctgcatggctacgatcaacatcaacatcaatggtttgccccgcatcggcacgcttgtggtcagggtcagcgctccacagcccccatgtcgagctcgtgggcgataacgaccccttcatcaccaccgactacatgacctacatgttcaagtatgacactgcccacggacagggacgcaccatgaagttaaggtgaaggactccaagacccttctcttcggtgaaaaagaggttgcggtgtttggctgcaggaacccacaggagatcccatgggctgctgctggtgcctgagtacgttgatgagtccaccggtgtttacactgacaaggacaaggctgccgcttacattaa

SEQ ID NO: 3089 - DNA, 84 bp, Triticum aestivum
  Clone ID: LIB3280-056-P1-K1-B11
gtgagagagatacaaagcgtgatagtatctcttcttcctgccgtcgcatcgaggaatttgggaccacatgattaacctgaacag

SEQ ID NO: 3090 - DNA, 135 bp, Triticum aestivum
  Clone ID: LIB3280-056-P1-K1-B12
gctttctactacaaaacgtatccatacacttcacttttttgccgtctccgtccgggccaggtctattctcactccggcagccaacaattttttgatcggacgtccgataatggggccagatggaatcaagtacgg

SEQ ID NO: 3091 - DNA, 345 bp, Triticum aestivum
  Clone ID: LIB3280-056-P1-K1-B2
gccagccgtcctcctttttttttttttattcaaacaccttcttatttcattttctcaacagggcaagttgggcactgtttacaccgcatagctcgctagactagtcataggtataactgggctgaacggtgtaaatagagactgaccataccagcatccttacaaaaatttatacaaaggacgcaccgttattttagaaaaaatatcgtcggctatacacaccaatggctgggagggcatataagtagtgtggagctcctccgactgattgttgctcctacaggaagagtgggtgatgcgactagtacgggacttgctggtgcaaatagcgcatcacgttgtttt

SEQ ID NO: 3092 - DNA, 421 bp, Triticum aestivum
  Clone ID: LIB3280-056-P1-K1-B3
gttagtgagagccattttaatcatgtgctgaacattgaattgtatcaaataattgacgcctgcaagttcggggatgaaaactggaaccccaagttcacgctgattgttgctcagaaaaatcaccacaccaagttcttcatacctggatctcctgacaatgtccctttgggcactgttgtagataatgcattttgccatccaaggaattatgacttttacatgtgcgctcatgctggaatgattggacttcaaggccaacgcactaccatatcctgcatgatgagatacactttggcgtggttgacctgcaggatcttgtgcactcgctcatatatgtgtattaaaggagcacgacagtcattatcaatgttactccaatctgttattcacatcttgcggctgctcacgtggcgcatttcat

SEQ ID NO: 3093 - DNA, 425 bp, Triticum aestivum
  Clone ID: LIB3280-056-P1-K1-B4
caacaactgtagtacgtatgtacgtaagtgtagctagcctcctcctgtactgcacgccatggcgctggtgaagaagaacacgagctccctgagcttcgtcgtggccaccctcatggtggtcatggctgccacccttctcctctcctcgtgcgacgcccgcaaagtgaaggataagcccaccgctttcctcgtggcggggaagtgcttctcgaggtttttcccgaactgcaccgagcagcgtgcaagaagttctgcgtccagccacttcccggagccgtctgcatcgacaaaacccactgttgctgccctattgcttaattataagcgccgctgaagcaatcgggctaagaaatagtactagttaaagatggcactaagcaatattcgtacacttccaaatatatactacctctttctaaatataa

SEQ ID NO: 3094 - DNA, 422 bp, Triticum aestivum
  Clone ID: LIB3280-056-P1-K1-B5
atagtcctcaagctataaccaaatcaaatgatggtttactatctttgaagacaaacaaagaaactattggtgggttttcacatgtaatgttcgcaacaggtcgtaaaccgaatacgaagaacctcggactggaggaggttggggttaaaatggacaagaagggggctatagtggtcgatgggtattctcgaacctcggtggattcaatttgggctgttggagatgttactgataggatcacttgactccggttgcactgatggaaggtggagcatttgcgaaaactttattcggtgatgaacctaccaaaccagagtacagagctgtaccagctgctgttttttcccaaccacccattgggcaagttggccttaccgtggagcaggctattgaagagtatggagatgttgttgtctacttgt

SEQ ID NO: 3095 - DNA, 367 bp, Triticum aestivum
  Clone ID: LIB3280-056-P1-K1-B6
ccacaccatcaaccacaactacaccgagtgatgcgtctcgacattggaccaacaaacatgacatcacggttggcatgagattggaatggagctccgcttgaagattctttcgaagaatgaatcaaacaatgatggatgatcagaccagtccctagacgaaaagtgctaccaaatgtgttgcctaagttgtgcgttttgtagagaggtttttatgtaggagtgaaggtattcctggtttgagcacggtgtggatgtaatcgtggttcgcattttacccagcgttccatacatagtccgttatcttgccgaagctataggagaaataatccctgaaattattctggccaaaaaaaagccaaaaagggcg

SEQ ID NO: 3096 - DNA, 380 bp, Triticum aestivum
  Clone ID: LIB3280-056-P1-K1-B7
gttgcagcagaaatcatatctactgatctgtcatgtgtcgtggacacattgtcaaacgaagaagacgatgctgaacttgatctggatagcccgaccgagggcttctcatctatttcggaggctattgaggacattcgacaaggaaaacttgtgattgtcgttgatgacgaatcaagagaaaatgaaggtgatcttatattggctgcttctttggttaccccagaggctatggctttatagtaaggcatagcacaggaattgtgtgtgttagcatgaaagaaaatgatctggaaagattgaaccttcctttgatgggttcaacaaaggaaaatgaggggaagctttgtaactgctttcaccattacttgggatgctaaaga

SEQ ID NO: 3097 - DNA, 416 bp, Triticum aestivum
  Clone ID: LIB3280-056-P1-K1-B8
cccacgcgtccgggctacgagaagcgccttgatatcaccttctctgaggcatcaatctttgctgaccctcatggtcgtggcctgcgcgccctctccagggcccagattgactctgttcttgatcttgcacggtgcaccattgtgtccgagctctccaacaaggactttgactcgtacgtgctatccgagtcgagcttgtttatctactctcagaagattgtgatcaagacctgtggactaccatgctcctgctcaccattccaaggattctcgagctggctgaagagctgtgcatgtcgcttgctgctgtgaagtactcccgtgggatgttcatcttccccggtgcacagcctgctccccacaggagcttctctgaggaggttggtgtcctgaaccgctactttggccacctgaag

SEQ ID NO: 3098 - DNA, 424 bp, Triticum aestivum
  Clone ID: LIB3280-056-P1-K1-B9
gagagagagagacagagcgacatagatggggcagctcacggcggcgcctggaggcggcggggactgcctgatcaagctgttcgggaagaccatccccgtgccggacgccggcgacaaggaccttcagcacagaggcagcagcgccacggctgaaccgaaggtgcaagaaatcgcccctcaggactccacgggctcgcctccgcagcagccggaggttgtggacgtcgaggacccatcgctgccaagaactcggcagcagatcaacaagatgaagagcagggcgacacggcgaaccagaaggagaagctcaagaagcctgacaagatcctgccctgcccccggtgcagcagcatggacaccaagttctgctactacaacaactacaacatcaaccagccgcgccacttctgcaagaactgccaga

SEQ ID NO: 3099 - DNA, 366 bp, Triticum aestivum
  Clone ID: LIB3280-056-P1-K1-C1
acggtttcctattcctggtggttttccaactttaacatggggtctttctgttacatccccacgtggcgctggcttcactccttcctcgcaacatgagctccttgtgtgatctctcctccggcgggtctgaatccgacgaggagtacggtccttccgtcgccacccatagcctccccactctccaaatccagagccttcggatacgggatcatgttatgtgcacccttcgactttgataaggagaactaagcctgtggcgtcgtcagttacttcaacgccctcgccaagttcgggcttactcatcatgtctatggctcgccggcacaggccctcttcagctgggtgcttgccgacttcgcgatccta

SEQ ID NO: 3100 - DNA, 244 bp, Triticum aestivum
  Clone ID: LIB3280-056-P1-K1-C10
ccaggacccatctcggggatcagccgacctggatgctccaccttctcctcgtgctgatgtgccgggcccagctcctacacatgacacgatggcgaagattggcgtgctacttctgctgcgcgtacgctgtgccgtgcctcctttgcggcaaaacacctgactttgctttgtctggagcatgactgcatgctacccggcagtcttggcgcttgtagaccagacctatgctggcgagcatcatttt

SEQ ID NO: 3101 - DNA, 170 bp, Triticum aestivum
  Clone ID: LIB3280-056-P1-K1-C11
ccaaggcctacgtccgcgcttacgtgtcccgggacctctagagcaaaaacgcgcgtgaggggcgcggacatggctgacgacatatgaaaggcatgtgggggcaagggatgtgctagatgggggaggcgatgtaggagctggaggtcttcttccggaccaagggcatcgtg

SEQ ID NO: 3102 - DNA, 224 bp, Triticum aestivum
  Clone ID: LIB3280-056-P1-K1-C12
caattgtattccaagggaaatcattaacgggcatattggccgcgatcgacactttctctgagcatttgataattgggatcttttactgactggggtttgcactattgtgcttggagacactgttgatcatttgggttcttcagattgtatacatgttctttcgatggcataagtgatgcggtcatgggtggtaaatttatagaagtttataagctgtagtgatt

SEQ ID NO: 3103 - DNA, 310 bp, Triticum aestivum
  Clone ID: LIB3280-056-P1-K1-C2
gtcgcttctgttttttacccacctcctgcacccaccagggaacaagaattcgatcccattccacccactcgcgccgcgaatttcaccgccgatccggccgacagcaatggcctcctccgccgacgagtccctgccgtcgcttccgccgatcaagacggcgccttcgccgccctccgacgccgactcggcctctccgtcgccggcgtcgtccacgcagagtcggcggcagcggaggacaagacgacgaatgctgcagcggcggagcaagaggagaaggcttcgtcgacgccgacgttgaaagagtgcagga

SEQ ID NO: 3104 - DNA, 431 bp, Triticum aestivum
  Clone ID: LIB3280-056-P1-K1-C3
ggcttcttccacatttgcactgagcaaagagaagcatatcggcagagaacgaagcaaaccggccgacgggtcctggcccctcgccatggccggcaaagctagggtgttcatgtgcgtggcgctcgtcgtcctcctgctccttgtcgagaccaccgccccgactggacaagctcacgccgtcgattgcggcggcgcgtgctcgtaccggtgcatcaagttgagtcgaccgaatctgtgcaacaggcgtgcaacacgtgctgccggcgatacaactgcgtgccgcccggcaccgccagcaacgaggacgtctgcccctgctacgcccacatgaccacgcactactgtcgccacaagtgcccatgatacaaccgccatcttcacggtcaatcaagattactacatagtcgatcgtcatggtctctcaattaata

SEQ ID NO: 3105 - DNA, 73 bp, Triticum aestivum
  Clone ID: LIB3280-056-P1-K1-C4
gcattcttacataatataactaacctgagggtaatttcttgtaatggaccgtgtcctaccggccgatggatac

SEQ ID NO: 3106 - DNA, 426 bp, Triticum aestivum
  Clone ID: LIB3280-056-P1-K1-C5
cgctgtccttcatcgcgcgcaaggtggtgagccgcgggatcaagccgtacatcccggacttccgcacggcattcgagcacttctgcatccacgcgggcgggcgagcggtgatcgacgagctgcagcgcagcctgacgctgtcggacgagcaggtggaggcgtcgcggatgacgctgcaccggttcggcaacacgtccagcagctcgctgtggtacgagctggcctacgtggaggccaagggcgcatgcgcaggggcgaccgcgtgtggatgatcggcttcggttccgggttcaagtgcaacagcgccgcctgggagtgcatccgcccgccggccgcgcccggcggcgccgacgggccctgggccgcctgcgtacaccgctaccccgtcgacatccccgacgtgctcaagcattagcctagccaacc

SEQ ID NO: 3107 - DNA, 429 bp, Triticum aestivum
  Clone ID: LIB3280-056-P1-K1-C6
cacggctctccctcctcctcctacgacactcctccccgccttaaatctctcccacattgcaatcccccatggcctcctacaaccccgccaaccctagtaccccggccccgtcggcgccgccgctctacccgtcgctcaccatggccgacctggcgccgcccgagatcccgcggtccccggccttccccgacgcgccgccgccctcggacgacgtgctgctccgcgtccccggcgcgcagctcacctaatcgaccgccagcgcagccacccgctggcggccggcgagctctccctccaccgcatccgcgccggcgacacctccctggccgacatcgcggcgctcggcgccgtccagtggccgctcgcccgcgacgtcgccgtcgtcaagctcgacccgcgccactactcctttttcttcgccgtgcccgc

SEQ ID NO: 3108 - DNA, 172 bp, Triticum aestivum
  Clone ID: LIB3280-056-P1-K1-C7
cgatggcgttccgccgactcctctcggccgcagtgcgccgccgctccgccgcggcggtggcggcggccgggaacgcgcgcgaggcctccacggctgttgtcgcgggccctggcgtcatggtcctcaacgcgcccttcgatatacgcccaggtgatggcgtacgaccggatta

SEQ ID NO: 3109 - DNA, 425 bp, Triticum aestivum
  Clone ID: LIB3280-056-P1-K1-C8
ccgaggccgacgacgccgtggaatgggccggcgaggtggcgccgtggagcaagggcgccgacttcgccttcctgctcgagcaggcccgggcccagcccctcgaggagcggggcctcggcgcggccggccgcctcgccttccaggactcggtatttgattttatgcaggcttctacatctatgcttgaggctaaagcggaagggatcatgtcctggtttgaagacgataatttcgtatagaggatgatttagcaccagattttgaggtgccttttctctccatggatcttcatgcattggccaccaaactctcaaagattaagctctcccaaagactttttatggaagaaaatctactacccgaggatatggctgttgcttctgaagaccaaaatgatgaaatactgattcaattgggcacaacat

SEQ ID NO: 3110 - DNA, 423 bp, Triticum aestivum
  Clone ID: LIB3280-056-P1-K1-C9
cgaggacccatctgtgggatcaggtgacgtggccgctccaccgtctcccggtactgaggcgccggcaccgcctccgaagcatcacatgatggtgaagaagggcatgctgtttctggagcgcgacctctttgccggggcgctcctgccggcaaacacccggctgggctacgtcagacgcacgagttcaccaggcccagtcatttcaagtactacaagcccagtaccacccttcaggacagcagtttcgagaaaatcttgaagttttacaatgtaacccacggctccaagcaagcagggaggatctcggagactctccagttctgcgaggaggcaggagacaaggaaccacacgtgtgcgcaacgtctgtggcagccgcgagagagttcgccgccaccgttttgggcaccaaagagccgcgcgcg

SEQ ID NO: 3111 - DNA, 430 bp, Triticum aestivum
  Clone ID: LIB3280-056-P1-K1-D1
caatgtttatctgctgatcacaaccatggaggctgtagatgagcgaaatgggttttgaggacagtgcggcatgatgtctgcacttataaaaaaagttgcatacaacagaaggcgtgcctcctatgaccaggtctaagaaatacaagcatagttcaaagtaaactgaccagaaaactaagattatctataaataagggtagagccatggattacatgatttcttttcaaaacacaacataagatgaactgcgcaaactgcttatgcaatatattcagaagcataattttgcaaacatgtatctcagtagtgtatactatcaaggtggcattgggtttgcatagctggcaaataactcgccattgtgtacgattgaaccttgaaactgattaggtgtgttgccatcgaaggcgaaaactagatgtcatgctc

SEQ ID NO: 3112 - DNA, 281 bp, Triticum aestivum
  Clone ID: LIB3280-056-P1-K1-D11
atcttatctgccaacactttgatcttgacaggatactgcttgaatctcttgggacctaggggtgtatcatatagatggtgacattataaatctataaaaatggtccatactgttgcgttgaactgattactccatgggattactttcaagaagctagttatattcgatagggatcggtcgcgcccattataactaagggcagtttactttgtggtgacaaaataattgtacgcatctgcttatgataagtcacttattgaattttgtgtaattactcactc

SEQ ID NO: 3113 - DNA, 369 bp, Triticum aestivum
  Clone ID: LIB3280-056-P1-K1-D12
gcggatgtggagtcaactgaagcggttgtcataggtcacctatgactacaaagccaaggggtggtcataggttattatgacgacatccttttggtccatcttatattcactgtctagcggtctcgtcggcggcaagaagaatggggaccctgcatgtatcattttttttttctttaggtttcatttccaagacgacataggcaaggtgatggtggcttatgcaagaggaataaggctttttgttctattcctactcgatgatgtttgatcaaaaacctgggaaagtattgttggctattggtgtaacatcttatgaactcttcattcttattggtctgataaatggttagatttactacatattttatg

SEQ ID NO: 3114 - DNA, 420 bp, Triticum aestivum
  Clone ID: LIB3280-056-P1-K1-D2
agcgagtctcatgcctaaaaccctaggtaagcccccggcacagccccgcctcgccgccgcaccggatctcgccgccgtcgccgtcgccgacgccgacgccatggacatggcagcgatgaacgacccggagaggctcttcttcttcgacctcgcctgcaagaccggcaagtccacctacgacgagaacccactcgacgccgacaacctgacgcgatggggcggcgcgctgctggagctgtcgcaatgcataacggccccgagagcctcaagtgcctcgaagatgcggagtctaagctggatgaagcactgagaattgatcacaacaaggctgatgcactctggtgcttggggaatgccttgacctctcggggattcttcacttcggaaaccggccaggctaatgaatgctttgaaaaagca

SEQ ID NO: 3115 - DNA, 428 bp, Triticum aestivum
  Clone ID: LIB3280-056-P1-K1-D3
cggacgcgtgggaaaagttgtcagtgcattagcttcaccctgctgctccaataacacttatactacactatgtatatacctctaaacttgcatttatgagtatgcccccagttattctaattttcttcacaaatacagcttctgagtagaagtcggtgtagatacttggggccaccgttctcctcaccagacccttgggtgggcgaaggccctcaagcacctccacttgaacttctggtaagatgtaaggaaccaccccaggacagtatcagtcatattagtcttttcttatcagctagctttgcatcgcccgcctccttgtttttaacattttcaagatgatgaattttcggattgccttgcagcttggttaggctctccaactgttttagctcatgcccatgttccgtccttacttgaaatacagc

SEQ ID NO: 3116 - DNA, 269 bp, Triticum aestivum
  Clone ID: LIB3280-056-P1-K1-D4
agtacgtttaggaaaagatgccttaacataatctacatgctagtgatacggttacacttatactatactgggcatatacctctaaacttgcacatatgactaggcccccagatttattaactatcttcacaggttcggtttttgagaagaagtctgcgtaaacacttagtgccacagttctacttatcagtcgcttgggagagcttgggcctttaagcacttgcgcttgagctgctggtagcatgcatggaacccccataagactgatg

SEQ ID NO: 3117 - DNA, 426 bp, Triticum aestivum
  Clone ID: LIB3280-056-P1-K1-D5
cttgatgcctattattgattcatgaaagaaaaatagcagataaaattgtaatttatttaactgggaaaagaaattgtacactaacctgttcaatggaataaattacaattttatctgctatttttctttcttgatgcctattattgattcatgaaatgactttcggtgtggccaataatgtatttcattcagtacatatttgtgcctcctttttctcccttaatcttaaattttgttgtcaactaatagcagatcaagaaattgtaagatgtgaccattaaactgtagcattggtaggaaacagattgttgaaaatttaaagccagacatggtctgacgtagtgtggtcatattatcttcataagatatatatgattgttgtaattagtgtcattgcaatttttttgtcatgtgtagttgcaactt

SEQ ID NO: 3118 - DNA, 428 bp, Triticum aestivum
  Clone ID: LIB3280-056-P1-K1-D6
aacaaatctccgacggagcagcccatcaggatcacgatcttctccaagctactcatggatattcaacttaaatggcatctctgagatgtacaagtcatatgaagatactaacctatggaggattgtagagaacgtaccacgcggggtacacattaattttctcaaggccgaaagaagtttgcatagatgggctcttgaagaccttcagagaattcataccgcggaggaggtggctgcggataggctggaggagttgaaatgcatgtgctcgaagatgctggacactgggttcacgcagataaccctgacggtctcttcagaatcctttcgtcaaccttccgcatcgagaccagcctaagagggcgggagtgagggcacagagctccgagcggcaccgccacatctctattttaagcgggcgggcctgc

SEQ ID NO: 3119 - DNA, 426 bp, Triticum aestivum
  Clone ID: LIB3280-056-P1-K1-D7
cgacctctcacctagcgcacatccatggcgcgcttcctcgtcgccctcctcgctgccacccttgtcgcggttcaggctggagggcagctgggccacgcggcgccggcgacgggggaggtgttctggcgcgccgtgctgccgcactcgccattgcctgacgccgttctccgcctcctcaaacaacctgcagcagaatccaccagctttgtgagagaccccgaggacaggccctcctcgactaccgtgattacagccgctcgtcgttcgatgatgaaccgagcaagatcacctgtttcgccttcggagcggggggctttgactacgacaactacagcggggccgactaacgtcgtggtgccaccgatgtatacaaggcgccgagcagcaacctcgctggaagcggggctttacatggctaggggcggc

SEQ ID NO: 3120 - DNA, 383 bp, Triticum aestivum
  Clone ID: LIB3280-056-P1-K1-D8
gcaaactgtgcagagctagcaaagaaggaagatattgatggcttccttgtcggcggtgcctctttgaagggtccggactttgccaccatctgcaactcagtgacgtcgaagaaagttacagcctgatgtgagaccaccacctatatggtagaaataagtgatgagaaagagaggcagcctggctaccgcgtcgaaaaagcgtgagataggtgctccacgtgaaccgtgaatcgtgcgagtcgtgatctggttttgctgattcgtagaacgaagaaatacaaataatacgacgtggcgccattttgcttcttatggaatttctgtacgaaacgggagttttcttttttgtacgtgagggaggggtcacactcacacctgaattg

SEQ ID NO: 3121 - DNA, 417 bp, Triticum aestivum
  Clone ID: LIB3280-056-P1-K1-D9
ctgccgccgccgtcctcgtgctcgatccacagttctgtcgtcggcctcgtgcaccacccgttgtaaagccatcatctcggagctcgcactccgccgtgggcgagctccaccccgacatacacccattcttgcactccgctcccccttccctagagctccatcccgagatcgagcggccgttcttgcgatccacatacagtcgccgtcctcgcgatccacatgcaaccgtcgtcctgcccctcccctgacatccagccgtcgtcctcgccaatccccgtccctgctactgccgggctccatctctgggctcccgcagctgccgcacctgcttttggcgggactccatattcgagcttccgctggtgccagatctgctgctactggacctgctggtgtcggggctggatcttctgtgct

SEQ ID NO: 3122 - DNA, 251 bp, Triticum aestivum
  Clone ID: LIB3280-056-P1-K1-E1
cccactcgatctgccacgcatacggactgacggttggaggcatcgtttggtgcagatgcggctgaactatctgtgaaaaactgtgatcaagaacatgtcctacctgatggccatggcctgatgggagctggattcttacctgcaagctaagctcatagtcacggacctgacatccgactgtatcaatgagtaaagaaagtggcacgcctgccaagaggagtgacagacaccctacatgagggacacagtac

SEQ ID NO: 3123 - DNA, 419 bp, Triticum aestivum
  Clone ID: LIB3280-056-P1-K1-E10
ccgcctccccacctccaccgtcatggatccggcgccgcaatcccaccccatcctctcctacgtgctctcccgcctccccaccctctccaagcccaggcccgccgccggggccgacttcgacatcgagcagccgccggtccacacgccgtccccgcgctcgccctccgtcggcgagttcgagctcgtcgagcggatgccgggcctccgccacgcctccgtgctccacgccatgaccccgccgtcggcgacgtctccgccgtccgctccgcgctccaggagctgggcccgcgccccgaccacgagctcatcgacttctcccgcgccgtcgtcgccggcgccgccgccggcgacgttgtcccgcggatcaccgaggaggacctcgaggcgtgccgtaccgaggtgcggttcgaggaggccca

SEQ ID NO: 3124 - DNA, 164 bp, Triticum aestivum
  Clone ID: LIB3280-056-P1-K1-E11
gtggaaagcaaggataacattactctgaattggtatttaagcaacaaccgggcgatgcttgtagcaaattgcctgtttcggatggtcttcactatgatccttgtgtcggacaagcgcttaaacaggatggggtccttgtacaagcatgaccacactgggaggac

SEQ ID NO: 3125 - DNA, 373 bp, Triticum aestivum
  Clone ID: LIB3280-056-P1-K1-E12
ggagcttcctgctgacagtaaaatccaccccgtgtttcacgtctcgcatttgaagtctttgaccctcaactacagtctcggtgttctctgaacttccggccaccactgatctgatcactaaggagaccataccagtggagatactggaccgcagaatgatgaatatgggcaatgcacccgtggttcaactgtaagagttctggtacacatattcctccgtctatcacctgggatgattcctcgtgctcctgttagcgttaccctgatgcaagcatttgggacgacgaagcaactgatgaagaagtacgttttctaagtggtgagaattgtttcactgtcagtacatggcatcctttgtgttactgtcttttta

SEQ ID NO: 3126 - DNA, 420 bp, Triticum aestivum
  Clone ID: LIB3280-056-P1-K1-E2
cccacgcgtccgcccacgcgtccgacggcctctgtcccgatcccggagcagagcaacagatagaacccttccttcctctcgcgagatcgaccgacgccggtaagatgctgccgtacgcgacggccggcgaggcggaggcggcgctcggccgcgccctgacgtgggcggaggccgcgtggctccgctactcggcgtcggtgccggaccgctaccttcactggcccaacatcgtcatcacattggcgtctacacgctggcgccgctggccctcgtcctatttgacctcgccgcgccgggctgcggcgcaccgtacaagcttgagaccaaggtgcagcacccgccggccaccttttttcgctgctacatggaacgccgtcgcgtctcgctgctcattatcgggccataccagctcaatttgta

SEQ ID NO: 3127 - DNA, 378 bp, Triticum aestivum
  Clone ID: LIB3280-056-P1-K1-E3
ggaaatgcttatgcacagattgctattggtactgatgatgtctacaagaccgcggaagtcgttagacaaaacgggggacaaataactcgtgaacctggtccattacctggcattagtaccaagataactgcctgcacagatccagatggctggaaatcagtatttgttgacaatctagattttctcaaggagttggaagaatgagttctcaggaagatgtcatcttcgaacaggtttcattggctttttcctcgagttgctagcaccccccaatgaaatcttgtaaaaagcctctaagcgaggtttgtagattgggttgtccaatctactgtgttcatcgcttggttgctcataggggaattagggtttgcttctttc

SEQ ID NO: 3128 - DNA, 429 bp, Triticum aestivum
  Clone ID: LIB3280-056-P1-K1-E4
caccctcaccgtgtcgccgccgccaccaccgccgcagctagataagaagaaaaaaagagagagaagaactcgccgggagggctcgagatctgtgtcgggagagagggaattcttgagatcggaatcggcacacgcgggcgcgctcgggatcggggttaccatacaatttttcccaggaacctttagtgaatgtgctaatggagtcaaagggtggcaaaaagtctagcagtagtagttccctgagtacgaagcacccctcggttacagcattgaagacgttctacctgctggaggcgccaagaagttctctgctggatactcgaactgcgcgaagaagccatcctgatatcgattttggcatccccttctcgtagtttaggatttttatgcaattttattctgactcttttctcccaccaatctctctgg

SEQ ID NO: 3129 - DNA, 422 bp, Triticum aestivum
  Clone ID: LIB3280-056-P1-K1-E5
acccaacccaacgagagctaatatccatccttggagctaaccgatcagatcatggccatggggactaggcgcgccgctctctgctttcttctgctagtcgccgtcttcttacaaggcaatcctacattggtttcagcggatgaggagtacaagtataggattccgtatgtacccttctgcaaggggtggagctgcaaggtggagtgctggctggaggccaagctcttccgcacccgtctgcagagcgcaagtgcatcaggggcggcatcaagggcgcctgctactgcctcttctgcgggaagcacctccaatgaaacacatacatcatccatccattatttgctcgctcgctcgtctagtaggcattaccactactccctccgttccataatataagagcgtttttggcactacactactgt

SEQ ID NO: 3130 - DNA, 416 bp, Triticum aestivum
  Clone ID: LIB3280-056-P1-K1-E6
cccacgcctggcaagagctaatatccatccttggagctaaccgatcagatcatggccatggggactaggcgcgccgctctctgctttcttctgctagtcgccgtcttcttacaaggcaatcctacattggtttcagcggatgaggagtacaagtataggattccgtatgtacccttctgcaaggggtggagctgcaaggtggagtgctggctggaggccaagctctttcgcacccgtctgcagagcgcaagtgcattaggggcggcatcaagggcgcctgctactgcctcttctgcgggaagcaccttcaatgaaacacatacatcatccatccattatttgctcgcttgctcgtctagtaggcattaccactactcccctcgttccataatattatagcggctctggcacttctc

SEQ ID NO: 3131 - DNA, 318 bp, Triticum aestivum
  Clone ID: LIB3280-056-P1-K1-E7
cccacgcgtacgcccacgcgttctcggacgcgtgggggaagtaacagtataagagctctaggaggtggggcctctggtggtttctgtcttctgctgctgcactgctggtttcaatggactgctactgtgatatccagcaagtcctatcctatgggttctatatcgcttgactccttcttatgtgcatatctgtgaagaggatgactgaccctgtccctgttattttttagccacactcttgcttgtgcgcacgatacactcatgtcggataaactgaccctctatgctgtgctctttttagggggcgccttcactgaa

SEQ ID NO: 3132 - DNA, 423 bp, Triticum aestivum
  Clone ID: LIB3280-056-P1-K1-E8
gttgagtcataccaactccattggccagggatatggggcaatgaaggttaccttgacggccttgctgatgcttatgagcaaggtcttgtaaaatccgttggagtctcaaactacagcgagaaacgtctgcgagatgctcacgagcgcctcaagaagaggggagttccacttgcttcaaaccaagtaaattacagtctgatttacaggaaccctgaggaaaatggggtgaaggcacttgtgatgagcttggtattactttgattgcatattccccaatagcccaaggtgctttgacaggaaaatacactccagctaatcccccaactggacctcgtggacggatatacacttttgactttctgtccaagctccaaccgcttattaacaaaattagggagaatggaggaagctatgacaaaaccc

SEQ ID NO: 3133 - DNA, 375 bp, Triticum aestivum
  Clone ID: LIB3280-056-P1-K1-E9
gaaaaaaggagggctctcacgattgttccatgcttgccgagctctgtgtcttcaactccgagactgaagagtggaaagtcatcgaggaggtgcccgccccgcagccccaggaccagagcaatggcggccagttccccatcctttggtcaaccgacgatgtgctcgcttgtgacggccgtttcctctgctgggtcgactacttgagtggtgtgctgctgtccgacttctccaccaagactgcccggggctccacttcgttcctttccctggaggaaaagagtacagtgaggaggtactcctttcaaggtgctttgcggggagatttcggagtgtgtccaatcaccatggcataatgcgctttgtccacattgacaa

SEQ ID NO: 3134 - DNA, 427 bp, Triticum aestivum
  Clone ID: LIB3280-056-P1-K1-F1
gtctcttacttgatgctggtgaatgatctaattcatgggctttatcctgaagccgtaactatcggtgaagatgatagtggaatgcctacatttgcccttcctgttcaagttggtggggttggttttgactatcgcttacatatggctgttgccgacaaatggattgaacttctcaaaggaaacgatgaagcttgggagatgggtaacattgtgcacacactaacaaacagaaggtggttgaaaagtgtgttacttatgctgaaagtcacgatcaagcacttgttggagacaagacacttgcattctggttgatggacaatgatatgtatgaattcatggctctgaacggaccttctacgcctaatattgatcggggaatagtactgcataaaatgaatagacttatcacaatgggtttaggcggaga

SEQ ID NO: 3135 - DNA, 386 bp, Triticum aestivum
  Clone ID: LIB3280-056-P1-K1-F10
gataatataaggtagatttcattgcgtctttagattgtaccaaaaactcaaaagcaattcaaacatactagtggcacgagcgcaagacaagacccacaaagtgcctcgctgaacataatgaacgtcaatataacagcgacatctcagtctactggactagaaatcaggtgtttgtggccctggtgaagatctgctggctggagggattgacaccatcctgatgagccccctctccatcaggtccttgatggccctgcgagccagtgacccgttgatcctgaggcgctcggagaggacggagggcgtgatctgcttgtacttgggcacctcggtgagcagcttgttcgaggtggcctggtcgaagagcaccgcgttgttcaccttct

SEQ ID NO: 3136 - DNA, 289 bp, Triticum aestivum
  Clone ID: LIB3280-056-P1-K1-F11
atcacgcgtggccgcacaatttcttctttctttgcctctctcacaaacaaacaaacatacggttcttgtctcccattccaatctcgccctgtcggtacaatcacatgttagaagaataagaagaggaatctaaggaacaagaagatggtgtttgcggtgctttgtaccatcctggtgactgtctgctcgacgatcattggacagcatacggtgctgcagatgctgctccaggggttcgtgttcacgtcattgacaggctcgacttctccatcaaggaggccattcgccg

SEQ ID NO: 3137 - DNA, 266 bp, Triticum aestivum
  Clone ID: LIB3280-056-P1-K1-F12
accgggcagaacagcctcgtgtgatcaggccttacgcatcaatagctcctattgagtctggagaaaacaacttaaggccgttatttcatttattttgggtttaaagtggatactgtcagtgctgagttttatccatttgtattccccaatgtcttgaatttcatttttctgtgctactaactctatatttttgttttattatgatattttatattttgtttggttttttgacgagttctttaatattgttgtcacttttgtgattg

SEQ ID NO: 3138 - DNA, 428 bp, Triticum aestivum
  Clone ID: LIB3280-056-P1-K1-F2
cccacgcgtccgcgccctcctccccccttttctctccatctcctcactaatatctctccctttccctgttccgcactgcaggacgccatggccatcgagcaaagctccgtcggaccttcccgaccagatcgacgatgacgacaagcggatctgccccccacgaagaggtagaaagcacgggggaggcggcggcggccccagtgggcgccgacgaagcccgccagcgccgccaggaggatgagccgcctaggatggacacgggccagcgcgaactccaacccccgcccatccccatgcgtacgcgatcagacccccgaggcgatgacggggacgacgcagaatgtcgcgtcacgcccaccgtgatgttggggatcacccccatgtctggatgctcaagctgtgctactgctgctgacccagactgtata

SEQ ID NO: 3139 - DNA, 294 bp, Triticum aestivum
  Clone ID: LIB3280-056-P1-K1-F3
accggtttgaatacccggctcacccacgcgttcgccacaccaggtccgcgttgagatcgagtcccttttttgcgggactgatttttcggagccactgacccgggcgcaggttcgaggagctgaacatccatttggtccgcatgaccctgggacccgtgaagaaggccaaggatgaagcttgcctcgagaagacccaaaatcacgagatggctcttgttggaggcagtaccagaatttccaaggtcctaattcttcttgaggacttactttgacggtaggagcctaataagggtg

SEQ ID NO: 3140 - DNA, 426 bp, Triticum aestivum
  Clone ID: LIB3280-056-P1-K1-F4
cggcgcgtgggcggacgcgtgggcaaatatgtcatttgatgaactactaaaagcctttgcatctaagcatgaagggaatgatatgcctggaaatttgtcaggtggaattcttattgatcaggtttatgccgttgcacccaatgacttgaatacacttcttttctcaccaagttcagactttctgcaatcactagcgaagatgcaagggactaccggtctggatattcaacaatggagacttgaaatgatggtgagatcttgaagagggttataacctacacaaaagctgctactaaactagttaaggccgtgaaagcaacagaagacgtgacatatcttaaggcagatggagatattgatgcagttttaacagatgtcaatacttcctgaagttccctttggcaataatttttagggtggagattt

SEQ ID NO: 3141 - DNA, 424 bp, Triticum aestivum
  Clone ID: LIB3280-056-P1-K1-F5
ggagctgctccctgtggtttatacaccaactgtatgtgaagcctgccagaagtatgggagcatatttaggcgcccacagggtctgtatgtcaacttgagagacaaggggaaggtcattgacgtgctaaggaactggcctgagaggaacattcaagttattgtagtcactgatggtgagcgcattttggggcttggagatatgggttgtcagggaatgggaattcctgtcggcaaactttttcgtacactgcccttggaggagttcgcccgacagcttgcttgcctattacaattgatgttggtactaacaatgagcaattgctcaatgacgagttctacattgggcttcggcaaagacttgctactggagaggagtatcatgaactcacggaagagttcatggtagctgttaaacaaatatatg

SEQ ID NO: 3142 - DNA, 414 bp, Triticum aestivum
  Clone ID: LIB3280-056-P1-K1-F6
cgcacatccggacaaaaaccacccatgaacttgatccaattacaagctgaagcaaatggacgagccgaccgcgctggctctcgacctggccgggctcctcctacaggcggcgggggcaggggttgtgcgcgccacgccgggcgccaggccgttcgtgaccacgtgcaacgagggccacgtccccgagcactgtgtaaaggagctgaggcccagcctgcttgaccaccaaaccacacggacttgaactccacatggagcgcgaaaaacagaggtggtcatgacacacaggggatgttttagatagttgtcttgttgaggaaactgctgaatataactgtgctgggcccatccaccgtcgccctcgtaaccattggaacaatttggcgagccaggccggttttaacatattccata

SEQ ID NO: 3143 - DNA, 388 bp, Triticum aestivum
  Clone ID: LIB3280-056-P1-K1-F7
ctacctcactcccgatctccccaccgcctccacctcctcgcctcctcctcgaccccccgccccctcgcgcgcgcccaccggcccggctccgtggtcaccgcagcggagatggtgttctccgtcacgaagaaggagaccaagccctacgagggccagaagcccggcacctccggcctccgcaagaaggttacagtattccagcagcctcattacctcgcgaatttcgttcaatcaactttaatgccctttcagctgaccaagtaaaaggtgccaccattgttgtctccggcgatgggcgctttttctcaaaggatgctgttcagatcattgcaaaattggctgctgctaatggagtaagacgtgtttgggttggacatgacagtctttt

SEQ ID NO: 3144 - DNA, 416 bp, Triticum aestivum
  Clone ID: LIB3280-056-P1-K1-F8
cccagcgccgccgccgccgcctcctcaaccctagctcgcccgcagcgccgcggcctcctccctcccatcctccccaccggcagccatggcgacggagctggcctacgcgccgcccatgaagtcgggcaagctcgggttcgagggcacgcaggaggtgcagcaccgcatccgcatcaccctctcctccaagtccgtcaagaacctcgagaaggtgtgctcggatctggtgaagggcgccaaggagaagcagctcaaggtcaagggccccgtcaggatgcccaccaaggtgctcaacatcaccaccaggaagtccccctgcggagaagggaccaacacctgggatcggtttgagatgcgggtgcacaagagggtgatcgaccttgtcagctccccaaacgttgcaagcagaacacctc

SEQ ID NO: 3145 - DNA, 72 bp, Triticum aestivum
  Clone ID: LIB3280-056-P1-K1-F9
gtcggttcacaataccccagttctcctccgaggaagaggcattgctaggtcgggcgccgttggcgtttattt

SEQ ID NO: 3146 - DNA, 385 bp, Triticum aestivum
  Clone ID: LIB3280-056-P1-K1-G1
cagcgagcgacctaaacctccgctccgtctccgtctccgagcaaaaccctagcggatccgtcgaccccgcggggaggagggagggggtcctaatatgcatatcttcgtcaagacgctgaccggtaagaccattacgctcgaggtcaagagcagcgacaccattcacaacgtcaaggccaagattcatgacaaggagggcattccttcagatcagcaatgtctaatttttgccggaaagcatttaatgatggtctaacattatctgattacaacattcataaagagtcgacgctccattttgtcctgaagcttaggtgtggaactatgatcaatgtgaaaacactttactgggaaagataatttgagattgttttttgagcccact

SEQ ID NO: 3147 - DNA, 80 bp, Triticum aestivum
  Clone ID: LIB3280-056-P1-K1-G10
ggcagctgatacttctgtctgagaaggtgcgagtatccttatgaacaccttgaccaacatggggtactgcgttcaagaaa

SEQ ID NO: 3148 - DNA, 56 bp, Triticum aestivum
  Clone ID: LIB3280-056-P1-K1-G11
ccttaattcccctctctacccactctatcgggaattcccttcttacacctttacct

SEQ ID NO: 3149 - DNA, 177 bp, Triticum aestivum
  Clone ID: LIB3280-056-P1-K1-G12
ctgacgcgcggacgagcgcactaccttttccttcttttgtaaaacaaaccgggggggctgggaaacagtacacatcctcttcgaacttcagtataggtacccttattgtgctaatggctgattatcctccactactcatgcgccgtccaacaaagataagggttacctcatcgattt

SEQ ID NO: 3150 - DNA, 418 bp, Triticum aestivum
  unsure (1)...(418): unsure at all n locations
  Clone ID: LIB3280-056-P1-K1-G2
agagccttccaccaaactggatcgtgtgtgctcctcccagtacaatntgagggatgagtgacgacggcgactctgacatctgcgatggatgcatcgaggcgatctgctgcgcctttttcgtggattccctcggcggcaagacactcttccgcattgtctgtgctatcgtgatcttcgccgtcctcgccaccggcttcacgctgctcgtcatcgcgttcgtcacgcgccccgtcggcgtcacgtcgaggacgcggccctcgcccgcctcgccctcgccaacaaaaacgccacggtcacggcgctcgcctacgacttctcgctcgccggtcgcgggcgcaaccacaactggatcatgcgcgcccagcacacggcgccggtccacgcggagctgctctttgccgcgctcacttcgaccgcg

SEQ ID NO: 3151 - DNA, 427 bp, Triticum aestivum
  Clone ID: LIB3280-056-P1-K1-G3
tcgaagatcatcaacatgagtgtgatttatactactacaagtgttcaactctgtacgatgttattaaaggtattattgttgtgttgcctatattgataggctccattgggccattagaatggtaatttacctatccggtgccattgacaagagcatgatttatactatagttgtttacctgcgtaagataacacgattttctctgaagtctcagttgtttgtctatttttgtaggcttgcgtcagcttttttcatcgctggggaatttctttcatgactaaataagtgaaaggtgaattattcaaaacaacatacagtgtgaatatgcatcttttgtagtcgagttggaggactttttatcagctgaagcaatcttcgagatatttccttcaaatatttaatccaacttgcatttgcaaattcacat

SEQ ID NO: 3152 - DNA, 223 bp, Triticum aestivum
  Clone ID: LIB3280-056-P1-K1-G4
aagacccttagccgcactcgcatgcctactcccatactcttatatcgagcctggaactcatggactgggctctctccatccacacaggcttaccaagctacagttagcgcctccgtccatcttgtacctgattcggtggcgaacaaaaggaccagggtcgtaatgaagatcgcgtcctaccagaagctctgccagttgctcgtggaggacaccaaggtgctta

SEQ ID NO: 3153 - DNA, 429 bp, Triticum aestivum
  Clone ID: LIB3280-056-P1-K1-G5
caaaaacaaatgaggtgtataaggtggatgagaggggaatactctggttttacactggagatattggccagttccatcctgatggatgcgttgagatcatcgacaggaaaaaagacatagtaaaacttcaacatggagaatatgtatctcttggcaaggttgaatcagctctacagacaagcaattatgtggacaacatcatgggctatgctgatccatttcatagttactgtgttgcactggtctgccaccacaccaggccttggagaagtgggctcaaaattcagggataagctacaaagacattgaggagctgtgttacaatgatcaagcaattaaggaggtgcagcaatctttattaaaggccgtgaaagcagctgaggctcgagaagtttgaaataccaactaagatcattttgttggctgaac

SEQ ID NO: 3154 - DNA, 309 bp, Triticum aestivum
  Clone ID: LIB3280-056-P1-K1-G6
gcaacatctagccagcgatcgagacagcatgaagctcactcaactacccccagacccgagcacaggtagcgtagtcactcggcgcaatcggcatggccagtaagtcggcgtccctgctgatcctcgcggcgctggtggccgcggcgtgcctcgccgggctgggctcggcggctcgcagcgtgccggcggagaagcccgcggaggacgcggtgaaacggccggacacgttccaggaggggacggtgctatccctgggatctggcggtacgagccgggcacccactacatcgcggtcatttggttgtcatg

SEQ ID NO: 3155 - DNA, 418 bp, Triticum aestivum
  Clone ID: LIB3280-056-P1-K1-G7
ggaatttctgtttatagatgtctcagactatcatttccttcctttttgctttacaaaaggcagcatatcactgaaaagccctagtgtgtcatttttcatttataaagcggtggaaaatgtacattggtgcatatgtaatatggtccttgagaaggttagctttatctttggcaacaacgggcatatatggaagcacaggctgcatgctatttaaatcttgcttcatgatattgagttggtacaaaaaaaaccctgagatttggttagtaaacaagaacaagtccaatgttgcttggacatgctatcttctccgttccgtgctttgcaaatcttatcttgtcatggtgaaatgacattcacaatccctgggttggcatatgctgctggagaattatttggtcaaataattggtatatat

SEQ ID NO: 3156 - DNA, 366 bp, Triticum aestivum
  Clone ID: LIB3280-056-P1-K1-G8
cccacgcgtacgcgcctagcctccagagctttccccccttcctctttcccttgccacctgccccgaaaccttcgaccccgagagcctaaaaaattcgagccaacaacacacagagagactgcgacagccccccggcgcgccgggtcctcgccgggctgcgggccgccagcgcatggcatcgtcgcgggtgatggccgcgtcgtcgcagtcgccgccgttcggctcctccgatccgcgcgcttccggagcgccagcggcatcggatccatgaacatggacgacatcctccgcaacatatacggcgaggcgccccccttcgggggccggcgccccggcggaccccgcccccgggccggagggcgactt

SEQ ID NO: 3157 - DNA, 411 bp, Triticum aestivum
  Clone ID: LIB3280-056-P1-K1-G9
ggcagctgctccttctgcctctgccgtttccgtcaggcagaggaatgccgcggcagcatcgctactgctccaggatcagcagcaagaaaagcatgaagccgtggatccggtgccgccgccgccgccgccgccacgatcgacgctgtaccaggcgctgacgtcgacggcgagcctggccaacctgctccccacgggcacggtgctggctttccagctgctcgcgccgaccttcacaaccacggcgcctgcgacgccaccacggcgctgctcacgcggatccttctcggcgtcctcgcgctctgctggctactcggcttctttacccgactcccttaaggggcccgacggtcgggtttactacagcggcgccaccctaaggggccttgggctgcttgactacccggcccgggg

SEQ ID NO: 3158 - DNA, 367 bp, Triticum aestivum
  Clone ID: LIB3280-056-P1-K1-H1
cttcctcctccgacgattgggtggctgccattgctctccagagtccaggccaaccaagctcgagctcccatttcatcaccactctgctagctcgagtctccctcttgattccccgtctgtttctagtctcgcaatcgtcgtcccagtctctttctccgtccaataagaatttctttgggtcgagggagctgctgttcttgctaggctaggctagatctggggggggaggctgggtccgtctccccttgaaatctctgggtattgctgcgcttgaggatcttgctggccatggtttgtccaggcatgctgaggcgcaatctctgagctttatgaagatcgccacttacctgcgccggtgctgctttct

SEQ ID NO: 3159 - DNA, 443 bp, Triticum aestivum
  Clone ID: LIB3280-056-P1-K1-H10
gacgcgacggcatcaactgtaacccgtacctgagcgttgctcatcctcctccttaggtggccgagcggcgcgacggaaggacggagaggcgcctcgttccctgccgcgccgtgcttcgtccgttgccgcgggccgtgcgtccccggccgccgttgtcttcccggccccgcggcggacaccccgagcgttttgtggcagcaggttcggagcccgaccggtgtggagagtggacagcggcagaatgttggagaagaggccggcgagttcagcggcgagaaggtgatcgccgagttcgagcggctgacgcgggacgccgccattgtgcagcgggagacgctgcggcggatcctcgccgagaacggcaacaccgagtacctgcgggggctgggcctcggcggccgtaccgacgccgccagctttaagcaatgcgtgccgctcgccac

SEQ ID NO: 3160 - DNA, 429 bp, Triticum aestivum
  Clone ID: LIB3280-056-P1-K1-H2
cccacgcgttcgcggacgcgtgggcttcgaggatgaaccctaaactcatacggcacagccgatagatatataaaacccagatcgggacctccttcctcgtaattctctgaaattagtccatacaaatcgcattcctgtacctctagatcaactaggacctgacaggcgccagccaggaggttcacgacgcagcccagcagcccgcgaactcggactccaactgcagcaaccgtgcccccgggagacgatccccgggtgcgactatgagtatgagcactggatggtcatcatggagggccccccaggagacgccagcaaccccgacatccaccgtaacgagatcatcgacggctacatcaagaccctcgctcaggtcgtcggaatgtatgctgtccccttaccttacccttgatggtgaagacaaagcaa

SEQ ID NO: 3161 - DNA, 329 bp, Triticum aestivum
  Clone ID: LIB3280-056-P1-K1-H3
ggactgccaaacccacacccatacaagaggcaggcaaggggcaccctcctcaagcctcaagcaaccaacgcagttcttccaccgatatttccttccctcgccggcaccgccgacgatctgcagccatggcaatggcttacaagatggcgacggaggggatgaacatcaaggaggagtgcaagcggtggttcacggagatgaagtggaagaaggtgcaccgcttcgtggtctacaagatcgagagcggacgcgcgccgtgctggtggacaaggtgggcggccccggggaggggtacgacgagctcgttgccgtgctgcccggcgacaact

SEQ ID NO: 3162 - DNA, 438 bp, Triticum aestivum
  Clone ID: LIB3280-056-P1-K1-H4
gcggaaggcaacaactgtagtacgtacgtaagtgtagcttagcctcctcctgtactgcatgccagggcgatgctgaagaagaacacgagctccctgagcttcgtcatggtcgccctcatggtggtcatggctgccacccttctctactcatgcgacgcccgcaaagtgaaggataagcccaccgctttccccgtggcggggaagtgcttctcgaggtttttcgcgaactgcaccgagccgcggtgcaagagttctgcgtccagccactccccggagccgtctgtatcgacaaaaaccattgttgctgccctattgcttagttataagcgccgctgaagcagtcaggctaagaaatactagttaaaggtggcaataagtaatattcgtacacttccaaatatatactacccctgtttctaaatataaggctattttgca

SEQ ID NO: 3163 - DNA, 377 bp, Triticum aestivum
  Clone ID: LIB3280-056-P1-K1-H5
caaccatccacgacacacacagcacggcagcggcgtaaagggaaaactcccgcaagatgtctcagctcgcccgcgctagcctgactgcggtggcgatgctcctcctccttgccgctgctgcggcggcggaggggccagcaggctgccaggacgacgttgtggcgctcaacgaggcctgctaccagtacgtgcagaagggcgcgccgactgtgccgccgtcgcaggagtgctgcgaccccgtgcggcggtggacgtgccctgcgtctgcagctacctgggcagcccccgcgtgagggacaacatcagcatggagaaggtgttctacgtctcccaagcatgcggtgttagcatccctggcaactgcggaggatcgaagg

SEQ ID NO: 3164 - DNA, 283 bp, Triticum aestivum
  Clone ID: LIB3280-056-P1-K1-H6
acgcacacgcgtacgatcgactccgccgttccaacgattatcctctcctccagccatggccggttcctcggctcctcttctactcttactctacctcgccgtcgtctccccggtggcagcgcgcgccgaggacctactcgtcgcggcccgcgcgccggagaccgccgcgtggctgcgcggcgtgcggcggctcatccaccagcgcccggagctggccttccaggagcaccgcaccagcgagctcgttcgcgggagctcgacgccatcggcgtcccctacgcgt

SEQ ID NO: 3165 - DNA, 327 bp, Triticum aestivum
  Clone ID: LIB3280-056-P1-K1-H7
ctctctctccctacccgcaaccgtccaagacttgcaacagctcgccgaccgcagcaacgtgacacagactccgcattgcggaaggagaggaggggagaggaggcacgcggtatgaagacgaggcgcggtgcgtgctactcctgtcatgagccggcggccgaggcgcctgagatgcaccgtcggaagaggcggagaacggccatggaggtggtggggtgtgctggtgctgccttagagacttgatcgaggacctgccggatgatctggtggtgttcatacttgctgatgtggtcgcgatcgccttctcgtcgggcgacctttgctgtg

SEQ ID NO: 3166 - DNA, 283 bp, Triticum aestivum
  Clone ID: LIB3280-056-P1-K1-H8
gcaatctatgctcccgcaaaactaatgcatttttttatcctggcaaatttgtgcatttttttccttttttgtgattatttgagatggcaaagtttagtgtcctagcaaattaagctctattttttcctgccactttatgcattattttattttatcataaattattttttatatcctgatggtatttttttagggatacatcttgatggtgtttaaaaaaaaggaaataacgctacatgggcctagcccgttccaccttttttcttcgcgcacttccctggct

SEQ ID NO: 3167 - DNA, 330 bp, Triticum aestivum
  Clone ID: LIB3280-056-P1-K1-H9
cttttctttgccagctgcactacagtgtctcaagaggaagagattatatgagcaacaggtggagcagcttgggaatttccaattgaggattcatgatcagatgataatgctggaaggtgcaaaagctacaacagagactgtggatgcattgagaaccggagcatcatcaatgaaagctatgcacaaatcaacaaatattgatgatgttgacaaaaccatggatgaaattaatacattatggagaacatgaggcagatccaggatctactgtctgcgcctatgggagcagcaagtggatttctatgaagaatgagctgagaagcctgaact

SEQ ID NO: 3168 - DNA, 415 bp, Triticum aestivum
  Clone ID: LIB3280-057-P1-K1-A1
catcaacccattgagcacttggtgagcttccgtgcgatgccaaacatgctgatgttccgtcctgctgatggcaaggagactgccggggcatacaaggtggctgtcctcaacaggaagaggccatctattctggctctctccaggcaaaagcttcctcatctgcctggtacctcaattgagggcgttgcgaagggtggatacactatctctgacaactcgaccgacaacaagcctgacttcatcataatgagcactggttctgaggtagagattgctgtgaaggctgccgaagagttgacgaaggaggggaagactgtccgcgttgagtcatttgtctgctgggagcttttcgacgagcagtcagatgaatacaaggagagcgtgctccctgaggctgtcaccgcaaggatcagca

SEQ ID NO: 3169 - DNA, 254 bp, Triticum aestivum
  Clone ID: LIB3280-057-P1-K1-A10
cacacccgtgggcactagctgccctatcactcatatgtgacttctcctctcctcccgtccatgtgaccgggtcatggctcgttttcttcacataagtcactagcgctttaccttacacgatgtcagaggcttcgccgtgtcaagggtcagaaggcgtaacagaaacttccacccctcccgcgtcgtgcagttctagaggcaccccatagcgttattgcacaaggggtttatctaggacgcggagtgttaccaca

SEQ ID NO: 3170 - DNA, 326 bp, Triticum aestivum
  Clone ID: LIB3280-057-P1-K1-A11
attgcctgctatgtgacgatcaggggtgagaaggcaatgcatcttctcgagagtgggctgaaggtgaaggagtactagctcttgaggaggaacttcagtgacactggttgctttgggtttggtattcaggagcacattgatcttggcatgaagtatgacccattaaccggcatctatggtatggacttttttggggttctggagcgagcttgataccgtgtcttccagcggcgccgatgcaaggcccgtgttgggatccaccaaaaggtgaccaaggaagacgccatgaagtggttccaggtcaagtttgagggtgtcattctgaa

SEQ ID NO: 3171 - DNA, 426 bp, Triticum aestivum
  Clone ID: LIB3280-057-P1-K1-A12
gtcatggctcgcatttgccgcccaaaaggtcgttgaggtgaacgcccttgccaaggcattggctggtcaaaaggatgaggcttacttctctgcaaatgctgctgctctggcctcaagaaggtcgtcaccacgtgtcacaaatgaggaggtccagaaggctgccaccgccctcaagggctctgatcaccgtcgcgctaccaccgttagcgctaggttggatgcgcagcaaaagaagcttaaccttccgatccttcccacgaccaccattggttcattcccacagacagtggagcttaagagagtccgccgtgagtacaaggcaaagaagatctctgaggaggagtacaccaatgccatcaaggaggagattagcaaggttgtttagatccaagaagagcttgacatcgatgtgcttgggcacggaga

SEQ ID NO: 3172 - DNA, 443 bp, Triticum aestivum
  Clone ID: LIB3280-057-P1-K1-A2
cgcattgcttgcagaaccaaacaggctagaggtgttgcaattggataatgaaattgttttcaatgaggctatcatcgaggaaagggaccaggcgattcaagacatccaacagcagattggtgaagtacatgaagcatttaaggatcttgctacgctcgtgcatgcgcaaggaggcataatagaggaagtcgacagcaacattgaaaactctgcagccgcgaccagtgaagcgaagaaagaaatcggcaaagcgtccaagactcagaagtcaaattcatccttgctttgcctgcttatggtgatctttggggttgttttgcttatcgtgataatagttttggcatcttgagacacggatgcttagaggcctattggtgccctctgaggagccatattacgtgcaagattaatcctcgctgtgcgccgaagactgtcgctaactg

SEQ ID NO: 3173 - DNA, 439 bp, Triticum aestivum
  Clone ID: LIB3280-057-P1-K1-A3
cccattcccatcagcctgaaaaggagttagcaagtgaggatgctactcttttgccaaatcaagaccttgttggttgggccgccgtggagaacatgcccagcaaggatgctgatgtcaattcatccaatagcaaagatgaagatgacacaactgaggaaacgcctgcattttctactcctacagttataattcgcagtgctgctgactgtgatgctcaagatgttgcaaatggtcctactaagaaacgttcaaaggcggcaagttctaaggttgcaaagccatcccctagagcatctaaaccaaccaaagaacagcaggaggctaggaaagctacccctaagaaagcgtcaactacgtcaactgccaagaaaagtaagaaagaaaaggctgatgattctgcaagtaatgggctcgataaagggaaggctgatgattctgc

SEQ ID NO: 3174 - DNA, 370 bp, Triticum aestivum
  Clone ID: LIB3280-057-P1-K1-A4
atcgatcctcccgcgtgccaagccaccgaccaacatggcagcgtctctccaagccgcggctacgctgatgccggccaagatcggcggccgggcctcctccgcgcggccgtcgtcgcacgtcgcccgggcgttcggcgtcgacgctggcgccaggatcacctgctccctgcagtccgacatcagggaggtcgcaagcaagtgcgccgacgccgccaagatggccggcttcgccctcgccacctctgcccttctcgtcttcggcgcgagcgcggagggggcgcccaagaggctgaccttcgacgagatccagaacaagacctacatggaggtgaagggttccggcaccgcgaaccaatgcccgaccattgac

SEQ ID NO: 3175 - DNA, 385 bp, Triticum aestivum
  Clone ID: LIB3280-057-P1-K1-A5
atcccaaaccccagcgacgaccatgactccccaagccctcctcctcctcctcctcgccgccgccgtcgccgtcgccgccgtctgcgcggccccggcgaacggcgcggcgaacgacctcctgcccaagtacggcctccccaagggcctcatcccggactcggtctccttctacaccttcgacgaggccacgggcgacttcgagatccacctcgcgggcacctgctacgtccgcttcggcgaccacctcgtctactacgagaagaccctccgcggctgcctctccaaggggcggatcaccggcctcgccggcatccaggccaagaagctcttcctctgggtctccgtctccggcatcgtcgcgcaccccgcggagggcaccctctag

SEQ ID NO: 3176 - DNA, 401 bp, Triticum aestivum
  Clone ID: LIB3280-057-P1-K1-A7
gacgccaccgtcgtcgcgttcggcgctccgtggaaagaagagaaaacccaccgtcagccatggcgaactcggcgtcgggcatggccgtgagcgacgagtgcaagctcaggttccaggagctcaaggcgaagcgaaccttccggttcatcacgttcaagatcaacgagcagtcgcagcaggtggtggtggaccgggtggggcaaccgggcgagacctacgccgacttcaccgccaccatccccagccgacgagtgccgctacgccgtcttcgactttgacttcgtcaccgacgagaactgccagaagagcaagatcttcttcatctgctggtccccggacacgtccagggtgaggagcaagatgctgtacgcgagctccaaggacaggttcaagagggagct

SEQ ID NO: 3177 - DNA, 406 bp, Triticum aestivum
  Clone ID: LIB3280-057-P1-K1-A9
cacgccgccctctcttcttttgctgccgcaccggctgtctctctccctccaaaccctaaccggcgcccgcctccctgccccatcgtcgtacagatccaaccccacgccggcgtcatctccttcgcccagtcggctgccgccgcaccgcacgaggtgggatgccatgccccagccgtctcctcggcctgcttcaccgtcgagctcgctcgtcatgtcgttgggagggaaggaagatggtgttgctcttatcgaggtgcaccgccgtgacgtcaacgggaggaggccaagcgaagcgcgacatccactcatccacatcccatcctttcttgctcacaccatcctatctccctcccagatccaccacgcagctctgtagctcgctcgggcgctcggacgccgacgccat

SEQ ID NO: 3178 - DNA, 269 bp, Triticum aestivum
  Clone ID: LIB3280-057-P1-K1-B10
cccacgcttgcgtggacccttggccggccccatggttcgcactgcttctgtcggacataggggagcagtgatcgtgtaccattcctcagagacactggttctgcaagtgtttagcattatcaacgagacagcctgagattcctactatgataaacgtcacctgttgacatcacgcgttctcgtaacaaggggaaactagttgtgagcgtacggggcggatgccaactcttgcccagccggcaccggaggagtccaatcacttgtgcaga

SEQ ID NO: 3179 - DNA, 380 bp, Triticum aestivum
  Clone ID: LIB3280-057-P1-K1-B11
ggcggcggagaaacctcggcgacccgacgacggcgcaggctgactccggttcggcgtggtaaatctgcagcgacagtcagatcaaggcaaggatgggtcggaaagctgggttgtacataaactcaaagaagtttggcggcgtcattaagccgggcatgctggagatgacggccttcctcaactgcctcgccttgaacaagcagatcgatgagaagtgcacgaggcataaggagctcttgatcacctgttcccaggctcagaagggcaggccgaagaacgcggccaagaccatcaattaccatcttcagaggcttgggcgggacaaggttcactagttggagcggaaactctctccctatttttattgccctgacgtctgg

SEQ ID NO: 3180 - DNA, 430 bp, Triticum aestivum
  Clone ID: LIB3280-057-P1-K1-B12
gttcaagtaccgcgtcgagctccgccgcattcctctactggtccgaccgggcaacgcgtcgctccccgcactggagacctgccgggccgccgacttcgcgcgggacgtctggtccggccggtggacgcggctcgccaggaacgacaggtgcgtggatgtggacgacgccggccgctaccggtgcctggagccggagcacccatgcgaggcaccgtggtgcgacgggccactggacgcgctggagagcaacggatgggtctactcggcgcactgctcgttcaagctcttcaccggcgacgcggcgtggcggtgccttgacggcaagtggctcttcttctggggcgattccaaccatgtcgacaccatccgcaaccttctgaccttcggtcttggcgttgaggacacattcgcagtgacacgccggtttgac

SEQ ID NO: 3181 - DNA, 458 bp, Triticum aestivum
  Clone ID: LIB3280-057-P1-K1-B2
gcttgctcgcgtcgtgctgcaattgagatcgactcgtcggtggccgacccctcggcggcgagcaccggggttagggtttaggggcctggatccatggctcggcccatgggatccagcggcttcgaggctgccctagccgtgtgccccgccgccgcccaggcctactccaagtactgcggtattgtatctggatgcacaaatgcgaacccaagggaagggttggcggatctttcacgaactatagataatatggaaggaatgagggatggaatatttggtgatattcacaagctcatgtcagttcttgagttcgatgatgtgagccaattcaattccttctatgattttgtcttcttcatttctcgtgaaaatggccaaaagaatattactgttcagaaggctcttgcagcatggaggatagttcttgttggaaggttccgattgcttgaccggtggtg

SEQ ID NO: 3182 - DNA, 245 bp, Triticum aestivum
  Clone ID: LIB3280-057-P1-K1-B3
gtgaccaaggctgccatcaagaagaaatgaggcgtttacctgaatccatctatgtctgcttttgagatctctagtagtttagtgcctattaagttttgctactgttagcgccgtgtgatatgcgccctgttgatgtgtcatttgagtactgtcgttaattttggcttttggcaaaacatggaagcttctgagactactcatttttatcctctgctttggaatgttaggctgctacttttagtctt

SEQ ID NO: 3183 - DNA, 414 bp, Triticum aestivum
  Clone ID: LIB3280-057-P1-K1-B4
cccacgcgtccgcggacgcgtgggttcacccccaggtcattcagcctccgccgaggcagaccattcaccggaggtagaggggaaacgcgcaacagccatggcctcgctccgcatcctttcagtgatcgccgtggtcgccatctttgccctcgccggcaccgccgtctccaatgacctccccgactacattgttcagggacgggtctactgcgacacgtgccgtgccgggttcgagacaaatgttaccgagtacatcaagggtgccacggtgaggcttgagtgcaagcgcttccgcactgagaaaggtgagcgcttcattgtcggcgtaaccgaccagaagggtactttacaaaatctagctcaaggacagccattcgtgggatatttgggagattgcctttgttcatagcctcc

SEQ ID NO: 3184 - DNA, 239 bp, Triticum aestivum
  Clone ID: LIB3280-057-P1-K1-B5
cccacgcgtgcgccgacgactagcatcaaaccaccttcgtacagtcctcatgatgcaatatgtgttaccgaaagtataccgagcccgaaccagaggggctgcggcgaggcgcatgcaatatgctactcatggaggcactaatccggcagctaccgcgacatactacgtcatgaaatacctgatgacttgcgggactactcattcaactgggaatcgtgacattgcccgtgatggcactt

SEQ ID NO: 3185 - DNA, 420 bp, Triticum aestivum
  Clone ID: LIB3280-057-P1-K1-B6
gtctgactcgtctccacctctccgccggaagaacccggcgagggccagcgccgtacatatatcccgacctcagcggaaccctacctttgagaaaccccttctccgtcactatccaagctctgcctgcaccgccgccattactactagaggaagcttcaactgttgtgctcttgctctctagctaatagtggttgctatcggtgctactaccgccgccgtccaaaccctagccctgatgccgcagcaggaggtgcccgaccagatcgccgtaaggtggttcgcggtggaggcgccggagcgaacggggagtctccagaggagcggctccaacagccgcctcaacgcgcaggcgccggaattcgtgccgcgggtcgcggcggtggttccaccggcacagccaccggcggcagtgattcgtgt

SEQ ID NO: 3186 - DNA, 258 bp, Triticum aestivum
  Clone ID: LIB3280-057-P1-K1-B7
cggtgcgtgggcggacgcgtgggcggacgcgtgggtggtgtggcttcctgttggacatagatcgttctctaatctgcaccttagatttgtgacacagattgttttattgtgatgttgctttgaacaaggaatgggcgatgctctaccactaggattgagtgatgaccacatacataattagtcccaggagaaatataaagtgttcctaggtgtgcttggtatgcagtgaccacctttgcgccaacaacagatggacat

SEQ ID NO: 3187 - DNA, 121 bp, Triticum aestivum
  Clone ID: LIB3280-057-P1-K1-B8
cggaccctggccggccccttgggcggacgcgaaggtggtgtggctccctagcggacatagatcctaactctcagccataccttaccatttgagacactcatagtcttactgtatacgctgc

SEQ ID NO: 3188 - DNA, 455 bp, Triticum aestivum
  Clone ID: LIB3280-057-P1-K1-B9
cgaccgttcatggttaacgacgacggacacaaccgctcgcactgcatctccccatcgtaggcgagctctgctcatgtgtgaatcttcatcgtctctggtactgcaagtgtttgcgtttccacagagacatactttgaaccctaaatttctccccgccacatgttgacggcgcgtgtttccctaacaccggttgcatcttcttgagcgtcatggccagatgccgcctcgtccccagccgccaccggcggcgtacaagcacttctgcagagtctgcaacaaggggttcacgtgcggcagcgcgctcggcgggcacatgagggcccacgccgtcgccgacgacagcccgggcgccgacgacgacgacgacgatcccgtgtcgtctgcgcgcggcggggaagatgggccgtccacggcaggagcagcgacgacgcacgtctacgcgctccgggcgaacc

SEQ ID NO: 3189 - DNA, 458 bp, Triticum aestivum
  Clone ID: LIB3280-057-P1-K1-C1
ggtaatccaatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaagggcagcgccttccaccgcgtgatccccgacttcatgtgccagggcggcgacttcacccggggcaacggcaccggcggcgagtccatctacggcgagaagttcgccgacgagaagttcgtccacaagcacaccaagcccgggatcctctccatggccaacgcggggcccaacaccaacggctcccagttcttcatctgcaccgtcccctgcaattggctcga

SEQ ID NO: 3190 - DNA, 257 bp, Triticum aestivum
  Clone ID: LIB3280-057-P1-K1-C10
atcacagggagggatgcattggcagtacaggtcaagagactttgcaggatcaggaggagtacctgtacttgtggatggggcccgctctttacaatggtggcagccgttgtgtgaagtacttgtcagtgaccactccaaagtgttgggcggtcgattctgaggctaatacgcgggagacggatggcagctacaatgcctatgtcgtggaagtcgggtcaagcgtgatttatcatcgaggtctccattggatcaaggac

SEQ ID NO: 3191 - DNA, 398 bp, Triticum aestivum
  Clone ID: LIB3280-057-P1-K1-C11
aaaaaaggggtgcatttaacaacatatcatggccatttcatgctaaggttcacagagtagatagctactccagcagttgactctcataaagctttggcgacgcaactgtctctagagaagaccctaatgaccacgcaaactgtttactttcaaatggtgttgctatatacatgatcttttagtgaacaacttattaaggtgcatacggcaactgcacctgtggtcacaaatcttggagaaatgtatcgtcaagcacatactggtgccattatgtcagagttggctagaatcgctgttgaaaactcactgtctgataagctggacagtgttcgacaacaattacaggtaaagcttgtgaaaagttaaaaggaataccggaacatatttgttgtacaaca

SEQ ID NO: 3192 - DNA, 443 bp, Triticum aestivum
  Clone ID: LIB3280-057-P1-K1-C12
cggacgcgtgggtttttttggaagaagaagagtaattcaaagtgcaattaatcaatttgatggagacgctcctggatggaggcctacgtgcgtcgccggagaggtgggcggggcgacagctcgtagttacgtacgtacgcggtgtagtagtgacgcgctcacgcggactgcttctagtcgctgcggagcttgtgcttgccggacgccttcttgtggggcttctcggcgttaccgtccgccttgccgccggcggcctccggctgtgcgtccttgtgcccctgcgagacggtgtttgacacctgctgctgcttgttgccagccgccaagccatccaggtcctcggggtcgacggagctgatccgtatgaccagagggccgtcggaggacatggggttattgaactcgttgcataacttcctgacctcgccgttcttgccggtgat

SEQ ID NO: 3193 - DNA, 429 bp, Triticum aestivum
  Clone ID: LIB3280-057-P1-K1-C3
acgcaacctgccatttttttttcctggcgacttcatcaaagtgctacggtaaaagcatgcttccaaaagctattccgagatgatcatatatgttgaagcatgtgaaagtggcagtatctttgagggattaatgccacaagaccttaatatttatgttacaacagcagcaaatgcggaagaaagtagctagggagcatactgccctgggatggaaacaccagctcctcctgaatgtatgacctgcttgggtgacgcatacagggtttcttggatggaagacagtgaaactcacaatctacacaaggaaaccatcaagcaacagtacgaggtggttaaagcaagaacggcacccccaaatgactccaatatcggttctcatgtcatggagtatgtgaacaagacattcaaagatgacaagcttttccttta

SEQ ID NO: 3194 - DNA, 294 bp, Triticum aestivum
  Clone ID: LIB3280-057-P1-K1-C4
cgatagcatatgcagatgaagctgagcatggtttggcagctgcagagtacccctggccgcatgctggcatccttagctcgtatgatcacgcatcaatccgccgtggacatcaagtttaccagcaagtgtgtgcatcttgccactccatgtcattgattccataccgtgatttggttggggtggcctatactgaggaggaaactaaggcaaaggctgctgaaatcgaagtggttgacgggcctaatgatcaacgctcaagtgttcacactttgtggccagctgagtgatcgtttt

SEQ ID NO: 3195 - DNA, 438 bp, Triticum aestivum
  Clone ID: LIB3280-057-P1-K1-C5
gcgcgaagcatgaacaggtctccaccgccggcccgtgggctaagcatcaccacgtcaccgacgcctgcctgtgcgcgaaacatgatcaggtcaccaccgcctcctcgcgccagaagcatcaagaaggcaccaccgtcaggccgtgaacggagctatagcaggtccccagcacagccacccgagcgtgaggagtccccttatgctgataacgcgtgagcacttggttccacaatgctagaagtgttggggggcgggggcctccacttgtttccttgaatgtttcggtatgactattgaatggccaggcggccgagtattgttcttcggtggcattagtgttcttttgctgctgatacaattgcggaagcgggatttcttttgactgtatgactctaacgtatgtaggtggtcttgagacaagatatgttttctttttct

SEQ ID NO: 3196 - DNA, 418 bp, Triticum aestivum
  Clone ID: LIB3280-057-P1-K1-C6
gcagaagcaggcaacaggcgagcaggaaggaagcaagagaggtggagatggcgcccatcaagctgtacgggatgatgctgtcggccaacgtgacccgcgtgaccacgctgctcaacgagctcggcctcgagttcgacttcgtcgacgtcgacctccgcaccggcgcccacaagcaccccgacttcctgaagctcaaccctttcggccagatccccgcgctgcaggacggagacgaagttgtcttcgagtcgcgcgccatcaaccggtacatcgtgaccaagtacggggcgttcctgctgccgacgccgtcggccaagctggaggcgtggctggaggtggagtctcaccacttctacccggcggcgcggacgctggtgtacgagctggtcatcaagcccatgctgggcgcccccaccga

SEQ ID NO: 3197 - DNA, 329 bp, Triticum aestivum
  Clone ID: LIB3280-057-P1-K1-C7
agaacaccgagggatgcacccagaggaccatcccagctgtccccacggttggtgatgccagggatgactggaagatcgtccgtgctctttccgaggttgccggggctccactgccttacgacagcgtcacagctgtgaggagccggatcagcatggtggccccaaaccttgtgcgcgtcgatgagagggagccgtcggtgatctctgccgaggtgaagcctccggtgaagcagcaagtgagccctgccccattcaaagctgccgtggagaacttctacatgaccgacgcgatcacgcgggctttcaagaacatggctcagtgcagcgca

SEQ ID NO: 3198 - DNA, 474 bp, Triticum aestivum
  Clone ID: LIB3280-057-P1-K1-C8
attcgaccacgcctcacgcgtccgctgagagggaaagatggatcaggagttcatttcatgagtctcaactgccttaccggagagaacattcaaatagtgagtgtgcacgcacttgcacatcgtgaccgggcttctccatcttatatctatcccctgtctgacaaacatgaaaaggtatatcgtgtcactcataaacttcgcccggttggtaatcttctgagtgtattggagcatgaggtttctagcataatagctcgcgctcttgccatatctgaagagcgtcggccggataccacagtcgcgaatgaggcggaggatgccaggaaggagcatactaaaacaatggagaaatcttatagctgtctatctgaaagttctatcggctcatcaccatggtcatgtatagatgctgaagcaaagcattcatcttctatttcatcatattcatctggcgaccttttctggtatgataca

SEQ ID NO: 3199 - DNA, 232 bp, Triticum aestivum
  Clone ID: LIB3280-057-P1-K1-C9
tactcagtgcgggtttttatgttcgtaggaagcaccttatttttcactgcaaattcttatatcactacaaattgatcggaagtgccttatttctccatgagatactgtaatcaatgaactgagagagctagtcggaaactgtttagcactgcatcctgtgtttgctttgggggaagctgattgaggactagttccatgtgttgcttcatttgcgatgtacgtgattcatcat

SEQ ID NO: 3200 - DNA, 449 bp, Triticum aestivum
  unsure (1)...(449): unsure at all n locations
  Clone ID: LIB3280-057-P1-K1-D1
attcctagctccactggtgcagcaaaggctgttgggaaagttctccctgagctaaatggaaagcttactggcatggctttccgagttccaacaccaaatgtctctgtggttgacttgacctgccggcttgagaaaagtgcctcttatgatgatgtgaaagcagccatcaaggcggcatcagagggtgcactgaaaggcattttaggctacacagatgaggatgtggtatccaacgattttgttggtgacacaaggtcaagtgtatttgatgctaatgctggcatggggctgagctcttccttcatgaagctcgtgtcgtggtacgacaacgagtggggctacagcaaccgggttcttgatctcatcgcccacatggctcttgtctccgccaagcactgatcacctncgagtgctactaataggctgcaattttgccggttcttttattt

SEQ ID NO: 3201 - DNA, 452 bp, Triticum aestivum
  Clone ID: LIB3280-057-P1-K1-D10
cctccccccttctctctctctgacgactcgctagctagctcctccggcccaacggaagctagcgatcgccatagcctctgcgactgccagcacccgcactcgaacaagaagaagaagaagaatcagaagcagaagcagaattattagaggcgcaaaggcttgcgtgcggtctcaaggaaccacgaaaaggccgagaagaaaagaggataaaaggtaggtagttgagtagtatttcacgcgtccatgggttgcgggctgtcgacgccggacaacgatggcggcggcggcgagggcgcgcggaggaaacaggggagcgtcggcgatgtcgtcgtcttcgtcccgggcctccgggcgcccatgggcgtggacttgtcccaggcgctcgcggggcgcctggacaagagcgccgtggagaggctgtcggccctgagagcgcgcgtcgtcaacatggc

SEQ ID NO: 3202 - DNA, 227 bp, Triticum aestivum
  Clone ID: LIB3280-057-P1-K1-D11
gctctaagttgatatgtgtatgaagactctctagctagttactaaagcccagcggaaggtggggatctgcatgctctgtgcgactgtcagcaccctcactacaacaataagaagatgaataacctgcagcagaagtagaatgattagatgtcgccaagctggcgtgcgggctaaaggtaccacgtattgtccgagaataaaagaggataaggggttggtagatgagt

SEQ ID NO: 3203 - DNA, 438 bp, Triticum aestivum
  unsure (1)...(438): unsure at all n locations
  Clone ID: LIB3280-057-P1-K1-D12
caaatttctacgatatatgttacacctgtaatctcaataatcaaagcaagatcatgttccaacatggcttctattctgtcttctgttttagaaacttcacactaaagcagcgacaagtaatatggaccggagggagtagtaatttttgtctatttaaagactgcaatcctataggaatgtttttcctatatatatgtttggaacagggaatgagtttctaggatttttacggagtgactctcaacagttcctctcgtgcattcatataggctcgcagtcatatatcattaggccctacacttgtctgatttgctctgttgtgtcttcgacacaattgagctgtaagtgtgcccttgctctctgaaggaaataaatgaatgcatgttattgattgttccccactacccaatgttntcatacatgggaagagcttcatgc

SEQ ID NO: 3204 - DNA, 432 bp, Triticum aestivum
  Clone ID: LIB3280-057-P1-K1-D2
aggactcgtggggacgctgcagagcctgtgaaggggaaggtcaatgttagtttcatcgacgaggtggctaagctcaatccaatgtacatttcagaaactgaagcattcaatgtccactctgagtccatgctagactacaacatgttcatggaaaaagaagtccttgaacaatcatcgtatctaatgaatgatgagttgcaccatccagcgcgacataataggagttcagctccaacgatgccagtggcgatacagtgctcatgtctgaaatagaccaacatttgaacaatctgcttcaaactaaggtgggtgctgatatgacattcgacgtcagtggcgagatgctcgctgcgcaccgatgtgtgcttgcagcccggtctaaagtcttcatggcacaactctttggccccatgaatgagggcactactacat

SEQ ID NO: 3205 - DNA, 437 bp, Triticum aestivum
  Clone ID: LIB3280-057-P1-K1-D3
cttctcttcacacaggacgaacaagaaccctaatccccaaatcctccagcccactctcagatcttgggacctgatccctaaatcggaccatggatcgactatgcggaagcatggcttgagatcctgtcgatcccggatgtggcgggcagcggcgacgaagcggcggcggtctggaagctcgccggcaggacaggaaaagagcagcggcgtctgacttactagccgtcagccgtagaaccggcgttgatagccacttccattgtggccgctccctgcttcagtagactgattggcttgcacacagatgaaccgctccaagaacggggcaacctgcgttgctgaccttacagatgaccttatcatcgagattctgtgcctgctgccagtcaaagaagagtgccgattcaagtgtgtctcccggcttctgtacagtctca

SEQ ID NO: 3206 - DNA, 436 bp, Triticum aestivum
  Clone ID: LIB3280-057-P1-K1-D4
tctttttcgatttctagggtctgctcatcctcatccccatcccctccgccgtcgccttccccgcctccgaccaaattcgtggtttttgattgatttccggacggaagatatgatccccaactccttcgacaccttcctgtgatctcatctgtccccgaatccagccaccaaaagaagccatactatggtgcgccgccgcccgtcaccgccagatttctcctcctgctcctcctcgacgccgatgctccacaagaacctacgggcgctcggccccggcctcaatccgtgtgcccccttcggcatgggcaactactcccgctaatccctattccccccctccctcatcccctgtgctcaatttctgatttgcttttctccggacccgatttgcttctcccccccttctcgttcttgattggattggattggattggat

SEQ ID NO: 3207 - DNA, 459 bp, Triticum aestivum
  Clone ID: LIB3280-057-P1-K1-D5
cggacgcgtggggacctgcggttacaccaagctcctgctggccattccaaggattcttgagcttgctgaggagttgtccctgccacttgctgctgtgaagtactcccgtgggacattcatattccctgaggcacagccttctccacacaagaacttctctgatgaggttgccttcctgaatggctactttggtggactcaagtctggcggcaatgcctatgtcattggtgatcctgcaaagccaggccagaagtggcatgtctactatgccacccagcagcctgagcagcccatggtcaaccttgagatgtgcatgactggtctggacaagaagaaagcttctgtcttcttcaagacctctgctgatggctacacatcttgtgccaaggagatgaccaaactctctggcatctctgaaataatcccggagatggagatctgtgactttgatttcgagcc

SEQ ID NO: 3208 - DNA, 452 bp, Triticum aestivum
  Clone ID: LIB3280-057-P1-K1-D7
gttcttcggtacgatgctcctggcgtgtttgatgaaatgtctataacatgatatgttactcattctctctttccttctcggttggttcttgggtcctccatgtcgttagccatcaaggttgggttccttcccactcccttgctcaatttttgcctactgaaagcgatgtgtgttgatgtgttggttttgacaacatccccgtgtgatctttgttggcatatcaaacgaggatatttgatggcatacccgctggatttggacgattggtgtgatctccgttcagtttgtcatgctcctttgtatgcagtctgcagaagcagtcaagacggtgaagatctgctgcatatgagttggctacgtccgcggcccaacaatggttgtcattgccatcaagtgcccaacaattgaagtggtggttgtcgacatctccaagccccgcattcacgcctggg

SEQ ID NO: 3209 - DNA, 448 bp, Triticum aestivum
  Clone ID: LIB3280-057-P1-K1-D8
ccaagggctgtctaccctagcatagttggtcgccctcggcacactggtgttatggtagggatggggcagaaggatgcctatgttggtgatgaggcgcagtccaagagaggtatcctcacactcaagtacccgatcgagcacggtatcgtaagcaactgtgatgacatggagaaaatctggcatcacaccttttacaatgagctccgtgtggcacccgaagagcaccctgtgttgctcactgaggctcctttgaacccaaaagccaacagagagaagatgacccagattatgtttgagactttcaatgttcctgccatgtacgtcgcaattcaagccgagctttccctctatgcaagaggtcgtactactggtatcgttctcgactctggtgatggtgtcagccacaccgtgcccatttacgaaggatacgcgctttctcatgccattc

SEQ ID NO: 3210 - DNA, 339 bp, Triticum aestivum
  Clone ID: LIB3280-057-P1-K1-D9
ctcgagaggggggctgcggagggaggagggcagggcgcacactctaggcgagggaggggaggaggactacaagataggagagagaggctgtgggccatgggcatcggcagagggctgcagcatggccagaagcattagaaggggcagttgtaaccaagtggcagccgtagatagagccatccatctatctttctatacagatcgcggttaggagatcagcgagcacgcccagatttctccctttccggatcaatcttatccgacaggataatgagccgtcgtccaggttcttttagcgattggagggggaggagaaaccatgatgctggagggcaaatc

SEQ ID NO: 3211 - DNA, 323 bp, Triticum aestivum
  Clone ID: LIB3280-057-P1-K1-E1
cccacgcgtccggcagaagctaattctgaggcagacgcgtaaaaacgcagaatcagcgggtgattcttccccggttgctctttctgctttctcggcatttctccttggtgccatctcaaaaagtgttgcaacaatcttgacttacccattaatcaggtgcaaggtcatgattcaagctgcagaccccgatgaggacgacgaggacgaatctgaaaagccaggcaattcaaggcctcccaaaacaatgttgggcgccatgcatgcaatgtggaacaaggaaggcatcccagggttcttcaaagggttacatgctcagatactaa

SEQ ID NO: 3212 - DNA, 285 bp, Triticum aestivum
  Clone ID: LIB3280-057-P1-K1-E10
ggcacgcgtccggtcaccatctcgtgggatcgtccaggaacatctactagcttatgaaaatgaaacccactcgaatcggtagccacatttataagatggtggcaccacgcgtgctgctacagatgacattagccaccttagcaccagcgcttgggggcgtagcatcttcggtgaggactactcggacattgttctgactgggaaggatcttgtgaacagtggtgacgacaactatctgacacactacgatgcgcacggacgcgtcgccctacatccttgattaca

SEQ ID NO: 3213 - DNA, 441 bp, Triticum aestivum
  Clone ID: LIB3280-057-P1-K1-E11
ctctgcacttgaagaattagcccacaaggagttacaaaggcttctccaaccttacgaagagataaggaagcggaagatcaactctttcttgaagtggagcatccccgaattggatgcgtcgagccttgacgccttggccactgacgcagtctttggggaggtcgggaaccaaggcgctgtttcggtcgcaacgaccaccaagcacccctggcaccggcccggctgcacttgcatagtgtgcatccagccgcccagcggtaaggggcctaagcacaacccggcgtgcacttgcaacgtgtgcatgaccgtcaggcgccgtttcaagacgctcatgatgaggaagaagcaacggcagtcggagcgagaggaggccgaggcgagcaagatgatcgcttgggtgggcagagacgagcccgaaagaagcaacctgtcgcggtcccc

SEQ ID NO: 3214 - DNA, 455 bp, Triticum aestivum
  Clone ID: LIB3280-057-P1-K1-E12
cccacgcgttcgggtaaatgggtctagaaacttgttgaaactgtgtgattttggtagtgctttgcctgccggaataaatgatatcacaccaattcttgtgagccgcttctaccgggcacctgagataattcttggattgccgtacgaccattcattggatatgtggtcagtaggctgttgcctatatgaactttacacaggaaaaatcttatttcctggtgggaagaacaatggcatgctttggcttcacatggaattgaagggtccattccctaagaagatgcttcgaaagggagcctttacaactcaacactttgaccaggaccttaatttccatgccactgatgagaatctgatgatgaaaaaggctgtgaacaaactgtgtatgaacgttaaaccaaagggtgttggcggaaaaatatcaagcttcgcaggcgaggatccgaaaatgctgt

SEQ ID NO: 3215 - DNA, 399 bp, Triticum aestivum
  Clone ID: LIB3280-057-P1-K1-E2
cacttccggcgtacgtttctatgctgaagtttcaagaccgtttgcatgctcatgaatactttcacaaggctgctgcaagggctatcaggtgttacatgaaattacatgattctccattaaaatcatctgctgaggagaatgatgagttgtcaaaactgccagctgcccagaggaagaagttgaggcagaaacagaagaaggcacaagctcgagctaaaagggtaacctacagaactttgttttagatgtatcactagctagtctgccttaatttgcccttaaatctccccaggaggctgaagaaaaacaagaggatgaaacaacttcaaccaacagttcgaaatctggtgagaaacaacaagcaaggccagttgatttggacccacacggtgaaaaatt

SEQ ID NO: 3216 - DNA, 376 bp, Triticum aestivum
  Clone ID: LIB3280-057-P1-K1-E3
cccacgcgtccgctcatattggaagctataaagaagcttaaggagtcttccggatcaaataaaacggccatcgcttcatacattgaggagcaatactggccacctgctgattttcaacgcttactatcaacaaaattgaaggcactggttgctactggaaaattgatgaagtccaaccaaaaatacagaattgcaccgagttcagtctcgttaggtggaaggagcaccaaggtgcactcaacagaagacgacaaacaaaatatttgtattagacaactaactaagcctcaagtggatgctgaactggatatgatgacacacatgaataaggaagaggcagcagcatttgctgccaaggcagttgctgaggcaaaag

SEQ ID NO: 3217 - DNA, 452 bp, Triticum aestivum
  Clone ID: LIB3280-057-P1-K1-E4
gagggtttacatgtggcgtgcgaaaacgcactcggtcgatatgatgccactgcttacaacacaatactcaggaatgcgaggccgaaaggcatcaacaagaatggccctcctgagcacaaactgtttggattcacctacctccggttatcgaatgagctactggagggacagaactatgccactttccaaacttttgttgagaaaatgcatgctaacctgggtcatgacccaagtgttgatccagtggcgcctttggaaagatcaaagccagaaatgccaattgaaatgatcctgaaagcagcgcagccaaaactggagccattcccctttgataagaataccgacctgccagttaaagatcacactgatgtcggagatgaggtgctcgttgcccctgtgtagaaatctttctctatcttcataaaataatgtgcatcactgatgcagtctac

SEQ ID NO: 3218 - DNA, 452 bp, Triticum aestivum
  Clone ID: LIB3280-057-P1-K1-E5
cgtttctgccgtacacccacttgcagttcagttggcggagggttaacggccaccaagaggctgacggcgagccagccgcagtgctcactactgctcggcggcaacgatttatgcatcattgtggacttgcagttcgccggtgatccactatttccttttttgtttgtcatttgaagtggtctcggccgaggacacagtgccttttcttttgcagtcattcacttgtattagcacaaactacgattcgctaacatggccagttttggtttagctttgttttcgtttcaattacaaagaaaatcgctaccctgttaaacacttattaggatatttagatttgcaaagtggtgctaccagataatgtgatgtacaaagtggtttacgcatttgtgatgtaaaaaaaatgagatatatgtttgttagttgattaacatggcactttcttagtatat

SEQ ID NO: 3219 - DNA, 453 bp, Triticum aestivum
  Clone ID: LIB3280-057-P1-K1-E7
ggccatcccatgctcgccgcaaccgtgcgcgactacaggatgaagctggtggacagaagaagaaagggagaggtgttctaaaaggttttaaagcatctaagaagcgttttgccaatggatctgcaaagctaaatattacattctctgaaaaattgggtggtacagtaggaatgaactatcgttcgttcaaggatgacgtggttgtcataatcaaaagaaagttaccactcattggagtgaggacgtggtcggacattcaccctaccattcatcgactcattgttgcagatataatagacagatgggacctggaagatacaccagaaacagaagaaaaagttctcaaaattgcgaaagagagatatagaggctggcgatcaactctaagctccacttacaaggcatacaaaacagatgcagctagattggctaatctttctgaagattacaacc

SEQ ID NO: 3220 - DNA, 403 bp, Triticum aestivum
  unsure (1)...(403): unsure at all n locations
  Clone ID: LIB3280-057-P1-K1-E8
cccacgcgtccgcccacgcgtccgcccacgcgttcgcgagcagctactagctagcagcgatcaagccaagctaagcttagccacgacaaagatatggctgcgcttggcgtcctcctcgtgacgatggcagcagccatggtagcagcggctgcggcagcagcagcaacggcgagggctcctcgtcccttcttcgtgttcggcgactccctggtggacagcggcaacaacaactacctggccaccacggcgcgcgccgactcgccgccctacggnctcgactacccgacccaccgcgccaccggccgcttcttcaacggcctcaacgtccccgacatcatcagcgagcacctcggggccgagcccgtgctagcctaccttagcccccacctcgacggccacaagc

SEQ ID NO: 3221 - DNA, 281 bp, Triticum aestivum
  Clone ID: LIB3280-057-P1-K1-E9
cccacgcgttcgcttaaaccaacgtgtatgcataactgagcgaatactagctagaacagagcaagccgggctatgctgaaccacgacatacatttggctgtacgtgtggtactactagtgacgatagcatcagccatagtatcagcggctgactcagtagtagtgacggagagggctactcatacctcaagggtgacctgcgactccctgttggacagctgttacaacaactacctggccgccacagcgcgcgccgactcgttcgcctacagccttgacta

SEQ ID NO: 3222 - DNA, 345 bp, Triticum aestivum
  Clone ID: LIB3280-057-P1-K1-F1
tccacacacatccactccgctagagccgacaccggtctcagtccgagagaagagggcaagaggccatggcgagcgagcgcaatggcgacgggggcaaggagcgcgccggggagaacggcaacggcggcggcgtgtccttggagctgccggagatcaggtacacaaagctcttcatcaacggggccttcgtcgacgccgtctccggtaagacattcgagaccagggatccgcggaccggggatgtgatcgccagtatcgccgaaggtgacaaggaggatgtggacctggccgtcaaagccgcaagagaagccttcgatcatggcaaatggcctcgcatgcccggat

SEQ ID NO: 3223 - DNA, 362 bp, Triticum aestivum
  Clone ID: LIB3280-057-P1-K1-F10
gtggaggttccgtaggaccctaaccccttctacctggccgctgctagccgacccggatctacgcattcagatcgccgagacgcccccctatggagtagctggtgtcctcaccgccggacccaacctgtggggcctattcatccagtcagatgactctttaccgacgggaccccctctcggcggtgctacctcgtcactggtcactctcgggatcaggtggatgttcacctgttctttgattgaagacaactaactttgcttgtcctgatggcaagaagtaatgatccgaccaggctccaaagagtcacaattttatgataactatgtgcagaaagtctattctcagcccattggagtaactt

SEQ ID NO: 3224 - DNA, 458 bp, Triticum aestivum
  Clone ID: LIB3280-057-P1-K1-F11
gcggcgctcgctggatggcatggtggaggtggtagagggtggcggaggcggagcagtcaagggcctcggcgccgtgcgtgtggtggggcagaaagtggaaggggaagggtgacgccatccagagaaggaggcagaggatctaaaggatcgagcctgcccctcacgcaaggtgtgcgggtgatagtttgttcagcagcatggaccatgccatgaaattggtgacggcaagactcccagactcatatgacaaaaaggaaggagttgtaggagatggaaccactggtgggtggtagaatttttttctgttgagggcgacagtgtgtaggagcaacctttcctttttaggacaatgtgtggacatgaatttacttttttggggtgtgtgctccaggggactagccagccaacgggtggtggctagtcgtgtcctaagtcaaatgggtctgaaactttttgca

SEQ ID NO: 3225 - DNA, 424 bp, Triticum aestivum
  Clone ID: LIB3280-057-P1-K1-F12
ggaacgcatattactcttatttatatacatatacatgtggtgcactccattcggaagcgcatatgcacacctatttatgcttgctacataaaaagtagccacaaacacaaatctgctcaaaagaacggaaaaaaccaacacacagaattgcagagcattaattcaactcaagagctccttcccgaaaagcccagcaatggctcgcccaggatcttcttccttgatcagggactctcctaccaaaacagcagaaacgccagcactatgcacatatgcaacatcgtcgggagtgaacaggccagattcaccaacaaccaatattcccttctcctttatgatatcaccacgcttctccatcaacatccttgtgtttgaagtatcaactacgaatgtctctagactgcggttattgattccaataagc

SEQ ID NO: 3226 - DNA, 432 bp, Triticum aestivum
  Clone ID: LIB3280-057-P1-K1-F2
tccagacacatgcactcacatagagccggcaccatattcagtgcaagcgacgaatgaacgagggcactttgcgcagagcaccatgccgtgtggccgcagtgctcctcagaacaaacgggacaaaatgtggcgggcgctcttggcttcctaaacccataccaactgtgctgtgagacctgtgagcaactactactcagcttggcgcaagacattataggcgcatagtatggaatcgctgcatgttgagaacctggaatataatgacgcaaaagaaattgtgggactgagagcctgggataccatcgtactgcagtgcaagcaaattatgtgaactcggggtgccatgccatgccatgggctgtccttcaacgaggtgggtatgctaaagtttcatgagttccgaggtagaaagacggctagttctgacggaaa

SEQ ID NO: 3227 - DNA, 412 bp, Triticum aestivum
  Clone ID: LIB3280-057-P1-K1-F3
atatgttagcagtgcattttcttttaagtcatgtaactcgctctttaaaaaaacttaaaagaaatttggctgatttgtgacgaacgaggactatcatgtattaacaagtttcttgtagtgaattatgtgtgatgttgctgattatgttgtaagggctgttctatgacaaagagttgataagaaattaaatgttatctaatatgctagtcaaactctagacattgtccaaataaattatgctactatagaaaaataatttttagcagctgtatttgtttgtgatcagttcagaccttatattgttgattctaaagtaactgtttacactgatcatgctgggattaaatatgttatggaaaagaaggatgctaacactagacttattagatggattttcttgctacaagaattt

SEQ ID NO: 3228 - DNA, 418 bp, Triticum aestivum
  Clone ID: LIB3280-057-P1-K1-F4
ccacagccccactcgtagagagcacgcgcaccggacacgcacgaagtctcctcgaccagcgagcaatggcgaccaccgcgatggcgctctccccctcgtccttcgccgggaaggcggtgaaggacctgccgtcgtcggcgctcttcggggaggcgcgcgtcaccatgcgcaagaccgcggccaaggccaagccggtgtcgtccggcagcccgtggtacggctccgaccgcgtgctctacctcggcccgctctccggcgaccccccgagctacctcaccggtgagttccccggcgactacgggtgggacaccgcggggctgtcggccgaccccgagaccttcggcaagaaccgggagctggaggtgatccactgccggtgggccatgctggacgctctcggctgcgtattccccgagct

SEQ ID NO: 3229 - DNA, 446 bp, Triticum aestivum
  Clone ID: LIB3280-057-P1-K1-F5
cccacgcgtccgtttctgtctgcctccgagagtgaaacccaagccagagcacaagatcctcactggtactagtggagctagctagcctagcagacatggccaccgcctgcaccatgtgcctgctccccatctcgcacctcaagcatatgcaacagcagcggcacacgcggctcgacggcgcgctccccgggaaggtgctcgtgctcggccagccggaagcgccacgtcgtgccgcgggcgcggctgtttggtccggccatcttcgaggcgttcaagctcaaggtgctgttcgtgggggtggatgaggagaagcacccgggcaagctgccgcggacctacacgctcacccacagggacgtgacggcgcggctgacgctggcggtgtcgcacaccatccacgccgcgcaggtgcagggctggtacaaccggctgcagcgggacgaggt

SEQ ID NO: 3230 - DNA, 365 bp, Triticum aestivum
  Clone ID: LIB3280-057-P1-K1-F6
cccacgcgtccgcggacgcgtggggccgcctcgccgtcgccgttcctcgcgacctcaccgccggtcgccagccggagcccggatcccagcctcctggcgcccgcgcctctccttcccgcccggtcggacagccctctggtccagccgcgcctacctgcccacgcccctgcttgcgcgcggccgcgcccctgccgtcggccggaagcctggcgcccctgccctcgccccgctgcaagtttggcggcagccactgccgctcagtcaccacaccagtcttcgggattgaagaccaccctgtcatccgttatgccgccgggctcacggagaagggcgctaccctttcatgaacaccgcatcggcggggc

SEQ ID NO: 3231 - DNA, 143 bp, Triticum aestivum
  Clone ID: LIB3280-057-P1-K1-F7
gtggaggtggaggtgggcgctcacgccgtagagcgagttttgagtggccgcagtggtggtttcgtcaactcttcaagcagaggtggcgcctttggtgattcccgcttccctcgttcatgtggtgggttcggtcgttcacgctg

SEQ ID NO: 3232 - DNA, 440 bp, Triticum aestivum
  Clone ID: LIB3280-057-P1-K1-F8
gtggaggtggagggggccacttacgcggtagccgccgccgtgggaagcacacgccgccggcgccgttgggagcacgcgccccctcgtccagaccgccccgctgcagggcccgatttcgacgccctgcatgcccccatcaatgagcttccaaggcggtcgtgaaggccatataggtctccgtgaattagctcgggtccgcgcgggtgacggcgaactgcgtcgcgccaggccccatgccaggaagctccatgccgccgcgcttgacggagtagctgctcccagcgctggccgttgaccgcgcctgaacatgcttggatcttgtgcagggtggctgttgttgaactctgcgatttgagtctgatttcgttctttcctggttctgttctgcaatctactgcatacgtggatggatgaactcacgcctccttaaatctttgcga

SEQ ID NO: 3233 - DNA, 429 bp, Triticum aestivum
  Clone ID: LIB3280-057-P1-K1-F9
gtgcacctgccggcggccagccatgatgtcggagctcgcactccgccgcggccgagctccaccccgacatacacccatccttgcactccgctccccctcccctcgagctccatcccgagatcgagcggtcgtcctcgcgatccacatccagccgccgccctcgcgatccacatccaaccgccgttctcgcccctcccctgacatccagccgtgagcctcgccaatccccgtccctgctactggcgggcttcatctctgggctcccgcagctgccgcacctgcttttgtcgggactccatatccgagctcccgctgctgccagatctgctgctactggacctgctgctgccggggctgcatcttctgtgctgcgcccctcccgaagacagccgtgccctgagattgctcgggccctgatacaccttgatg

SEQ ID NO: 3234 - DNA, 422 bp, Triticum aestivum
  Clone ID: LIB3280-057-P1-K1-G1
cccacgcgtccgcccacgcgtccgcccacgcgtccgttcctgccgccgcccgccgccgccgccgcccatggctctccgccgcgccatcggatcccttgtcgttcgctcccaggcctactacctccgccgcgctgcggcctcacctccgccgtccttcagccgcccgatcatcccctaccggtccttcgccgctccgcctcagcatgccaagaaggtcaccaagggcgacgacgccgacgccgggcccaggatcaacaacgacatcaccgctcccttcctcaggctcgtcaccgacgaagggcatagcgttgtccccaggcatgaggctcttcagctcgctgccaggatgggcttggacttggttgaggtccacagaaaaacagatccttctgtttgcaagatcatggactttcacaaagaga

SEQ ID NO: 3235 - DNA, 385 bp, Triticum aestivum
  Clone ID: LIB3280-057-P1-K1-G10
ctcactcatccatcctttagtaggtccgagcaggcctcctctaattgaccatcaggggcgggctgggctcttctgcgttccaagacatcgatcataccttgttatggagctttctaggtgtgagggcacgccagccccatggctgagctgctgtcatgcatgggtccaattgctggctgcgacaggtacagtggcaccgacgagttaacgacaaatgaggtgactggcgcggacatcgtcgcgagttggtagctatgggactcgaaggaaccggtcttgtcagctgttacagatgccgttcttagagcgagccgatcgtgcctgctgctcgtccccaaaatggtcttcctttaacgcattccatctggaagagcctgggcatcag

SEQ ID NO: 3236 - DNA, 457 bp, Triticum aestivum
  Clone ID: LIB3280-057-P1-K1-G11
tcgctcgagcatgcaatgatacgcaactctccgattctggcggagtacttgggaggcgccggaaacagcgacgcttaccacatgactaatccgagaccagttggctgcggcgtgtctgtgtgcatcagacagagccttgaagacgcaggcgtcacaccagaggaggtcaattacataaatgctcatgcaaccttaacctccgccggagatcttgcataggtgaatgctttgaagcaagtttttaaggacccatctcggattaaactgaacgcaaccaagttaatgatagggcattccctatgcgcagcaagcagtttggaggccatcgttaccatcaaagccataaccaccggatgggtgcatcctactataaaccaatttaacccaaagtcggcagttgatcaatttgacacggttgcggagtgtgaagcaacaacacgaagtacacgttggtatt

SEQ ID NO: 3237 - DNA, 456 bp, Triticum aestivum
  Clone ID: LIB3280-057-P1-K1-G12
gcacgcacaaagggagccaccacacccatgcatccatcacgcacgcacaaaggcctccgtccttgggaactcacgcacacatccatccatacatcaaccacgcacgtagaaaacacatgcacgccgacaggctctacgcgcatcagccaaagctctcgccctcaagcacgccgccaactccacgcctcttttttccgcttctcaatcttcaccgtaaaagtttcgtcgaccgcggacgacgccgaagctttatcaacatgctgatctttgccaaaaccgttggccttgatggtgagttataagatctgatcgcatcaatgagctttgtgtgatggaagaagaatgatgtctacttggctatttcataaatctttatcatggcacgaccgcttcatcaaagtcgaccatgtaaaaatattcaaccatggcacgaccgtctcatcaaagtcgcccatg

SEQ ID NO: 3238 - DNA, 411 bp, Triticum aestivum
  Clone ID: LIB3280-057-P1-K1-G2
atcgttcaagatggaactgtgcatcctctgacaagctatgtgattaattatgttaaattcctatttgattatcagtcgacgctgaagcttctgtttcaggaattcgaaactggtagtgagacagaatctcagcttgctgttgttactacgaggataatgcaagcactacagaataacctagatggaaaatctaaacaatataaggatcctgcgctaactcacttatttcttatgaacaatgttcactatatggttagatctgttcgcagatcataagcaaaggatatacttggcgatgactggattcagaggcaccgtataattgtgcagcaaaatgccaatcaatacaaacgtgttgcttgggcaaaggttcttcaagcactttccgtacaaggagcgccaggcagtact

SEQ ID NO: 3239 - DNA, 406 bp, Triticum aestivum
  Clone ID: LIB3280-057-P1-K1-G3
cttcgagcgcctcctactgtctcgccctcgccccccgtcccctcgtcggcgcccgatctaagtcaagatgagtcgtggcgggagtgctggtggtggtcaaagttctctgggttacctgtttggagatggtgagcctgcaaagcctcgctgcagcaccagctgcgaagcccgcacctgctgagaaaccagcaccggcagctgctgatgtagccaagcagattccagctggcattccaggtagccgggcgaacaactactaccgtgcagatggccagaacacgggcaactttcttacggaccgttcttcaaccaaagttcatgctgctcctggcggtggctcctccctgggctacttgtttggcggaaagtgatgttaatgatgctgcttaatgaacgaacgatgaat

SEQ ID NO: 3240 - DNA, 464 bp, Triticum aestivum
  Clone ID: LIB3280-057-P1-K1-G4
cccgcttcgccggagcacgccgcacccccgccggtgacctcgaccccaggcctgacctacctccgccgccctctcctttcttctccctccattctctgctcatttctcctctcccctgcagtgccctccatcgccgccatgggagttcgtcggagccggagctccctcggcgccgccctcgcctcccgccgctggatttggccggaaacggagccgccacctccagatccattgtcctccactgcctggcgtccgtccctgacctcctccgccgcccctcatcagagatcgtgccgccgccgctctctagtttgatcgggagatcctcgatccacctccagcgccgttgaccgcagcccccgcccgcgtgggccacgccttccctgcggtcctagcagcgccaagccggatactgctccaccgagccggcccatgaggcctgcttcggtttcgttccggagttg

SEQ ID NO: 3241 - DNA, 420 bp, Triticum aestivum
  unsure (1)...(420): unsure at all n locations
  Clone ID: LIB3280-057-P1-K1-G5
ctcgtctctcccccactcgttcttctccatcccacaacgccccactcccctctccagctatggatgcagatggcatcgaggccaccaccgggcctcccgactcctctttcttccacgggctcagctcagcgctcgcccaatccctcgcgcacgccgcgacccacaccggctccagcgcctctccttctccttcttcatgtcttctcctcaccttcttagcttttttcccttgttcatgcagggagcacaaaaggagcctcgcctgtggaagtggatccgaccgtccccgacctcgtctactcctcccgtcgccggatttgacgcgcctcctgccggatccgtcctaatcggactcgtctactcctccccgtggccggatttgacgcgccgncgccagatccgnctncatcggaccggatc

SEQ ID NO: 3242 - DNA, 462 bp, Triticum aestivum
  Clone ID: LIB3280-057-P1-K1-G6
gctactcaagaaggtcgcaacctgtccaacttcaaatatgcatgtgctggatattccatatacctagatgacaaggatagctctacagtgaagggagagaagcatgcagagctccctatctgtgttggagttgagctattgacagacagagctccaactaaacaagctccagctcacgtgactaaacaagctccagctcacatgaaaaaagatgctactcaagcacatgggcacaaacctgcgctgacacaagccgatttcataaccaaatttcagaggaatgctgggcttgtggccagtggtgtggttaggaacatgaataaagttgggacttacgtcaaagacactgtggatgacatcctgtacccataccgcaagcgtcccaagtaaaacccagctcttgttcttcttaaatcctggagtagaatagagaaaaaatgtgggagcatgtaacctattact

SEQ ID NO: 3243 - DNA, 335 bp, Triticum aestivum
  Clone ID: LIB3280-057-P1-K1-G7
cccacgcgtccgaaccctagcagatcggtcgagccctccgccgccgccccgccttcagctctctccttccttctccgatccaagatgaagttcattgctgcctatctgcttgcttacctctctggcaacgccagcccctctgcagaggacctgacatccattcttgagtctgttggttgtgaaatcgacaatgagaagatggaactcatgctgtcccaagtgaagggcaaggacatcaccgagctcttggctgctggtagggagaagtttgctgcggttccatctggtggggggggtgtggctgtttcagctgctgcccctgctgctggaggtgc

SEQ ID NO: 3244 - DNA, 414 bp, Triticum aestivum
  Clone ID: LIB3280-057-P1-K1-G8
cccacgcgtccgaccactcgtccgcgcgaaccggtcgtctgacatgtagccaatgagagggaatggccaattttctgcttcaagacttgggagggattcagggatggagatttctccaggagatgggatgagcaacctgcactcgtactctgaacaccaaggcctcaaaaatatgtcaccggcagtgattgatgttgagaaaggtcaaggcgaagccagtgtgagataggcatatatgatccgcgtatattgattccaagatttcattcaacccattaagctggagtttttctgtcactggtatgagctgaggatgatgtatgatgtaatgtacccgcaattgctttaatggcgacagtggcgtagctaggatttcaaaccaaggggagctgataataattgatgggttcaatt

SEQ ID NO: 3245 - DNA, 401 bp, Triticum aestivum
  Clone ID: LIB3280-057-P1-K1-G9
ctcactgggagtgctccagatctgtgtcgggagagggggaattcttgagatcgtgaatcggaacaagcggtcgcgctcgggatcagggttaccatacaattttttccaggaacctttagtgaatgtgctaatggagtcaaagggtgagcaaaaagtctagcagtcgtagttccctgatgtacgaaactcccctcggctacagcattgaaaacgttcgacctgctggaggcgccaagaagttctctgcttgatactctaactgggcgaagaagccattctgatatcgtttttggcatccccttccctgaatttaagatttttatgcaattttattctgactcttttcttccaccaatctctttgggctgcttgacgataatcgaccagttctctagtcttac

SEQ ID NO: 3246 - DNA, 430 bp, Triticum aestivum
  Clone ID: LIB3280-057-P1-K1-H1
gcgggaggagatccaaagggcggacatggcggcggcgaaagcggcgttggagaagatgagggcgttctgggactcgcagtgcaacaacgaggagaactgggcggtcaactataaggtgctaaaggctgctggtatatttgctggatccgtcttcctgatgcacaactttggccataatatggtcatctaaacgggactagatagggcaataatggacattcaatggtgtggtgttgcactgcctttttcgttttctcatcaacatggtcatcacacatgttcttagtgtggattaaggagtgaaactgttgttcttagacattggttggtaataatggcagccaaaatagtactttatatgtattactctatcaggtgttctcatgctttgtgaattatcaggcaagtcgtcgcaaacttgttggggatc

SEQ ID NO: 3247 - DNA, 433 bp, Triticum aestivum
  unsure (1)...(433): unsure at all n locations
  Clone ID: LIB3280-057-P1-K1-H10
gtgccggtccggattctcgntcgaccgacgacccacgccttcgaccacgcgttcgtgtgactccatcattgccagcgcgcgcagcagccactacacacagtatggatccgacgatctccgccgacgtcgtgacggaagccacaccgactcctgcttccatggccgtgctaaaccaaatggtttgctcgagcgcgccggcgccaatcatcaccgtcgtatccaagcagttggttctgccggagggcacagcgccggttgaagacctgaacctgtccagctccgacatgcccatgctgtcgtgccactacattcataagggtctcttgttcccggccacgggcatgcccaatgcccggctcatgtcttcactcgcactgtcactgtcccgcgcgctcggcgttttcccggcgctcgcgggacggctcgtcacgct

SEQ ID NO: 3248 - DNA, 299 bp, Triticum aestivum
  Clone ID: LIB3280-057-P1-K1-H11
acgccaagatccatgacaaggaggtcatccttccatatcagctctgtagactgtttaccgacagggatcttgtgggcttcacgcaagtcgatatagtgctgatgctattaaagcacggatgtataatattggtattgctgctggcgtacagtcaatgacagggaacaaagctaatcttgtcgagaaaagcaatcccaaaggtgtgctttttgctcaaacacgtgattgccttctcccaataggccttacctgcgaaaatggtgcacaacggtttggcataacacgcattgagcaagatc

SEQ ID NO: 3249 - DNA, 367 bp, Triticum aestivum
  Clone ID: LIB3280-057-P1-K1-H12
cccacgcgtccgcttttccatttccatgagtggatgctcagatcaccccacaccaagtgtgctccgctctgctctgctcgcacgactcatccagcattttccatccgctttcttctagccccattgccgcatgcatcactgattaggtgatggtgcactaactagctgcgtacctggggtcgattatccgtgtcactccggggcgcacacagacacaggagcaagggcatatgctcttactaggttgttgcgctggcgcctttggcaatgtatatatagggctgcacaggtctctgctgctaataccttcacagagctagccgcagaaaaacacttacaaaatcaggatgggtggtgccggcggcgc

SEQ ID NO: 3250 - DNA, 452 bp, Triticum aestivum
  Clone ID: LIB3280-057-P1-K1-H2
gaccgcaccaccaccgctccccatctcgatctaaagccgagggtttcgtccagctccgtcgccgcgacccaagccagagccagccccaccccagccagccagccatgccgaagaacaagggtaagggaggcaagaaccgcaagaggggcaagaacgaggccgacgacgacaagcgcgagctggtgttcaaggaggacgggcaggagtacgcgcaggtgacgcggatgctcggcaacgggcgctgcgaggccatctgcgtcgacggcaccaagcgcctctgccacatccggggcaagatgcacaagaaggtctggatcgccgccggggacatcgtcctcgtcggcctccgcgactaccaggacgacaaggccgacgtcatcctcaagtacatgaacgacgaggcccgcctgctcaaggcctacggagagctccccgacacgctccagcttaac

SEQ ID NO: 3251 - DNA, 445 bp, Triticum aestivum
  Clone ID: LIB3280-057-P1-K1-H3
cctaagagggcaactgagcaaaaccgttggccagccatgacaagtgggcgtgggcctgccaatcttatgccgaatactgaactttctgacaaatctagcaaaccagtgactttgtcaaacacttctagagggctttcaccaaagaagatttctgcttctgaagacacaggtaaaaggttgaatcaatcactggatgacgtggcaaggagactagctattcatgcaaaaagaagagatgaacagttagattctggtagtgatgtttattcacagacaacggaaagatctaaatatgtgagccgtccaagcaggacaaccactttgcctgttcctgttcttcatcgctcatcatcaccaaacaaggtcttgtcagctgcatcctctgcttctagggcttttcagagtccatcgaggacaagaccttcaacaccttgccggtcacaaa

SEQ ID NO: 3252 - DNA, 321 bp, Triticum aestivum
  Clone ID: LIB3280-057-P1-K1-H4
acccacgcgtccgctcaacatctcggccgtgtggaagctgcccgccatactgatctgcgagaacaaccatgacgggatgggaacggctgattggagggcggccaatagcccttcctactacaagcgtggtgactatgtgcctggattgaaggtcgacggaatggatgttcttgctgagaaacaggcatgcaaatttgcgaaggagcatgccattgcaaatggcccaattgttcttgaaatggacacgtataggtaccacggccactctatgtcagatccaggaagcacttaccgcaccagggatgagatcctcggtgtacg

SEQ ID NO: 3253 - DNA, 412 bp, Triticum aestivum
  Clone ID: LIB3280-057-P1-K1-H5
gccaagatccaggacaaggagggcatccctccggatcagcagcgtctcatctttgccggcaagcagcttgaggatggccggaccttggccgactacaacatccagaaggagtccacactccacctggtgctgaggctccgtggcggcatgcagatcttcgtcaagaccctgaccggcaagaccatcaccctggaggtcgagtcctttgacaccattgacaacgtgaaggccaagatccaggacaaggagggcattcctccggaccagcagcgtctcatctttgccggcaagcagcttgaggatggccggaccctggctgactacaacatccagaaggagtccacactccacctggtgctcaagctccgtttctgcatgcagatctttgttaagaccctggccggtgagacca

SEQ ID NO: 3254 - DNA, 445 bp, Triticum aestivum
  Clone ID: LIB3280-057-P1-K1-H6
cggacgcgtgggttcccggaagaattccccaattaaaagatctctctctctctctctctctctcgtcacatccacctcactcgctcgctccctgctgccattccgcggccggacatgtcgtcgtcgggggccggcgaggagggcgccgccgcgccgcaagggccgctgcccgtggagcaccgcaagggcgccaacggcctcgacaaggtcgtcctccgcgaggcccggcgcatctccgccgaggtgtacctgtatggtggccatgtaacatcatggaaagatgagcatggggaggagctgcttttcgttagtaataaggctattttcaaacctccaaaagctatacgtggaggtataccaatctgctttcctcagttttccaacttcggacagctggaagctcatggtattgcaaggaacaagatctggagtgttgacactgatc

SEQ ID NO: 3255 - DNA, 383 bp, Triticum aestivum
  Clone ID: LIB3280-057-P1-K1-H7
cccacgcgtccgcaactgtagggtcgtccctcgccaagaactagccaccgccgccgcctcgcggccttcgcttacaagcctcgaggtctcgggcgtcaaccgaagcaacggcagcatgaagcgcctgctcagacggctgtcccgcgtggccgcggccgacgcctgcgcagccgccgcgtaccagccgctccggcccgactccgcggggaaagccttctccacggcttcatcttcgtcctcctcgttcttcggcgcgcgaaggctcggccgcggcgcgcgggtgccggaggggcacgtgccggtgtgcgtaggcaaagagggcggccccgtggagcgctttgccgagcgggccgagctcctgggccagtcggcgattaaggccc

SEQ ID NO: 3256 - DNA, 422 bp, Triticum aestivum
  Clone ID: LIB3280-057-P1-K1-H8
ctgaagccaaaggaaaggtggggactttcttggtgaaaaacgcgtgtctgtagcgggcgtgaggacttcgcttacagacctatctgggtctatcgataaccgaagcagcggctccaagaatcgtgtgggtacacacatgccctgcgcggccgatatctacggcagtccgatcgtgggatccagccggctggcgattgcttctcgacggcagttttcttcacggccgaattcagcttctactatgagctcggagccagtaagctctaacgcagaaccaagatattggtggggtatcaaccggttcatttatttgaactgttaaggccagtccagggttttataaagcgggcctgggttcggatgagatcagcaagttttgcttttttaaagcgtataggtttgagcaccccaaacaactgggt

SEQ ID NO: 3257 - DNA, 409 bp, Triticum aestivum
  Clone ID: LIB3280-057-P1-K1-H9
cccacctcctcctctccctcccgcgatcccctgtgcctcgcacgccgccaccgctcgccctcacgccgcctccgcctcagctcgccctcgcgccgctgccgcctctgcccccgctcgccctcgctccgctgtcgccttcgcctccgctcgccctcatctctgctcattaggaggagcgcggctcaccgctggacctcgcgagagaggtcagggttagggtctcggcccggggtggctactgcggagctcctggcgggctacctgctctgcctgctcgcgcttgcggtggccaaggcgaccacgctgctctgggtcatgcatcgtcgcttcactccacgatgccatgttgcttccccgcgccttcttccggttcttcagggagaagaggatgcataccaagtaaggcttt

SEQ ID NO: 3258 - DNA, 332 bp, Triticum aestivum
  Clone ID: LIB3280-058-P1-K1-A1
cctgtccgaacgatccgatccgatctcgtcggattccttccagaattcaaaccgattgcggcagagtttgttggccagccgcctcctaatccaactccccgacccgagcaacgccgcgtgctatttcttccttccgcctccgtgttgtagcgggacatcggcggccattatttgatccgctgcaggcgcatccagagccctgcggcgtcttctagtctagaatggccggcgtcgggtcggcggtgcggcggctctacctctccgtctacaactgggtcgtcttcgtcggatgggcgcaggtgctctacttacgcggcacggcgctgctggac

SEQ ID NO: 3259 - DNA, 398 bp, Triticum aestivum
  Clone ID: LIB3280-058-P1-K1-A10
gaacatgaatgtcgtctctattaatacagatgataatgccaattactccatatttcctactaggttaaaaccaatgcaactttgcacaccttttcattcataaactcggatctttgtttacaaccacgactagaacatgaaaaaacatccacatgcctttcctgaggttcctgacgtagtttatctgctactatctcctaacatttagatatgatcacggagaccttcggtgccgggacttgttacctttggctatgctaccctttggctttcacatgacgtccttcaggccattcgagatactatggtaaaacttgtggaattctggggtatcgccattcgacttgcgggctccaccatgtagagtgagggtgtcacttaaaaacctttgtgcaatt

SEQ ID NO: 3260 - DNA, 456 bp, Triticum aestivum
  Clone ID: LIB3280-058-P1-K1-A11
cccacgcgtccggcgcaccgcggccccccttccctccctccttccctccgatcgccggcgctcgccccgtcaaccgcaccgccacccctctgcccggccttctaccaggtgtgacggaggaggagcctcgcgcgggaggcagagttgcgagcgcacgtccgtgcgtcgccggccatggaccataaggatgagcactccgcccaccccgaccaggaggtcgaggaggaggaggatgaggaggccaagcgcgccgtcgtgctcggcccccaggtgcccctcaaggaccagctcgagctcgacaaggatgatgagagtctgaggaggtggaaggagcaactgcttgggcaggttgacacagagcagctcggagagactgcggagcccgaggtgaatgtgctgaacctgaccatcctgtcgccggatcggccggacctggtcctgcccattccattcgtc

SEQ ID NO: 3261 - DNA, 421 bp, Triticum aestivum
  Clone ID: LIB3280-058-P1-K1-A12
gtgcgtgcttggctcgtgtgcaggtgtctgtgtggcgcgtgtgtgctgattgaaagtacagccatgtgacactgattatttgctactgccgatgctgctgattttgcttctccttggttcctataaaagtagatagatgatgattgctgttgatgctgattgtttgctattgctgctagttgctattgctactaccgctgattgctattgccgttgctaccgattttgctgctcattggtacctatacagtagatataatataatactgcattcccaaataaaaaatatagagatctggatgttttaattttttgcatactgaaccaactacttgttatctcttctttaatctttctcttgatcagattctcttctatgctctccattgcaaaaataactcaacatgtacagtgcggtaca

SEQ ID NO: 3262 - DNA, 456 bp, Triticum aestivum
  Clone ID: LIB3280-058-P1-K1-A2
tgttcagaaagcgaaccccgaaactcccatccttcccactgctgccggaaggagacgaaccccaaaaccctgacctgaccctccccgtcgaccccatccgccgccgccgccgccggaggaggagatggacttccaggtcgtcgtcctcgccggaggcatctccgagaagctctcgcccctcgtctccaaggacgttcccaaggccctcctccccgtcgccaaccgccccgcgatctcctacgtgctcgatctcctcgagtccagcgacctcaaggacatcatcgtggtggtggagggtcaagaggcggcccgcctcgtcggagcctggatctctagtgcttacctggaccggcttgtcgtggaggtagttgcagttactgaggaccattggaactgctggtgcattacgagctatttcaaagagactggtcgcaaatgatgttttggtggattagc

SEQ ID NO: 3263 - DNA, 452 bp, Triticum aestivum
  Clone ID: LIB3280-058-P1-K1-A3
ggacgagatatacaaaatctgtagcattcttggcacaccaaatcagcatacttgggctggaggactgcagctggcagcatctatccattttcagtttcctcagtctcgatgcataagtctttcagaagtggttcccacagcaagtgaagatgcgctgaaccttatttcgtggctttgctcatgggacccccgtaaaaggccaaccgcagtggaggttttgcagcatcccttctttcagccatgcttctatgtccccccttcacttcgtttcagatcgaccggatatgcaacaccaccaccatcagttggggctaaaggggctatggaccagaagaatgctaggagataccctgtggggactttaaccaacgggagaccggcagtcaataactcgtacctgagcactaataacgcccagcatgagcagctggcgtgcaaaggaagctagagct

SEQ ID NO: 3264 - DNA, 443 bp, Triticum aestivum
  Clone ID: LIB3280-058-P1-K1-A4
atccatcacatcacacctgtctcttgcccgctcacctctcgatcgggacggagaaagatcgccgccgcgcgcgatggatgaggagtacgacgtgatcgtgctgggcacggggctcaaggagtgcatcctcagcggcctcctctccgtcgaccgcctcaaggtgcttcacatggacaggaatgactattatggtggagactccacatcgctcaatctcaaccagctgtggaagaggttcaagggcgacgagacaccccctgcaagtataggagctagcagagactacaatgtagacatggttccaaagtttatgatggcgaatggtgctttggtccgtgtactcattcatactggtgttaccaagtatttatcctttaaagctgtggatggaagcttcgttttccacaagggaaagatccacaaagtttcctcaactgatatgg

SEQ ID NO: 3265 - DNA, 448 bp, Triticum aestivum
  Clone ID: LIB3280-058-P1-K1-A5
ctcggccatggcagaagcggcggcgcagaggcttcttgcggcgagcacgaagatcgtaggggccgggcgcaactacatctcccatgccaaggatctcggcaaccctgtcctcaaggaacccgtcctgttcctgaagcccacgtcgtcattcctccacgccggcccgacggccggccccatcgaggtgcccgagccgctcgagtcgctgcaccacgaggtcgagctcgccgtcgtcatctaccggcgcgcgcgcgatgtccccgaggccttcgccatggatttcgtcggaggttatgcacttgctttggacatgtcatcaaacgatctgcaatcagcttctaagtctgcaggtctttcttggactttgggtaaagtacaggacacctttactccaattagtgcggcggttccgaaatcagcgatcgctaatccctatgacctagaactg

SEQ ID NO: 3266 - DNA, 392 bp, Triticum aestivum
  Clone ID: LIB3280-058-P1-K1-A6
cggacgcatgggcggacgcgtgggcgccccctcgccttcggcctgttctcctatcttttcttcctcgcctgcgattggtctgcgcaatataaggaggcgaggggagagaaagagacaacccatcatcgcccgtcggtcgtccagcgtaaggccagctagcagcgcggccatggggttcttcaccaggagcacctccaagcagaccgccaagctcaagtccctcgttaagctcgccgtcgcgcgcctcgccgtcgttcgccggccccgcctcggccgccgttccattgcgcgcggcgacgtcgcgcagctcctctccattggccaccttgaccgcgctttctcccgggcggatcatgtcatggatgaggacagcgtgcttgacgcgctggaca

SEQ ID NO: 3267 - DNA, 408 bp, Triticum aestivum
  Clone ID: LIB3280-058-P1-K1-A7
gcaggttcagcctgggatgagcttaaacatattagacaagctattggtttcctggtgattcatcaaaagccaaagaaaacgttggacgaaataagtcatgacctctgtccagtgagtggagaaatacattaagtctttcattacgtccctttgtttgaaaagttggatttccttggaattttataacaaccctgaatatcctgttcaggtacttagtatacaacagctatacaggatcagtactatgtactgggatgacaagtacggaacacatagcgtgtccccagaggtcatatcaaacatgagagtattgatgacagaagacttcaacaatcctgtaagcaattcgtttctactggatgatgactcaagcataccgttcttcgtcgatgacatatccaaatcaat

SEQ ID NO: 3268 - DNA, 386 bp, Triticum aestivum
  Clone ID: LIB3280-058-P1-K1-A8
gtttgctggaggatttgatgccttacttggagaaaggtccaaaggagcaccatgctgctcaacctcaaaaacgcccaagaaaagttgaccaggaaagctctatggttaggcaaggtaaaacagctgtagagagtgaggatgaagaactagcacgggcggttgcggcttccttggaggagaacaaaggagccgggggatcggatgccgctgatgagaagtctaatcccgtgtaagagaaggagcccatcttgagcgtgaagatcgagtatccccctctccccgaagagccgaaagtgagcagggaccttctctgcaaggtggcggtccggcttgccgacggtcggaggatccagatgaatgttcttcacacagatcctatcaagctg

SEQ ID NO: 3269 - DNA, 420 bp, Triticum aestivum
  Clone ID: LIB3280-058-P1-K1-A9
ctcctcgcgcgtcctgatccatcatccagcccagcaggtgattaaggtcgccatgtcggactccgaggaccaccacttcgagtccaaggccgatgccggggcgtccaagacctaccctatgcaggccggcgccatccggaagggcggcttcctcgtcatcaagaaccgcccctgcaaggtggtggaggtttctacctcgaagacaggaaagcacggtcatgctaaatgccactttgttgccttagatatattcaatggtaaaaagcttgaggacattggtccttcatcccacaactgtgatgtgccacatgtggaccgtactgagtatcagctgattgacatatcagaggatggatttgtgagccttcttactgataatggtagcactaaggatgatcttaaactcccaactgatgatgc

SEQ ID NO: 3270 - DNA, 469 bp, Triticum aestivum
  Clone ID: LIB3280-058-P1-K1-B1
agcatttgcattatactattgtgtgtattgtttttaatgccaaaggtaaatctgaacctgctcagaccacggggaggatttctctggtggactatcgctggcaaggttggcatgggagtaggcccgtaccatgggtttgtgtggctggaggaccgtggccagtgctgcgattgcctgatgtccatgtgcagcatagctcggcatgaggtgatatccttctatgataacatagctgtacacaatttcttcaaagaaaattaacatatatatcaaagttgagatttgcaatgtatttaaattagttcttaaattgctccaaagctactgaaatttcccttattatatttttttgtagatactgattgttcaaaattaaactcactacttaaattccatagaaacgagaggctcaaggaagcaacaagtaggatgaaagagttaacgggcagaagcatagatcacagaaaaa

SEQ ID NO: 3271 - DNA, 451 bp, Triticum aestivum
  Clone ID: LIB3280-058-P1-K1-B10
cccacgcgtccgcgactaccgccagaacagggacggctaccgtcagaacggagatggcttccgccagaacagggacggctaccgccagatcggagatggcttccgccagaacagggacggctaccgccagaacggagatgactaccgccagaatgggaacggacaccatcagccacgccccgtccacaacgggaacgggaatgcgaatgggaggcctggccgcttcaatggtcccaagcaaatagcagttaccgcatagtgtgtgcaatccagcaaagtaggaaactagagtgttcgcctattgatactgtttcgcaccccctacttctttaggaatctctgaaatcattcgcattctatcgcatgttcaacctgatgataccaagtttcggctggtgcctcttttgtggctggttgctgcccgcatatttgaatgctttgacctgtaaca

SEQ ID NO: 3272 - DNA, 331 bp, Triticum aestivum
  Clone ID: LIB3280-058-P1-K1-B11
gccactcgtttccgactacctccagatccagcactgccaccgtcagaacggacacggcatccaccgtaaccggtacggttacgagcctcgatagaagccgctttcgtcagagcgtggaagaggcgcctccaacccctgatgcctccgcgctcggtgggagcaaccacgcttgttaggcgcctgtgcacgggacaaacctgcacatgatcccgaggcccaacccattgactcgatctgaaaaattccgtgtagagcggatgctgttctggaccctctcggcgctgatcgtgcatggcgtgatcttccgtgccgctgtctccaaccatgggtt

SEQ ID NO: 3273 - DNA, 257 bp, Triticum aestivum
  Clone ID: LIB3280-058-P1-K1-B12
gtacctttctctgagttagggttagggtctttctctccctaagatcagagaaggcggggccgcttctgaccaggaagatcgtgaagaatagggtcaagcacttcaagagggcccatagcgaccgctacattggccttaagcaaagctggtgcagtgccaaagggcattcgattcccgtgtcaggagaaagttcaagggatgcaccttgatgcctaacattggctactgttcttgactagaagaccaagcattatctt

SEQ ID NO: 3274 - DNA, 450 bp, Triticum aestivum
  Clone ID: LIB3280-058-P1-K1-B2
catccccacccacccaccccaaaccccgcccaaaaccctagccgccaccccgccccgccgccgccgccatggacgccgccgccctggaaaccctcatcctcgacctgcacgccatcgaggcggtcaagctcggctccttcgtgctgaaatccggcatcacctccccgatctacctcgacctgcgcgcgctcgtctcgcacccgcgcctgctggcctccatcgcctccctcctctcgtccctcccggccacccgcccctacggcatcctctgcggggtgccctacacggcgctccccatcgccttcgtgctctccgtcgaccgcggcctccccatgctcatgcgccgcaaggaggtcaagacccacggcaccgccaaggccatcgagggctccttccgcgccggtgacaccgtgctcaatatcgaggacctcgtcaccagcggcgccttcg

SEQ ID NO: 3275 - DNA, 349 bp, Triticum aestivum
  Clone ID: LIB3280-058-P1-K1-B3
gtgatctgctatatgagccatggcaagtttatgatgagaatgggcttgcatttacaacgttcaatatgtattgggaaaagtgcatgaaattgcatatcgagatatcatcatctcttgccccttggaggttggtgcctgtctcaggtatagaaaacatttgcagtagttcaattgatgacctaggtcttgaatcaagtaaggatgaggaatcaagcaatgctttgctaagcagggcttggtctcctggctggcgcaatgcggagaagacacttgaggatttcgtgtctcatggtctcctagattattcaaaagacggaatgaaggttgcaggaactacaacatcgttact

SEQ ID NO: 3276 - DNA, 392 bp, Triticum aestivum
  Clone ID: LIB3280-058-P1-K1-B4
cggacgcgtgggcttctctgttttgttggtacaacggctaacgacagcaatgccgacagccaagggaggaattggaaggattcagttcactatagcaccgctgccatcattgttgtgatgagcgccttggcgctgctgcttccgtgtggtggcgctgttcaacgtccgctacaaaaccaaccaggatgagctcctctccttgcctccggttctaacatacatgcatcaatcaaaataaatggctatgaatgagaaagattaacttgcacaagataattcatttgtttagaactcaagaagaaatagaaaacttgaggagttgaaggtccttttcgcttgctcattttcggtggttcaagcacgtgtctttggtgatgggaaagcaagggccc

SEQ ID NO: 3277 - DNA, 402 bp, Triticum aestivum
  Clone ID: LIB3280-058-P1-K1-B5
caaaatgtagcgaatatgttcaccaaggagaagagcccgtgggcaaagctttgtgctccttcttggtatatgtgtgcgtgtgtgttctttgagttcttccatgatgagtgtccttgagagaaactctgagtaggaagagttgcgagggagagaagaagagcggcgctgcgaggagaggcggcgccatcaattggcatcagagccttgtcgatccgaggcgacggtggcggcgcggcagactccatgtgagggggacgttggcggcgcaaggtgaacgccgttggcggcgcgatgctgctagcggccggtgcgtgtctccatcatcgtcgagctgcgtcacgagcgatggagaggggtgtgcttcccggtaagttgcggcatcggcgggaaggtggtgatggc

SEQ ID NO: 3278 - DNA, 453 bp, Triticum aestivum
  Clone ID: LIB3280-058-P1-K1-B6
cgcaagccatctaggctagcactctctccttccacaccgcgccgccgagctccgcctccggccgacgcaagcagcccacctgggacgaattcttcttcccctactactcgtatctaccggaatggcgtcgggtggagatctcccatccgggttcgctgatgagagcaaaagtacaaaaacagaaggatcatccaacgaatgtcacggggtccctccagctgccgctgcaggcttgtcgggtcctttcgatttttcttctatgcaaagcatgctcaatgatccatctataaaggagatggcggaccacattgcaagggaccctgcattcaatcagatggctgaaccgctacagaaaggtgctcatactgcaggagaacagggcatgcctccattggatcctcataatacatgggaacaatgcaaaaggtcatggaaaaccctcagtttatgaca

SEQ ID NO: 3279 - DNA, 459 bp, Triticum aestivum
  Clone ID: LIB3280-058-P1-K1-B7
cccacgcgtccgcgtgaagtatgcatgcattgacatcctcaagaccgcgttgaagaataggcgccaccatctcaagaagaagcattttgacaatgtaccggccaatctagtgagtgtcaaatctcttgataagaatgtgacagatgcggagtggcaaagactggtcaagatgtggtctaccccaaggcacaaggaaacctgtcagtcgaacaaggagaaccgttccaaagttaagttccatcagaaaactggttctcgcccctacatttcccatgtgcatgctttgaaagaggctcgtaagggtgaagagttgactgcattgtatctattcaaggagtgccacaatggcaagaagactggattctcttggccagttaagaaggctatagctgacatggaaaaagctattggacaaggcgttccagaaggtcgaggaccaaagaatgttgcttgctgtgt

SEQ ID NO: 3280 - DNA, 456 bp, Triticum aestivum
  Clone ID: LIB3280-058-P1-K1-B8
cggcgcacgtacaaacagggcaggggcgcgcgcacacgcacccgccccctccgcataaccgacacacactcgctccgtcttcgtcttggcctgctctgccccgccgctaacacaacccataattaggcgagagaggagatcagccacacaccgagcaggaacagttccgactggaccgcgcccaccctctggtttacctttctctctccaccgacgtaccattggcgactcactctgcttcgctcccaaggccgtccggatccgccgtccgacgcgatctgggtctgggcgcgtagtgacaacacagtcgtgacatggggacggcgttcggcgacgacgaccggcacgtgatgcaccagggcggtggcgtgaacctgtaagcgcggcgccccttcttggaggcgctgcggtcgagccttgccgataccttcttcaccgacgacccgttctgaggtt

SEQ ID NO: 3281 - DNA, 455 bp, Triticum aestivum
  Clone ID: LIB3280-058-P1-K1-B9
aacagcatatgccgagggcgtccatcgacaacctgcccaatgtccggattcaccgaggagtacagctagagacactattggttgcctgcaggcctgtgagttgagttgctgcttcgttggagatgttgatgttgttcgagacgcccgctggattcacccttttcaaggttctgaattagggcaagctcgacaaggttgagtggtacaggtatgatcttcatggagctagccatcattggatttggtaatacataatcacttattcagagagcccaaggtgagaagggacgagcatctataacaccaccacctactaatcagcgagctactatctgtctttgaatgagttacttaacaagagaaagcaggagttatctacctttcttctgcaaattcgggatgcctttatggcatgatcatgtgaaaaagtaccttgatgcagaaatggatatgat

SEQ ID NO: 3282 - DNA, 428 bp, Triticum aestivum
  Clone ID: LIB3280-058-P1-K1-C1
ggcaaatcagtgtgtcccactagttttgtcaggagagaggttggaaaatcaacatttggcaatgctgatgattctttacggactgcttcccaaatactatctatcatgaagcccccagctggattgtctcactttgctacccagctccgtacatcagtgcaatcttgcttgaagctggatactgcacatgcaaagaactcagcaatcactcataataggaatgaattatcagggaatgcttatccaacttacaatcatcaggtcatcatgaaaccaccagcttttgatgctttggacttggaattgatagatctcccaggatctgagatgtgcaatgcaaacgagcagaaactagaatcgtcaggcaatcttaacactgtaaactgtaatggtacaggttctgcgccaatttcgaatgtcactagcat

SEQ ID NO: 3283 - DNA, 327 bp, Triticum aestivum
  Clone ID: LIB3280-058-P1-K1-C10
atccggttcgccacccgcctccggagaagccgacgacaacggcggctaaacagtgtcacggggaggcgagaatacatgtgaggccgcccggagacggcgcggacaatgagggccgccgccggggcatgctccggtggacgcaaggacaccctggctgctttcttcgttcactgcattctcctcttgcttctccctctcacttgctctgtatatcctctaggccctgcacgctattctgtactcttggttgcttcctgaacatgatgggcttatgggagcactattctttttaacacttaccgtgcacatccttatatcttctactcc

SEQ ID NO: 3284 - DNA, 422 bp, Triticum aestivum
  Clone ID: LIB3280-058-P1-K1-C11
atacgcgtccgcagacgcgtgggcacaccgctgtcttaatcgtggctctactgcgggtcggcgaggcgagggtaccattcacggcagccaaagacaggacggacaatgccgggaagaaggccgaagcgccggcgccctccgccagcgcgcccgccgacgcgcccgccgctgactccccagcctccgagccctccgctgcggatgcaccggagcccagcagctccagcacctccgactgatcgatgacccatccatccgcccggacgccggacagagatcgctctagaacaattcttaatcggagtgatcgatccgtctggtgatgatgaaccggaactctccctttctctgtttgaaataatgcatgcgtgctgaatccacatttgtcacgatcgccgcatccaagattggtcttttctttt

SEQ ID NO: 3285 - DNA, 356 bp, Triticum aestivum
  Clone ID: LIB3280-058-P1-K1-C12
gttgtctccaatgccgctgcaaatccttctgtggatagcatactagagatgaaagagtcagttcttgacaagctatgggatattaatgtcaaagctactattcttctacttcaggacgccgcaccacattagaggaagggatcatctgtgatactaatttcttcaattgctggctataatcctgatgcaactttaacgatgtatggtgtaacaaagactgccctttttggtctcacgaaggcttttgctactgagatgggcccaaatacccgcgttaactgtatatctcttgggattgaacctacacgctttgctggtttccttacaactaatgataccattcatattgaacttat

SEQ ID NO: 3286 - DNA, 438 bp, Triticum aestivum
  Clone ID: LIB3280-058-P1-K1-C2
ccgaaaggtcccccccctcccctcaaaaaaaaaaaaaaccccaccccagcgccatggccgccgcctcctccgccgccgccgccgcccccgccgacacgtacgacatcccgtgggtggagaagtaccgccccagccgcgtcgccgatgtcgtcggcaacgccgacgccgtcagccgcctcgaggtcatcgcccgcgacggcaacatgcccaacctcatcctctccgggcctccggggaccgggaagacgacgagcatcctggcgctcgcccacgagatgctcgggcccagctaccgcgagggagtgctcgagctcaacgcctcggacgacagggggcttgatgtggtgcggaacaagatcaagatgttcgcgcagaagaaggtcacactgccacccggacggcacaagatcgtcatactgtacgaagctgacagcatga

SEQ ID NO: 3287 - DNA, 447 bp, Triticum aestivum
  Clone ID: LIB3280-058-P1-K1-C3
cacgttatggaaacaataatagctatggacatgatacctgcataaacaatttccagtggggacagttggcggaaagaagatatggccatttcaggtttttctcagagatgattaagttccgtcagaaccacccaatactgaaacgggacaggtttctcagtaaaaatgatgtcacttggcacgaggattgttgggataacttggaaagcaaattcttggcattcacgatacacgaccacaactctggtggagatatctatttggcattcaatgcccatgactattctgtggatgctgtgattcccccagcccctcaacaaaaacactggaaccgtgtggtggataccaacctggaatcaccaaacgatattgcaccggaaggggtgccacttactggatcagggtatagaattgctccattctctttcatcttgctcaaggcaagcc

SEQ ID NO: 3288 - DNA, 426 bp, Triticum aestivum
  Clone ID: LIB3280-058-P1-K1-C4
gcagcagctgtattgttccgccagtcttctctgtcatcgcagcatgatcacgcactcgcaaacataaacaggagagctagcccttcaggcagtggaggcagcgagatctcctaccatgctgacacaaccctgatgacaaattcacactcgatcgcatcgggagcgcagctcagtagcagcagcagtggggattcagtttacaagagcttccgaagagatagctccccagacatccccgacctgcaggcagcagtttcagaaattgcaacaaacctgaagcattctcatgaccaggatgatctgaagcttcaaattgagagtatgaaggtcaaactgcgacatctttagatgcttcacgagtgtgctcatactgaaccggtcgacttcgctcaaaaattacacaacaacttgggcattcagcgcgtc

SEQ ID NO: 3289 - DNA, 267 bp, Triticum aestivum
  Clone ID: LIB3280-058-P1-K1-C5
cagcttctgaggagaaaggaaatgttgcatcatgtgcctccacatgcagcaacggaaactgaggaatggatggtgccatgaaggagaaagggttaggaaagatggatcgcgatttcatttatgctcccttccaattggtgtactgcatgaagcggacatgcttttcaagctatgtgttgggttcaagtttaattgtgtcaaacatacctttaccaatctagcatatatatttggaccaaaaaaaaaaaaaaaaaaataaaaaaaata

SEQ ID NO: 3290 - DNA, 452 bp, Triticum aestivum
  Clone ID: LIB3280-058-P1-K1-C6
cgattcccctcccccagatccaccttcttctcttccagggcgcgccgtcccatccccactgggtttcttcccacaccgacgccgccccacccccaacccgcttcttgccccgccgacgccgtcccatccccatccggctcctcccacgccagttccgccactaccaggcaacgacgttcccgcgcccaactcctcctccttcccatggtcatggcgccaccacgtcccgtccggtgcacttgatgctctgtcttcccctccccagaccggagttgcatccacgacggtcacatcgtgccaccaccaacctcggctgccagggtccctcgtccccttccatggcgagttgtgcctcacgtggaactcagaccaccccaccaccagatccatccaggggaggcaaggggctccgggctgccaccgcaggccacacgcggccaccaccttcatga

SEQ ID NO: 3291 - DNA, 464 bp, Triticum aestivum
  Clone ID: LIB3280-058-P1-K1-C7
gtctgggaatggattgcctcattgttggggtttctcagtatgtaatttcttttactcattttagattcttaattcggtggttcttgattgcaacctagggtcatcctgttcctactcacatgttacattagtgttttgtataatatatccaagctctcactcctgaaaattgtccatctgttctctgatgcacgcacgtcactggagagggagtctggcttgcgagtttcgccgattcgttcacaacggcgatgccaaactatgaggagataccaaaggtgtactgggaggcggtgcttcctggaaccccaatgcgtccacctattatcaacctgctgttagcccagcaaaatggtatctctctccttccctccctccctcccttcccaccttggtgacctcatttaagttgttttgataattggtggtacaactttccctctttgatacctacaaattcttta

SEQ ID NO: 3292 - DNA, 372 bp, Triticum aestivum
  Clone ID: LIB3280-058-P1-K1-C8
aataagagaaggagagaagaggccgccgcggcgccgagccctcgtgtcgtcgtgcagccccgccccccactttccccccgtgatccgcccgtgggatctctcgccctcccgcccgcccaccaggatcaagccgcggcccgagcctgccatggggatccctcgctgatcgcggcgcgtatgcaggcggtcaccgtaggaggaggaagagggaggagggtgggcagcgagttccccccttatggtcacaactgcgaggccatactatgaggagataccaattgtgttctgtgaggcggtgctttcctggaaccccaatgcgtccacctattatcaatctgctgttatcccagcaaaatggtttcttttttcttc

SEQ ID NO: 3293 - DNA, 449 bp, Triticum aestivum
  Clone ID: LIB3280-058-P1-K1-C9
cgctccgcacgcccaccgcccccgccaccctcgcctccgtcccctccgccgtccgcctgcccacccaaatctccaccctcgccgcctgcctacacccctccgccgcctcctcctccccgcgccgcgccacccgcatcaacgccgccgcggcctccctcctctccccgctcactgcctcctcgcccggcctctcccgctccttcccctccggcgcccccggcgccgccggccgccgccgcacgctcgtctggttccgcgccgacctgcgcctccacgaccacgagcctctccacgccgccgtcggcgcgtcgtcctccctcctccccgtctttgtcttcgacccacgcgacttcggcaagtccccctcgggcttcgaccgcaccggaccctaccgcgccagcttcctgttggactccgtcgccgacctgcgccggagtctccgcgcacgc

SEQ ID NO: 3294 - DNA, 438 bp, Triticum aestivum
  Clone ID: LIB3280-058-P1-K1-D1
cgacgagcgagtgaacaatcctaaaaagagtgcacctacactgaacgaaacatttttgggtcttctatatccgactgagaactacaaagtgtatggctatttgacaaacacaaaggtcaaatttttaatggttactactgatcttgatgtgaaagatgcagatgcccgaaattttttcaggaagttccatgctgcatacgtggacgccgtctcgaaccccttccacgtcccagggaagaagatcgcctcgagaagcttcggtgcgagagtgagcaccatagtgaaatcctttggctcagggactgtcggttaaaaaccacatccgcctgagcaccctccgcaatcaattgtcctgtgctttacaccttaaccggcaacctatctttaccttcattgtgtatcacaaaatgtatgttggacaagaaatagtttgacact

SEQ ID NO: 3295 - DNA, 158 bp, Triticum aestivum
  Clone ID: LIB3280-058-P1-K1-D10
cttcaattatatctccaaatgatgagttaaatgtaatacagaagcatttaactcttcaattatatctccaaatgatggtcttcgttcaggatcagaatcccagctgcgctgaataagtgacaagagacttggtggagagccagactctggaagggccc

SEQ ID NO: 3296 - DNA, 456 bp, Triticum aestivum
  Clone ID: LIB3280-058-P1-K1-D11
gggagtactaccctaatggctgtgactaccagtgggacggttgggtatcggtttctattggccttgaggacgacgaatatgatgacgctgacgatgatgagcaaaggcagcccgtgaaggtccggcttgccatctgtttgatcgaccaatttcagtgggatcagtcagtatacatccatgaatgtgaaacagaagatttcgttctcaatcctgtagtctgcgataaagatttcataagaagatctacgttggaaagatcttcgcatctcaaggatgacagcttcatcatccgttgtgacgtcattgtacttgacgtcaaggccgacgtcaacacggaggttggcgctaccaccatcgtttatcagttcatccaagtccctccttaggacatggcaatccactataagtatctcctcatgtccaaggagggtgctgacgtgacgtttgaggttggcg

SEQ ID NO: 3297 - DNA, 145 bp, Triticum aestivum
  unsure (1)...(145): unsure at all n locations
  Clone ID: LIB3280-058-P1-K1-D12
gnacagcttattttgtcgacatcgaggtttcagtttgcaatattagacctnnntgtatcaaggtatggctgaccataactgaactttgnnnttgtttatacagtattacattatgcgcttcatccaataaaaaaaatgaaaatca

SEQ ID NO: 3298 - DNA, 426 bp, Triticum aestivum
  Clone ID: LIB3280-058-P1-K1-D2
tttgattggtcatgcacaacttagaatagattgtggtccatcccaaaggcaaacaacgcagggatttattcatgccttagggatcttctcaatgtctcctagcacctatccgctcgaagacgagaatgtcaatcctaccgcgaattggaaattatcagcaccagctccagcaaagaaatcatggatcccagcgggctttggaggcagtggcaagcatgacgccaccatcgacatcccattatatgatccgaagaagcgggagcaagagctcttatcatgggaggaggatttgaagaggagggagcgggatatcatacagagggagaatgcaatgaacagagctggtgtcaccatcgaagtgaaaaattggccaccattctttctcgtcatacatcatgacatagccaatgaaataccaacccatgc

SEQ ID NO: 3299 - DNA, 436 bp, Triticum aestivum
  Clone ID: LIB3280-058-P1-K1-D3
tgatatgatactcaaccctttcttttttcatttaattttgatgccgcctcatcaaatttacctagttgacatgcatgatactatctatgatactcccattacgaccagcctgagggattctcacgggatggggcgaccagagtggtgtcactggcccatcaatttttaaggcccatatgtcactgactacaaaacaaaatgcatatacggcctagcatgaaaacatgacttctccttttcgttttgtttcagatttttttagtagattttgtctttcttagtatttctcaggtgtaaagtaaattttgtttgaaatctgatgacatgctagtttttgtgtgtgtgcggaagttatgacatgttagtctaacttatatatattgtaatttgttccgagatgtttcaggactatttgcacgacatttttaatatttcg

SEQ ID NO: 3300 - DNA, 460 bp, Triticum aestivum
  Clone ID: LIB3280-058-P1-K1-D4
cggacgcgtgggcggacgcgtgggatttccttcaagtcgccttgggcttcttaggcatcctgtagccaccgacaacgcaggcatggtcacgctcgaagggctccagggtcacctgctccgaaggcttgaactgctcaagcttcagcttctcaacttcggcggcaaacacggcctcaggggcctgggtggagtcgatacagttggccttgattgaaatgacaaagtgaccaccattcttcaagaagtatgaagcattaagggccaagatcctagcctggtcaggctgtgcaacatcagagaagataacatcaaccatgccgaccaacatccggtacttggcagggtgcctagcatcctcgatgatgggaatcacattggttctctgcttggccatgttgacaaggatcctgccactgcggtgcgagaactccacagcattacaccaacccagtcgggccaa

SEQ ID NO: 3301 - DNA, 409 bp, Triticum aestivum
  Clone ID: LIB3280-058-P1-K1-D5
cccggctccatccatccaccgggaggagagggcagcaggcggaggaggccacacctacctacctatctatctatctgtctgtctaagccgccggcatggactcggagcactggatctcgcgcctggccgccgccaagcgcttctacgccgcgcagctcggccacgccggcgcagatcgggcggggatggacgagctggacatggacggcgacgagaacgccggcaggcccgacttcgcctgcccctactgctacgaggaccacgacgtcgcctccctcatcgcccacctcgaggaggaccaccccttcgagccccacgccgcgccttgccctatctgctctgaaaaggtatctaaagatattgctaaaccatatcaccatgcaacatgggtactttgtcaagaatcgcc

SEQ ID NO: 3302 - DNA, 446 bp, Triticum aestivum
  unsure (1)...(446): unsure at all n locations
  Clone ID: LIB3280-058-P1-K1-D6
ggtcttgggcgagatcaccaccaaggccaccgtcgactatgagaagatcgtgcgcgacacctgccgcaacatcggtttcatctctgatgacgttggtctcgacgccgaccgttgcaaggtgctcgtcaacatcgagcagcagtcccctgacattgcccagggtgttcacggacacttcaccaagcgtcctgaagaggttggcgcccgtgaccagggcatcatgttcggctatgccaccgacgagacccctgagctgatgcccctcagccacgtgcttgccaccaagctcggagctcgcctaaccgaggtccgcaagaatggcacctgcgcctgggtcaggcctgacggaaagacccaagtcacagtcgagtacctaaacgaggatggtgccatgggacctgttcgttgcacaccgtncttatcttcacccagcacgacgagaccgt

SEQ ID NO: 3303 - DNA, 288 bp, Triticum aestivum
  Clone ID: LIB3280-058-P1-K1-D7
cccacgcgtccgcatttatccaataagtcctttgggcaaaaaaaagaagaaacgaaaaaactctcctgctcttcctgttgttgacgttgtacgtacgtagtgtgtacagcaccatgcaagcgttctctcatggagtggagtggagtggaattaatggagctgggggagagtaatactatgcgaaggtgtatggcggggtgagcggcatgcccacgaccttgccgtactggagggagatcacagtcattttgtagttgttcctgagcaacctggtccgtgaggtgcagc

SEQ ID NO: 3304 - DNA, 320 bp, Triticum aestivum
  Clone ID: LIB3280-058-P1-K1-D8
cccacgcgtccggccggcgagcccaacacgatggtgctgtttgaggaggccggcggcgacccgtacgagggtgaacttccacacggtggccgtaggcgcggcgtgcgcggaggccgctgaggtgggtgactaggtggcgctggcgtgcagtcacggcaggaccatctccagcgtctacgtggccagcctcggcgttgctcgcggcaagtgcggcgcctacgagggtggctgcgagtccaaggtggtgctggcggcattcactgcggtgtgcgttgtcatggagtcgtgctcggtgcggcacacggaggattttcttgctt

SEQ ID NO: 3305 - DNA, 366 bp, Triticum aestivum
  Clone ID: LIB3280-058-P1-K1-D9
agcaaacctcccatctccgtctagcgtcggcggcagttccactccctcgccatgggcaagattaagatcggaatcaacggtttcggaaggatcgggaggctcgtcgccagggtcgccctccagagcgacgatgtcgagctcgtcgccgtcaacgaccccttcatcaccaccgagtacatgacctacatgttcaagtacgacaccgttcacggccactggaagcacagcgacatcaagctcaaggacgacaagactctgctctttggcgagaagccagttaccgtctttggcgtcaggaaccctgaggagatcccgtggggtgaggctggtgccgattacgttgtggagtccaccggtgtctttcac

SEQ ID NO: 3306 - DNA, 300 bp, Triticum aestivum
  unsure (1)...(300): unsure at all n locations
  Clone ID: LIB3280-058-P1-K1-E1
cccacgccttcgctgtatgcatgggtctatcagataggtgcactgtcaaatcgtgcatttgcttgactggtttatttacttgctgaagtatgtgcgtcatgttgctcgcggatatgcgcgacagacggagtggttcacagcctgttcccattgtcattgtggtagcacccgagttgatgccaaagctgtccactcgctatatatatacacatatatatacactccctccgttcggaaatacttgactngaaaagtgatggatacagttatagatgcatccatgttttccacaacggtttt

SEQ ID NO: 3307 - DNA, 366 bp, Triticum aestivum
  Clone ID: LIB3280-058-P1-K1-E10
gcggtaccttgttccagtgcaaacaggctcctgatggtaatcagatacattgtgggtcatcggactgagcgaataagagtcttcaagctcgaagacaaggatgaccagctccgctggattgagcaagatgatttacctggtcacaaagtattcatcggtcatgggtgctcaagatgttatgaagttggtgatgaagttcttaacgtctacttctatgatgacagagaggagctgaggatgcctcagtactatttcagagatgattcagggattgcaacaggtttggagatttttctgtggccagttatcatgggggagtcacaaattgagagtgccttcatgggggagtcacaaattgagagtgtt

SEQ ID NO: 3308 - DNA, 460 bp, Triticum aestivum
  Clone ID: LIB3280-058-P1-K1-E11
gacgagcctcttttaaagacacacggccttccggtgcttgtcaggctcgatgaagcatatgttgcgttgccaagcctacaatcaaggatgacatgcgttaagaagcatgataattggattgatctccaaacattcaccaaaccagcaggtttagctgggcttcgtgcgggttatggagcatttcctctaagcattattgagtacttatggcgggccaagcagccttataatgtttctgtggcagcagaagtctctgcatgtgctgccttgcagaacccagtctatttggagagcgtgaaaaatctgctactacaagagagggagaggctgtataatcttctcaaaggaataccttacctgaaaccatttcccagtcatgctaacttcattctgtgtgaagtcacgtcaggaaaagatgcaaagaaaataaaggaggatcttgcaaagatgggaatgatga

SEQ ID NO: 3309 - DNA, 432 bp, Triticum aestivum
  Clone ID: LIB3280-058-P1-K1-E12
gagacgcgtgggccgacggtagccctccttactcccgcttaaccatcctcgccggcggatgcgaccgcggcggccccaatggcgtcctcctccgccgccgagccaggcgcccgcctctccgatcggacgaggaggtcgcccctgggcctgagggccatggttctcctgatgcacgtggtcttctgcggcgccgacttcctgctcgattcgaccctcgataggcggatccacgaggagccgtggtatattggagtgtatggtgtgcttgttctgatcaccttagcgcaatacttgtacactgctggttcatctacaggctatgttattgatgcaatgcaagccagtggtgggatgcatgcatccttcatcaatactgccactctttcaaaacagttcagttcaaatcatggaagcttaaagtccttcacaaac

SEQ ID NO: 3310 - DNA, 63 bp, Triticum aestivum
  Clone ID: LIB3280-058-P1-K1-E2
gaaaatatattttatgatgaatctaatgctactaatttgatggcgaataattgaaaagtagat

SEQ ID NO: 3311 - DNA, 463 bp, Triticum aestivum
  Clone ID: LIB3280-058-P1-K1-E3
cccacgcgtccgaagatattgacttcagacgatagagtgaaggcaattctagtgaacattgttggaggtatcatgaaatgtgacgtgatagcaagtggaatagtgaatgcagctaaacaggttgatcttaaggtccctgttgttgttcggctagaaggcaccaatgtagaccaagggaaaaggattcttaaggagagtggaatgacattgatcactgcagaggatcttgatgatgctgcagagaaggctgtaaaagcatcagtcaaatgattaatgattgtaccatatcagtctaaagttctgttttcactggcacaagaggagtggtgctctcttagtgattttgggggccgtaatcttgaagtgcatttttttttgaagtggagtgattccacttttgaggtttccttaaaacttgtgatctttgtgttaataaacctatatgggcaacaaattgagcagt

SEQ ID NO: 3312 - DNA, 446 bp, Triticum aestivum
  unsure (1)...(446): unsure at all n locations
  Clone ID: LIB3280-058-P1-K1-E4
cggacgcnttntcagtgattgacataactgaatgggttgaaggtccaaagaagaacgtatcactagagactaataccaccgatgagactttgactgctgaatcaggaacaactgatacgtcaacagatagaagggagaattctagttcaggaagagatgctgataattcgagcactaccaatgatgataccagtgtgcaagatactattacagagaaggtgctgtataaaagaaccttcagggttccattaaaggtcactgaaaaaactgttggtcctgcatcaaccctatcaaaggagctgtgttttgaggcaaaaagtagggtagatgtacttaacaagaaggaggctgacctnantntaatctgcgaattgaaaaataaccttgagtcttacatatactctttgaaggaaaagttggaggatagcacatatatgttgctcgtt

SEQ ID NO: 3313 - DNA, 466 bp, Triticum aestivum
  Clone ID: LIB3280-058-P1-K1-E5
gccacctccatcctatacaggcagccgcaccacgctcgcacgtactcacgtacgtcggcaccaagcagccagcaacaaataataagtaaataaaccagccatggggcgatcaacccacgcgctgctcctcctagtcgtcgccgtcgcagcggcgacctgctcctcggctgcggcacaggcgccacccgaggtggccgcagtctgcaagagcaccccgtttgcggatctgtgcagcgccacggccgggaagcaggcggggcactacaccaccgtggacgcggttgcggtgctgaacatgcaggtcgacgccttcgcgaagcgcacgtcggcggcgaaggagcacgtgacccagatgtccgccgaggcgagccccgcggccaaaaaggcgctggagttgtgcgatagcctctactcggacgtggaggacaaccttggtgcggacgccgggccttaggctttaaggacg

SEQ ID NO: 3314 - DNA, 452 bp, Triticum aestivum
  Clone ID: LIB3280-058-P1-K1-E6
cggacgcgtgggcggacgcgtgggaaaaagacacaacagatcgattgagcggacgcaatagcggcagagaggaaaccctaaggaagaaaccctggtcgattgagcggcgcgccggagatggagctcatcgacagcgggttggcgctgatggagatctccatgggcgagtccagtacaaagacgaggatgaagagcattagagaggcggagcaaaccaatctgaggcgcatcagagagttgcaggagaggatccggaggaggcaggagcaacttgttcgcgatccacagccacctcttcgctacgagtttgagaaggctcctacagatgagcaggaggctgaagactaccgacaaatgagggagatgtgctttcgccttaaattcggctcaatcgacggggaaacttctcttggtcccatttgctgtacaaccggaaccaacccagcagatgc

SEQ ID NO: 3315 - DNA, 459 bp, Triticum aestivum
  Clone ID: LIB3280-058-P1-K1-E7
acaatcaactgctaagcctaccctgatttcagtcgccgccgcaccatcttcgacttgtaggtatcaagggcaactgcaacacttttctaaggaattagagcaaggtggaaggagatgggttttttgttttctaagtatcttgcgaggcgaggaactaggatttcaaagcggcggtccggacagcgcgtcggcggccgtgagcgaaagcgtcggcggcatcacctttaccttgactttgatgactggtcgctcgggtatagcatccgcaaggtagactcatcgcctggctctcgtcgccaatccgctgtgaggcgcttgcctcggcctttcttacgattacaggcgccgcatgggtcgccggagtacttcccgtcagcctttggcaccaacatcttgtcgatgcattccaggtctacctcttgcaacagcttgttatccgggagcttgtatccttacctt

SEQ ID NO: 3316 - DNA, 429 bp, Triticum aestivum
  Clone ID: LIB3280-058-P1-K1-E8
atcgccactcccccagagaaatcctccctcctcacctcgaacgctccgggaagcagcaaacgcgaggccggccaagatgtcgtggcagacgtacgtcgacgagcacctgatgtgcgacatcgagggccaccacctcgcctccgcggccatcctcggccacgacggcaccgtctgggcccagagcgccgacttcccccagttcgcgcccgccgagatcactgccatcatgaaggacttcgacgagccggggcacctcgcccccaccggcatgttcgttgcaggtgccaagtacatggttatccagggcgaacctggcgctgtcatccgtggcatgaagggagcaggaggcatcaccatcaagaagaccggtcaggcgctggtggtcggcgcctacgaggagcccatgacccctgtgcagtgcaacatggt

SEQ ID NO: 3317 - DNA, 462 bp, Triticum aestivum
  Clone ID: LIB3280-058-P1-K1-E9
ggaacaagttctcagagatcgtggtgtggatgctttggcaagtgaccttgagatcacctctccagttggcaggcccaaaaatgaatttgcaaaggtcgagcagaaggttgaagctatgaccattaacccttcaggcgaaaaggctgagagttttgcagttggtcacagaggcccaaggaatgctgataggaaagattacaggcgggatacagacagggctgatgcatacaggcctacacgacgcgatgagaacaggaaggtttctagagatgtcgaaaagcagcctgaacaacaacgcccagagcctgaaacctggcgtaaaccagtggagccaccaaagcctgaggttactgcacctcggtttgggaaagcagcgactgccttggagctcgcccaagccttcttcaagtccatgtctgatactgtgccgcagtctcgcttgaccagtgttcctagtccaag

SEQ ID NO: 3318 - DNA, 412 bp, Triticum aestivum
  Clone ID: LIB3280-058-P1-K1-F1
ctcctctcgccgcagcctccaccgaagccaagagaggagcagggcgaaaggaggccgtcggagatgtcggagaagaagcgcgcccccggcccgcgcaaggacgaggtggtgacacgcgagtacaccgtcaacctccacaagcgcctccatggatgcaccttcaagaagaaggcaccaaatgccatcaaggagatcaggaagtttgcacagaaggccatgggaaccaacgatgtccgcattgacgtgaagctcaacaagcacatctggagcagtggcatcaggagtgtcccgaggagagtccgtgtcaggattgcccgcaagaggaatgacgaggaggacgctaaggaggagcttgactttctggtcacagttgctgaagttccccaagaaggtcttaaaggtttgggtacca

SEQ ID NO: 3319 - DNA, 315 bp, Triticum aestivum
  Clone ID: LIB3280-058-P1-K1-F10
cgccccccgcggagcttccatctcttcttcctcgatccctccctccctccctcccaatccctcctccaccccacagccatccctcccccgacgccgggcatttgctggtctcggcgagggccgctcctctgctcgtgtgggaggccgagccctcgccggcgtcgcgtctcgcctgccctcgaatctacggcgagccgctcgcgccccaagcccgagcccactataggttttactgacagacagagacgtacgtgtactggtacagaaatggagcgaagggtggagcctgcctgtcgagaggctttgctggataat

SEQ ID NO: 3320 - DNA, 427 bp, Triticum aestivum
  Clone ID: LIB3280-058-P1-K1-F11
cccacgcgtccgcggacgcgtgggtgcaaacttgctctgcttgactctgttttggcctcaaggcgtctcacttgtcacatattgttatcaactcaggtatggtatctggaaaatcgttattctaccaagagaacatttcttactttggtttctaggcatatgaaagtaatgagtaaacataacccgctgaaacaaaaacatggtgaagtagctggctgtatattttgcttggagatgatactgttcactgaccatattttgtttgtatggtggctgtactttgtaacgctagcatggatgtctgttataaaatatacaatatctagatttttgctgggtaaagaaatttgcagctccgaatactttatatttcccggctgttcttaatttctgaagtatgcatgggaactctgggatgacgtgtttc

SEQ ID NO: 3321 - DNA, 425 bp, Triticum aestivum
  Clone ID: LIB3280-058-P1-K1-F12
gcgaggaagattataattcataaaccaggagagaccatggcaccttatgtatcagacattgcaagtccgatccccgacgtgtcacaatctacgacgatctccaagagcacgccaggctaccaaaaccagcactacagctcctgcgacatactcatgcataccataattagttgatccagacgttaagtaatgcaccctcagctcaacggatgcaacaagcatctactgctgttgcagcagctattaagccacatggctgatcatcaatcgcggaaagcatgtctagcccgattcttggagaagcggaaagacagagatttacgtgtcacgccattacttattgtcaaaaagcccgctagcgagcaccggtaccttgggcagagcgagcactgaatgcaagagatctcgtgcagacattgttccat

SEQ ID NO: 3322 - DNA, 189 bp, Triticum aestivum
  Clone ID: LIB3280-058-P1-K1-F2
actgcggggatacaacaatacagttggttttccttttttgcgggagcaatacagatgtgaaacgtgcaagtaaaataaactagagatcggcagaggctgctacacttaacatttaacaagagatggacggcacatatgtacacggggatggggtgcactacgccaaagtgcagacaggctgatgtacac

SEQ ID NO: 3323 - DNA, 455 bp, Triticum aestivum
  Clone ID: LIB3280-058-P1-K1-F3
ctctttcacaaggcacttaaagaagcctttgaggtcttctgcaataagggtgtgtctggcagttccagtgctgaattacttgccaccttctgtgacaacattttgaagaaaggctgcagtgagaagctcagtgatgaggccattgaggatgcccttgagaaggtggtgcggttgctcgcgtacattagtgataaggatctctttgccgagttctacaggaagaaacttgcaaggagattgctttttgacaagagtgccaatgatgaacatgaaagaagcatcctgacaaagctcaagcagcagtgtggcgggcagtttacttcaaaaatggaaggcatggttactgaccttactgttgcaagagatcatcaaactaagtttgaagagtttgtagctgatcatccggagtcgaattctggggtagacttggctgttactgtcttgacaactgattc

SEQ ID NO: 3324 - DNA, 460 bp, Triticum aestivum
  Clone ID: LIB3280-058-P1-K1-F4
gaaaagcattccatggcatataatcagactgcgtttgtactatcctgcaagactatgttgtattcacttcggaaccctccaaagcattttgagacccttgtcgtgcaccatttccacgagcgggagcgtgccatcctggacgcatgcagcgcatacgcgtctggcattatcgtcggatcatcggtcagggatggcgcgaagtacgcctgtgataagtgctttgccggtttcaagaagtccctggatgcacacaccgaacttctcgcaaaggagttggctaagaacagagctcaagcgccggaactgaagggagacacgccagccgcagatgagatcgcgtctaccagcttgggccagacctgaccattgctaaattcacctacttagggagtagcttggaagaaaaagggtgtgtaaatcacaatccacacggaaggtatggaataactctaggggtgat

SEQ ID NO: 3325 - DNA, 464 bp, Triticum aestivum
  Clone ID: LIB3280-058-P1-K1-F5
gctgaattgctgtgcatttatgcagaaagataggccaggaggcaaacctatgctgaattgatgtgcagtaaagataggccaggaggcaaatattttctatggtcttggcaaaagcagtgtcacccagcagtgggcaaatcaacagatgctttgaccatttttattttttttgcagatgaggggattagcatgaaaggctgcttaactagcaccttcatcttttgctttaattgattaataggttaagaaaagcttttgcaccaggcaatctgcatgtaaagatatttgcatcagtggtgcattctgaaggagagggacagaggagacaaggacactggccctgagtggctgagctgctgagcttaccttgggtatatgtatgatcatgcctttcctctccttgatgcaccaattattgactccagaaagagaaacaaaaggctgtgctgtgctttgctcctggc

SEQ ID NO: 3326 - DNA, 464 bp, Triticum aestivum
  Clone ID: LIB3280-058-P1-K1-F6
gaaaaagattgtgctgcaaaagctttccacaaacccaaaccagaagcagttctacctgttaattttgctcctgatagtaacaatgagaaacgatattcttcttgtgaaaaacatggtcccgagggcaagagtaaagccactaattttggtgatctcagtgagaagaaaataagtttggaagaattacttagactcgaaagtgcagaagagtgcctgcataaaggtgcaataagctctgaaaccagaaaaaatcatatgctatctttccatggagaagcagtcaggcaggtttcggcaaatgtgggtcatggagtcgaagttattgcatccaaaaccagtggtcttgttaatgatactgtatcaagtaagaacaacattgatgattgctcagtaacaacctctgaagaatgtgatgcatcggcatcatttgatgcgagaggactgaacctaatagttactttaat

SEQ ID NO: 3327 - DNA, 461 bp, Triticum aestivum
  Clone ID: LIB3280-058-P1-K1-F7
cccacgcgtccgcccacgcgtccgcgaaccaagcctcagagatcactacgcacagcagcagcaccagcaccgccaggaagtgcagtagtcgacgcagctgagccatggcccgccgcacggccctcatcctcgccgcgctcctcctcgtcgccctggccgtcgcgccgttggccaacgccaagaaggccgccaaggacaaggaggagaaggcctccgacgccccctcggccgacgcgccggccgccgactcgcccgcggaggggccctccgatggaccggcggctgcccccgggcctgagggcatcgccggcctctcgcccgacaacgacgacaacgacgacaagtgaacccgagtgcatgcccttctggaaggatccgttcgatgctgaccagatcgtccgcatggattttagtttcgagacaataataatactactacgtataggcctgttgccctgcta

SEQ ID NO: 3328 - DNA, 439 bp, Triticum aestivum
  Clone ID: LIB3280-058-P1-K1-F8
ggagaggtacctcagcggcttcaccaaggtggaggacaaccgctactccatgaagatattctttgagatccgcaagcagaagtaccttgaagccctcgacaggcatgatcgggccaaggcagtggagatactcgtcaaggatttgaaggtgtttgcctcctttaacgaggagctgttcaaggagataacgcagctgctgactctggataattttaggcaaaatgagcagctgtccaaatacggggatacaaagtcagcccggaatatcatgctcatggagcttaagaagcttattgaggcaaaccctctgttccgagacaagcttaatttcccaccatttaaagcctcgagactgcgcacgttgatcaatcaaagtcttaactggcaacatcagctcttgcaagaatcctagaccaaacccttgcataaagacacttct

SEQ ID NO: 3329 - DNA, 407 bp, Triticum aestivum
  unsure (1)...(407): unsure at all n locations
  Clone ID: LIB3280-058-P1-K1-F9
cgccacctcccccacacacaccgagtgctcgtgctcgacgcaattccccaccccgcgatgagtgcggcggacaaggtgaagccggcggccagcccggcgtcggaggatccctccgccatcgccggcaacatctcctaccacgcgcagtacagcccccacttctcgccgctcgccttcggccccgagcaggccttctacgccaccgccgagagcgtccgcgaccacctcctccagagatggaacgacacgtacctgcatttccacaagacggatcccaagcagacctactacctgtccatggagtacctgcagggccgngcgctcaccaacgccggcggcaaccttgccatcaccggggcctacgccgacgccctgaaaaagttctgctacgagctcgaggccatcgc

SEQ ID NO: 3330 - DNA, 185 bp, Triticum aestivum
  Clone ID: LIB3280-058-P1-K1-G1
gccaaaccttttgggggaactcccccttgggccgtggctttcttgtttgccgttttggttccgaaaaccccgccgccgccgccgccgcacgggcaaaagctcgactcgttccctaaaggtaaggttgggagaagtcatgttcctaaacaatcctttcaaaaccttgtccaaccctaaaaaccttg

SEQ ID NO: 3331 - DNA, 354 bp, Triticum aestivum
  Clone ID: LIB3280-058-P1-K1-G10
cgtctccctgcgcttcacgccacagctcaccagcgcgcgcgctctctctgaacctttggcgagcctcgtacgccctcgcaccactgtgcgcgactgcttgcccggcttctcgtgcccgctagggagggagggaggggggattcggagccggaggagatcgccggcggctgggctcctgccagaggactcggcgggcgggatccaccttgcgcttcttggaggcccccatgccgtgagcgaagcagccagcgccatcctttgttccccggggagatcttgctcctgcctgcagcaggtgagagccgagggccgacaccgagaggaggtcacccccgccgacatggccggcagcga

SEQ ID NO: 3332 - DNA, 462 bp, Triticum aestivum
  Clone ID: LIB3280-058-P1-K1-G12
cgcgtctctctattccaccagccaaaccagaccgtcgcccgcacgccttccatgaccaccggaattccgcgccgacggtccggatccgcccgaccgcccgcccgctgtctcccctgctggcgctgcggttccacacttctatgcagtgggtggaggcggcggtgatgcgtgattggtcgcggcggcgctaggtgctcttctccggccgcggcgactcaggccatggggtgcatccagtccacgccgaagcggaggcagcaccctgctggctacgaggaccccgttcacctcgcctaccagaccgccttcatcgtcagcgaagttgatgcgctgatcgagctgttcaagagcattactggtttatcgatcgatgacgggctgatcaacaaggaagaaattccagctgcattgttcaaaacacagggaaggaaaatctattttctaatcggatatctggccttt

SEQ ID NO: 3333 - DNA, 427 bp, Triticum aestivum
  Clone ID: LIB3280-058-P1-K1-G2
cccacgcgtccggccgcatcctgcgtggtgaagctgcgactcccgctcgccgccgtcggccaccggcgacgagcctccgtctccgcctcctctcgcctagcatcctctcccaaaccccaagctaggagccctccgccgctctcccctcccaaacccctcctcgcacccgcccagatccaagcgcccatcttcccctacgccgccgccgccgtcgccgccgggccgtccaagagggggagcgagcgatggctccctattaatctccatttccccttcctccatcccctccgccgctgtcccctcccaaacccctcctcgcacccgcccagatccaagctagcccatctttccctacgccgtcgtcgtcgccgccgggctcttcaagaggcgaccatggtggagctgcccctgggaagggggacccctt

SEQ ID NO: 3334 - DNA, 453 bp, Triticum aestivum
  Clone ID: LIB3280-058-P1-K1-G4
gcatctcctggatttgagaagcaaatgtttcaggagtggctgagatccatgttaagagaacatggaggtcccttttttgacgctttcagatcaaagcaccctgaaaggacgggagcttatacttgctttaatcaaaaagttggagctgaagaatacaattacggttctagaatagaccacattctcatttctggtgcctgttttcatgactgcaattcggtggaagatcatagcatattccattgccatgttgaggattgtgagataatgaatcatttcagaagaggggattcaggaaatatctcaaagtggaaaggatggagaagtagtaagctagatgggtctgatcatattccaagttatatgatcttgaacggaataccttgaacttcctgcccataataccccaccatcaggtggaagatatttcccagaaatccgggggcgcaacaa

SEQ ID NO: 3335 - DNA, 441 bp, Triticum aestivum
  Clone ID: LIB3280-058-P1-K1-G5
accaaacccccatccccatctctcctcccctaggctcgccttcgccgtcggtcgagctccctctccgacacgccgccgtcgatacgtccacccgaggcatggcgacggcgttcaaggcgttcgtgaacagccccgtcggccccaagaccacccacttctggggccccgtcgctaactggggcttcgtcctcgcgggtttggttgacttgaacaagcctcctgagatgatatctggcaatatgacagccgccatgtgtgtgtattctgggctctttatgaggttcgcgtggatggtacagccccggaactacttgcttctggcatgccatgcctccaacgaaaccgttcagctctatcatttatctcgctgtgctagggctcaggggtatctggattccaagaaagagccggaggcccaacagtaaagggtgtggtgtttct

SEQ ID NO: 3336 - DNA, 382 bp, Triticum aestivum
  Clone ID: LIB3280-058-P1-K1-G6
gtagctggctgacccacctccacgaccaccccagccgtcgtcgcgtgtgtgcttgttggaggctaagagctgcaagagaggagagatcgtggccacctataccactagcagcagcttctgctgccaccaccggagtgtcatggccgacacaggttgccggcgtcgtcatacacgtgcgggtcggcatcacctgatgcgccagttcagctgcaaaaaaagagcagtatacgttggtgtctactccactcacttggtgaaataaaaaatccagccggatcttgctacacacagggaagacatagagaagacgcctagcatagatcgaccgctgttgtgccacgccgtgcgcgccatccatgccgactgctgcctactgcaacac

SEQ ID NO: 3337 - DNA, 377 bp, Triticum aestivum
  Clone ID: LIB3280-058-P1-K1-G7
cccacgcgttcgcggacacgtggggcaggatgtgaaggtcatggtcttcttttcatcatgtagctcagccaaattccatgcagaatttctaaatttccttgggatagagcgttatgatatccacgggcaactaaagcagcagaaacgcactagtacattctttcaattttccaagatgaataagggcatcttattatgcactaacgtggcagcacgtgggcttgatatttctaatgtggactatattgtgcaggatgatccttcagatgacctaaatgacttcattcatagagttggtcgtactgcccgaggtgattaaggcataggacgccctgtattgttcttacttcccaaagaaatgaagctgcttatttacc

SEQ ID NO: 3338 - DNA, 446 bp, Triticum aestivum
  Clone ID: LIB3280-058-P1-K1-G8
ctcagattataggcgaaggccttgggtcgcttggcatcaaagagctcgagctgcttgaaaaacaacttgattcatcctcaaggtacataagatccacaagactaattgattgctttccatataatcatgatttagaagataggagcactagctctttcattatgtacagaaaacaatacaaattgttcctttgtactgcatgtttctactctgttaaataatcataggcaatattatgctgctagatggtcatgatcacttttgaccagtgttgtaggtagattacacctatttttgtcttgctttgtttttaagtaaagttgattagggtgtgtgccatgatcaagcaataagcaaaatggagtctctttaagctgcaaatttagcccagttaagttcaatggacataacacatcttacggtaatgagcctttctgtacactaca

SEQ ID NO: 3339 - DNA, 449 bp, Triticum aestivum
  Clone ID: LIB3280-058-P1-K1-G9
cgcctcccggccggccggagtggatcgtactcatacgtcgaccatggccacgcgccgcagcagcacgggcggctcccacgtctcctccctcctcgtccttctcttcctcgcctccgcctcgtccttcctcctcggcgcccgcgccaaaggccccgtcgtggacgtcaaggcgtcctgcgccaagacggacggcccgatcacctgcaactccttcctcgggcccgagccggacaccaagacggcggacgcgcgcgggctggcggagatcgccatgagggtcaccgccaagctcggcggcttggtgggggcctacgcgcgccgcgagctggacctggtcaaggacaacccgacgtggcagtgcctggacgagtgcgccgaggacatcgaggacgcgcttgcgcacctggacgacgccctgtgcggcgtcaacgacgcccagttcgaccagg

SEQ ID NO: 3340 - DNA, 460 bp, Triticum aestivum
  Clone ID: LIB3280-058-P1-K1-H1
ttcgaccagcacgcgcgcacggccctggccttcgtcacgctcaagtccaacggcgagcgtgagttcatgttctaccgcaacccgtcggccgacatgctcctgaccgaggccgagctcaacctggacctgatccgccgcgcccgcatctttcactacggctccatctcgctcatcaccgagccctgccgctcggcgcacgtcgccgccatgcgtgccgccaagtcggccggcatcctctgctcgtacgaccccaacgtccgcctgccgctctggccctcggcgcaggccgcccgcgacggcatcatgagcatctggaaggaggccgacttcatcaaggtgagcgacgacgaggtggccttcctcacccagggcgacgccaccgacgagaagaacgtgctctcgctctggtttgagggactcaagctgctcatcgtcaccgacggcgagaaggggtgcaggt

SEQ ID NO: 3341 - DNA, 408 bp, Triticum aestivum
  Clone ID: LIB3280-058-P1-K1-H10
tgactgttggattatcagcccttttttgatggataggtgctactgaccagctaccatggatggaagaaacctcatcaaaaactaatacatatgttactgattccgagccttcaaagttttcttttgcagtagcatttattttgcacggttcatcttccatgcaaagagaagtcctagaacttttaggtgctggtatggcagttgcagccgtttgggaattgctcctagctgtaaattttctattatgattaacctgagagcaatcctgactaacatcagcatcctcagtgttaccatagtccttgcaatgaacagagagatattcatggatggagctggtaaggccactcattttcatggcagctagggacacagaaacacaagtttgagaaagttactgaaagggaa

SEQ ID NO: 3342 - DNA, 453 bp, Triticum aestivum
  Clone ID: LIB3280-058-P1-K1-H11
atgagcctgactgccagagaatggaaggagcaagatgtgcttgattaccatgtttcgtgcggatcggcaggcttgtggccagggttgctctccagagccccgatgtcgggctggtcgccgtcaacgaccccttcatgagcactgactacatgacctacattttcaagtatgacactgtcaacggacagtggaagcaccattgagttaaggtgaaggactccaagccccttctcatcggtgagaaggaggttgctatgttgttttcactgacaaggacaaggctgcagctgacatgtagggtggtgccaataaggacatcatttctgctcccagcaaggatgctcccatgtttgtctgtggggtcaatgagaaggaatacaaatctgacatcgacattgtcttcaacgctagcttgaccactaactaccttggtcctcttggttatcaatgaca

SEQ ID NO: 3343 - DNA, 379 bp, Triticum aestivum
  Clone ID: LIB3280-058-P1-K1-H12
tgcaaaggatggtctgaaaggtgcacctggatctaagaaacctgagaatgataaatcgccgggtaaagatggtgacgccccgccacaaaaaccagaaatacccgacaatgagtgtgaaaagcgtatcacaccagaggttataccaccaagtgagctaggagtgacatgtgatgacattggagccctggctgatatcaaagagtcgcttcaggagctggtcatgcttcctcttcggcggcccgaccttttcaagggaggaggacttctaaagccttgccgtggaatattgctgttcgggccacctggaactggcaagacaatgctcgctaaggctatagcaaatgatgctggcgccagcttcattaattgtctcaatgtt

SEQ ID NO: 3344 - DNA, 236 bp, Triticum aestivum
  Clone ID: LIB3280-058-P1-K1-H2
ccgcaccccaacccaaaccctaccccgccgccgccgtcgccgacgtagcgcgcggaggcgacctcccaccgccgccaagatgcagatcttcgtgaagaccctggcgggcaagaccatcacgcttgagggggagttctcggacaccatttacaaccgtcaaggccaagatccaggacaaggagggcatccggccggaccagcagcgcctaattttcgccgtaagcagttcggggacg

SEQ ID NO: 3345 - DNA, 409 bp, Triticum aestivum
  Clone ID: LIB3280-058-P1-K1-H3
tagcaaccaactgattgccatacggcgccaccgcgaatcaaaaggttaagacgcctattaccgcgcgcgccactgccgatcgatcgacagcagagtagcagacccacgcgcgccatgtcgtcgccggagcctggaagcatcgccagccggtggcgcgagctgcatggcgcggggtcgtgggagggcctgctggacccgctggaccaggacctgcgcgccttcatcatcgcctacggcgagctggcggaggccacctacgatgggttcaactcgcagcgccgctcgccgcacgccggcgcgtgcttctacggccatgccgacctgctcgccgccgccggggtgtcccgcgcgggctactactccgtcaccaagttcatctacgccaccagcgggttcttcctggcgccca

SEQ ID NO: 3346 - DNA, 393 bp, Triticum aestivum
  Clone ID: LIB3280-058-P1-K1-H4
gcacaaaccaaatcccgctcccacaatttccggaatagcaagcgcgccgccgccgttcgggttcgagatgttgcctagggttgcgccgttttcgggcaccggcgccggcgcagcgggtggccagcttttcggggcggggcttacccgccgtttcgggaaggtggcggggggccttccctgttggggcaggtcggccgtctggttcagggcctgggcgaatgggaaggaggtgctcaacggcttgatgttcccacctaccgaggagctaaagggggagctctctctcctgccgcagggcaaggaccattcgctcgccaggcacaagtttgtcgacgagtgctaggccgccctcaacgagcatatcaatgtggagtacaatgcctcgcacgcgta

SEQ ID NO: 3347 - DNA, 445 bp, Triticum aestivum
  Clone ID: LIB3280-058-P1-K1-H5
cggacgcgtgggcggacgcgtgggcggtaagtaagaaactctctaaccaccgatcctaaagaagggcaaagggactcgaaggccgtctaccaccgccggccacctccatagcagtgccggcggcaccctgtacgtctacaccgaccagctgctgcgttacccatctgctgcctttcttctccggcaatctcctcgctgttggagacgctaatttaggtggagacgtggagccatgggctacacaaggggtgcacaagcaggcagcaagtttctctcggtactcaacaaccttatgttgatgactatcccacgtggagagtggagatcattttctcatctaagaaatctctcaacgtctatgccgctaatgctaaaggatgtaaattatgatgtttaggcgggcattaggagtgggctcaaaatgcatgtactatcatgcacatta

SEQ ID NO: 3348 - DNA, 248 bp, Triticum aestivum
  Clone ID: LIB3280-058-P1-K1-H6
cccacgcgtgcgtgagtgtaatgaaatgattggagacaactgctgcctaccacttgtaacaaggcgtaaacgaactcttgtgacgagtaccactaaccatcacctccatatcggttgccgacacagcttcgacctttgcatgagcaacatgttccttgcctacattgaaaggtatgttatagcatactgtcttcgatcgcggagacgctgcatgaggtggggataatgacccttttgcatcgcagggg

SEQ ID NO: 3349 - DNA, 382 bp, Triticum aestivum
  Clone ID: LIB3280-058-P1-K1-H7
cccacgcgtccgctgaaaacttattctgccacaacacttcatgcagaaggtgacatgcatggggtccgagagcaaacgcagcatgcgctggctgcatacttgaatgcactctcaacagaggtagatcatgtaccatccaaggtgtccatcggtgctctcctgtcgaaacaagggcccaagtatctcccggtggcgaggagcttcctgtcggacgccctaaggctcgagcctacgaacaggatggcctggttctacctaggacaggtccacaagcatgacgggaggctagctgaggccgtcgattgctttcaggcggcctcgatgctcgaggaattagacccaatagaaagactccgaccggtctgttcggtcaattggaaca

SEQ ID NO: 3350 - DNA, 410 bp, Triticum aestivum
  Clone ID: LIB3280-058-P1-K1-H8
cagaccacagctgcggcggcgcgcgcataggaggcgaagcagtagcggagccaagccaccgacgccaccatgggtatgtggcgtgactccatgcacaagcgccgggccaccggtgggaagcagaaggcgtggaggaagaagcgaaagtatgagctcggccgccagccagccaacactaagctttcgagcaacaagacagtgaggagggtccgtgttcgcggaggtaacgtgaagtggagggctctccgactggacactggtaacttctcatggggtggcgaggctgtgacccggaagacccgtttgctgaatgtggcttacaattcgtcaaacactgagcttgtgaggactcagaccctggtcaagaatgccattgtgcaagatgatgcagcccctacaaagcgggggta

SEQ ID NO: 3351 - DNA, 240 bp, Triticum aestivum
  Clone ID: LIB3280-058-P1-K1-H9
ccgacaccgactgcgtgatccatcgcctccagcttctacgcgagccttcatttagcggatcatggagctgaccaatgcccaagagcaagcccaccggcgtgaagagagatctgatcgggcatattatcaagcaagggcactacaaaggaggctacaagaatgcgattgagggcaacaatgtggagcagtacttctctcgacatctctgtgccgagccctttgcgccacctttgtggacaa

SEQ ID NO: 3352 - DNA, 364 bp, Triticum aestivum
  Clone ID: LIB3280-059-P1-K1-A1
tcgccttccagttttggaaggaagcctcttttggaagtcgccgaggaggccatggcccgtacgaagcagaccgcccgcaagtccaccggtggcaaggccccccgcaaacagctcgtcaccaaggcggcgaggaagtcggcgccgacgaccggcggagtgaagaagccccaccgttacaggcccggtaccgtggcgctccgggagatccgcaagtaccagaagagcacggagctgctgatccgcaagctgccgttccagcgcctggtgagggagatcgcgcaggacttcaagacggaccttcgctttcagttccacgccgtgctggcccttcaggaggcggtcgaggcgtaccttggtggggctt

SEQ ID NO: 3353 - DNA, 360 bp, Triticum aestivum
  Clone ID: LIB3280-059-P1-K1-A10
agaagcatgaagttcctgattcaaaagaaaaccaaccaaatggaggaccacattttcgcttgtgcaattcttagacacgattccagctcctaatggccaagatagctcggatggcctaaggcacaaaagaatccacagtaaatcaggcaacagcaacagaaggatggggggaataccataacaaaaacatccatggcaccaagtacaaagatacccttgactaaacagccaacagaactgaatccaaagtatcggctaaactgcaaaaaacagataattccttaggacaaaacactgctggtagcaacttatgcttcagtctgctccctcaagcgacggatggtgctcctgacagtgact

SEQ ID NO: 3354 - DNA, 397 bp, Triticum aestivum
  Clone ID: LIB3280-059-P1-K1-A11
caaacccttcagagtctcttctcaaggagctacaagttgtagaggacatgaaggaccactgtgatcagaaaagagaggaatatgaaaccatgcggtcagcctataaagataaaggacgatcaaggcatcccaaaactgaaacattctccccagaacaattgcaagcgtcctatctcgagtaccaagaagatgcaacattattcatatttcgcttgaaatcattgaagcaaggtcaattcttgagtattttaacacaggctgctcgccatcatgctgctcagttgagttttttcaggaaagggttgaagtatctagaggctctagaacctcatgtaaaagcagttgctgagaagcagcacattgattatcacttcagtggactagatgatgacactga

SEQ ID NO: 3355 - DNA, 396 bp, Triticum aestivum
  unsure (1)...(396): unsure at all n locations
  Clone ID: LIB3280-059-P1-K1-A12
cggacgcgtgggcgccgcgcctcctcctcgcccaaggtaggagcttgtgaaagttctctaaggctgagaagatggttctgaagaccgagctctgccgttttagcggccagaagatttaccctgggaagggtatcaggttcattcgttcggattcgcaggttttcctctttgccaactcaaaatgcaagcgctacttccacaaccgcctgaagcctgcaaagctttgctggacagcaatgtacaggaagcagcacaagaaggacatccatgctgaggctgccaagaagaggcgccgcaccaccaagaagccgtactcacggtcgattgttggtgccactnctgaagttatccagaagaagagggctgagaagcctgaagtccgtgatgctgcccgag

SEQ ID NO: 3356 - DNA, 397 bp, Triticum aestivum
  Clone ID: LIB3280-059-P1-K1-A3
ataccctggaatactgtattggggtttcaccaatgtagatgaaattctacataccggaaaaagtgcttcagctcctgggatttggctattagctcagttggctgctgcaaaagttgttgcgactgcactatgcaaaggttctggtcttgttggtggcctatatgccccaagcttgatgattggtgctgctgttggtgctgtttttgggggctcagcggcagaattaataaactctgccattccgggtaacactgctgttgcacaccctcaagcttatgcacttgtgggaatggctgctaccctagcctcagtttgttcagttccattgacatctggtctactactttttgaactgccaaaagattacagaattctacttcctctgttgggagctgtt

SEQ ID NO: 3357 - DNA, 383 bp, Triticum aestivum
  Clone ID: LIB3280-059-P1-K1-A4
gaacccctgattttactgacaataaaacaagtctgaactgcagtaatacgttcagacaatttgtttcatacagaatcacacaccacagcatctgtccatgaaggagaaaaagacttcttttccaacttacatacagatcaagcataagttatcacacagtcaatgaacacttaaacagccagcagcctaatcgctactgccttcggtggcatcaccggtgtccctgggcttcttcactcggaaattaggacgagtgtctggtcttttcctggcaacaggagggtcggaaggtatccggatcgttgatagcggcaccattatagggtcagactcgggcgccggccctctgatgctcacaagacagagtcccctgcgatcagctt

SEQ ID NO: 3358 - DNA, 343 bp, Triticum aestivum
  Clone ID: LIB3280-059-P1-K1-A5
gctccagccgcccggacccgccgccgctgcagggcctagggtccagctgccgctggtacaggggagccaccgcggcggtcggcccgctgtcgacccctgtgaacctgggcgtgagcatcgtgccggagaggaaggtgttcgtggtggagcgcttaggcatgtaccacaagtctttctcctcggggattcacttcctcgtgcccggcattgaccgcatcgcctacgaccactcgctcgaggaggaggccattcaaattcccgtacaaccctgccatcacaaaggttggcaccttgatctagattggaggagtgctcacatgttaagtatgccgttcctttcctt

SEQ ID NO: 3359 - DNA, 380 bp, Triticum aestivum
  Clone ID: LIB3280-059-P1-K1-A6
gcgggtttggtgtctgtgtctgtgttcgatcaccaggtccgatccagagcgatttggcctgttggaggttgtgattgctgtctctccgaggaaagaggaagttctcttctgaacttcggatttagcttgtggatgggcggacctttggtagactgcagtgctgaaggtgtgagcagcagctcatgtctcagccgcagcacctgtggaaaagcaggttttgagcacagctcttgtgctctccctgaagatgaaaagtttgaagctggaatagcatgtgtgaaagatgatttggttgtcaaggaaatcagtttggctcttgttgaggtgattgcttgtctataatgactatgatgatgaaaagactgttcttagttaatact

SEQ ID NO: 3360 - DNA, 346 bp, Triticum aestivum
  Clone ID: LIB3280-059-P1-K1-A7
ggatgttgtgaagaatttctttgagggaatttgtggggaggttgctcgacggaggctgcttggtgattacgtgcatgccacgtgcattgcctttgatgagtttgttcatgcagaaggagcaattatggccctcaactgcactggcatgcttcttggctcgcttcctgtttgggtgagcccatacaagaccccagttcgcccccgttcgactcgtgcgaagttgtacttgggttgttcctccatctgaagcccgcgttcagagcatctattttcggcaacaaaccctagtcggggccttagagactgttgcgttcttggattaagatacttttgttgaagaaaggag

SEQ ID NO: 3361 - DNA, 401 bp, Triticum aestivum
  Clone ID: LIB3280-059-P1-K1-A8
cggacgcgtggggtggaaatcggtaggaagaagaaagctgctgcagctgccaagaaggatgctgctgagggacaagagtctgaggttgctgctgctgccacagaggaagcaaagaagagcaacaatgtccagaggaagcttgagaagcgccagcagggacgtacactggactctcacattgaggagcagttcagcggtggaaggctgctggcctgcatttcgtctcgccctggacagtgtggcagagctgatgggtacatcctggagggcaaggagctggagttctacatgaggaagctccagaagaagaagggcaagggtgccacagcttaggctgaagagctgctgcatgttacttgttggattttcttagatgttgcggccatgtcatgtttgcagac

SEQ ID NO: 3362 - DNA, 400 bp, Triticum aestivum
  Clone ID: LIB3280-059-P1-K1-A9
atcctttagcggtacaacaagcactttaaagactatttttggatgtagctcgagataaagcaacatacaattgtccatgggaaaaaaggatcagggaggtagactccaacatttggtattgtttgccatgtgccttatttatgagtcataacaaagcatagtctgataggaaattgcttcctcttgaacccaataggtaatatttcatcatctgattggcacaacggtattcgaggtagaaagcctctctttccaggatgttgccccaacacgattttaacatttataaaattttctggaaccacatactaccaacattgttccgttacacaaaccattagttggatccaggtgccgtagcaggatcacgagacaattaacctccagcttgagcacatgc

SEQ ID NO: 3363 - DNA, 409 bp, Triticum aestivum
  Clone ID: LIB3280-059-P1-K1-B1
gttcttgtgattctgacagatatgagctcatatgccgatgcacttcgcgaggtctcagcagcacgagaagaggtacctggtaggcgtggttatcctgggtatatgtatactgatttggccaccatatatgagcgagctgggcgtatcgagggaaggaaaggatcaattacccaaattcctattcttacaatgcctaatgatgatatcactcatccaactcctgatcttacgggatacattaccgaagggcagatatatattgacagacagcttcataatagacagatatacccacccatcaacgtcctgccatctctttctcgtctgatgaagagtgctattggtgaaggtatgacacgccgggatcattcagatgtgtccaatcagctgtatgccaactacgccattg

SEQ ID NO: 3364 - DNA, 392 bp, Triticum aestivum
  Clone ID: LIB3280-059-P1-K1-B10
cggacgcgtgggcgacgccgccgccgcaagccgtccgcctcgctcttctcccgagcctgggcctcatcctctcgcctctcctccccaacacagatttaacaatctagagttagcgcctccgtccgtctcgtagctgctcagatggcgatcaagaggaccaaggccgagaagaagatcgcgtacgaccagaagctctgccagctgctcgaggagtacaccaaggtgctcatcgccgtcgccgacaatgtctgctccaagcagctccaggagatccgcatgggtctccgcggtgactccatcgtgcttcatgggcaagaacaccctcatccgccgctgcatcaaggtgcactcggagaagaccgtgcacatggacttccttgagctcagaacct

SEQ ID NO: 3365 - DNA, 377 bp, Triticum aestivum
  Clone ID: LIB3280-059-P1-K1-B11
agacgagatgtagcaaaattacttgggtgtgtttcccataaaaaggttggacaagagtgagattgttcttgtcaacattatccaaccaatcaaaatccttttgacaaacaaaacatatcctcgacatgaaataatcaattacatgctcatttgggaggccgaccgggatatgaatatgatccatgtatatgatcgctaacatgggaaggcatgaagcgatctgaaactttactgctttttctgtatttgcttgcatcatcttcttctcttgaaagattgcaacctccttcatcgctcatgccaacaaatgcacatcccaaacgaattcaggaccgatctcccttcccctatgactaatggatcctttggcagatgtt

SEQ ID NO: 3366 - DNA, 401 bp, Triticum aestivum
  Clone ID: LIB3280-059-P1-K1-B12
gtcgtggtgcatcaactggatctgcataatcatcggcgtgcttctgtccgttttggcgcccatcggaggcctccgttccatcatcatcaactacaagacgtaccaattcttctcatgatctgctggaaacgtgcatgcagcagtccagctagctacttagatgcagcgtattatatgcatagtgtgtgttaccttgtcatgtttaaattaggccaaagaaatattcgtgtgtttgtggatgttgctcgatcagtttgtgataattaaagaggatcaatgcctaaatggaggttctctctttaaaaaaaaaaaaaaaaaaaaaatatattttaaaaaaaataataaaataaaaaaaaattataaaaaaaaataattaatataaatttatattaatatttaat

SEQ ID NO: 3367 - DNA, 406 bp, Triticum aestivum
  Clone ID: LIB3280-059-P1-K1-B2
cccacgcgtccgaccacgcgtccgcccacgcgttcgggttgctgcagctcctacagtcaagcctgttacattggaacttggtggcaaaagtcctattgtagtatttgatgatgtcgacattgacaaagctgttgagtggactctatttgggtgcttttggaccaacggtcagatttgcagtgcgacatctagtcttcttatccataaaaacatcgctaaagaattcgtcgacaggatggttgcatggtccaaaaatatcaaggtgtcagacccgctcgaggaaggttgcaggcttgggccagttgttagtgaaggacagtatgagaagatcaagaagtttgtagcgaatgctaaaagtgaaggtgccaccattctgactgggggtgtcaggcccaagcatttggag

SEQ ID NO: 3368 - DNA, 384 bp, Triticum aestivum
  Clone ID: LIB3280-059-P1-K1-B3
tgcatcttcagattgccatgaaagaactgagagcacgcaagatccccttcacgattaggcggtacttacctgatggaagctacgaggactggggagttgacgagctcattgtggaggactcgcggaagcgtcaggttggcggggactaaagctggtagactgtttgaatggaagactctgtgctgcaacaaaaccttgccctagtagctatatgcaatgtttagcactgaactgctgtgacaatgttatgctatcgtaacatgtgtgggctatgtctgcccattgtgttgtgctactactgtaaaccaattgcgtggttgcgttagtttgcttggaccattgctggcatgcagctacaagttgcgaatgaacacctatcctaaa

SEQ ID NO: 3369 - DNA, 275 bp, Triticum aestivum
  Clone ID: LIB3280-059-P1-K1-B4
ctattcagctgaaatcatggcagagaaaacacacaagttcacagtctgttacacatcatcacttgactgatcatccacacagaggggcccaaaaaaaaatagtgtaaccagcctacacaacgcaagagctcacagcctgttacagacaccatcacttgactgatcatcatccacaagaccaatgttaaaagagaggcttaccaagtggtacggccgaaagatggagttagagatcgtgattatttcacggatatgatgtggtagaggtttcttta

SEQ ID NO: 3370 - DNA, 404 bp, Triticum aestivum
  Clone ID: LIB3280-059-P1-K1-B5
cgcgagtccgaagtcaaggcgaaaaccctcgaggcgaagcgagagtcagataggataccgcgagagacgagagtcgagtgagagggtggaagggaagccgagatgaagctcaacgtgaagaccctcaagggcacaagcttcgagatcgaggcgacccccgaggcctcggtgggtgaggtcaagagaatcatcgagagtgctcaggggcagaatgtgtaccctgcggatcagctgatgatcatatatcaaggaaaaattcttaaggatgataccactctggaagttaataaggttgcagagaacagcttccttgttataatgctgtctaagccgaaggcgtcgtctagtggtgcttctactgcttcaaagacacctgttagtcagtctcaacctgccactccacc

SEQ ID NO: 3371 - DNA, 401 bp, Triticum aestivum
  Clone ID: LIB3280-059-P1-K1-B6
caaaactggagaggaaaagaaagttgtgatatcagttgatgatgggattaggccagggaccacgctatgtggattggccaagcttaagacagtttttaagaaggatgggactacaactgcaggtaattctagccaagtgagtgatggcgctggagctgttcttctcatgaagagatctgtagcggtgagcaaggggctccctatacttggcgttttcaggagtttcgctgctgttggagtggatccagctgttatgggcgtcggtcctgcggtcgccatacctgctgcagtcaagtctgctggccttgacattgacgacattgatctctttgaattgaatgaggcctttgccttccaatttgtctactgttgcaacaagctgggcctcgaccggtcaaagg

SEQ ID NO: 3372 - DNA, 372 bp, Triticum aestivum
  Clone ID: LIB3280-059-P1-K1-B7
catcttcctccctgcctcccctcttcccccgccgccgctcgccgccggcgtccctcgtcccggtccggagcctccggtcccgcccccgcccccgcccccgcctcctctcctccgcgcgcacgacccccgtcctcctccccgccgccgcgatggccgccccggcccccgccgcctcctcgaagagggacctgctcatcttcgacgccgaggagaacctcgcggtggccctggccaagtacacggcggatatttccgccaagttcgccgccgagaggggcgccgtcaccgtcgtgctctccggcggattcccttatttacgccctcaggaagctgacggaggcgccgtacctggagactgttgactggagcaag

SEQ ID NO: 3373 - DNA, 400 bp, Triticum aestivum
  Clone ID: LIB3280-059-P1-K1-B8
aaaaaaaaaggatccagccctcagtctcccctatggcggccttggcctgtgcatctaatgtgcgccgcctcctcctccaccccggcgccggagctccggcgagatccttctactcccagccctaccaagccaaggtaggcgtggtggagttcttgaatggggtcggcaagggggtggagacgcacgccgcgaagctggaggaggccgtaggaggcgatctccagaggctgctcgagacccgcacgctacggctcaagaaactcggcgtcccctgcaagcataggaagttgattttgagttttgcccacaagtaccgccttggtctttggaagccccgggcagaagccaggaaagtgcagtaaagttgatttgttttcaaagtgtccacttggagaaatta

SEQ ID NO: 3374 - DNA, 401 bp, Triticum aestivum
  Clone ID: LIB3280-059-P1-K1-B9
tctgaacggagtcgagtattcattgcctatcaacaatgggccgaacagccttcatggtggattgaaggggtttgacaaggttgtgtgggatgttgtagagcgtaaagatggcgagtacccatcaataacctttcaatatgagagcaaagatggcgaagaaggttaccctggcgatgtaaccgtccgagcaacgtattctcttccggaggccaccactctaagacttgatatggaagctataccagctaacaaagccactcctatcagcttggcacagcatacttactggaaccttgcaggccacaactctggcagcatcttggatcattcgatccagatctgggcaaaacacgtcactccagtcaatgaaaacacgattcctaccggagaaataatgcccg

SEQ ID NO: 3375 - DNA, 408 bp, Triticum aestivum
  Clone ID: LIB3280-059-P1-K1-C1
ctcgacctctcacctagcgcacatccatggcgcgcttcctcgtcgccctcctcgctgccaccctggtcgcggttcaggctggagggcagctgggccacgcagcgccggcgacggcggaggtgttctggcgcgccgtgctgccgcactcgccattgcccgacgccgttctccgcctcctcaaacaacctgcagcagaagccaccagcttcgtaagagaccccgaggacaggccccccttcgactaccgtgattacagccgctcgtcgtccgatgatgaaccaagcaagcgcaccggcgccgcctccggagcggggggcttcgactacgacaactacagcggcgccgacgaacgccgtggcgccaccgatgaatacaaggcgccgagcagcagccccgctggaagcgggg

SEQ ID NO: 3376 - DNA, 399 bp, Triticum aestivum
  Clone ID: LIB3280-059-P1-K1-C10
gcagtttcttgatttgacgcaggccagatcgctttctggtgttttcttttccccggagtggttgaggcggtccccgtcctcggtcggagacggacatggcggcggcgaacggaggcggcgcggcgctgttcagcgaggaggaactccgggatgtgagcgggctgcgcctgcgcgagggcttcgtggagatgatgtgcggatgcaccagccgccgctacggcgacgccgtcggccgcctcttaatctacccgtccggcgagctggagattagctgcgactgcacgcccggctgccgcgaagaaaagctgactccttcagcgtttgagaagcactctggaagggagactgcaggaaagtggaggaacaccgtgtgggtcatgattgatggagaaaaggttc

SEQ ID NO: 3377 - DNA, 401 bp, Triticum aestivum
  Clone ID: LIB3280-059-P1-K1-C11
tgcgcattcccttcccttcccctccacctcgtcgccctcgcagatcccccaccccccggcgaatggcgtcccgtctcgcgtcccgcctcctcctccgccgccccgccgccgtattaagtttgctccagagttctagacatgctagacatttcagcactcagttacttgaaggtgttccgagacttccaaagccaacatgtgaacgctatttccttcgaaatgcttctccttatcaaatttggagtagatcatttgcttcagagaatggtgacttggttgaagctgttgtgcccttcatgggtgaatctgtcactgatggaacccttgccaatttcttaaagaaacctggtgatagagttgaagctgatgaggcgatagctcagattgaaactgacaaggtt

SEQ ID NO: 3378 - DNA, 382 bp, Triticum aestivum
  unsure (1)...(382): unsure at all n locations
  Clone ID: LIB3280-059-P1-K1-C12
cccacgcgtccgggcttctgatactgaggccaccgaggaggccgtcagttttgccctggattatgccaagaagctcggcctttgcaagtcaggagattcagttgttgcggtgcatcgtctcagcgcatcatctctcgtcaggatcttgacagtgaattagtgtcaggtgaggttggctcatggggacaaattttgttaggttgttatcggatcctcgctatcattttgttggctcatcccacgtcgtgagtcctatattacgtcttgtgttcagctacgcatagtaaagagttggtgtcgcccattctgaatatcctttgctaaataatacatactctccctactcaatatatatgccagttcgttcattanatatatatat

SEQ ID NO: 3379 - DNA, 408 bp, Triticum aestivum
  Clone ID: LIB3280-059-P1-K1-C2
ccctgctggattcaatgggtgggagttgtggagacaccgccgccgccgcccgattcaggcgaatccattgccggctatggaactccttctgcagctgattactactcctagaagatcccctttggttgaggaggtggatggaagtcatctctccatggatctgctggataaaggacggcgacgtctttcagggcagtggaagagccgccgccggcatcctttagggcagacgtgcggaactgtcagaaacaggcaggcgtggatggacgacgggagagctcggcccagttgtctgcaaaatggatgcaacctggtggtcaaagaggttcgctagaaaaccagaaatctaacattttgcctgtgtctgcttcgttgataatgctgggatcaaagtaatctgggatgagt

SEQ ID NO: 3380 - DNA, 410 bp, Triticum aestivum
  Clone ID: LIB3280-059-P1-K1-C3
caccgttctccagtcgatcacgcacgctctcctcgccgccgagatgttcgggttcgggcaccaccacaaggaccaggcgccgccggcgtcgggccccaaccagatcttcaagatctactgccgcgcctccgaggactactgcctcgccgtccgcgacggcgaggtggtgctcgcccccgtcaaccccaaggacgagacccagcactggctcaaggacatgcgcttcagcaccaccgtcaaggacgaggagggcatgccggccttcgcgctcgtcaacaaggccaccggcctcgccgtcaagcactccatcggccagtcccaccccgtgaagctggtgccgttcaacccggcgtacgaggacgcgtcggtgctgtggacggagagcaaggacatgggcaagggctttcgct

SEQ ID NO: 3381 - DNA, 391 bp, Triticum aestivum
  unsure (1)...(391): unsure at all n locations
  Clone ID: LIB3280-059-P1-K1-C4
cttaactgcctcgaggccaagctggacgtggacatccccaatggtggccgcgtggtggtgctcaacaccgcgaacctgccgctggtcaaggaggttggtcttggtgctgaccttgtcaggatcgatgcccactccatgtgctccccaggcttctcctgtgactcggcctaccaggtgacctacatcgtccgtggcagcggccgtgttcaggttgtcggccccgacggcaagcgtgtgctggagacccgcattgagggcggcagcctcttcatcgtgccccgcttccacgtcgtgtccaagatcgccgatgcctccggcatggagtggttctncatcatcaccacccccaacccgatcttcagccaccttgctgggaagacctttgtgtgga

SEQ ID NO: 3382 - DNA, 411 bp, Triticum aestivum
  Clone ID: LIB3280-059-P1-K1-C5
gctcgacttagagatcagaaatggcaatgcagacgggctgctgctcggcggcggcggtcctcctcctcctcgtggttgccgcggccggtgcgtcggtcgccggggcgtcgtatgtcaggtacaaagaccccaagcagccgatccaggcgcgcgtggaggatctcctcggccggatgaggatcgaggagaagatcgggcagatgacgcagatcgagcgccacaacgcctcctccgccgtcatcgagaagtacttcgtcgggagcgtgctgagcggtggcggcagcgcgccgtcggagaaggcgtcggcagcgacgtggcaggagatgatcaccaagatgcagaaggccgtgctcagcacccgcctcggcatccccatcatttacggcatcgacgccgtgcatggcaacaaca

SEQ ID NO: 3383 - DNA, 404 bp, Triticum aestivum
  Clone ID: LIB3280-059-P1-K1-C6
gtgagcgttgggtgctgtgtccgtcggctaagcagcaagccggagctgcaagtcgttgaacatggggtgctactgtgaggatctcatgtctctcactctatgtgtattagtagaccatttcctttctgaatatgagctatgctatggatcttgggagcaggtcatccttagtttgcttacagtggagtagtggcggagaggtggaactgggagtggaggtcaacatattaaacgcacgcaagaactcatctctatgtacaagttctcggcagatctggcctccagagcaaacgaaacggacggccagatctccttgttggaggagggggatggagggatggataagctcttcatcgtggaaggcggtgtgtacgacacctgcgaccacgcctgcaacatttgtc

SEQ ID NO: 3384 - DNA, 392 bp, Triticum aestivum
  Clone ID: LIB3280-059-P1-K1-C7
catctgcgagtttcgccctcgcgcgggcgacgggcggcggcggcggcggagatgggctgctgcagcagccggagctcggactcgccggccacccgcgtcacgcgctggcgctccaccgggatcgtcgccctccgggacgccaaactgaaggtggtaccacatgaagttctgcaagtgggaaattcccttagaactctggatttgacaaataacaagatagttgaggttccccaggaagttggtaccattgtgaatatgcaaaggctggttttggctggcaatttgattgaaaacattccagctaatattggatacctgcggaaccttaaaatcctcacgcttgacagaaataggatcactgtcttggcctgaagaattgggttctctatcaa

SEQ ID NO: 3385 - DNA, 400 bp, Triticum aestivum
  Clone ID: LIB3280-059-P1-K1-C8
gaaaaacgcagccacgctctgcctcgccgtgctccgccccgccccaccacctcgcgcgacgccccgcgcgtcgtgcgccgccggcacgcccccaccttcttcctccccggctcattccccaccccacccctcgacccccaccaaccactgccctgtccaccatcgttgggcgcctccaccgaccacccacccaccggcgccgaccccgacgacccaatcgtacccgagacccggcgcccccatccatctaccttctcatcgcgtcgcgcccccgggcccccaaaagcaccgcccgacatgggacccgagcgggcaaccgcccaagggcgcctcccggcggtgcttccgggccaacaactactcacatccttccccacgattggttgcctccattaccctc

SEQ ID NO: 3386 - DNA, 401 bp, Triticum aestivum
  Clone ID: LIB3280-059-P1-K1-C9
cgttcgtgacggttgcgacgatcgagactctgaactggatcaggacggggcagttggtgcccctctcggagcagcagctggtggactgtgaccagtacgacggcgggtgtaaccgcgggtcctatcacagggcttacaattggattgtggagaatggcggcctcaccacggcagcggattacccgtacacggcggtgaggggcgcctgcaaccgcgccaagtccgcccatcacaccgtcaagatcctcggcggcggcgtgatcccgcccaggaacgagcccgaaatgcagcttgccgtctccgggcagcccatcggcgtggccatcgaggtcggcagcggcatgcagttctacaggagcggcgtctactcgggcccttgcgggacaaatcttgctcacgcc

SEQ ID NO: 3387 - DNA, 407 bp, Triticum aestivum
  Clone ID: LIB3280-059-P1-K1-D1
caacaagggcttcgagaaccactgcccgggcataatccccacctacaacacggtcgatctcgacggcaccatcacctacggcggctactccggcatggtggtggtgcacgagcggttcgtggtccggttcccggacaccataccgctggacaaaggcgcgccgctgctgtgcgccggcatcaccgtgtacagccccatgaagtaccatggtctgaacgctcccgggatgcacctcggcgtgctgggactgggcgggctgggacatgttgcggtcaagtttggcaaggccttcgggatgaaggtgacggtgatcagttcgtcgtcggggaagaagcaggaggccctcgagccagctaggtgcggacccgttcgttttcagcaaggatgccgactagatgaatgcttga

SEQ ID NO: 3388 - DNA, 363 bp, Triticum aestivum
  Clone ID: LIB3280-059-P1-K1-D10
cttctgcgccgtccaacgatattgcggcgtattcgtcgcaccgagacagagaccacgtctagaccgagcccaaggggttcgaacgggctcgccgggactaccaggctggcgacatgtacacgcacacatatatcaacgcagcacatatcaacaatctcagcctagcagagaaaaagcccacccgtgccgacaatggatacacaaaggcacacaactaagacatgggtgacggaacacacagacaaacttgcatgctaacacagtgtgagggactacacatgagatacatagacggacaatcaaaccatcgagacttagttcgctcttcatgcatgctcatgatgggcctggagagcatgctac

SEQ ID NO: 3389 - DNA, 404 bp, Triticum aestivum
  Clone ID: LIB3280-059-P1-K1-D11
cgcatccccccggaccagcagcgccttatctttgctggcaagcagctggaggacggcaggacccttgctgactacaacatccagaaggagtccaccctccaccttgtcctccgtcttcgtggaggcatgcagatctttgtgaagaccctcactggcaagaccattacacttgaggtggagtcatccgacaccatcgacaatgtgaaggcaaagatccaggacaaggagggcattcccccggaccagcagcgcctcatctttgctggcaagcagctggaggacggcaggacccttgctgactacaacatccagaaggagtccaccctccaccttgtgcttcgtcttcgaggaggcatgcagatctttgggaagaccctcactggcaagaccattacgcttgaggt

SEQ ID NO: 3390 - DNA, 403 bp, Triticum aestivum
  Clone ID: LIB3280-059-P1-K1-D12
gtgatctcaaacaggcacacgagcaggtatgtgcaagtatatcatctgattcgacaaatatgaacgagcttgttcagtggaacgagctttacggtgaaggcggatctagaaagaagacacctctaagctacttcatgtagcttatgtctagtctgtacatagagcagaagcattatagtgaaacgactgagaagataggcaatgaatagctctgttggttttcatttataggcaatttttttgagtcaattgttttgtaatgtcagtttggagttcctacagatagcgtaggacctggttggtccaccattctccttgaacggtcaaacctgtatgtagactgagcatcagaatacagttcagttaattgatgttccagccagtgcgaatccagttaggtctt

SEQ ID NO: 3391 - DNA, 406 bp, Triticum aestivum
  Clone ID: LIB3280-059-P1-K1-D2
gctgcagaaggaggtcgacaggctgaccgagctcgccgagagggctctcctggacgcctccaaggccgaggaggacgtttccaacataatggtgttggctgagcaggccgtggctcttgagatggaagcggccaagcgcgtgaacgacgcggagctggcgttacagaaggcggagaaggcggtcgagtccgttgtggagctggtgccggctgctgatgggcacatgagtgacgaagaggacgatctttctgatgtttatgactatagcggtgacggcatggctgacatttctgaagggatgaggtgtcaaatgtcgagcgtttgatgcagattagcgacttggctgctgaaggcatcgagccgcttgaaccgtctaatgaaatgcctgttgaagaacgcagtgaca

SEQ ID NO: 3392 - DNA, 372 bp, Triticum aestivum
  Clone ID: LIB3280-059-P1-K1-D3
agccatgtagccactgtaaagaagaaaaggattgggacgttcgtgcgccggccggaaaaccttgtgtccactgttcttcttcttccacctccattcaagtgagaggagaggtagctagagggctgcggttccaacaaagatggggtctgagcgtccaattcccacagtacccgaggaatcccaaatatgattcaatcggccatgtgtcatatggaatgtcgaggaggacaggggagggagttgggatggcaggcggccacctgtatgaaggacgatgggaataaaatgagataagggggagcacccaatttaaatgggaattcatcagtttcttgtggaggtcatggggagaggaagtgatgcgcgtataat

SEQ ID NO: 3393 - DNA, 405 bp, Triticum aestivum
  Clone ID: LIB3280-059-P1-K1-D4
tcccgatcaaacgcggcggcggcagcagcggcagcgcaagaggtagattggagtatcaccaccaccgcgcaagaaatggcggccgagactttcctcttcacctctgagtctgtgaacgagggccaccctgacaagctctgcgaccaggtctctgacgctgtgcttgacgcgtgcctcgcccaagacgctgacagcaaggttgcctgtgagacatgcaccaagaccaacatggtcatggtttttggtgagatcaccaccaaggccacggttgactatgagaagattgtgcgtgacacctgccgcaacattggcttcatctctgatgatgttggccttgatgcggaccggtgcaaggtgcttgtcaacatagagcagcagtctcctgacattgccccaggtgtgcac

SEQ ID NO: 3394 - DNA, 382 bp, Triticum aestivum
  Clone ID: LIB3280-059-P1-K1-D5
gcctgtcgtaaaaccttgttggccaccgcaattgccaatgagtgccaggctaacttcatcagtatcaagggacctgtgctggtgaccatgctgtttgccatgagggaggctaatgggcatgatatctttcacaagactagaggcacagctccatgtgtactatcatttgatgagcttgactatattgccacctatagaggaagcaacagaggcaatactggaggtgcagctggtagagcgctgaaccaactgctgactgaaatggttggcatgaacgccaagaaaaccgtctagataattggttctaccaacaggcctgacatcatgcaccctgtcatgctcaggccagggcgtattgcacagcttatctacatgcttattt

SEQ ID NO: 3395 - DNA, 406 bp, Triticum aestivum
  Clone ID: LIB3280-059-P1-K1-D6
ggaatggatcccaaacactacgtgggtgagcacacatatgtcccagtcacccagaagggatattggcagtttgacatgggtgatgtcctggttggagggaagtccacaggattctgtgctggcggttgtgccgcaattgctgattctggaacttcactgcttgctggccccacggccatcattactgaaattaatgagaagattggtgcggctggggtagtcagccaagagtgcaaaacaattgtttctcagtatggacaacagatcctcgacctgttgctagcagagacccaacccaagaagatctgctcttaggttggtctgtgcacctttgatgggactcgtggtgtcagtgctggaattcggagggtggttgatgatgagcctgtgaaatcgaatggccttc

SEQ ID NO: 3396 - DNA, 399 bp, Triticum aestivum
  Clone ID: LIB3280-059-P1-K1-D7
ttttcctctcccctccctctcgcctcgcccccccagccgcgatcgaggaggcgaaactaatatccgcaccaggaatcaagaggggatcgacctccccccagtccgcacctccgccctgaatcccctgccgccggttcgccgccgccgccgccaccgctcccgatggatttggatctgtggatctccaaggtcaaggagggccagcacctcgccgagcacgagctccagaccctctgcgaatacgttaaggagattcttatcgaggagtctaacgtgcagccagtcaacagcccggtcacagtgtgcggcgacatccatgggcagttccatgaccttatgaagctctttgccaccggaggacatgtgcctgggaccaactatattttcatgggtgatttt

SEQ ID NO: 3397 - DNA, 381 bp, Triticum aestivum
  Clone ID: LIB3280-059-P1-K1-D8
cttttatcacaatacaagcgcggcggaggagctgtcttctgagttgaccggagagggagcacattggagaggcttctgagatggccaagggtttactgatcgatccatcctgattgggatctgtttgtggtcctggttgactggctggtgcgtcgtgccgttgctggtgcttgaggttgtctcgctggtttccttgcagtatcgtcgatctgtgcattcaggcaccccaagcttttcctcgcgcgatggcatcatgcgcacggagggagctcttctccgttgatgtggtgaacaacgaccgtgatctccgttccacggcttcaccggctagtaaggccgagacaagcatcctaaggatccagttagaatgatgactgattt

SEQ ID NO: 3398 - DNA, 400 bp, Triticum aestivum
  Clone ID: LIB3280-059-P1-K1-D9
cgcgctcttcctcagggttgaggctgaagaacaaccggaaatttcagaggcatatggagttacagcagtgccatactttgttttatgcaaggaaggcaaacctgttgataccttggagggcgcaaacccagccagcctggccaataaggttgcaaagttagctgggcctgccaatgttgctcagcctgctgcacctgctagcttgggggtggctgctgggcctgctgtactcgaaaaggtccaagaaatggcacggcaaaatggatcttctgctgctgaaagtacactgaagaagcgtttggagcatcttgtcaactcccatcctgtcatcttatttatgaagggaaatccagaagaaccaaggtgtggtttcagccgaatggtggttgacattttgaag

SEQ ID NO: 3399 - DNA, 405 bp, Triticum aestivum
  Clone ID: LIB3280-059-P1-K1-E1
cccacgcgtccgcccttccgccccctcccgacgatcgcccccgctcgtcccaccgcggtgggcgatcgctcctcacctccgtgcgcgcgattcctgaggcgaggcgaccgacaccagattccgccggccggcccacctcccccgcttcgccgatcggatcgcgtgctccatgaggtagaggtgacgataaagcatagttgttgacttagcttgcagtggttctttatcaaagctaaggcagataataattggcgttatggcatatcgaatggtatgcgctccccaagtcattgatcttgagtctgagcgagggcatcctcatgttcattctgaaagtttaattcacaatgggaatgatttgtccgaccaaggcggtcaatatactgtcagagttgtaggcaatgc

SEQ ID NO: 3400 - DNA, 229 bp, Triticum aestivum
  Clone ID: LIB3280-059-P1-K1-E10
cgctacattgcacggtcgcttcgatgccacttggtaatcttgattagagaactcggaatcaatgcgtctggtagtactactcgcgtgtctcatgtcaaacctgattgagtgatcctcatgagggaccaacaagaacagacgccacttttgtcattgtgttgtgaaggccttatctgatactagtatttcctgtgtgctgctttattgattgttacatgtatgtgctgcc

SEQ ID NO: 3401 - DNA, 400 bp, Triticum aestivum
  Clone ID: LIB3280-059-P1-K1-E11
gccccagtgagtgcgggcaagaaaggcaggaagtagtaatcccttctgttaggacaaactgggtattctggtgacattaaacttttgcagacggttaatgtggatagacggtcttttatcaaaatgcatgtactagcgattcccctgcttgcgcttgggctcctaggcacttaccgccaaatcatttggttgcttctgggcgacgatggttgctatgaagaccatctcgctttccatccggactatcgggctatgtagatagagactggcatttagtcagaggtgcgcaccttataagtgcatgtccttgacttggcggaaggaggtgaaacaagttcatccaatgatgtgcaacatcctttggagtgctttgggccctcgcgtttcagtttcacggaga

SEQ ID NO: 3402 - DNA, 406 bp, Triticum aestivum
  Clone ID: LIB3280-059-P1-K1-E12
gctgcgcactgatcgcggcggcgagttcacctccatcgagtttggcgagtactgcgccgatcgaggtgtgcagcggcagctcaccgccccatactcaccccagcaggacggggtggtcgagcggcgcaaccagacggtggtgtcaatggcgcggagcatgatgaaggcgacggcgatgcccgccaagttctggggggaagcggtgaccacggccgttttcctcctcaaccgcgcgcccacgaagagcgtgcgcggcatgactccctacgaggcctggcatgggacgcgtcctgcggtgcacttcctccgcaccttcgggtgtgtggcacatgtcaagaacgtgcgcccgcacctgaagaaactcgacgacagatcgacgccgatggtgttcatcggctacgaggaa

SEQ ID NO: 3403 - DNA, 179 bp, Triticum aestivum
  Clone ID: LIB3280-059-P1-K1-E2
cggacgcgtgggcgccgcagcagcccaaaattcaggtcaaaccctaagattcgccgtcgccggcgagcacctgcgatggctggcggcggcgctggatccgtggtgaacgggacgccgcgcaggcgcgaccatgtagccgtccccgcccccctccctgacgaggtggtccagtgggaaat

SEQ ID NO: 3404 - DNA, 403 bp, Triticum aestivum
  Clone ID: LIB3280-059-P1-K1-E4
cggacgcgtggggtttgataaaggatctgaagatgctaccattcaacaagtgaactgggatccctcgaaagttaaggataagcttaagcgtgacattgaggctcatgtggtgtcagttcgtgctacaaagctttctgaactttgtgccacatatgagggcaaacttaccaaagctcttgcagaacctgttgaagctcttctagattcagccagagaagacacctggccagctattagaaagcttctttagcgtgagacaaaagccgccgtttcaggtcttgaatctgctatttcaacttttgagcttgatgaagctactgaaaaagaattgctcttgcggctggagaatcacggaaggagcgttgttgaatcaaaggcaagagaagaagctgcaaggatcttg

SEQ ID NO: 3405 - DNA, 405 bp, Triticum aestivum
  Clone ID: LIB3280-059-P1-K1-E5
gtattcttgcagagttatcagccctcgttgacctagaattaacgtttgatagagccctggaagaaacaattgccatctacgggacagcattcgcaatcctaaagcggtttcgggtcaactgcaagaacatggcacacctaaccttccaagttggggcaatgcccaagctccagtgcatctctctagggttgaatgccttggggtggaagcaggaaaattacgccacacctacaggtatcgagaacttgttcgcgcttgaaagaatttctgtaacaatcggctgcctggatgctactgaatctgaacagagaagcgtagagtctgccatcaggagcgctatcaacatgcatcctggccatgctcacattacaaccaatattgcacgggaaccataccgtttttctt

SEQ ID NO: 3406 - DNA, 410 bp, Triticum aestivum
  Clone ID: LIB3280-059-P1-K1-E6
atccgaacccaccgtatcctcgtcgccgacgacgccaccatggcggcgctcctagcccggcaggcagcgctggccctccgcgccaggcagacggcgcgtctaggcccgtccgcgacggcgatgcagggccacctccggacctacatggacgcgggggcgcccaagaggttcaaagaggacgaggagaaagaacagcttgcgaaagagctcgccaaagattggagtgctgtgtttgaaaggagcatcaatacattgtttttgactgaaatggtccgtggtttgatgctgacgctcaagtacttcttcgagaggaaagttacaattaactatccatttgagaagggccctttgagccctcgtttccgaggggagcatgctctcagacgttatgatactggggaagagcgatg

SEQ ID NO: 3407 - DNA, 399 bp, Triticum aestivum
  Clone ID: LIB3280-059-P1-K1-E7
cgaaaccctagccgccgccgccgccgccgccgccgatcaccgcgagcaggctcagatgggaggcaagtgcccacaccgcaaggtcaagaagcgccgtctcaactgcaagcaggtgcgccgcggcaagttcctcgtcaaggccgacgacgccgtctacgacgagctcgtcaagctggccgaccagggcaaggattccgagggcaaggcgctgcccgtcgacgaggacctccccggcatgggccagttctactgcctccactgcgatcggtacttcgcggatgagacagtgaaggaggatcactaccgctcaaagcgccacaagaaaagggtcaagcagttgtctggaccagccccacacacgcaaatagatgccgatctcgctggtggaatgggaatgcc

SEQ ID NO: 3408 - DNA, 399 bp, Triticum aestivum
  Clone ID: LIB3280-059-P1-K1-E8
gagaactatgggttggttacttaccgggaatcagctttgctttatgatgagcaattatcggcagcatccaacaaacaacaggtagcaatcaccgttgcacatgaattggctcaccaatggtttggcaatcttgtaaccatggaatggtggactcacttgtggctaaacgagggttttgcttcatgggtgagttatttagctgtagaatccatttttcctgaatggaataactggacacaattccttgatgagacgacctctggcctcagattggatgcacttgcagagtctcatcctattgaggttgatgtaaaccatgccagtgaaatcgatgcgatttttgattccataagctacgacaagggagcttctgtcattcgcatgctacaaagctacctt

SEQ ID NO: 3409 - DNA, 391 bp, Triticum aestivum
  Clone ID: LIB3280-059-P1-K1-E9
gtccctcgctgcagccgcgacctttctccacctcccggactgcaccgcctgctgctaccacttcgtcgccattccccgctccctcgccggccgccgggccctcctccttcgcgcgcgcgcgccccgacgcggcatacgtcgtgtgcagcgccgcggcggcggtcgacgcctcggaggcggagcccgtggagaagttccggatggacaacctgagccgggacaagggggcgcggcggaagcccaagcggaaggggcgcgggatcttggcggcgcagggcgccagctgcgggatctgaatgcgcgagcagaacgggcggcttcagcccggcgtccgacgaggtgtcgcgggcgagcaaatgcctgtttatcgtctactcgctgagcaagaccg

SEQ ID NO: 3410 - DNA, 366 bp, Triticum aestivum
  Clone ID: LIB3280-059-P1-K1-F1
gataaaacgggccggccgcctccctcggccccgacccgcacgccacgcgggactcacccacccaccctcttcctccccctccctcccatcttcctccctaggatgcgcgcctccccccgcctcctccggccggaaccctagccaggcgtgcaggcgcgcagcaggcggggcccccgcgccgcgccgatggggaggccggggtacctgacgctgcccatcttcgcggtgctcgccgcgatcggctacgtctactacaccacggtcttctgcgccgtcgccggctggctcggcctcgccacggccgccggggtcgtcaacgccgccggcttcacggtcctcgccgccgtctgccttttacaccttacg

SEQ ID NO: 3411 - DNA, 404 bp, Triticum aestivum
  Clone ID: LIB3280-059-P1-K1-F10
cccacgcgtccgtggagatgatcgagcgctccgtgctccagcgctaccgcctcaagtccttccacgtcgtggcgcactccctcggctccgtcctcgccctcgcgctcgccgtcaagtaccccggcgccgtcaagtccctcacgctcctcgccccgccgtacttcccggtgccggaggaggaggcgggggcggcgacgcagtacgtgatgcggcgggtggcgccgcggcgggtgtggccgccgatcgcgttcggggcgtcgatggcgtgctggtacgagcacgtgagccggaccatctgcctcaccatctgcaggcaccaccgggtctggaacaggctctttaggatcttcaccagaaacaagatgaggacgttcctgatcgaggcgttcatgtgccacacccac

SEQ ID NO: 3412 - DNA, 405 bp, Triticum aestivum
  Clone ID: LIB3280-059-P1-K1-F11
ttatactgcagacatgggcattggtggtggacctgatgaagccaaacttctgtgtaatgcaatgcataaggtgactgtattgtgatacattggttgagcaggtatctgagctctcattcgggttgctgagcagctgcggaattgctttacctgcgcaggttctgtcggtgcggaagttgatcttctacggagcatgttctggtcaactgcgaagtagatttgtcggattcataacctgcaaaaataaaaagatttgtgctacctccgacccatagaaggtgtcgcagttttgaacgacacttattttggatcagagggagtagggtttatttgtccagtttggtagctccttacctaaatataattgtaggcatcatccaacaggcatgatgacaagcagcgact

SEQ ID NO: 3413 - DNA, 408 bp, Triticum aestivum
  Clone ID: LIB3280-059-P1-K1-F12
cgacgctcaagcccccagacgccgcagcgccgccactccacccgcagcggcaaccatggcggtcggcaagaacaagcgcatctccaaggggaggaagggtagcaaaaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgttcgaagtatctctagctgatcttcagaacgatgaggaccaggcctacaggaagatcagactccgtgctgaggatgtgcaagggatgaatgtcctcacaaacttctggggcatggacttcaccactgacaagctcaggtctcttgtgaggaagtggca

SEQ ID NO: 3414 - DNA, 379 bp, Triticum aestivum
  Clone ID: LIB3280-059-P1-K1-F2
agagcctcttcctaccaatcaacaggcctacagagaccatcacctatatgcccttgagaagtggctgcacaagaaccaagttcttcatcccaagggtccagtgcttggcttctgtaaggggcatcctgtttatcctagatcttgtgttcaaacactgcaatcaagacacggatggttgacggagggtctgcaagttagagaaaacgagtcgcctgcaaagattgtcatacgaccaaagaggattttcaactcccagtcgcgtgaatccaatagcaacgaagatgaacttcaggcaaccacggaattatatggcaaatggcaactcgaacccctgcaacttcctggtgctgtaaatggcattgtgccaaagaatgagcgt

SEQ ID NO: 3415 - DNA, 404 bp, Triticum aestivum
  Clone ID: LIB3280-059-P1-K1-F3
cccacgcgtccgctcagctagggatgctctaaacgtcatggacgcggctcgaggtggaatatgcaactgggaccggagccagccctgtctcgccctcagactcaacaccaccactgacgcctccaggagcactggcgcatcaccggtggcgccggcaaggcaacggttgtggttaggctttagtgtcaggttcctcacagctgtagctgacggggaaacactgctatgctcgctatccggggggggggtttgggcatgccacttgtgctccttcggattgacatcgatgcctccacgctcggagtctgctgtatctacgggttcctagattgtatatggcccattgtataagatgcagtttggattattaatctggaacaactatattaatggaggtgttgttt

SEQ ID NO: 3416 - DNA, 409 bp, Triticum aestivum
  Clone ID: LIB3280-059-P1-K1-F4
caaaatcatcggcacactttaggataccagttgtattttgtatctttgagtggctaatttcaaattgaaactgagattgcttactgcttacaggctgcttactgcttacaagattgaaatttgaacatttgtagcttctaaatgtattgtagcacatttggattaattcctgaacataaacaaacatgatgatccagatctaatgaaaattctgaatgcaactggaaaacatttgtttgtgcaatgaccgtataaataaaaccaaagtgcggctgagttgacgttgatagacttgtgcgtgctctgccactcgtaaccttttttttctcccatcgatcatgttctatctccagtgctcatgtctgatggtcattcctaatagtatgcttattctttcaggtttaagctg

SEQ ID NO: 3417 - DNA, 405 bp, Triticum aestivum
  Clone ID: LIB3280-059-P1-K1-F5
tctccacacatttcatcggagaagcatggtttccatggcggcggccaggatcgccgtcctcctggccgtggcagcgctcttcaccgcggcgggggcagcggatccccaacgcgcaaagggagcacattgctggcggtgctactcttcctgcatgcacaagtgcgacggccaccgtgatgccgccgcccgctctgccagccgtactcagcccgcagtccacacaaccgtcgatgatggtgcagcagcctcctccatccccgtcaactctaccaatggcactgcagcagtcgtacactccaccgatggcactctagccactgttgacaaaaccgatccagcagtcggccacatcggtgatgccaacgacgacgataacaaggactacgacatagatgaccacaagga

SEQ ID NO: 3418 - DNA, 410 bp, Triticum aestivum
  Clone ID: LIB3280-059-P1-K1-F6
aaccattccaagatatttgaggaacatgaagcacccggagcaagatcgttctttacggagataatagcatcaatttcagatgtaaagttttcaagggacggaagatatcttcttagtcgtgattatatgactctcaaactatgggatctaaacatggattcaggccctgtttcaaccttccaggtccatgaacatctaagaccaaggctttgtgatctgtatgagaacgactcaatatttgacaagtttgagtgttgtcttagtggggatggacttcatgttgcaactggctcttatggtaatctattccgtgtttttgcttctactcctggtagcatggaggtgaccactttggaagctagcaggaacccgatgagacgtcagattgcaaacccgaccagacccactcg

SEQ ID NO: 3419 - DNA, 397 bp, Triticum aestivum
  Clone ID: LIB3280-059-P1-K1-F7
gggattgtttcttagtggcacgaggccagtctgggttatggtttgtcgacaacgatttcgggtgcatccacagttatgtgatggtcccattgaagcctttactgttctccacaatgtaaactgttgtcatgggcttatatatgttacatcacagggttttctgaagatatgtcaactgcccgaagcatataactatgacaactactggcctgtccaaaagatccctttgcatggtacccctcatcaggttacatattatgccgagcagtctctgtatccacttatcgtgtctgttcctgttgttcgccccctaaatcaagttctgtcaattatggctgatcaagatttggttcatcacatggattatgatgctacaagtgccgatgacctgcaaaaa

SEQ ID NO: 3420 - DNA, 395 bp, Triticum aestivum
  Clone ID: LIB3280-059-P1-K1-F8
ggcgatcagcaggccttgctcgtgtatatgcattgtggaacattacttcactggttaatgttgttgtggctttgatatgcggattcgttcactataagtcgtcaaccaagagacatccaagcacacagccatggaaccttggaacggatgaaagcggctggtggctgtttccgactggactcatgttgttgaaatgcatccaagcaaggcttgttgattggcatgtgggtaatctagagatccaagaccaagcggtatacagcaaggacccgaacatattctggcagtcgtgacatctggttttaacagaggtgcttttgatagctttttacaactcgattttttgggagttgataaaagaaaaggagtggggggcagctcggcctttctttatt

SEQ ID NO: 3421 - DNA, 391 bp, Triticum aestivum
  Clone ID: LIB3280-059-P1-K1-F9
ctccgtactactgtttccccagagaaaacaaattgggcggaattgggatgcggaaggaggaggcagccatgtcggcagcaacggggaagccgatcctgtacagcaaatggttcagctcctgctcgcaccgggttcggatcgcccttaacctcaaaggtgtggattttgagtacaaagcgaccaacccgatgacagatccagattatgagaaaatcaatcctgttaagtttgtcccagcattagtggatggggattttgttgtttccgactcgttcgccatcattttgtatatggaagacaagtatcctcagtgtcctctcttaccccgagatctgaaaaagaaagctcttaatttgcagattgcaagcatagtgtgttcaagcatccagcc

SEQ ID NO: 3422 - DNA, 406 bp, Triticum aestivum
  Clone ID: LIB3280-059-P1-K1-G1
aaaggattggggcgttcgtgcgcccgtggcggcgttcgtgcgccggccggaaaatcttgtgtccattcttcttcttccacctccattcgattgcgaggagaggtagctagagggccgcggttccaacaattggtatcagagcttggtgtcttgggcgtgcttgccgtgccggaggcgtggcagcgatggcggcgcttgccgggagctgcgcgttggagctccgggtcgtgtgtcggcctatggaggtgggcggcgctgtggctgccatggcgcgtggcggaggcggcgggcggtgacgtcgtacgtgcggcaaccgcggaggccgccgaggcgctgcgtggtggcgcggtggcgcgtcacgacatggcggcatggaagccgcggcggtgcagggcaataagacgcg

SEQ ID NO: 3423 - DNA, 146 bp, Triticum aestivum
  Clone ID: LIB3280-059-P1-K1-G10
ggcggtgcagtggccggtgatggtggtggtggtgatgatgggggcggcggtggctagcgtgggagcgtacatggactcggaccgaatcgagtgctcatagcattttgtggggctttctccttttttgtattatgtgcaagggcagg

SEQ ID NO: 3424 - DNA, 403 bp, Triticum aestivum
  Clone ID: LIB3280-059-P1-K1-G11
ggcggcgtttacgtcgtaaccatcttcagaggtgtagccttggagggccagcctttggatgtcatgtggggctctttcgttttcaagggcggtgtatgtcggggctgcggctccaggatcttctattaagtgtcgaggctgcggcctcgggcagtactgcgacgacagctccaagaggtagggctgcttgtcggcatggcttgggtgaggaccttgaagtgcggaagcagcaaggttgtcagctccgtcaatgcgccccagtcgggactgttggacgacatgttggggcagcggcccaggatgtggtgcagcgtttgtggtctatgtgcggttggcctgagcagcgtgagctgcgggtagctgtatcgtccggcgtagtgccggccaggttgtcgctcatcca

SEQ ID NO: 3425 - DNA, 405 bp, Triticum aestivum
  Clone ID: LIB3280-059-P1-K1-G12
cccacgcgtccgcccacgcgtccgtttatggcgaaggagacaccggtgtacatgttttgcatcacgcttttggaggagacggcgaggcggaaccgaagctcgctgatgacgcagcctgagaccctccttccccttcatggcatacagatccttgacggaaccagtgtccgcaacgacgcgactcacgaccggctactccttcatgaggtgcacgtccgtgacggataggttaatgaagaacagattacagacgtacaggctttgcaccacgtttcttagaggagacggtgtggcggaatcggagctcggcgacgacacagcccgggactcgcctcccccttcatggcgtacaaatttttgttcgaaccagtgtttgcagcgacacactacaagaccgatcccttc

SEQ ID NO: 3426 - DNA, 366 bp, Triticum aestivum
  Clone ID: LIB3280-059-P1-K1-G2
atttaattatggttggttggattattatttactgtaaaaaaaaaaaaaaaaaaaaaaaaaagaaaataaaaaaaaaaataaacaaaataaaaaaaaaataaaaaaaaaaaataaaaaaaccaaaaatatctaacaaaagaaataaagggcctgccgttttggggtgtccatgccttcccccccgcgcatgcgcctacatttgcttttttcgggagcccctaaatttaatctcctgcccgtttttataccccttgtggtcttgggaaacccttgttgtcacccaatttaaccttcttgccacctcttcctccttttttcctgtctgcttatattgcaagaaggccctgccccttttttcccttttcc

SEQ ID NO: 3427 - DNA, 344 bp, Triticum aestivum
  Clone ID: LIB3280-059-P1-K1-G3
cgcgcctcctcgacatccagaccgcgctggcgtcggtctcgccgcggggcgcgctcatcgccggcgcgccggggacggtggacttctcggcgctcgtcgccgtggccatggaggcggccacggaggccggcgcggtggcgaccaccattttcgagggcaagctccccgggttcaacacctccgtgccggacttcaaggtctgcctcagcaactgcagcgtcaccatgaaatccgccatgaagaagatccacggcgccacggccgccttgaaggtccacgcccacctggttgccaaggtgctcgtcgaccgggccatcggcgacgtgttggcccgcaccatcagc

SEQ ID NO: 3428 - DNA, 408 bp, Triticum aestivum
  Clone ID: LIB3280-059-P1-K1-G4
cagccgcctgcgcctagggttccgcccccatgaccgtcgccgagccggagatgccggcgtcagagcgcaggctcgtggccctcgccaggtgggacgcgctcatcgatcgtttgggtcggcatcgcggcgtccctcgccaaggtcatcgcgcgccgcgctctgggcgaggtcgagggttccgccgttctcgcggcggcgtcctggctctcccaccactcccttatcttcgctgctctgttcacccccgttgccttgattctcgtcggcgcgaccggagtgcgctccgcgcacaacaccaggaaggatatcaaagagcccccgaaaactcttcgccaggttgcgcagatgatgctcaaggatcctgtcattggtggagcgcttgttttgctggtcttcctcccgctcata

SEQ ID NO: 3429 - DNA, 415 bp, Triticum aestivum
  Clone ID: LIB3280-059-P1-K1-G5
atttacccgtctaggaagagacatggaggaaattggtgttcaaaaaagcttcaagttggcggaaaaggttgcatctataatggaagaagcacaacctctcctttcacggattgaagcattagctgaagaagttcaacctttgctctcggaggtgcgtgagagtgatctggtgaaggatgtggaaaccatagctaaaggtctggctgaggcatccggcgatttaagaaggttgaagtcttccatgcttacccctgagaacagtgatctaatcaagcagtctattttcacccttatatttactttgaagaacattgagagtatcagctcagacatctctggtttcactggcgatgaggcgacacgacagaacatcaagctgctgattaagtcacttagcagactattgggatccctc

SEQ ID NO: 3430 - DNA, 415 bp, Triticum aestivum
  Clone ID: LIB3280-059-P1-K1-G6
cgaaatctgagccaggaaccatcaggggtgaccttgctgttgttgttggaagaaacatcatccatgggagcgatggcccggagacagccaaggacgagatcgcactctggttccagcccaaggagctggtctcttacaccagcaacgaggagaagtggatctacggtgtgaactaaccgctgcatcgtcttcagaagagccaaagaagctccagtccctttccgtaatcgcgtctagaccatggcagagtgcaataacaccgcgacccgggcgacctttcagtcggtgtcgcccttgcccttgtctcgttctgatgcaatagggcccgaagaaatttaaagagcttgtacctttgaatattatagagcgtgcaccgagcaatcgtgatgttcaaatcaaaccgtcgccttcaggc

SEQ ID NO: 3431 - DNA, 399 bp, Triticum aestivum
  Clone ID: LIB3280-059-P1-K1-G7
gcttttcccaaggacaatagtgtctattcatacttaccgtgataggatctatgttggtgatatgcaagaggtatgctctcatcgcctatgtatatgtgtagccaagaagagaagccgccgatttcacttgtgcacaatataaaacggtttttatcttaactattgacctaattataatgttaatagtgagggaaaagctcatgatataccatttacagattggattgattcatgtctgggttagagagaggatagggatggattacttggaatacttttgaacttgatagatatgcatcgtctatctctcataggcctttttttgtctgtttcattgaacaatgttttttgagctatattatagctagttttttttgattcaaaacaaagatttcagtt

SEQ ID NO: 3432 - DNA, 399 bp, Triticum aestivum
  Clone ID: LIB3280-059-P1-K1-G8
gccgcccgaacacaagcccactcgaacaaaacccaacccatctcctcctccctccgtattctattcctcatcgtcgtcgtctctctccagcactgactttctccgaatccctcgcccccctctgctctgttaaccccgtgctgccatccattgcggggctgcgatcctgcgccggtgctggcacctggtaatcagcacgagcaccgccgtccggcgcatcgggttagggtgtcccagatttgaaaggctgaggttaccctttgttggaaaaggctttgccatagagctgggacatggacatggcattgccgattgtgaatgccaccacggcagcgcttgctcgtgtctcagctgcattcaacgctcctcttgcccgtgctgtcgtcttcggggttcata

SEQ ID NO: 3433 - DNA, 386 bp, Triticum aestivum
  Clone ID: LIB3280-059-P1-K1-G9
ggcaatctcaaggttgtgtacttcgtcaattctgggaccgaagctaatgaattggcaatggtgatggctcggctgaacagcgggaatctcagtatggatgcattgagaaatggataccacggtgggagtgctggaacaataggtctcacggttttgcagacgtggaagtacccgattcctcacggtgagattcatcatgtgatgaatcctgatccttaccggggagcttacgggtctgatgctgcagcttatgccagggaagtcgaaaaacatataaattttggcagatcaggaagggttggaggatttattgcagaaactttccaaggtgcatgaggtactgttgaacttacttctggatacctgaagtcagtatatgatactgt

SEQ ID NO: 3434 - DNA, 438 bp, Triticum aestivum
  Clone ID: LIB3280-059-P1-K1-H1
ccctgccgtactcgcccgtaagacccacgcgtacgcacacgcgtgcgcccacgcgtccgcccacgcgtccgtacttatttctcaatttatgctgaccaagaggatggcactccactttttgggggctctttgccacctcctttcccatctccctgtactgtgagggttgcacttgccagatatgccgatctgttgaattcacctaaaaagagtgttttacttgctttggctgctcatgcatctgaccccaaagaggccgagcggctcagacatctagcatcttctgctggaaagaaggagtattctcagtggataatcgctagtcaaagaagtctcttggaagttatttcggagtttccatcggcaaagcctccgcttggtgtcttctttgcagctattgctcctcgccttcagccgagatactactcaatatctttc

SEQ ID NO: 3435 - DNA, 405 bp, Triticum aestivum
  Clone ID: LIB3280-059-P1-K1-H10
tcgcccacgcgtacgattaaagtgtggttttcttacttaaatttaataatattaatctaatatgcccattggtgttccaaaagtaccttaccggattcctggagatgaagaagcgacttgggttgacttatacaatgttatgtatcgagaaaggacactttttttaggtcaagagattcgttgcgagatcacgaatcatattacaggtctcatggtatatctgagtatagaagatggaattagtgatatttttttgtttataaactccccaggcgggtggctaatctcaggaatggctatttttgatacgatgcaaacggtgacaccagatatatatacaatatgcctcggaatagccgccttcatggcgtccttcattctgcttggaggagaacccaccaagcg

SEQ ID NO: 3436 - DNA, 452 bp, Triticum aestivum
  Clone ID: LIB3280-059-P1-K1-H11
acccctgcggtaccgccggcggagattccacggcgtgacccaatcgtccgggtggaggttatgaaacggttgggtagcaaatgtgtggaaactttgcagcaattgcctacgactgctgatgtggatgggaggctggtccattttttacgcaacctacagaacagcactaattggagagtagatgtggagcagtcaagttttggacaagaatttgccgcgtttctccggttccatagcgtggacctggattgtacccacaatcagctcctagttcgactcctgcgatctctggagagatgggaattggctgtccgctggagatgtagctacaagatagctcttaccaagtgtgttttgtactgtaaacgtttgattaatgagctttccttgcaatgagattaacaatcgttacaagattcaaatatactagttcttgagtgctctttggaaaa

SEQ ID NO: 3437 - DNA, 396 bp, Triticum aestivum
  Clone ID: LIB3280-059-P1-K1-H12
cccacgcgtgcgcccacgcgtccgcatggaccaagcttatatgtgggattcccaacccacagactaaacagatttctttagttcagatcatacttttatgtaggaaaaggctaggctcttaagaaccctaaccaatgctgctttggttttacaactttcattgcttctaacttccaaatcaaactgttgttacacacatatttgttgtatagatgcaccctaaaaattcctacatttactttcttgtagaattgcatttttctggttgtaaaaatagggtgagcaacagctttcttgtcaacatgatggcctcctgaagataattgagacccatccatcacttatttgtgaactaattttcagtttcttctgtcgatgataagtgagctacttttt

SEQ ID NO: 3438 - DNA, 422 bp, Triticum aestivum
  Clone ID: LIB3280-059-P1-K1-H2
caatcccctctccgcgatctcaccgggaaattcctcgaccgattgaaagccaaggccctctcgtcctccttcaagatgcagatcttggtgaagaccctcaccggcaagaccatcaccctcgaggtcgagtcgtctgacacgatcgataatgtcaaggccaagatccaggacaaggagggaatccctccggaccagcagcgcctcatttttgccggcaagcagctggaggatggccgcaccctggctgactacaacattcagaaggagtccaccctccacctggtgctcaagcttcttggaggcatgcagatttttgtcaagaccctcaccggcaagaccatcaccttggaggtggagtcctcggacaccatcgacaacgtgaaggcaaagattcaggacaaggagggcattccttcggacca

SEQ ID NO: 3439 - DNA, 375 bp, Triticum aestivum
  Clone ID: LIB3280-059-P1-K1-H3
ggggcgacgagtgcggccgtcccctgccccgtcgcccgcctccccgctatacatacccccgaccccaccgccccaaccctaccgctcacccccgcctcctccaccgtctgcgccctccgtcgcgccaccggaccgacaccgacgctccccgtgccccccttcctggtagaaaatggccgacgccgaggacatccagcccctcgtctgcgacaatggtaccggtatggtcaaggctgggttcgctggagatgatgctcccagggccggcttccccagcatcgtgggccggccacgccacaccggagtcatggtcgggatggggcagaaggacgcctacgttggtgacgaggcgcagccccagaggtgtatcttgac

SEQ ID NO: 3440 - DNA, 365 bp, Triticum aestivum
  Clone ID: LIB3280-059-P1-K1-H4
gacgccacacgcttccggattaccatggttctcgtcttcctcgtcgacatcatcccatcccctcccctccccctgccccagagaactggtataaaaaatgggcgagccaccaagatcctgtccttttgtgcgacccgactcctccaacttgtagcagctccacgcaggataaagagggttggaaagcccaagaatccccagagccccaccccgagatcccgagctttctgcgttgctccgtcgcaatccacaggaatccccatcggaggtttcgcgttctccgcgcggttcttgatccacggtgcgcaccgaggactcgtcaatgcagacgcacgcgagcggtaacgcttggcggtggtggcgcg

SEQ ID NO: 3441 - DNA, 437 bp, Triticum aestivum
  Clone ID: LIB3280-059-P1-K1-H5
ccggagatctccacggcgcgccccactcgtccgcgtgcaggttatgacacagtcttctcacgtaggtggcagcaccagcagcagcttgagttcttgcggatctgcggctgcgaatcccagtctcgtatcaactcagccaggcagaggagaagcaggaggaagatgtccaaggcggcgctgaccctggaggaggtgtccaagcacaacaccaaggacgactgctggctcatcatcgccggcaaggtatacaatgtgaccaagtttttggaggatcaccctggaggtgatgatgtactgttgtcctcgactgccaaggacgcaaccgatgactttgaggatgtcgggcacagcagcaccgcccgtgcgatgctggacgagtactatgtcggtgacatagacccggccacgatacctgcccggacgaagtacgctccgcc

SEQ ID NO: 3442 - DNA, 397 bp, Triticum aestivum
  Clone ID: LIB3280-059-P1-K1-H6
gcggctgcttgacagcccacgcgtgcgcccacgcgtccgcatggaccaagcttatatcgtgggattcccaacccacagactaaacagatggctttagttcagatcatacttttatgtacgaaaaggctaggctcttaagaaccctaaccaatgctgcttgggctttacaactttgattggttctaacttacaaatcaaactgttggtacacacatatacgttgtatagaagcacgctagaaatgactacatttactttcttgaagaagtgcatttctccggatggaataatctgaggaggaccaaggaccttgagaacatggtggccgagagcatgcatgatgaaggcagccatgtgttagtctactacaaggagggagctgctgatcaacttttct

SEQ ID NO: 3443 - DNA, 357 bp, Triticum aestivum
  Clone ID: LIB3280-059-P1-K1-H7
aacacaataaaagatttttccacttgatgtcaccacaatagaattttgcaaggttgagctcatctgtcatacacaactccctcttgaagatggcttttttcttattatttgcaattgtatgtgtcttaaagtcagatttgtactatgatttttctgcagaagtagctatttatcatttgtcttagaaaaatagcaaaatcgaggccataattatctgatcagctttagtgggcgaatcatggcattgtcctcatgatccaaaatgtgacagtgatagacgtagccgggctcggccgtggcgtctaaggggtaggcctcgccggtctccaccatcaagaacttgacgaccacctgtgt

SEQ ID NO: 3444 - DNA, 393 bp, Triticum aestivum
  Clone ID: LIB3280-059-P1-K1-H8
gtgaagtccctccgaaggatgaaccatccaaacattgtgaagctcaaggaggtcataagagagaatgacatgttgttctttgtttttgaatacatggaatgcaatctctatcagctgatgaagagcaagggcaagcctttttcggagactgagatccggaactggtgctttcaagtatttcaagctcttagtcacatgcatcaacgtggatactttcatcgtgaccttaagcctgaaaatctgctagttacaaaggagctcatcaaggtagctgattttgggcttgctcgtgagattatttctgaaccaccatacacagaatatgtgtcaactcgctggtatcgtgccccagaggttctacttcaagcttctgtttacagctcagcagttgac

SEQ ID NO: 3445 - DNA, 400 bp, Triticum aestivum
  Clone ID: LIB3280-059-P1-K1-H9
gtgcatgcttggtgatgcccagcatgtcgaccaggctgagaaaatgggacttgactacatggatgttgaaagtctcaagaagatgaacaagaacaagaagcttgttaagaagctagccaagaagtaccatgctttcttggcatcagaggccataatcaagcagatccctcgtctccttggccctggtcttaacaaggcaggcaagtttcccactctggttagtcaccaggaatctcttgaagccaaggtcaacgagacaaaagctacagtcaagttccagctaaagaaggttctttgcatgggtgttgctgtgggcaacttgtcgatggacgagaagcagatccaacaaaacatccaaatgagtgttaacttccttgtgtccctcctgaagaagaattgg

SEQ ID NO: 3446 - DNA, 439 bp, Triticum aestivum
  Clone ID: LIB3280-060-P1-K1-A10
cccacgcgtccggaggacaaagccacccacccaccaagagtcagtctctcccggtcccggctctccctccctccctcccctcgtgcggtagcctccaaatcatccaacgtccaatccacttccaacaagataccgccaccatcctccgcctgatccgacctctcttccatcagcgacagcgacctcgcaacccccggctccatcgggcgagggaatggaggaggagggcgcgaggaaggcggtgctcttcaggctgttcggcgtcgaggtccgcggcgcggaggaggatgatgacgcggagcccatggagctcaagaagagcaccagcatgcccaacctcgcctgcgcctccatcgtcccgattctcctgcccggcgaggccagcaacgacaagggctacgcctccgacgacggcgagctggcgtccacgccgcagctc

SEQ ID NO: 3447 - DNA, 447 bp, Triticum aestivum
  unsure (1)...(447): unsure at all n locations
  Clone ID: LIB3280-060-P1-K1-A11
gccaccgcgagagagagagctagcagtagcaggcggggcgatcgatgatggcggcgctctcctccctggtcctcgtccttttgctcgccgtcgcgtctcaggaggccgcggcgaccatcaccaggggcgacttccccccggggttcatcttcggcaccggctcctcctcttaccaggttgaaggtgcggtcgcagaggacggaagaaaacccagcatctgggacacgttcacacactcagggcacttcgtcgacggtgccactgctgatgtgactgcnnatcagtatcacaagtacaangnnnatgtaaagcttttgagcgacatgggcgtcgacgcctacagattttcaattgcctggcctcgccttattcctgatggccgtggagctgtcaatccaaagggactggagtactacaacaatcttatcgatgaactcctggctcatg

SEQ ID NO: 3448 - DNA, 444 bp, Triticum aestivum
  unsure (1)...(444): unsure at all n locations
  Clone ID: LIB3280-060-P1-K1-A12
ggcagtttgagaggactctgattgtggctgatgagaggagcacggttagctatttagaaggttgcacagctccagcatatgactccaaccagctccacgccgcggtggtggagctcgtgtgcaaagaaggggccgagattaagtactccaccgtgcacaattggtatgctggcgatgaggagggcaaagggggcatttacaattttgtgaccaagagggggcggtgcatggggcgtggctcgaaaatctcatggacacaggttgagactgggtctgtggntcccctggaagtacccaagtnnnnagcttgttgtggacaacactgtgggagagtactactacatagtactgaccaaggattaccagcatgccgatacagggacaaagatgatccataaggagaagatttcacgctaccggattatattcaaaggtatctaggca

SEQ ID NO: 3449 - DNA, 434 bp, Triticum aestivum
  unsure (1)...(434): unsure at all n locations
  Clone ID: LIB3280-060-P1-K1-A2
cgaccaaagacagcagccagcaagcctcaaacctcgcatcaccacctccatccccgtggcagcagcagcaagccaccagccgccgccgccgcagcagcagcaccagcagcagcgtgcctctctaaccttcctgccgccgcgagaggagctcgtcccagcggcagcacgtctcagcagcggcgccgggagaccagctggagatcggtttctgcagcacctgcctcctctcctcctccgcgccagggggagcgcgcgcgtgcgccagccaagtaattttnnntgagtgggctgcatacgtagatnagcaggactggaggaagagtacaatattctctggatatccagttgtagataaatacattctgagtcagctgtatttacatggaatcttttttctgagagatgccaacatctaagccaccatcggtgccacc

SEQ ID NO: 3450 - DNA, 266 bp, Triticum aestivum
  Clone ID: LIB3280-060-P1-K1-A3
tcgcggacgcgtggggcaaggtcatatgtttagccaaaatttgttcccttcaaaatctactcaatctggcggaagtttactcagctcttcggttgcccatttagcaccagctccatcgccaaacggtcactccactactataaatattgatcaagctgagaaaactgtggagttgttactaccagttgacattactactgtgaggattagattttctccaaagaatgatgatactggcagtcgtgctacagtggtatggcattaaa

SEQ ID NO: 3451 - DNA, 449 bp, Triticum aestivum
  unsure (1)...(449): unsure at all n locations
  Clone ID: LIB3280-060-P1-K1-A4
gaaaaatcttatctctttctcccacgccacactcccacctaaacctaggtcacctgccgccgccgccgccgccgccgttgcttgacctgcgtgccgatttggtcgcgttgcctcctctcccatcaacggcggcacctcccgcagcttcctgctacaatgtggtccttccccatggtcgaagcccaaggtgccgcctcatcgtccacaaaagaggagcccgtccgccgcatgcagccaaggggtcgagtcgaccgcggccgaggagccgcgccgcccaccgccagtgtggagtcnacccccgccgagcaataccgctgtacttcctcaagatccaggccgctgtagggtgatgctgtccgcaaccgaggagccaccttgccctctgcatccagaggttctgccccgccatccctcttccaccaccggcgacggctctcccctcccctgct

SEQ ID NO: 3452 - DNA, 440 bp, Triticum aestivum
  unsure (1)...(440): unsure at all n locations
  Clone ID: LIB3280-060-P1-K1-A5
cccacgcgtccgtgccctctccactatggagctcctccgcgcggtcgtcctgctctccctggcgctcctggccaacggccgggacaccgacctctcccgggacagcttccccaagggcttcgtcttcggcaccgcctcgtcggcgtaccaggtggagggcaactccctcaagtacggccgcgggccctgcatctgggacaccttcctcaagtttccaggtgccactcccgacaacgccaccgccaacgtgaccgtcgacgagtaccatcgctacntggacgatgtggacaacatggtnnnggtgggcttagacgcctaccgcttctccatctcctggtcgcgcattttccccaatgggatcgggaggttcaacaaagacggcgtggactactaccaccggctcatcgactacatgctcggcaacaacatcactccggaca

SEQ ID NO: 3453 - DNA, 438 bp, Triticum aestivum
  unsure (1)...(438): unsure at all n locations
  Clone ID: LIB3280-060-P1-K1-A6
cttaaatttactcccatcatcttctggggaagatacgggacaccgatcgccttctcgtcacctatgcatgtggttgttggtagacccattgagctgaagaaaaatcctctgcctaccattgatgagataaacgaagtgcacgggcaattcgtcggcgcgttgcaagaactgtttgagaagtacaagacgaaagccggatatcctggccttcatctgagagtcctataacactttcgtgtggagaataagtggcttgtaatatcacggcaacttcncgacgcttgcggcctgtttgatcnttgcacgatcactagtacgaagctggagtttgtccgagttgttaggccatgatgttggtactggcaagtgttgatgatcacacggtgcctttttgtgacagaattgacaagttccactggttgctcataatatcaagcc

SEQ ID NO: 3454 - DNA, 444 bp, Triticum aestivum
  Clone ID: LIB3280-060-P1-K1-A7
cggacgcgtgggttttttttgaaggtctctccctagtctttgggaaggagaagaacatacagtagatacattcatctgatctgcttagttaccgtgctttgtactcgtgatcactgatcaggatggcagaagggctcttctccatggctcacccgtgggcctccgcctttggcatcctaggcaacatcatatccttcctggtgttcctcgcaccgacgccgacgttcctgcgggtgtaccggaagaagtcgacggaggggttcagcgcggtgccgtacgtggtggcgctcttcagctgcatgctgtggatcttctacgcgctggtcaagaccaactccagcccgctgctgaccatcaacgccttcggctgcgtcgtcgagtccttctacatcctgctctacgtggtgtacgcgcccaggaacgccaggcaccgcgccctcgtct

SEQ ID NO: 3455 - DNA, 454 bp, Triticum aestivum
  unsure (1)...(454): unsure at all n locations
  Clone ID: LIB3280-060-P1-K1-A8
ggccgccgtggcaaatggcgttgtccagggcgcagacgaactccggcgagtcgctcatctcctccaccttcgcgtcgcgctacgtgcgcaccgcgctcccgaggttcaggataccggagcagtccatccccaaggacgcggcgtaccagatcatcaacgacgagctgatgctggacgggaacccgcgtctgaacctcgcctccttcgtcaccacctggatggagcccgagtgcgacaagctcatccagaattccgtcaacaagaactacgtcgacatgtgtcnnntaccccgtcaccaccgannnccagaaccggtgcgtcaacatgatcgcgcatctcttcaacgcgcccatcggggaggacgagacggccgtcggggtgggcaccgtcggctcctcggaggccatcatgctggccgggctggccttcaagaggaagtggcagaacaagatga

SEQ ID NO: 3456 - DNA, 456 bp, Triticum aestivum
  Clone ID: LIB3280-060-P1-K1-A9
gagcacgcaagccagtgtttgtagccagcagccacaatggccgggaacatgctagccaactatgtccaagtctacgtcatgctcccgctggacgtcgtgagcgtcgacaacaaattcgagaagggcgacgagatcagggcgcagctgaagaagctgacggaggccggcgtggacggcgtcatgatagacgtctggtgggggctggtggagggcaagggccccaaggcgtacgactggagcgcctacaagcaggtcttcgacctggtgcacgaggccgggctcaagctgcaggccatcatgtcattccaccagtgcggtggcaacgtcggcgacgtcgtcaacatccccatcccacagtgggttcgcgacgtcggcgccaccgaccccgacattttctacaccaaccgcggcgggacgaggaacatcgagtacctcacccttggagtggacgaccag

SEQ ID NO: 3457 - DNA, 450 bp, Triticum aestivum
  unsure (1)...(450): unsure at all n locations
  Clone ID: LIB3280-060-P1-K1-B1
actgaagaatcttctcagtcaggggatcgcttattctccagtcccattgccagaaagttggcagaagacaacaatgtaccgctttcaagcttaaaaggtactggtccagatgggcgtattttgaaggcagacattgaggattacttgtcttctgcagccaagggttcgaagaaggaagctgcagcagctccaggactaggttatgtggatcttccaaatacacaaatacggaaggttactgcaaaccgcctgctgcaatctaagcagactatccctcactactatctgacagttgatngccntgttgacaaacttatcaaattgcggagtgagttgaacccgatgcaggatgcatctggtgggaagaagatatctattaatgatcttgttattaaggctgcagcattggctcttcgtaaggttcctgcctgtaacagttcctggatgaat

SEQ ID NO: 3458 - DNA, 401 bp, Triticum aestivum
  unsure (1)...(401): unsure at all n locations
  Clone ID: LIB3280-060-P1-K1-B10
agcacccacagtggagcctaaatccaataaagctaaggagaccgatgatccaattcctctggtggataagagtgcgttcaacgacacaaaagttccgtcaagttctaccaaagattcagttgctccagaaaataatgcaaatggatgtggtttgtcagcttctcaagaggttgttgcaggaagtactacatgtgcaactaatcctgtgctgttaaaggacaaaccaagttctgaagtggagccagatgatgatttaccttcacatggcaagatggagtttcacatgactgaagatgcagttgcnntccctactgctgttcaagaagatttgaaaacccttacattgaggatatgttggcttgtatgtactttatttacatttagtttatacataatgaatc

SEQ ID NO: 3459 - DNA, 449 bp, Triticum aestivum
  unsure (1)...(449): unsure at all n locations
  Clone ID: LIB3280-060-P1-K1-B11
gtctcccgctttattaatcatagttgttcgcctaaccttagtgcccgcttagttctggtggaaagcaaagattgccaacttgctcatgttggattgtttgccagtcaagatattgctgttggagaagaattgtcctttgattatcgacggaagctgcaatccggtgatggctgtccctgccattgtggagctcagaattgccgaggccgtgtttattgagtttgcagggtgaaaaaataaaagggaatgatccattgcttgtagcgcatcttcagatnctcgtagaatggtgatcacttggcnactattaacattgtttttcctagagcttgaatgcagaggctggatcctcattcttgatgcaaccaattgagtgcaggggtggtgtctcattctgcatgccgtcagcaagtagtgtttgtgatatatgattcttacagtagtgacac

SEQ ID NO: 3460 - DNA, 448 bp, Triticum aestivum
  unsure (1)...(448): unsure at all n locations
  Clone ID: LIB3280-060-P1-K1-B12
gcttgctgaagagctgtgcatgccgcttgctgccgtcaagtactctcgtgggatgttcatcttccccggcgcacagcctgctccccacaggagcttctctgaggaggttgatgtcctgaaccgctacttcggccacctgaagtctggtggcaatgcttatgtgatcggagacccagcgaagcctggccagaagtggcacatctactatgccaccgagcaacctgagcagcccatggtcaccctggagatgtgcatgactgggctggacaagaagaagncctctgtcttcttcaagactcaanctgatggccacgttttctgtgccaaggagatgaccaagctctctggaatctttgacattatccctgaaatggaggtctgagactttgactatcagccctgcggctacttcatgaacgccattaacggatctgccgtctacaccatc

SEQ ID NO: 3461 - DNA, 297 bp, Triticum aestivum
  unsure (1)...(297): unsure at all n locations
  Clone ID: LIB3280-060-P1-K1-B2
agcgcttatccggtaagctgtgatcgtgtacgctaggaagtaaagctcaggtgattagcagtgagagcagactgaagaaagtgtattggatatggaagggggaacttgctagaatagtactactagtaatggttacaagtaggcagattagccctttaggtattgccaagactgtttgttgctccgtgacctgttgcctgtgtaaaaatcgcttgctctgtctgagtgtaaagggttaaaactttgcttgagaagcagtaaatcttgcgcgtgatctnnctgcattatggccccttt

SEQ ID NO: 3462 - DNA, 448 bp, Triticum aestivum
  unsure (1)...(448): unsure at all n locations
  Clone ID: LIB3280-060-P1-K1-B3
cccactcgtccggcttatgcaaataaatctgcccggtgtgagatgggttggtggtgttgaattggaattgattgccatagctacagggggacgtattgttccaagattccaagagttgactcctgataagcttgggcaggctggcttggttagagagaagtcatttggaacaacaaaggatcgaatgctttgcattgagagatgtgcaaattccagagctgcaactatcttcatccgaggcggcaacaaaatgatgattgaggaggccaaggggggnnnccaggacgctctgtgtgnggcaagagatctgatccgcattaactctattgtttatggcggcggctcaactgagatatttttgctctgttgctgtcgaagcttgcacatatcgatatgctggagccgagcaggttactgctgagttttaacagctaaattgcaacaagat

SEQ ID NO: 3463 - DNA, 271 bp, Triticum aestivum
  Clone ID: LIB3280-060-P1-K1-B4
tcgtccacacgttcgagaccgacgcccgctagttccgcaagatgaaggagaggctcgtcggcgtctccgaggagaccaccaccggcgtcaagaggctctaccagatgcaggagtccggcaccctcctcttccccgccatcaacgtcaacgactccgtcaccaagagcaagtttgacaacctttacggttgccgccactcgctccctgatggtcttatgagggcttctgatgttatgatcgccggcaaggttgctgtggtctgcggttatgg

SEQ ID NO: 3464 - DNA, 416 bp, Triticum aestivum
  unsure (1)...(416): unsure at all n locations
  Clone ID: LIB3280-060-P1-K1-B5
gcgttaggaggagagagagagggagagagagagagcttgtgctacgatcgatcgggccgggaaaggcgatggggcgatcgccgtgctgcgagaaggaggggctgaagaaggggccatggacgccggaggaggaccagaagctgctctcctacattgagcagcagggccacggctgctggcgctcgctgccggccaaggccgggctgcatcggtgcggcaagagctgccggctccggtggaccaactacctccggccggacatcaagaggggcaagttcancctgcaggaggagctagccnncgggcatctccatgcgcttttcggctacaggtgatcacccattccattatggaccgattgtactacatatgccgcttactttgcacccaatagttacttaactgcactgcctaat

SEQ ID NO: 3465 - DNA, 209 bp, Triticum aestivum
  Clone ID: LIB3280-060-P1-K1-B6
cccacgcgtccgaaacaagtttgatccagatttgtgtgtttcttacaccgaatgctcgaggtgctgctagtactttgttatctatctatctatctgtattataataccctgtggaattggaactgagtggtggctggaacttagattccggtttgctcatccgccctatctctatgaatgaattggtttgggctaaaaaaaaataaacc

SEQ ID NO: 3466 - DNA, 454 bp, Triticum aestivum
  unsure (1)...(454): unsure at all n locations
  Clone ID: LIB3280-060-P1-K1-B7
cccacgcgtccggccggtgcggcgggccgccaggggtttaagagcagaggccgcctcccgctagggtttttcggatctcacctctgccccttttctccatcctccgactcgccgccgccgccgggagccgacccaacaagcccgagcgccagccatggccatcggatctctcctcgcctcgcggctggccaggtccggccacgccctcgccacgcgcgccatcgctcaggctccccggacccacaatcatcatcacgcgacgtctcccctgctctccaggctcggagccgtggcccgcgctttcanctcaaggcccgccgccgccgatgtcatcgggatcgatttgggcacgacgaactcatgtgtctccgtcatggaaggaaagacaccacgggtgattgagaatgctgaaggtgcgaggacaacgccctccattgttgccacaaacagcaaa

SEQ ID NO: 3467 - DNA, 456 bp, Triticum aestivum
  unsure (1)...(456): unsure at all n locations
  Clone ID: LIB3280-060-P1-K1-B8
agaacacatcacatgcacgcaagcttccttcactggtataatagcagaggcacactacacgctagggaatctcggggctaacacatgtcgctcatatacacactgcgactggacaccgtctgcgctagccgacccaacaagcccgagcgccagccatggccatcggatctctcctcgcctcacggctggccaggtccggccacgccctcaccacgcgcgccatagctcaggcttcccggacctacaatcatcattacgcgacgtctcccctgctctccaagctcggagccgtggaccgtgctttcnnctcaaggcccgccgccggcgatgtcattggaatcgatttgggcacgacgaactcatgtgtgtccgtcatggaaagatagacaccaccggtgaatgaaaatgctgaatgtgccaggacaacgctactgcattgtagtcacaaacagctaa

SEQ ID NO: 3468 - DNA, 448 bp, Triticum aestivum
  unsure (1)...(448): unsure at all n locations
  Clone ID: LIB3280-060-P1-K1-B9
gccatggagaggccaaggtcagttggattaagagggctggacgttgccatggacaagggggtggaaccagtgaggccttcatcacatgaaggcagggttggggaagggaaaatcggagaggtgccagaaaggcccaagctgaagctgcttcctcgttccaagccaatcgaatcccctgcaccatcacctacctatatggaagagaagcaggtccttccggtccctgtgatagcgagtgtcatgcaggttgaggttgttcatgaagcgcgccagaatgtgannnncgccaaaacgggagtttcattnacagatgctgaaagcagggcaacagtggagcgaccacggctgaatctgaaacctcgctctaatggagtgggtcagtctggtgaaagtgctgcaaaggagaggccatccctctttggtggtgctcgcccccgggaacaagttc

SEQ ID NO: 3469 - DNA, 450 bp, Triticum aestivum
  unsure (1)...(450): unsure at all n locations
  Clone ID: LIB3280-060-P1-K1-C1
cggacgcgtgggcgaacccgcagtctcgcctctcgcacacgcagccgagcgagccagacaccaccagcgcagcgcagcgcctcccctccctctcggcctcgcgcccgccgcccgccgcccgccggagaggacgccatggcgccggagccggaggacgacatcatggccgagaagaacccgcgccctctcgacgaggacgacatcgccctcctcaagacctacgggcttgggccatactccacgagcatcaagacggccgagaaggagatcaaggaacnnnccaagaggatcaatgaccnangagggataaaggagtctgatactgggctggctccacctagccagtgggatctggtgtcagataagcaaatgatgcaagaggagcagccattacaagtagcaaggtgcaccaagattataaaccctaataccgacgatgccaagtacatg

SEQ ID NO: 3470 - DNA, 454 bp, Triticum aestivum
  unsure (1)...(454): unsure at all n locations
  Clone ID: LIB3280-060-P1-K1-C10
gaaggtcattaaatttttaatattttcattaaatttggaaaaagttcatagaaattcaaaaaaagttaatctacttttagaaaaagttcattgaacttaaaagaagttcatacatgttcagaaaatgttcatcaaatttcaaaatatttcatagataataaaagttcatcaatctgaaaaaaaccgttggaatttttaaaaggtttgtagatattcaaaaaagttcacataattcgtaaaaaagaaaatgttaaccggcgcctagatgggccggaccattcncggacgccacaggcgccngttnntgaaaatgcattgtctcagaaaaaaattaacgaaaatgcacgttaactggtacctttggcgccaaataggaaatgcccaaataggcttccaatgagttctgctttggttgtgaaatgttcaagccggctgcagtgttcggttttagcat

SEQ ID NO: 3471 - DNA, 449 bp, Triticum aestivum
  unsure (1)...(449): unsure at all n locations
  Clone ID: LIB3280-060-P1-K1-C11
cgccagtaggagctttggaagcagtcattggcgatgaagcgtcacttgatggatctctagaacctgcacaagcagattttgagtggcctgaggtggattcccttattgaggagctgaaaaacatagagcaagttaaagatgtttataaaggaaggttcttccggagcccaggattagctccaacattccaggtatatatggcatctttggttggccaaaagtataaggtccttgcgcggtatggaaacaatgtgcaagaggtgatggtggagacgtctnnngacaaagaagggctgcnngtggcaattttgatgtgcacaaacagggtgagctgatcatcagggtttccacgcgggaactgcacacggtcaattttcatgagaccattttatgacatctactcaactcgatctcaccggagaggaagagactcctaggacgaagagctc

SEQ ID NO: 3472 - DNA, 254 bp, Triticum aestivum
  Clone ID: LIB3280-060-P1-K1-C12
cccacgcgtccgctgcggatgaggatgcgttctttgctgactacgctgaggcacacctcaagctctccgaattgggatttggcgaggcgggctgctgctgattcaagctcggcgcctgaaggtcggtggtaatgaagaagaagaagatcatgaagaagaagaagagcactaaggatgtgttggcctgctgcggccatgtcatgtgttaatttgtctcgacttgtattatacgggtccgctaatggagcgttgca

SEQ ID NO: 3473 - DNA, 448 bp, Triticum aestivum
  unsure (1)...(448): unsure at all n locations
  Clone ID: LIB3280-060-P1-K1-C2
gacctctctcttatcgcaccacctccctcaaaaaaaggaaaaactcggtagaaatttccggggtgttgctctagagattgccggccgagcctcgcgtcaggatggcacccacggcggcggagcagagccagcagcacacgaggaaggcggtgggcctggcggcgcgcgacgtctccggccacctcgccccgctcgccattacccgaaggagcactggagacgacgatgtcgtcataaagatcctgtactgcgggatctgtcactctgacctgcacnncnnctagaacgactggaattacccctacttacccggtgatccccgggcacgagatcgccggcgaggtcaccgaggccggcttgaacgtgaccaggttcaaggccggcgaccgtgtgggcgtggggtgcatggtgaactcgtgccagtgctgcgagagctgctacaagggct

SEQ ID NO: 3474 - DNA, 379 bp, Triticum aestivum
  unsure (1)...(379): unsure at all n locations
  Clone ID: LIB3280-060-P1-K1-C3
aatattgttcgtgctactaagcctgtttttagtgtattgacaaacccaattatggggccactgttggaggttcttgaatataccctgccactatggaacctttgtgccgaaacggttgaatatcttaattcagctgcaatggtagcgatggaaacatcattcagtgcggttgtcagtccagatcagatgatcatgtggccatcttggtttatcttcagtacgacgtttaatatatccaattcaatcttataccccgcaattcggttcgtcggagtgcncctagccgtaccttttcgacttattgttgcgctagcaagttttgctgcgaacttctgccatgatattttggacgtttaagaggctacctgatcaacattaa

SEQ ID NO: 3475 - DNA, 268 bp, Triticum aestivum
  unsure (1)...(268): unsure at all n locations
  Clone ID: LIB3280-060-P1-K1-C4
ntagatattgtgtcgggaaggacgtggagcaggagcattggttcagattttctctgtcaggcttgtgtatgtttaccgattattggcttgacatgaagattgatcaggtgtacggaacagtaggcgaaaagtatggggtgaagtactctgaggatgagatcttgattaggacctctaggcctcggtgagcccctcccaacaagatgcgcacaggatctatgtcttgacggggaaagcttctgagttggtgcatagtcaaatgtgggcg

SEQ ID NO: 3476 - DNA, 450 bp, Triticum aestivum
  unsure (1)...(450): unsure at all n locations
  Clone ID: LIB3280-060-P1-K1-C5
cactggcacacatcccacagccaccaggagccggccgccaccatggaaaaaaccagcagctcctccatggcctccccagtccgctcaccgccaccggagccggccgcggaggcacaaccacctcctccttcttcgcccccatcacagcttccggctaccgacccctttcgcctctcgccggataacccaaccccaactcatccccttcctgctgcacctacaactactgctccggcgccatctaccggcccctttcgcctctcgccggataacccanccccagctcctccccttcctgctgcacctacaactactgctccggcgccatctaccggcccctctcgcctctcgccggataacccaaccccagctactccccttgctgctgcacctacaactactgctccggcgccatttaccggcccctttcgcctctcgccggataaccca

SEQ ID NO: 3477 - DNA, 449 bp, Triticum aestivum
  unsure (1)...(449): unsure at all n locations
  Clone ID: LIB3280-060-P1-K1-C6
cggacgcgtgggcggacgcgtgggcggacgcgtgggcgccgccgcccgctccggcccgacccggcgggggaatggggaacatgacccggtcggactcccccgtctcgcgccgcatcgtcctctccttcctcgacttcctcaactccgttgagttagctcctggggctgaccctgaagctcttgaagtcgctaaggattgcctggagtccctttttagcatcaactcatcatcaactagcgagaggatacagccaggacttctacttgaactctggnctnctctgcaagctaatgaacannatagggcaagaccagatcccgtgtcacgatcagtgtcaaacaaaccttcctgcagtgcaagtacttccagtatccaagaagagtcaaataaatgtacaacatcaaatagtgaaggccaagcggaagaaacctttgacctagatcatgca

SEQ ID NO: 3478 - DNA, 422 bp, Triticum aestivum
  unsure (1)...(422): unsure at all n locations
  Clone ID: LIB3280-060-P1-K1-C7
ggagacgccccggccgtgaagacaaggtataggaagaagagagaataccactgcgccaactagtagcaactcaagagtcgattgattacgttacgtgaagtgcgtcgatcgatccctaggaaggaaggaaggaagcaagcaaggataggataggatgcagggcgaagtggagcagcaggcgccgatgcagatggtgctgcgggtgaagcacccgtcgtcgctgtccagcggcagcgaggaggcgtcggagggggaggggtcgtccaggtcggcgctctccnngnncaaggccaaggaggagcanntcgagaggaagaagatggaggtcagggacaaggtcttcgcgcagctcggccgcgtcgaggaggagtccaagcgcctagcattcatacgacaggagctggaagggatggccgatccta

SEQ ID NO: 3479 - DNA, 261 bp, Triticum aestivum
  Clone ID: LIB3280-060-P1-K1-C8
gagatattcattcctaaaataaaacccataggaatgccttacaaataccgccgtgccagcttggaaactgcattgagcagattgggctccatacgcgcgactctccacactacatcttcgtaggctgggatgggtcaggctgggataggtgaggaagcagggcgatgaggtccagctgcgccgatgcagatggtgctgaacgggaagcacccgtcgtcgctgtccagctgcagtaaggaggcgtacggagggggaggggtc

SEQ ID NO: 3480 - DNA, 452 bp, Triticum aestivum
  unsure (1)...(452): unsure at all n locations
  Clone ID: LIB3280-060-P1-K1-C9
tgattgggaagaataagcggcagaagtgagatagcaattgctgctttatgctctcaagcggctgattttgtaccgcggactctaaagctgcatatattgagtccctctgtaccagctgggaggagagcaagcggcgtcgtggtggcctcgacggtgactaacaggaggagcacggcgagctgagccggaggaggacgagccgtccacgtgcaggaggctccccggcggatctgggagacggcgggaggcatctccgacggcgtgggccgggccttcttgcttcctcagatccgcgtttctatcnnacatccagtttgtcgcttcccttgacgttgatggctctatgattagccgtgttctcttcctgctgtgtggctacaccgtctcatcctgcaagtactaagccacgatgagatttatttggctcatcctcgcgcctcaagttttcgaca

SEQ ID NO: 3481 - DNA, 447 bp, Triticum aestivum
  unsure (1)...(447): unsure at all n locations
  Clone ID: LIB3280-060-P1-K1-D1
ggcaatcttatttacccaagtagctcttatttgacaaatcaccatccagtttgctgtatggctgattctgatgcactcaaagtgaacaatgaagaataatgattcttcttatataattacatgattaattaaacctcagttcctcatgtttacttcatgggactgaaaagatttgtacgaatttatcaatcatgtgtcggccttcatttgcatctcatcctcaaagaaatgggatatgatttaattccattggcaaattattctggttagacttcnnncttgggccagtaatttnnnnnntgtagataacatcatgtggacctccttcagattaatgagaagaaaaactctgggttaagtggatttgtgatttatgatgttcaggtcaaggacgtcgtgttctcctgcttgctctggttcggaccttttatgctctgtttggcctgt

SEQ ID NO: 3482 - DNA, 424 bp, Triticum aestivum
  unsure (1)...(424): unsure at all n locations
  Clone ID: LIB3280-060-P1-K1-D10
cccacgcgtccggtgacatgtgaatatccatacagtgaatgcgaaggcaagccatggatatacaagaaaatttctgaaggtataaaaccagctgtgctttccaaggttgaagatgcataagtaagaggtttcatagaaatctgtttggctccggcagctgaaagactttgtgcaagtgagctcttaaagaactgtttcctccagaaagacaagcctatcccagcgcctgcgcctcctatttcagtctctctggtctcgagtgtgactaaagatgggcgttantctnccagtttcatgctatgnnnnggtgaattctcactgaaaggcgatatgcatgtcaccgaccatgttattttatcactaagatttcctgatcccagtggttgttttaagaatgccgagttcccgttcgatgtggaccaag

SEQ ID NO: 3483 - DNA, 444 bp, Triticum aestivum
  unsure (1)...(444): unsure at all n locations
  Clone ID: LIB3280-060-P1-K1-D11
ggcaagtccattcctgttccggccagacctttccaggattacttgaagcactgttgtgcctggagaaggccacgccgccgcgatgaagagcagggcggcaagagctgagacttagcccgaggactaggagcaatttttggagaagctgcaaacggggccaaaattcaggcttcttctcgactggagcttcagagaggggcaaagagcagcccctgtagaattgggcgcagatgcgcccatagggaatgagagagaggggagctttttttggggaaggaagggtagatatcactcagttgtagtannagtctacaaaataagtacggtagtactgtacggggttagggttaaactcccatccaaatggctgtgaattcggaacaagttgttgtgctgctagagaacaggcttcttttgctgcaagttgtcaactgttctactgat

SEQ ID NO: 3484 - DNA, 360 bp, Triticum aestivum
  unsure (1)...(360): unsure at all n locations
  Clone ID: LIB3280-060-P1-K1-D12
cccacgcgtccgcccacgcgtgcgcggacgcgtgggcccgacctctctatctgtcccaacccaaacacctaaccctcgaatcgaagcaaccacgccggcggcgatgggtgcaaggttctccaggcggtatgggcaagcagggcggactccccggagaccgcaagccgggcgactgtgccgccggcgacacgaaggacaggaagttcgagccccctgccgcacacgtggcgcgtggggcgcaagcagcggaaacagaggggccccgaggcggctgcgcggctgttccccgtggcgccgttctccaagnncccgctccgccttctcaagccggaccgtgtgaaggactaccttcttatggag

SEQ ID NO: 3485 - DNA, 268 bp, Triticum aestivum
  Clone ID: LIB3280-060-P1-K1-D2
tgatttcctgtgattactgtacatactcgtgatagtttgtgatcagatgtgtagctcgcaattccatatatgaagaatgcaatcgctgctatttgtactccctccgtccgaaaatacttgtcatcaaaatagataaaaggggatgtatctagaactaagatatgtctacatacatcccgttttattcattttgatgacaagtatttccccacggagggagtacgtcgactgagtgatttcatactactataagctgccattttcccat

SEQ ID NO: 3486 - DNA, 315 bp, Triticum aestivum
  unsure (1)...(315): unsure at all n locations
  Clone ID: LIB3280-060-P1-K1-D3
cccaaattgtggttgctatctgttcacaattctgcaaggtttctttatgttgtcttgtgtggaaggtatagcgcatgcatggttggctttgccctgacaaaactaggctcctcaaccatgaatgcatgatgtacctgttatccttatctggttgatgatgtagctgttctttatggccatgtgatggaaataatttggatcacagttgatgatgtatctgttctcttgtaaacaatttagcctgctgactaactttattttattcaactgtgtgcnnntcagttcacagtttccttgntttgtttataacatatt

SEQ ID NO: 3487 - DNA, 440 bp, Triticum aestivum
  unsure (1)...(440): unsure at all n locations
  Clone ID: LIB3280-060-P1-K1-D4
cggacgcgtgggggaatcctgaaggttattgaccgaaagaagaacatatttaagctatcgcaaggggagtatgtcgcagttgagtatctggagaaagtatatgtcttccctccaattattgaagatatctgggtgtacggggacagctacaaatcaatgttagtcgcagtcgttaacccacatgaagaaaacaccatgaagtgggcagggtcaaatggctacaaaggttctttcagtgaaatatgcaaatctgaaggccttaaagagcatgtccttacngagctcgcagcggctgcacannntaacaagctacgaggttttgagtacatcaaaggcgtagtgttggatcctgtaccttttgacattgaaagggatttggtcactgcaacaatgaagaagagatgaaactacatgctaaaatattatcaacctgagattga

SEQ ID NO: 3488 - DNA, 463 bp, Triticum aestivum
  unsure (1)...(463): unsure at all n locations
  Clone ID: LIB3280-060-P1-K1-D5
gtttaagcctcaagtaaacgatgaactggatacacagaattttcagaagtttgacgaggtagatcccgctccagcaagaacaggttctgggtcctcaaggaagatgattcctaatactaaagaccttagctttgtgggctatacatacaagaacttcgaagctgtgaaaggtttgcgttagtctgcaggtctgggaagaagctcctcgttaacaagccagcctagtgaatctgcatctgatgcagtcgacatggattcatcagcagaaccgaatggaagtgacacacacatgctcnctgtctcgtttgccgatcnnnnnatgcaataagcagccttgctgtggctgaaatccctgtccccgcaccagcatgattcgccttcagtgatgtggcttcatccaaagcgatctgcttgattttagtcaggactcacgctgtacttatcgctggtgagcattttgttg

SEQ ID NO: 3489 - DNA, 244 bp, Triticum aestivum
  unsure (1)...(244): unsure at all n locations
  Clone ID: LIB3280-060-P1-K1-D6
cncgcatatctggagactcggtggtggggggaggggatctctgtgggctccgggtccatgggggcccgctgatggggccgacggacgatatcttctagatcctgattaccttagctgggccggctcgtcatcctggcacgggtatgatgtgaaatgcttgctgtaatatccaggtttggaaatatgctagctcgtctcaatccatccctttgaaaatgaatcttatacaggaggcttgtattca

SEQ ID NO: 3490 - DNA, 399 bp, Triticum aestivum
  unsure (1)...(399): unsure at all n locations
  Clone ID: LIB3280-060-P1-K1-D8
acagctgcggcggcgcgcgcataggaggcgaagcagcagcggagccaagccaccgacgccaccatgggtatctcgcgtgactccatgcacaagcgccgggccaccggtgggaagcagaaggcgtggaggaagaagcgaaagtatgagctcggccgccagccagccaacactaagctttcgagcaacaagacagtgaggagggtccgtgttcgcggaggtaacgtgaagtggagggctctccgtctggacactggtaactttttatggggtagtgaggctttnacccgcaagacccgtcttcnnnntgtggtatacaattcgtcaaacaatgagcttgtgacgactcagacccttgtcaagaatgccattgtgcaagttgatgctgcccctttcaagcag

SEQ ID NO: 3491 - DNA, 266 bp, Triticum aestivum
  Clone ID: LIB3280-060-P1-K1-D9
ctcaatctcatcatctccacagcaacaatggtgcagcgcagctccaacgccgaggtgatgtgcatggacctgtcgcccaagaagccggccaaggcctacggcagcgacggcggcgcctactactactggtcgccggccgacctgcccatgctcggcgcagcctccatcggcgccgtcaagctgcacctctccgtcggcggcctcgccctccccagctactctgactccgccaaggtcgtctacgtgctccatggcgcctgcgcctg

SEQ ID NO: 3492 - DNA, 433 bp, Triticum aestivum
  unsure (1)...(433): unsure at all n locations
  Clone ID: LIB3280-060-P1-K1-E1
gccaaactgactaatcatacacgtacctgcttagcttaagcccttccggcgaaatcaagtgcaatggcgtcggccagcatgctctgcgccgccttcgtactactcctgctgctggacctcgccgtcgccacggaggccgacgcggtgaagaagagcatcgggtcggagcccaagctcatctttttgaggccgtcgggacccatcatctcgaggccggcggtgaaggacatcatcgcgtcagagcccaccatcccgaggccggcggcggtgtacttnccnncgacgtgcatggggncncnnaaagagctgagcccgtgcctggccttattcagggacgcgggcacgtccaaggcgccggcggggtgctgcaagggcctgggcaccatcgtacgagaccagccggcgtgcctgtgccacattttcaaccacaccc

SEQ ID NO: 3493 - DNA, 225 bp, Triticum aestivum
  Clone ID: LIB3280-060-P1-K1-E10
gtcctccgtatcatcaatgagccaacagccgctgccattgcttatggtcttgacaagaaggcttccagtgttggtgagaagaatgtcctcatctttgaccttggaggtggtacctttgatgtctctgttctcaccattgaggagtggtatttttgaggtcaactccacagctggtgacactcattttggtggtgaggactttgacaacaggatgtgcaaccactt

SEQ ID NO: 3494 - DNA, 453 bp, Triticum aestivum
  unsure (1)...(453): unsure at all n locations
  Clone ID: LIB3280-060-P1-K1-E11
ggtgctctctgcagcgctaacccaagtgccgacgccacggacaaggtgccctctccatcacttccctctctgtatttttgatttggagttggtgctctgttcctgttcgtgaagcgccctctcttctctgctgcaaggttcgtcaagcatctttgctcgtggaaaccgagcaggcaggaggtaccaatatctcctctcgtctggttttcttcacccccctatgtgatgggtgccatctgtttttgtgcatgcttcatggagaggagaagctgctccgatcccatctgctgaaggaggatgcccnccatccaaggtgctcgacatcaccgccatctgttgcctgccaagaaggatttgaatgctggaagtaagagggtgagatggatagatagagaaccttatgcttactggatagggaatccagagatcgcaactataaggcaagagcttatc

SEQ ID NO: 3495 - DNA, 455 bp, Triticum aestivum
  Clone ID: LIB3280-060-P1-K1-E12
cttagctgcacccgtgctcacctaatcacctcccgccgggccggcgaaggccagccggttctccaactcgacccggcgacggcggccgacatgcggcgccagggcctcgatccgcacgagctggaccggagcaccgagcagctcatgtcgctcatccacgagaacctcccggacccacccgtctccaccaccgctcgcttcgtcgccctccgcgccctctcctccgacggcgtggaccgcttcagcggcctctccgatgcgctcctccgcaacatcgtctcccgcctccccgtcaaggacgccccccgaaccgccgtgctcgccgtgcgctggagcggggtctggcgctcgacgccgctcgttctgatcgacacccagctgatcttcaacggccgcaccccggcgcgcgccagcacgccggacgttaccggtggcgtcttccgcatactcgtcac

SEQ ID NO: 3496 - DNA, 441 bp, Triticum aestivum
  unsure (1)...(441): unsure at all n locations
  Clone ID: LIB3280-060-P1-K1-E2
gagcattttaaaggtttaagttttcctacgatatcatctgtggggccaaatgcagcaataattcactattctcctgaggcaaatacatgtgcggaacttgatgctgataaaatatatctgtgtgactctggggcacagtacctggatggcactacagacattacaagaactgtacattttggtaaaccctcagagcatcagaaattgtgctacactgctgtcttgaaaggccacattgccctagatgctgctgtgttccctaatgggaccacannncntgctcttgacatactgncnncatccccactgtggaaaagtggtcttgactatcggcatggcacaggccatggaatcggatcttatttgaatgtccatgaaggccctcatctaattagcttcagaccttctgctcgcaatggaccactgcaagcatcaatgact

SEQ ID NO: 3497 - DNA, 410 bp, Triticum aestivum
  unsure (1)...(410): unsure at all n locations
  Clone ID: LIB3280-060-P1-K1-E3
tacaatataaccggggacggggaaggtggaggaagcagcggagtcagacatggggagggggagggtggagctgaagcggatcgagaacaagatcaaccgccaggtcaccttcgccaagcgcaggaacggcctgctcaagaaggcctacgagctctccgtgctgtgcgacgccgaggtcgcgctcatagtcttatccaaccgcggcatgctctacgagttctgcagcacccatagcatgacgaatacactcgacatgtatcaaaaatgcagttatgcatgacctgatactactgcgcannnccgcgaaaatgagcaactgtaaaacagacgctttgagtgcctgaaactataggcacggttttgtaatgtacagccatcacagatgaatttgtttggtgaataactcgatt

SEQ ID NO: 3498 - DNA, 347 bp, Triticum aestivum
  unsure (1)...(347): unsure at all n locations
  Clone ID: LIB3280-060-P1-K1-E4
gtcaaggccagagccctctgaacaaatttctcatcgcatcgctccttccaggctccaaggccagcagctggatctacaccacgccctacgtacctgcgcccccgtatcgtatgccgtttcccctccgtcgtcggtgtcggagcctccccctccttgtaaactagacatagatgctctctctcgttgtctttcccgtttccaagattttagacggcatgcccatcttatttccccttgttgctgaggtgcgtactacgtaaatttgcccgtgctcgnnnnnnaagcgactggctccacncnntcgttcggcacttatccacgaaaagacaaacattctggtgtgtttt

SEQ ID NO: 3499 - DNA, 439 bp, Triticum aestivum
  unsure (1)...(439): unsure at all n locations
  Clone ID: LIB3280-060-P1-K1-E5
ctccctctctccctcgtcggcaggtccctccaccgtggtccctcctaccctagccccggccattctcccttctgccaccctctcatgtcccagtctctcgcctttgtccacctgcagcctattgagcgcgccgcccaacctcaccagcaacatatgcactgccgcccagcagccacggcgtcgcggctggccggctcgtcggcgtgcgcatgcttcaatgcacgccgctcaatcgagctggtcggaccgcggcggcgcgtgacctagggttttggacannnnnccccatgccggccacnncnctccggcaaccaggacggggacgacatcgacgacatcctttaacggtcgtcgtccaccttgcattgcagggaggggtcggtcctttcctcggacgaggggccggccgtgttcgtcgttccacaccctggcagtcgat

SEQ ID NO: 3500 - DNA, 449 bp, Triticum aestivum
  unsure (1)...(449): unsure at all n locations
  Clone ID: LIB3280-060-P1-K1-E6
cccacgcgttcgccctgacgaaagaaattccccttctctcgctccccccgtcccgtgatggcagcaacggcgcccggcgccggcgccgtcgaggtttccatggacgacaaggccaaggctttggtggccgcgaagatcaaggaaggggagtacaaggtgcagatgataggacagtacgcggtgcggacggaccgcgcaatcgatgcgctggagaaaaaggtgcaggacatcgaggcggtgatggatctcgagctgatgctcggcgagtactgcgccgacctctcggacatgcacaaggcgcnccactactaccgcgccacctcgctctcggaggaggagaagttctacctccaccaaatcgacgacttcgccaccgccaccatcgccgagtacgaggccagcgtctgccccgtccccgccttcgacaaccaccttagcctgttcagcca

SEQ ID NO: 3501 - DNA, 451 bp, Triticum aestivum
  Clone ID: LIB3280-060-P1-K1-E7
cccggctcagctcccctctctcctctagatctcccggcgcaacaaacgcaaggccaccggcgcctccgcgcatccgcagtcgccgcctctgcgatcttgcccgccgccgccgccgctgccgccccgagagatggcaaaggcattttacgcggtggggttctggatccgggagaccggtcaggccctcgaccgcctcggctgccgcctccaggggaactacttcttccacgagcagatttcagggcatcgcacacttatgaacatctttgacaaagcccctcatgttcacaaagaggcatttgtcgctccaagtgcatcccttattggtgatgttgaaattggacaagggtcttcaatttggtacggctgcgtcttaagaggggatgcaaataacgttcaagttggatctgggacgaatatacaggacaattctgttgtgcatgtggcaaaa

SEQ ID NO: 3502 - DNA, 345 bp, Triticum aestivum
  unsure (1)...(345): unsure at all n locations
  Clone ID: LIB3280-060-P1-K1-E8
gccaaccattgtcttctggtacatcaatgcagcatggaacacatgttgctagggcgcgcaattccaccaatcgaactgggccagcgcgtctgtgagcttgccgaacatcaaatgctgtgtgatcctgcgtgacggataggtgtcatacgggggggggtactaaatccggcagaccgtggactgactgctccgcctgacctgtctgctacagggactgtacttctggcacgagcagacctgatggcatgaaacactaatgaacgatttggacaaggtcccncntgttcacaaagaggcctctgtggttccaagtgcactggttattggggatgtactaacagggca

SEQ ID NO: 3503 - DNA, 266 bp, Triticum aestivum
  Clone ID: LIB3280-060-P1-K1-E9
gttcgtgccaaggccagcactcaccctcccatccctcctctccggccgcaacccccgccgccgccgccatggtgaagtactcgagggatccgtccaacccgaccaagtcggccaaggcctgtggcaaggatctcagggtccactttaagaacacacgcgagacagcgtttgctcttcgcaggatgcctttgggcaaggctaagaggtaccttgaggatgttctttctcacaagcaatctattccctttcgtagatactgaatatgt

SEQ ID NO: 3504 - DNA, 441 bp, Triticum aestivum
  unsure (1)...(441): unsure at all n locations
  Clone ID: LIB3280-060-P1-K1-F1
cccagagtggctggttgttattggggtctgcactcatcttggttgcattccccttcccaactctggagactttggtggctggttctgcccgtgccatggctcccactatgacatctctggcagaatccgcaagggccctgccccgtacaaccttgaggtgcccacctacagtttcttggaagataacaagatgctcataggctaagagcctaaaaccagtacctaccgacatatattctcgacaggagtgaattcctgttgcgctgttattttnnnttcaatgtggctaggagttttngtttcaggactatcgcaacggtgatccactgttacctactgaagttcatttgcagtgcgaaataattgtttctcctatgtagctactggattgtaagttgatttatactgattttctgagaccctatcggaaggatattgtat

SEQ ID NO: 3505 - DNA, 396 bp, Triticum aestivum
  unsure (1)...(396): unsure at all n locations
  Clone ID: LIB3280-060-P1-K1-F10
cccacgcgttcgatggacgagtgggttgctcatccaacagaacacactgctctggatgacattatcccctgtgttgaaccggctacggcgaacgagaccctgacacgaaccaaggaagtcacatcacaactagtgaatctggggaaccaggtgctctccaatgtgtcaaaccgaaacttccctccggcggccactcccttttattacaaccagtcagggccactgatacccacactctgcaacccgtttggacccaatctgagcaagcgcacctgttccctttnnnaggttaccttggacaaagccncccaggtcttcaagagcctttagtgccagactagggtggtgtcagggaccgatgttcgcacaacagtggtccgggtgaccccttgattt

SEQ ID NO: 3506 - DNA, 438 bp, Triticum aestivum
  unsure (1)...(438): unsure at all n locations
  Clone ID: LIB3280-060-P1-K1-F11
cccacgcgtccggtccatccatgtccctgactacaggattcaccgtaggctaacggggaacaatgtccactacagggccatcccaaacccgaaatgcgccccggctgccgtcccggcgtgcagggtgcggtgagagccgagcctccttcgttcatgttgcctggagttaaaggaaataggttcagttataaatttgcaagccgtggattgcgcgtttcgtgggtgtgtgtgggtgcacttgtgccgtgcgtattctcttgttttgcatggactgtaaatctgcnccncgtgctgctgctgctgctgctttgggcgccctctagctttctcactgaggtattatgtggtgctgataagacatattgagcccttgccgataaccagcagggtttattcctagaaatgaactggtgagctcttatgttggtatggtgaaat

SEQ ID NO: 3507 - DNA, 348 bp, Triticum aestivum
  unsure (1)...(348): unsure at all n locations
  Clone ID: LIB3280-060-P1-K1-F12
cccacgcgtccgcccacgcgtccggccagccaaaagcctgcccgcttcctcttcaacgctagcgccgccgtcgccggctacctcgacgccggcctgcaatccaatcatcgctctcctaatccagcagagaggcttctctgcctgaccttgcgcttcgctcggtagagagacagagcgcccggctcaccgcgccgaggcaccgctgcactgcccccgcccaccgtctcggccgcgtcgccccgcttacgctgcgcctncgaaactccgagccgcccccttcttcnctggactgctgcgccgcttcntcanaccggaaccccgcccctgtcggatcgcctccgctgcacc

SEQ ID NO: 3508 - DNA, 422 bp, Triticum aestivum
  unsure (1)...(422): unsure at all n locations
  Clone ID: LIB3280-060-P1-K1-F2
atcggaacatcggatcacttgaaccgattggacgatggatctgcagtgtgagttggcccaagtgagttcattcatcaatccccgtctgttgggtaagaggggaagtgggtgcatgagggggacacaacatgatggttttgtgttcagaaatggtattgtaatttgattacttgaatcgattacacgatggttttatggtgtggctttgtccaagtagaggaatgggcaagttagtgcattgattcaagtctctggctttactggttaggtcactctgacctcttggctgccgctgtnattctatcgaatgtgttcttttgttgctcaaatatagtgtattggattcccaacgtgtgttatcattcttgctgtacacttccatcaataccccataatcttagttatgtggttgcagacctgct

SEQ ID NO: 3509 - DNA, 445 bp, Triticum aestivum
  unsure (1)...(445): unsure at all n locations
  Clone ID: LIB3280-060-P1-K1-F3
agaccctgttattgtgagaattcttaattcaagagttatagggagggacttatgtcaccacaaacagaaactaaagcaggtgttggatttcaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacnatgctatcacatcgagcctgttgctggggaagacaaccaatggatctgttatgtagcttatccattagacctatttgaagagggttccgttactaacatgtttacttccattgtaggtaacgtatttggtttcaaagccctacgtg

SEQ ID NO: 3510 - DNA, 401 bp, Triticum aestivum
  unsure (1)...(401): unsure at all n locations
  Clone ID: LIB3280-060-P1-K1-F4
tgatgatttattcgccagaagttggattggcgaatggtggcgcaccaggaggcggaggcgacgacgacgacgacggtggacccgatgcgcctggcgtcgtggtggcggtccccggcggagtgggttgccaccgcagcggcactggactcggagcccatgccatcctagctcaacaccggcaacagctcgggcctctttgcagtcctctccgtcgacaagatgtccgtctagtacctgggagtcaaccaccacggacattacgtcggtgtcgtgcaggcctactgcccctgtacaatgcaccccnccgtttactacttagatatgaccgtgaggaatgctgggcttaagggccagaacttcattggttttaccaccgaaagctttaagatgccccggccacc

SEQ ID NO: 3511 - DNA, 443 bp, Triticum aestivum
  unsure (1)...(443): unsure at all n locations
  Clone ID: LIB3280-060-P1-K1-F5
gatgaattctggaaaggagttctgccgctggagtttggattgctgccagcacttcaggatgctgtcaccgtcgttggttaccctattgggggagacacaatttctgtgacaagtggtgtagtatctaggatagaaatactctcatatgttcatggttctacagaacttcttggactacagatagatgcagctataaattcaggaaactctgggggccctgcttttaatgatcagggaaaatgtgtcggtatagcttttcaatctcttaaacacgattttgcngaaaacataggctatgtnnnncccaccccggttattaagcacttcattcaagactatgagaaatctggagagttcacaggttttcctatacttgggatagaatggcagaaaatggaaaattccgatctccgcaaggcattgggaatgaaatctgaccaaaa

SEQ ID NO: 3512 - DNA, 450 bp, Triticum aestivum
  unsure (1)...(450): unsure at all n locations
  Clone ID: LIB3280-060-P1-K1-F6
tgcatgtccaacaacgcagaggcatgtgagcacgaaatatttaggactcgtagcagacatctctcggataaggatggtcaactttgcactacttagtcttaaccatctgatggctagcattgtgaagtttaaagatggcagctccaatttggagggtaacctcccattgctccagctgtggttttgggagaaggtgcgcgttcataaattcgacacctcaattgattacagtcaacgttcgaagccactgatgcagcactggacagaggagaaggctctttnnnntagcagtggtcatcgaannccatggcttcggagttggagaggttgttgtcgacccgaaagagcctttcaagtcccaaaaagagccatcttgctctgaaagtctaccttcagatctgaaggagcccaaccaacaagtattgaacatgtttggtacactcattggcc

SEQ ID NO: 3513 - DNA, 452 bp, Triticum aestivum
  unsure (1)...(452): unsure at all n locations
  Clone ID: LIB3280-060-P1-K1-F7
aacccatccaccatacatctacagcccatactgctttcttatacacaaaactctgggaagatgcgacatatctggcccgcgctagcttgattgcggtggcgatccccatcctccttgccgatgatgcggatcgggcggggccaataggctgccagaacaacgttatggcgctcaacgaggcctgctaccacagcctgcagaacgactcgccgaccgtgccggcgatcaagaagaacgtgcacgccctgacccggctctacgacgcccagcttgtcatcatacctgnccactccaccggcgagggccaccatttctacagcaacggcgccgtccttaaggcaatattgcaccgttaccatcagtccaatctgaccaggctgtaaatcgagcagcatgaacatatgcagcgcacgctgagccatcttaacgacatcaatccaaacctgcccacc

SEQ ID NO: 3514 - DNA, 446 bp, Triticum aestivum
  Clone ID: LIB3280-060-P1-K1-F8
aagggtagggaaggcaagggaagggagagggagcgcccagatccacggcggcatcagcgcgctgtcgtcgacctgatccgcgttcgtcctcgacggaggttgtccatggaggtctgacccggcccggcagcagcgatggacggacggagacgccccaaacccgagaacggcacctcaaccttcaaggacgacgcctcaaccttcaagggcgcgtgccggcgaccgaggatcttcggtgactgctatggatggctgccccggatctggacacacgacctgcagctgctgcagcaggtggacgacccaacgcacgagccctgcccccttcctcatggctctgcttcctcctaccctgccccccttacgtggacgtgctgccttgtcagggatcctccatatcaagggaagagcggtgtatagtgtgcgagggaagtacttgtgtacca

SEQ ID NO: 3515 - DNA, 450 bp, Triticum aestivum
  unsure (1)...(450): unsure at all n locations
  Clone ID: LIB3280-060-P1-K1-F9
cgctcctctggccccaaatcttaaccagctccccccctccgcccccttcttcttcttcccctcctcccctcccctgtctcgcccgcagcttcaccggcagcgagggaaagagggaggatgagcgcgtccaggttcataaagtgcgtcaccgtgggggacggcgccgtcggcaagacttgcatgctcatctactacacctccaacaccttccccaccgactatgtgccaacggtgtttgacaacttcagtgctaatgttgtggttgatggcaacactgtcnacctcgggctatgggatactgcanttcaggaggactacaacagactgagaccgctgagttatcgtggagctgatgtcttccttctggccttctcgcttatcagcaaggccagctatgagaattgttcaaagaagtggatacctgagctgaagcattatgcaccaggtgtg

SEQ ID NO: 3516 - DNA, 121 bp, Triticum aestivum
  Clone ID: LIB3280-060-P1-K1-G1
accacgcgtgcgcggacgcatgggtagacaattatttatactacggatcatgtaatgccaggatcagagacaacagaatatgccacacatcatgtgggtggttaataagatagataaacga

SEQ ID NO: 3517 - DNA, 256 bp, Triticum aestivum
  Clone ID: LIB3280-060-P1-K1-G10
cgccgtactcgctcccctgatctcatctccaccgagaagccaaccaacagtccaaaaagggtcagacgcccaagccaccatggcgaacccatccacgagctcgaggccgtcgttcgcggctcctagtggcaccaagctcagctgcctctgctcgcccacgaaccacccgggctccttccgctgcacccgccaccgcaacccgcgagggcgaccgcagacgtcgttgccgtcgttcttcggccgcgcctagcagcct

SEQ ID NO: 3518 - DNA, 460 bp, Triticum aestivum
  unsure (1)...(460): unsure at all n locations
  Clone ID: LIB3280-060-P1-K1-G11
cccacgcgtccggaagcctggtgtgacagtgaaacattgcaaggagggaacagagagttctgctttctggtttgctcttgatggaaaacagagctatacaagcaaacccatcatgcaggatactattgtcagagatcctcatttgtatgccttctcaattaggaaagggagactggaggttaccgagatattcaatttttgccaagatgatttgttgactgaagacttgatgattcttgacacacacggagaggtctttatttggattggtcagtgcgtggaaccnanngagaaacaaaaggcgttcnnagttggccagaaatacatagagcatgcgatgtcgattgaagatctttccccgtatgtaccactatacaaagtctctgaagggaatgagccatgctttttcaagacatacttctcttgggataacacaaaaactgtgattcatgggaattcg

SEQ ID NO: 3519 - DNA, 385 bp, Triticum aestivum
  unsure (1)...(385): unsure at all n locations
  Clone ID: LIB3280-060-P1-K1-G12
ctcgatctcctctcttcaactccctgccgactcccaagtcccaactcccccagcccccccaggtctcacgccgccggtcgccgccctcccgccttcgccgcccgcgagatccccagagcgacggccttccagcctcccccgtccggccgcctccctgccggaggaccggagccagattgctggtcccgccccgtcccgtccccccactggccagcgccgttctctgctccactcaaccggcgacccctcccgcggacgcggcaggccgaggcgtgatgtgcggatcgnancatggacgtgatcngcctccccagtagaagctgcagcagccgtcgcgggagcagggtgtgcgccgtctactgccatgacgatctacctagctcgg

SEQ ID NO: 3520 - DNA, 378 bp, Triticum aestivum
  unsure (1)...(378): unsure at all n locations
  Clone ID: LIB3280-060-P1-K1-G2
atcggaccctagcgttccgccgccgtccgtttctcggctcgagagcgccagagactggtaccagttcacagcgggcacgttatgatgatgtgacaagagagtttagaaacttcaggcttgaggttgtgtggtctgaaaaggtggctaacctgcttgatttgggttacaaggcgggatgtcctattgcggccggtggcgtgcccctagtgggcatcgccgtatgtgtggtgcagtaaagcggtgacccctctctgggtctcagttagcctaggcggnaagtgcggatcggaacatggacnnnttcgcctcgtccagtgtatgctgtaccatttcgctttgtagcaggatgtgctgccgttttactgccatgacgatcta

SEQ ID NO: 3521 - DNA, 267 bp, Triticum aestivum
  Clone ID: LIB3280-060-P1-K1-G3
gagaaacagaggaggcggcgccgagcgatccccctcctcctccccccgtcgagtgatgcatggccatggccgcctccagatcgctctgggcctcccgcgccgtctcctacctcaagatctccgccttccccagggccttctccaccgtgctgaaggatctgaagtatgctgaaacccatgaatgggtgaaggttgatggtgattccgtaaccgttgggattacagaccatgcccaggaccatttgggtgttggttgcttatgtggat

SEQ ID NO: 3522 - DNA, 267 bp, Triticum aestivum
  Clone ID: LIB3280-060-P1-K1-G4
ctcctgtccactaaggcctaggtacccggcccggttcggttcgttagggtttagtagcggggaagaggaggaagaatggcggacgtccatgtaccgctgcttcgtcggcggcctctcctgggccaccgacgaccagtccctccagaacgccttatgcaagcacggcgacgttatcgactccatgatcatcactggcaggcagacggacctttcccgccgttttggattccacaccttgttgtaggacgaggctacgcgcctggacat

SEQ ID NO: 3523 - DNA, 448 bp, Triticum aestivum
  unsure (1)...(448): unsure at all n locations
  Clone ID: LIB3280-060-P1-K1-G5
ggtctacatgatggcataattctatgtagactgatgtgtcgattattacggcatgcatttatttgcccaacattacctacatacttagtgccattacaatagacatctccgttggtattacagaaagtgatcgctccatgcacatacacattaaaagaaaatgcacaactgcaccatggctatctagcttatcaagcaagattaatctaaacataccttacagcatctcattactcccgtcgaagtaatctaaacatgttcttaatggcgacaaatttgagctnaagatattcttaatggcaacangtnactaattctttcgttcctatggaatatgtaaattcatatgcaggtaagcaggttaatctaaacatgccttacagtatcccattacttttgttgaaattctatactgttagattacaccttttgttggattaaatatctg

SEQ ID NO: 3524 - DNA, 457 bp, Triticum aestivum
  unsure (1)...(457): unsure at all n locations
  Clone ID: LIB3280-060-P1-K1-G6
cccacgcgtccgctccgtcttcacgggtacccctggggtcaaggtctccgtcaaggtggccggcatccactggcactacggcacccgctcccacgcgcccgagctcaccgccggctactacaacaccaggaaccacgacgggtacctgcccatcgcgcgcatgatcggtcgccacggcgccgtgctcaacttcacctgcgtcgagatgcgcaaccacgagcagccgcaggacgcgcagtgcatgcccgaggcgctcgtgagccaggtggccagcgccgccaangatgccttagtgggcctcnccnnnnagaacgccctacccaggtacgacgagacggcgcacgaccaggtgctggccaccgcggcggagaaggctgaggaggaccgcatggtcgccttcacctaccttcgcatgggccccgacctcttccagcccgacaactggcgccgcttcgcc

SEQ ID NO: 3525 - DNA, 450 bp, Triticum aestivum
  unsure (1)...(450): unsure at all n locations
  Clone ID: LIB3280-060-P1-K1-G7
tattcccccgccccgcagcccctggtcacccctctctctctctcaccgcaagaccggaaggagcggagccgccgagccgggaagagccaccaccccatcttcctcgcctccgcttccgaagggtcagagatggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagctgctacatgactcagaaccttggcatcagngnccccatgatgtcatcttctccattgtttgccaatgcaccacctgagaagaaaggtgtcaagaactttgcaattgacttcctcatgggaggagtgtccgctgcagtttccaagactgctgcagctcctattgagcgtgttaagctgctt

SEQ ID NO: 3526 - DNA, 450 bp, Triticum aestivum
  Clone ID: LIB3280-060-P1-K1-G8
cccacgcgtccggctggtattaccatcttgccacttctcacaggcaactccttcaactaatgcattgtctgctgaagaaatcaaggctctcaccaagaggacacaggagggtggcacagaagtcgttgaggcaaaggctggaaagggatctgcaaccttgtccatggcgtatgctggtgcagtttttggagatgcatgcttgaagggtctgaacggagttcctgacattgttgaatgctcctacgtgcaatcaactgtgaccgagctgccattctttgcttccaaggtgaggcttggaaagaatggagtcgaggaagtgctcgggttgggtcagctgacgcagtttgagaaggatgggttggaagctctcaagggcgagctcaaatcttcaattgagaagggtgtcgcgttcacaaatgcaagttagttaggccattttgcagattatag

SEQ ID NO: 3527 - DNA, 448 bp, Triticum aestivum
  unsure (1)...(448): unsure at all n locations
  Clone ID: LIB3280-060-P1-K1-G9
caaatttcatcttacgacgtcagtgcgaagatactaattgaagcaggtattctcccacctctcatagcagacctctttacagttggcagtaatcagcttccaatgaggttgaagaaggtatcagcaacaattcttgcaaatgttgtggcatcaggtgcaaattttcagtccattccacttgaccacaacaggcacacactggtatctgaagaaattgttcacaatctgcttcatctcatcagcaatacaggacctgcaactgagtgtaagttactccangngcatgttggtttaactagnncntctacaactgtccaaggcatagttgatgccatcaaaagctcaggggctactgtcagtttaattcagtttattgaagcacctcaaagagaggttcgcatggcttccatcaagcttttgaattacatatcaccatgtatgggtcaag

SEQ ID NO: 3528 - DNA, 434 bp, Triticum aestivum
  unsure (1)...(434): unsure at all n locations
  Clone ID: LIB3280-060-P1-K1-H1
ttttcatccacccgcgcaaggcagattgagaacgacgaccggcgacgacgcaggcgcgtgcgtgttcgtcttccccgatcgagccgtagcgcggatggagatggactttctgggcccacgatcggcgccgcggcatgcgatgccgctcgtggcgcgacgcgatgccgaggacgacggcgagccctggcgtctcgcttcaccggcacacttcgcgtatccggacgtgcgcgcggcggcggctcatcgccaccacccgacggcgccgtcttaccnnctgcacgcgccgccgccgncgcctttgcatccccaagccttcccgtgcgccattcccgcctcgttcctgcaaggcccgcaggtagtccaccgtgcagcgttctcgcccgatcggaggtgctcctgcgtgcagttgacgatattttacgcaggttcagtgc

SEQ ID NO: 3529 - DNA, 246 bp, Triticum aestivum
  Clone ID: LIB3280-060-P1-K1-H10
ctcgaagccattgtgaagcatgctaatatggagcaccggctgggagataaggaatctgcttgtttagtctatgagaaagccattgctgctgaaaaggataaggagcacagccagcttttaccaatgctactgatccactactcacgtttcttatatatggacggagacttggaaaaggcaagggagatctcaggtggactgcacgggctagctaaccttactaaaccaggtgttgaggcttgcatc

SEQ ID NO: 3530 - DNA, 447 bp, Triticum aestivum
  unsure (1)...(447): unsure at all n locations
  Clone ID: LIB3280-060-P1-K1-H11
cccacgcgtccgcttcgccaacaccggggagttccaatctgtgaagcttatccgtgacaagcaaactggacagcttcagggctatggctttgtcgagtttgcaagccatgcaggcgctgagcgagttcttcagacattcaatggtcaaatgatgccaaatgttgagttggcatacagactgaactgggccagtgctggtgaaaagcgtgatgataccccggactatacaatctttgttggggatttggcagctgatgttacagactacatgttacaggagacattcnnnntccattacccttcagtgnnnngcgcaaaggttgtaactgacaagatgacaatgcgttcaaaaggttatgggtttgtgaagtttggtgaccctacagagcaagctcgtgccatgactgaaatgaatggaatgcccttgtctccagacctatgcgcatt

SEQ ID NO: 3531 - DNA, 448 bp, Triticum aestivum
  unsure (1)...(448): unsure at all n locations
  Clone ID: LIB3280-060-P1-K1-H12
ccactcccccagagaaatcctcctcacctcgaaacttccgtgaagcagcaaacgcaagtccggccaagatgtcgtggcagacgtacgtcgacgagcacctgatgtgcgacatcgagggccaccacctcgcctccgcggccatcctcggccacgacggcaccgtctgggcccagagcgccgacttcccccagttcgcgcccgccgagatcactgccatcatgaaggacttcgacgagccggggcacctcgcccccaccggcatgttcgttgcaggtgccaagtacanngtcatccagggtgaacctatcnctatcatccgtggcaagaagggagcaggaggcatcaccatcaagaagaccgggcaggcgctggtggttggcgcctacgaggagcccatgacccctgggcagtgcaacatggtggtggagaggctcgtcgactacctcgt

SEQ ID NO: 3532 - DNA, 367 bp, Triticum aestivum
  unsure (1)...(367): unsure at all n locations
  Clone ID: LIB3280-060-P1-K1-H2
gtgagcgttgggtgctgtgtccgtcggctaagcagcaagccggagctgcaagtcgttgaacatggggtgctactgtgaggatctcatgtctctcactctatgtgtattagtagaccatttcctttctgaatatgagctatgctatggatcttgggagcaggtcatccttagtttgcttacagtggagtagtggcggagaggtggaactgtgagtggaggacaacatattaaacgcacgcacgaactcatctctatgtacaagtcctcggcagatctggcctacagagcaaacgaancagacgggcagatctccttgttggaggagggggacggagggattgaccatctataagtaccgggcgggcgc

SEQ ID NO: 3533 - DNA, 445 bp, Triticum aestivum
  unsure (1)...(445): unsure at all n locations
  Clone ID: LIB3280-060-P1-K1-H3
ctgctgctggtccgaccgcggctccggtcatcggatcagccgctccctgtctccctgtgtcgtcccaagatggtgcgggtgggcgctgtcctgacggccgagcgtgtgctatccacggaacacagctgcttcacccaggccctcctgcgcaacgccggcgaggacactacttcgtccgaaccgattatcacaaccacgcacaggtcttggacatgatggccggacgcgatgaggaggacatactggatccccatggatgccaaggattcgagggccttggcagatgtagaggaggcaantacgaccgagatgattgcgggacacaatttaaataaaccagaatatcctgaaaattatatttggtgtatagaattcagctttagtctttgagtacatttacatcattcactaactccagtggtgagtaaatatatataaaactacg

SEQ ID NO: 3534 - DNA, 442 bp, Triticum aestivum
  unsure (1)...(442): unsure at all n locations
  Clone ID: LIB3280-060-P1-K1-H4
caacaatcaacccagaaggagctctgtcactgctgctatcggtgcattcaggctcttgaaggtgctaaagtggagctaaaaggcctgccatgagtctcgcgtacctgccccaaatttctagagcatgcccaacatgatctattgcctgcccatggcgcgctagagcactcgtcaccctgcgaaacttttctgcacctgcacaagatgcgcatccacgagcagacgtaggacgcgcaatgcatgcccgaggcactcgtgagccaggtgggcggcgccttttnnnangccatagtgtgcctcgcctgtaagaacgccctacccagtttcgacgagacggctcacgaccaggtgctggccactcgtgaagacaatgctgttgaggaccttatggtctccttcacctaccttcgcttgggccctgacctctttcagcccgtctact

SEQ ID NO: 3535 - DNA, 365 bp, Triticum aestivum
  unsure (1)...(365): unsure at all n locations
  Clone ID: LIB3280-060-P1-K1-H5
ggctgatgaatcaaaaaaatacctaaactcttcgtgtaggcttccagaacttggtttggtcagggaaagcctttgagatgtatctaatcagggcgtggtgtggttgctgccctgatctcgcggagcttccatcctttcctctatatgattggtcactctagtctgcgtcctgtgacaagatatgacttgctcatacgttcctgcactctgtctgaacccgtccgccgtatgcagacaaggggacaaagtaaaccgataacgaagagccgcaccgacaaaccgcnnnngtggagttaaccgacgtcgttcaaaaaaaaagggctgccctattaaaaagacccaatgtaaggtgatgctgcttcgca

SEQ ID NO: 3536 - DNA, 455 bp, Triticum aestivum
  unsure (1)...(455): unsure at all n locations
  Clone ID: LIB3280-060-P1-K1-H6
attgaaaggaccaccaaccttgactggctcaagggcccaaccctgcttgatgcgcttgaccagatcaaccagcccaagaggccctcagacaagcccctccgtcttcccctccaggacgtttacaagattggtggcattggaactgtgcctgttggccgtgttgagactggtgtcatcaagcctggtatggttgttacctttggtcccagtggtctgacaactgaggtcaagtctgttgagatgcaccacgagtctctcctggaggcgcttcctggtgacaacnnnngcttcaacgtcaagaatgnnaccgcgaaggatctgaagcgtggttttgttgcatccaactccaaggatgaccctgccaaggaggcagccaacttcaccttccaggtcattatcatgaaccaccctggtcagattggcaacggctacgccccagtgctggactgccacac

SEQ ID NO: 3537 - DNA, 451 bp, Triticum aestivum
  Clone ID: LIB3280-060-P1-K1-H7
ggaggaggaggaggagaccatgtcgtcgtccggtggcaagctcttcaccctggaggaggtcgccaagcacagctccaaggacgactgctggctcgtcatcggcggcaaggtgtacaatgtgaccaagtttcttgatgaccaccctggaggcgacgacgtcttgctgtcttcaactgccaaggacgcgaccgacgacttcgaggacgtgggacacagcacaaccgcccgggcgatgatggacgagtactacgtcggcgagatcgacgcgaccacgatacccaccaaggtcaagtacacgccgcccaagcagccgcactacaaccaggacaagacccccgagttcgtcatcaagatcctccagttcttggtccccctcgcgatactgggcctggccgtcgccgtacggatctacaccaaggcagactctgtctagcaccgtcatcttatacca

SEQ ID NO: 3538 - DNA, 411 bp, Triticum aestivum
  Clone ID: LIB3280-060-P1-K1-H8
atttctctcctccttctactgccaccgatcccgcaccagggaggaaccctgctcgatgagggcaaaggaagagaagaggagatcacccagcccagttcgcgcacaggacagcaggcgccgcgatctggtgcatgagcggagatggggctcacgttcacgaatgctgttgacccggctcttcgccaagaaggagatgaggatcctgatggtcgctatcgatgcgggtggtaagaccaccatattctccccgctgaagcttgcacggctcccaaccaccatccctacaatcgggtttaatgtcgaaactgtatagtacaagaacattagttctaccgtttggtatgtatgctgtcacgacaagatcaggcccctgtgtaggcactacttacataacacccagggtctcatttt

SEQ ID NO: 3539 - DNA, 389 bp, Triticum aestivum
  unsure (1)...(389): unsure at all n locations
  Clone ID: LIB3280-060-P1-K1-H9
gccacgcatccgatcgtagaaggggttagcgaacccgtcaattatgacttgccgcctctagtgtagcgtatccttctttgatctggagacgtgcacactaggtggggcacataggatacatgtgcgtcacaaacgagcacacgatagaggccactgcgaaatagagcacgaacgtggaaggagctcaccattacgacactagaaaacggcatcccaatcatgcaggctatagggagacacatggtagcgatcccagccgctgcacacacaccactcacgcncnngctacctcatggatacanncntgcatccatccttagaacttattctagcgcgtaaattgcttagcgctagagctctagcggatgcaggagacgaatgaggagaga

SEQ ID NO: 3540 - DNA, 422 bp, Triticum aestivum
  Clone ID: LIB3281-001-P1-K1-A10
gcagacacaacttatgatggagcaggtggaggaacttcgcaagaaggagcgtcagctgggagacatcaacaggcaactcaagcacaagctcgatgctgaaggcagcaacagcaacaactacagggccatgcagcagatctcctgggctgccggcaccgtcgtggacgagggcgccgccgcatatcacatgcagcagcagcagcaacaccctaatcattccgctgctatggactgtgaacccactctgcaaattgggtaccatcatcagttcgcggctcctgatcaagcagccaataatattccacggagcaacgcccccggaggggagaacaactttatgctggggtgggttctctgagcgagcgagctgctaacgcaactggttaacttggctgtccatcaaccaaaaaaccaaataaaat

SEQ ID NO: 3541 - DNA, 387 bp, Triticum aestivum
  Clone ID: LIB3281-001-P1-K1-A12
tgctgatgtcatagttcttgacgacaacttcacaactataataaacgttgcaaggtggggtcgtgcggtttacataaacatccagaagttcgtgcagtttcagttgaccgtgaacattgttgctttggtgatcaactttgtctcagcgtgcatcacagggagtgctcctctcactgctgtgcagctgctgtgggtgaacatgattatggacacattaggagctttagctctagcaactgagcctccaaatgatgaaatgatgaagaggccgtctactgggcgaggggaaagcttcatcaccaaagtcatgtggagaaacatcattgggcaaaggatataccaactggttgtgcttggcgttctcatgttccccggcgaaaatttttt

SEQ ID NO: 3542 - DNA, 395 bp, Triticum aestivum
  unsure (1)...(395): unsure at all n locations
  Clone ID: LIB3281-001-P1-K1-A2
cccacgcgtccgcccacgcgtncgtaagaatatcctgatgaaattaggtcgcactcgcaccaccaccgatcagaagccaccacgccaacgctgcgccgccgccgaactttggagaggagacgcggaggacggcaagatgggattcgagaaggagatcctgaaagccggcaccggccccaagcccgtcaagggccagaaggtcaccgtccactgcaccggctacgggaaggacggtgatctgtctaagaagttttggagtaccaaagaccctgggcagcagccattctctttcaacattggtctcggttcagtaatcaaaagatgggatgagggagtcatgggcatgcaattgggtgaagtcgcccgtcttacgtgcaccccagactacgcttatg

SEQ ID NO: 3543 - DNA, 172 bp, Triticum aestivum
  Clone ID: LIB3281-001-P1-K1-A4
cttaaaacatatcttctctacgctattttataaccagacgatccgtatttaatttcatatctttaacattgttgatccatgatggtttgttttgctctgtggttctagatttgaagattatcattttataaggtgatgagatgtagacatatttcattcaattgttatgttc

SEQ ID NO: 3544 - DNA, 430 bp, Triticum aestivum
  Clone ID: LIB3281-001-P1-K1-A5
cccacgcgtccgcccacgcgtccggcctactccatgggttgttttgtctcttcttcctattgttggtggtgtggcattggcatctatttctgaagcttcttttaactgggctggatttctgagtgcaatggcttcaaatgtgaccttccagtcaaggaatgtcctcagcaagaagctcatgctgaaaaaagaggcatctctggacaacatcaatctcttctcgattattacagtcatgtcattcttcctcttagcccctgtaaccttgttgacagaaggtgtcaaggtcactcctacttatctgcagtctgctggtctgaacttacaacaagtgtacacaaggtctttgattgccgcattctgtttccatgcataccaacaggtgtcatacatgatccttgcaagggtgtcaccaggtacccattcggta

SEQ ID NO: 3545 - DNA, 285 bp, Triticum aestivum
  unsure (1)...(285): unsure at all n locations
  Clone ID: LIB3281-001-P1-K1-A6
cccacgcgtccgcggacgcgtgggttggcagtactactactctattcattcttggatttgagagacaattaaaagtactactcctatgttttgagacaattagtaagtgcgttagctaccttcatcacagtttgaatgtattagtcgtatgatgactacatctcatccgattttggcacatcatgtgtgtttggttcttgtatatatttgtgtgacgctgtgagctagtataattgttgagcttattaactttgaaaaagaaaccaagttnacagaaagtgttaa

SEQ ID NO: 3546 - DNA, 228 bp, Triticum aestivum
  unsure (1)...(228): unsure at all n locations
  Clone ID: LIB3281-001-P1-K1-A7
ccaacacgngcggttttttaagagtatcgtataaactcgcgcaggtgtctctgactgtctaggaggctcatcggaggctcaggacaacttactttcgaccatggcagggaccttagtcctgccggttgatcttgagataactttagaaggccgaacaagcggtcagtactgcaagtttatggaaccaggaggacttcctcaatgttggcatagtcattgaaccttcct

SEQ ID NO: 3547 - DNA, 224 bp, Triticum aestivum
  Clone ID: LIB3281-001-P1-K1-A8
ctagcgacgcggccggcgtcccgatgccgcacgtcatgaaggcgccgatccgccccgacgtcatcaccttcgtccacaggctcgttttctgcaacagccggcagccctacgccgtcttccgcaaggccggtcaccagaccttggccgagtcctggggcacgggtcgcgccgtctcgcgtattccccgtgtcggcggggggggtacccaccgcgccgggcaggga

SEQ ID NO: 3548 - DNA, 425 bp, Triticum aestivum
  Clone ID: LIB3281-001-P1-K1-A9
agcggatccaggtgttgggaggacagggcagaatggcgaggcagatcctaacacgcaacagaaagtacacggggagggggagctcaagaacgtcattactgagaacactaacacggataattccgtcgaaggaactagcactgggaaagatgagccagtacagaaaccaaatgacaaagatggcaacacaacatcgtcggcagacttctcgcaggatccactgatcggcgaatgtgatccatcccatagatgtctcattgaaaagcagaagttcatcgcctgcttgaaagtttctggagattcgtcagctctatcccttttgatggacaacaaaagcacaaacccacttgatgttagcataacggctccagattatgtcatcttaacagaagatacaagtcatgttgaagcaaacggtcacaatg

SEQ ID NO: 3549 - DNA, 357 bp, Triticum aestivum
  Clone ID: LIB3281-001-P1-K1-B1
cggacgcgtgggtgttaagaggattctttatttcctacgggcgacatgattaacactctagatgaatttgtggatagtcgcctgatagtaatatccttgtatctcggtgctcctgtagtttgcacgttcagtctcaccagtgttgttaagctacttgtctgtacaattccttgctaaagattcgctagaccagtttgcgcttgtggaggctgtgatttgtcttccaaaggagaatcgagtacccccttttcgttcttaaaattcaaagtgcattaattttttgaattttaaactttcccatatttgacaaactttatattaaatattaacacttaatataccaagttatttatcggg

SEQ ID NO: 3550 - DNA, 422 bp, Triticum aestivum
  Clone ID: LIB3281-001-P1-K1-B10
cggacgcgtgggagccttactactcgcctcggccagtcgcctccgccaccaaaaccctaaccctagccccggagctcaagcgacgctcgcgcctccaaatggacgggggaggcacgcatcgcacgccggaggacgtgttcagggatttccgcgcgcggcgggccggcatgattaaggcgctcaccaccgatgtggagaagttctaccagcagtgcgacccaaaaaaagagaatctatgtctgtatggtcttcccaatgaaacatgggaagtgaacttgcctgcagaggaagttcccccagaacttccagagccggcactgggaattaattttgctcgggatgggatggatgagaaagattggttgtcacttgttgcggtgcacactgatgcctggttgctagcaataaccttctactttgga

SEQ ID NO: 3551 - DNA, 355 bp, Triticum aestivum
  Clone ID: LIB3281-001-P1-K1-B11
cccacgcgtccgccactagccagccatggcgaacccgctagaggtgacgtctctgggccatgttcagagtatcgtgaagggctacgacgggatcttcgatctgccggtgcgcatcatctccattgacagcctccgcgacgccgaggagatcgtcgccctgctgtatgacaaggtcagcgaggaaggtggcgagtggcgcataaaggaattcccccttctccaacggctggacaagctccatgactacgttcgcagagccagcacccttctcgacgagatcgactccgcggtcgagaaccacgatgagctgatgatccgaccacagcttcttcgaaacacgggggtgcacaccctg

SEQ ID NO: 3552 - DNA, 303 bp, Triticum aestivum
  Clone ID: LIB3281-001-P1-K1-B12
cggacgcgtggggcctttcacaggttggcgaggcttcaggacaagagggatatacatctgcgtctttccacccagatggtcttatccttggaacaggaactactgaagctgttgtcaaaatttgggatgtgaaaactcagtccaatgttgcaaagtttgaggggcatgctggacctgtcactgctatgtccttctctgaaaatgggtacttcctggcgactgctggtcttgatggtgtcaagctttgggatctaagggaactgggaaattttaggactttcttgccatatgattcggataccc

SEQ ID NO: 3553 - DNA, 335 bp, Triticum aestivum
  unsure (1)...(335): unsure at all n locations
  Clone ID: LIB3281-001-P1-K1-B3
cccagcctcccccgcctcgccggatatcacgagaggcggcgctccacatccccgcgatggacgcctcctaccgccgctcaagtgcgggcggcggcggcggctcagccccccgcaccgtcgaggacatcttcaaggactaccgcgcccgccgcaacgccatccaccgtgccctcacccacgacgtcgaggagttctacgcgcagtgcgatccagagaaggagaacctgtgcctgtacgggtacgccaacnaggcgtgggaggtggcgctgcccgcggaggaagtgcccaccgagcttgccgagccggcgctcgggatcaactttgcgcgcgacggg

SEQ ID NO: 3554 - DNA, 409 bp, Triticum aestivum
  Clone ID: LIB3281-001-P1-K1-B4
gccgccggaaggagacgaaccacatataccctgacctgaccctccccgtcgacctcatccgccgccgccgccgccggaggaggaggagatggacttccaggtcgtcgtcctcgccggaggcacctccgagaagctctcgcccctcgtctccaaggacgttcccaaggccctccttcccgtcgccaaccgccccgcgatctcctacgtgctcgatctcctcgagtccagcgacctcaaggacatcatcgtggtggtggaggggcaagaggcggcccgcctcgtcggcgcgtggatctctagtgcttacctggaccgcctcgtcgtggaggtagttgcagttactgaggacattggaactgctggtgcattacgagctattttaaaaagactggtcgcaaatgatgttttg

SEQ ID NO: 3555 - DNA, 362 bp, Triticum aestivum
  Clone ID: LIB3281-001-P1-K1-B5
cggacgcgtgggcggcgacgagctggctggacggcttctacgggttcatggcgcaccacgtgacgaagcacccgcgggaggcgtacgtcaacttccgggacctggacatcgggcagaacgcgctggaggacgacttcggcgccgccgagaacgccaggttctggggccagcgctacttcctcggcaactacgagaggctcgccaaggtgaaggccgtcgcggatcccaccaactacttccggaacgagcagagcattccgcccatggccaaccagccacgcgagtgagcagggttgcacgccaaggcaaggcatccatcggatctcaacaatctaaatcatttatggtcgacgatggcttac

SEQ ID NO: 3556 - DNA, 233 bp, Triticum aestivum
  Clone ID: LIB3281-001-P1-K1-B6
atatgccttatcaacagttattcaatacaatgcatatgccaagtcatgcactccacatctcaaggtaataataatcagtctacataaacaagaatagtggcaatccaaaacacatgcctgaagcatgagtttacaaaacgagcataatcaggattcattattatgaacttaacagacggatctagcgtgggagactagcagacgccatgaactcgcactctaagctataacat

SEQ ID NO: 3557 - DNA, 415 bp, Triticum aestivum
  Clone ID: LIB3281-001-P1-K1-B7
cggacgcgtggggcacagaatgctatcaatgaactcaatgggatgcttttgaatgacaaaaaggtttatgttgggccttttgttcgtaaacaggaaagggaaaatgtttttggcagtcccaagttcaataatgtctatgtaaagaatctatcagaatctaccactgaagataatctgagagaattgtttggtaattttggacctataactagtgttattgtagtgcgaggcgatgatggtaaatccagatgctttggattcgtgaactttgaaaatccggatgatgctgcatgtgctgttgaggatttgaatggcaagaaatttgatgataaggaattgtatgttggtagagcccaaaagaagtctgaaagggagatgcaattgaaagaaaattttgagaaaagcaataaagaga

SEQ ID NO: 3558 - DNA, 430 bp, Triticum aestivum
  Clone ID: LIB3281-001-P1-K1-B8
caaataacaggaggttaaacaatgtatttttccactgctccggcaggaaaacagaagataattgcatattcagactctcaaaagaaaatgtgtgatggtggcaatgttgtcgaacccatttttagatgtaaatacgatgccagttaattgctctatctcatcaatccacaaacaagataatcagaaccgagccatcaaccttaacaatgcacagagcctgatggatgtagatcatgcaaataatattgaactgaactcaggttcagtggatcttgcttcacatgcatcacgtagtgcacaaaaaagaaatgtggacatggcaaactggattgacggagccaatggatcagtagacaagaaaattaaattggataatgtatcatccactgtggagtctagtttaagtgggaagatcagagatggaaggttg

SEQ ID NO: 3559 - DNA, 243 bp, Triticum aestivum
  Clone ID: LIB3281-001-P1-K1-B9
cggacgcgtgggatgttccggaagtgcctatggaggaagattagtggccgtggagagtgtcatagttggtttgcctgtgtgagcttcatcagcgcttcagttttgatcattacgtgtttttgtgtgggcaatttgtacttgcgatgttgttgagaaagagaaagattgttattacatataccctggtttgtaaggacggctgctatagaagtgccggttgaattcactaaaacataagagctc

SEQ ID NO: 3560 - DNA, 359 bp, Triticum aestivum
  Clone ID: LIB3281-001-P1-K1-C1
aggctccaattgagaatatgcatttgcattgtgaatgtaacaataaaacatatcacctttcagtactctcgggtgccctatcagctaccgtatttccaacataagaaggtaaaaaaaggtactggtaaattacatcttagtaatgaaatcgtgctaaacaaacaaacaatccctaaagttcatccaagttggcgcctgaaaaataacaggactgattctcctccaggaactgccagtagaggcgcaatgacaaaaagtcgcagccatcacttggggcgggttggagaggcccatgtttctgttcactgtacagaagaacacaacttctaccagcattgggatcatccgcaagggcttag

SEQ ID NO: 3561 - DNA, 147 bp, Triticum aestivum
  Clone ID: LIB3281-001-P1-K1-C10
gtacaacgggggacacgcgggctttaccttatggagccccaacgtgaacatgttgcgtaacccgaggtggggccacagccagaagacacccggtgaggaccccgacgtgtcccgtcggtacaccgacgtctatgtgcgagggctgca

SEQ ID NO: 3562 - DNA, 268 bp, Triticum aestivum
  Clone ID: LIB3281-001-P1-K1-C11
gcaaacactgggggatttggaggttctttcttatcaggttcatgacccaaacctgggatcttcagataagggtcatagggcggaagcccacggcactgcctcctgcgtacccatgggggcggggcacgattaggcataccgggagcttttttaagatagcggcacagcttgcctcggttcactacctcaagcgaggacgtacacctgctgcaaacactctacagtataccacaactacggcttgttcgggttggtttggtgacccaca

SEQ ID NO: 3563 - DNA, 329 bp, Triticum aestivum
  Clone ID: LIB3281-001-P1-K1-C12
ggcgactccatcgtcgtcatggacgccttcgcgctccccgtcgagggcaccgagacccgggtcaacgcccaggccgacgcctacgagtacatggtcgagtactccaccatcaacaagcaggctggaaggttggaaaatgtggttggctggtaccactcacatcctggttatggatgctggctgtcaggcattgatgtttcaactcaaatgcttaatcagcagtttcaagaaccatggttggctgttgggatagaccctacaaggactggttctgctggtaaaggggacattggagcttttaagacatacccaaaagattacaagccacc

SEQ ID NO: 3564 - DNA, 295 bp, Triticum aestivum
  Clone ID: LIB3281-001-P1-K1-C2
cctatatgtatgtggtacacaatcttaaatagtagaaggggaaaataaagcattaatgtggagtatgttccaatggaaatcttcaggaacaccttgaaggtctgagtgcaatttttctttagttctctgtgagcttaaaaatgcaactgatgtggcccatgcaactgagattaaaaacatggagaagaatcataaaagatctcgctgaaaatgccctcgttccgcacttcgtgtggacaggcagcgccctttaccttcgaagtctcgaaaaatgggctgggtgatgcgggtgcct

SEQ ID NO: 3565 - DNA, 155 bp, Triticum aestivum
  Clone ID: LIB3281-001-P1-K1-C4
cggacgcgtggacaagcggatacaaacacaatgagcaatacccggcctctgcatagctaggatgcacacaaccaccaccaacacacacaaaaaaaaactcacgccggcagaaagcaaagtcctacatgactgaagctctgccttggcggaggaag

SEQ ID NO: 3566 - DNA, 174 bp, Triticum aestivum
  Clone ID: LIB3281-001-P1-K1-C6
agtccctacctttcccttcgagcaaactgacacaacccacaccaccgcagcccccaaccccacccgaagcagcagtcatggccctcaaggcagacaagaagccggcggtcgagaacaaggtctagaaggctgcggagaagacccccgtggtgaagaagcccaaggcctagaagc

SEQ ID NO: 3567 - DNA, 427 bp, Triticum aestivum
  Clone ID: LIB3281-001-P1-K1-C8
ggcacacctgacagtatccacatgtgacagtcgctgataaggagccaaattggcttcactgtgaagaccagcattccagaatgagatatttgtctgctcaagctgctgaaacaactacaggacgcgtagaagaggattagtcaacagaatatagatgctcttgcaaaactggaagaattgaggaggctttaatctatacagagtcacaagtccaatgatgcacccccagacgcagatatgtactgcaaaccaaaaacgcgagatgatgtgactgctaaatgcgctagttcagtggcagatacatgttgtattgtctctgctgatggctataatgcgcctcagccagtatctggagtcaagattagtgaagtttctattggttccagtgcagaatcaaatacttcaagtgttagtaaaggttataatt

SEQ ID NO: 3568 - DNA, 319 bp, Triticum aestivum
  Clone ID: LIB3281-001-P1-K1-C9
cggacgcgtgggaaacaagcctacttttacaagttgtctgacttcattaagtttggttagatctattgatgatgacaccaagatccttcacgatatgacgattgaagtgcgccttccggataataaacttgaactgggatggttggaatcctacgatttgaaatacaatgttgcggttatcaacatcggtcgctaccattctcttcaagtaacatgtctagatcatcagcggcaatttgagtctcacagtaaagtagttgccgtagggcgttgcttcaactcaagaaaactagtggccacagctgggatgttgaccgac

SEQ ID NO: 3569 - DNA, 171 bp, Triticum aestivum
  unsure (1)...(171): unsure at all n locations
  Clone ID: LIB3281-001-P1-K1-D1
cccacacgtccggaccgccccgnttttttgctttttttcaaggccaagcacgggaccagccggaagccaaaaagagcagcgcgcgccgaaccgacgcccccggcaacaacggcaggccggccaccccggagccggtggccgaccgcggtgagacagaaaaggtccttgagc

SEQ ID NO: 3570 - DNA, 380 bp, Triticum aestivum
  Clone ID: LIB3281-001-P1-K1-D10
cggacgcgtgggattctttactctctccctctctctgatgcaccagcaggtcactcacaccatatcgccactgcccactgttgggtaagccctcctgtaatctcctcatcggatcagaagaatcccagcgaatccagggaaagaagactccctccgagtcccgtccgagacgcaaagtgtcagctccgaccccgagcggatggcgtctcccccggagggggtggagccggcggtgatccacgcgtggtcggcgccgcgctccctcagcaccagccttatgtactccttctccgagagggatgacatggatgtgcttgacaagcctctctacgctaattttctgcgtgtcaccggcgttgacaggccctaccgccaggagc

SEQ ID NO: 3571 - DNA, 345 bp, Triticum aestivum
  Clone ID: LIB3281-001-P1-K1-D11
tgcattcaatagtcatcaatggtggatcccatgctggaaacaagcttgccatgcaggagttcatgatccttcctactggagctggctcattcaaggaggcaatgaagatgggtgttgaggtgtaccacaacttgaaatctgttatcaagaagaagtatggccagtatgccaccaatggtggaaattaaggtggttttgctcctaacattcaagaaaacaaggagggccttgagcttttgcaaaccggaattgaaaaaggttgattcaccggcaaggttgtcaatggaatggatgttggtgcttcatagttctacaatgacaaggacaaaacctatgacctcaact

SEQ ID NO: 3572 - DNA, 334 bp, Triticum aestivum
  Clone ID: LIB3281-001-P1-K1-D12
cggacgcgtgggaagaccaacatgcaggagaactggagaatagttgactttttctcgcaccacccggagagtctgcacatgttcaccttcctctttgatgatgttggcattccactcaactacaggcacatggacggttttggtgtcaacacctacaccttaatcagcagggatggaaaggcgcaccttgttaagttccattggaagcctacatgtggtgtgaagtgcctcttaaatgatgaagccgttactgtaggaggcacctgccacacccatgccacaaaggacctgactgatgctattgcagctgggaattacccagaatggaagcttt

SEQ ID NO: 3573 - DNA, 334 bp, Triticum aestivum
  Clone ID: LIB3281-001-P1-K1-D2
cccacgcgtccgcacggcccagccttcctactcccccgtcctctccactttgaccgccggcgcacgcccaaaccctcgttcgccggcgcagatggcggccgacgctctcgccgccccttccttcacagttcgggcgccacgcacctgatcggccgctcctcatctccacgggcggcgatggcgccgggctcccagaagaagaacaccaagggcgtgaaggaggtcgacccgacggccaagctcaccgacgacctcctcgtggacatcatctcgcgcgtgccctacaaagtaacatgctgctgcaagtgcgtctccaggcgttggcggaacctta

SEQ ID NO: 3574 - DNA, 219 bp, Triticum aestivum
  Clone ID: LIB3281-001-P1-K1-D3
cggacgcgtggggctcgccgagaacgcctacaaggacaacaagaagtctcgcatcgttcccaggcacctgatgcttggcgtgaggaacgaccaggagctcgggaggctggtggcccgtgtgaccatagtgcacgggggagtgctgtccaacatcaatcctgatctgctccccaagaaaacgggcgggaatgcacccaagtcgacccaaaaggcttgcaa

SEQ ID NO: 3575 - DNA, 277 bp, Triticum aestivum
  Clone ID: LIB3281-001-P1-K1-D4
cgcttcaaggggatagagaagccctcctacttcgatcgctggatcaacctgagggtccccttccaggctgcgctcggcggcggagggcgggtcaccctccaggaggcggtcagggcagcgggactggactgggagggccgcctgcactgcggactggacgacgcgcgcaacacggcgcggctttttgttgagctgatgcggcgcggggtcaagatgaccatcaccggttcgctggcgccgccggcggcgatccagcagaaagagcaagccccgcagc

SEQ ID NO: 3576 - DNA, 418 bp, Triticum aestivum
  Clone ID: LIB3281-001-P1-K1-D5
agataccaaagggtggagaagccttggaatgagacaccgattcgtgagaacgagatcaggatcactgctctcgggaggatgaggaactatatcagctaccggatgtcgttgcttgaggaaaatgggcatgatgagatcactatcaaagccatgggacgtgccataaataacacggtcatggttgctgaatagatcaagagaagggttgctggtctccatcagaatacgtctattgaatctgttggcatcactgacacatgggagcctctggaagaaggccttgcacggctagagacaacttcgtatgtattaatgattaccctaacattgtccaaggaaccattggatacatcatttccagggtaccaaccacccataccagctgaagaggtgaaacctgcttttgattatgaacacg

SEQ ID NO: 3577 - DNA, 419 bp, Triticum aestivum
  Clone ID: LIB3281-001-P1-K1-D6
cggccgtggtggcgcgcgtggtgcgcgtgggcgcgtctgttgcttggctacggccggcggccatggtggtcggtggggcgcggcgtgggcaggcaggatctggcctgcagtggaccggatttggtcacatgcagcggcgggctgcaatgacccttcctatgtggtggtgcagggagcagcgcttcgcagtctaccggtgcttctcggaggtggtctgctcacttgggcgaaagccactgctcctgccggagccggcgatagtgacacccgcgggtgccgcttaccttcttggaggcattgctgtcatggtgacttccccttcgaggttcctggggaaacccatattcctggtctgtccagaacggccgatagcggcgcgtttcgcgtcgcttcctttctgaaggcatcagcttggtgga

SEQ ID NO: 3578 - DNA, 410 bp, Triticum aestivum
  unsure (1)...(410): unsure at all n locations
  Clone ID: LIB3281-001-P1-K1-D7
aaaccccaantcttttaccattttcaggaaagaaatgaggaattcgcgctcagcaagatcgctcgccatggactcaggggagagctccgtcgtcttcaacgccgcccacgcggcaatggccgtcgactacgcccccgaggtcgcctgctgcgtatcatccatggtcgacctcggcggcgccgccggcgtggagagccagcgcctgttcctggcgcgccgcacggcgctggaaatgctgcgggaccgcgggtacagcgttccggaggacgagctttgccgcacccttccggagttcccggcggtggggttcgagacacccgagatcgagcgccttttcttttacacaaccctttgcttcgacgagtccaacaaggggcgaattggtttcttgccacctgagcccgttaaaa

SEQ ID NO: 3579 - DNA, 338 bp, Triticum aestivum
  Clone ID: LIB3281-001-P1-K1-D8
gtcgtggcagggggcgctgagctatgtttcccctcacactaaggtggtcaagggtaacaggattcttccctttcagtgtgagcttgacagtcttcagatgagtattcatgctgatgtcgacgccaatgatggtgccgtggacggtggtgcggtcgtggcagggggcgctgagctatgttataccttggaaattttgcactgcatgcttgtgtgcagtgtaatctggtttcttacttgtacggagcaatattcttattagagccaggaagacattgatattggctgtaccagctgttcttgatgtggaattatgttgttggtgtttgactgatgttgat

SEQ ID NO: 3580 - DNA, 228 bp, Triticum aestivum
  Clone ID: LIB3281-001-P1-K1-D9
aaagtctgaaagagtcctaggatttgaccctcctacagccttgccgtcttttcagcgtgtgtaatttgtagtaccaacttttttttaatctttactgctgcgagactgtaatctgtaccttgatgtaccatcatcgtgttgtgttgcacaaaggactgatgctgttgttgagtgctcattgcttgctcaggcatgtttgaggctttcattgctgcatggtttgcaccc

SEQ ID NO: 3581 - DNA, 261 bp, Triticum aestivum
  Clone ID: LIB3281-001-P1-K1-E1
cgccgacgccccccttcccacacgtagccccctccgcccgccgccgccgccgccgccgccgtcgccgttccacctcgtcgcctccaccgcgtccgcagtctccgtcatcggcttttgaggtgaactgagcacccaacttttgtcaagatgtctgatagtcatgaaaccgacaagaacattgagatgtggaagattaagaagctgatcaagggacttgagtctgctagaggcaatggcacaagcatgatctctctgattatg

SEQ ID NO: 3582 - DNA, 128 bp, Triticum aestivum
  Clone ID: LIB3281-001-P1-K1-E10
tcgccctgcatggcggttttggctctttttttaccccgcaccctgcgccgttcttgtcgcccgtacgttccggcttccccgcgcggtgcttttaggcagtattgctactgctaccttgcctgcacaaa

SEQ ID NO: 3583 - DNA, 372 bp, Triticum aestivum
  Clone ID: LIB3281-001-P1-K1-E11
cggacgcgtgggaaagcgtgtagctgcttggacgtttctccctgaagaaaatgccgagtcaatgcaggttctgcattatgaagttggtcagaagtatgatgcccacttcgattattttagtgacaaaaagaacataaagcgtggtggtcatcgagttgccactgttcttatgtacctgacagatgtgaagaagggtggagagaccgtgttcccaattgctgagggaagagatttacaacataaggatgaaacgtggtcggagtgcgcgagacatggcctggcagtgaagccaagaaaaggcgatgcgctactgtttttcagtctccacgttaacgcgacaacagatcggagcagtcttcacgcgagctggcc

SEQ ID NO: 3584 - DNA, 308 bp, Triticum aestivum
  Clone ID: LIB3281-001-P1-K1-E12
cggacgcgtgggggccaacttccgtaagatcctgctgacccagatcaagaagctcgtcgccgtcggcaagctgaccaaggtcaagggctcctacaagctcgccaaggcccccgtcgtcgtcaagcccaagacggtgaccaagaagaagcccgccgccaagcccaaggccaaggcgccagccaagaagacggtcgccaagtccccggccaagaaggccgtcgtgaagcccaaggccaaggccccaaccaaggcccaggccgtcgcgaaacccaaggctgtggcgaaaccgaaggcgggtgccaagccca

SEQ ID NO: 3585 - DNA, 355 bp, Triticum aestivum
  Clone ID: LIB3281-001-P1-K1-E2
cccacgcgtccgcggacgcgtgggctctctccactccggccggccagccagtctcttcttcttcttctccagcgagcgagcgagctaggctcggaggtgagcgaaaatgccggtcagcaggatcgccgtggggagccaccgtgaggtgtacgaggtgggcgccctcaaggcggcgctcgccgagttcatctccacgctcatcttcgtcttcgccggccagggctccggcatggccttcagcaagctgagccccgacggcgcggcgacccccgccggcctcatctcggcggcgatagcccacgccttcgcgctgttcgtggcggtgtccgtgggcgccaacatctccggcgggtac

SEQ ID NO: 3586 - DNA, 192 bp, Triticum aestivum
  Clone ID: LIB3281-001-P1-K1-E3
cgcaggtagccctgctcactcccgtttaaccttcttcgcccgcggatgcaaccgctgcgtcctcaatggcagccagctaccgcgccaagctaggagcccagctatactatcggacaaggagatcgcccctgggcgtcacggctagggggcccctgatgcacctcttcatgcggggctccgcgagtctatttg

SEQ ID NO: 3587 - DNA, 432 bp, Triticum aestivum
  Clone ID: LIB3281-001-P1-K1-E4
cgcctccgtccgggttccgccgtgccggggctgctcgagagagcgagcgagtcgccggcctcgccgcctccgtcccgtattttcctccgatcctgccctctccgtgtccctgctttgggtctcagggaccaaaccatcccaccgcggcttgctggcgaggtgaagacataagattgtccttcgctggagtttaccaatgtcggcaggagccactataaactggatcagaaccccatttcacgcccagagatttcatgacttctcaagtttaagttttagatgccgaaacacttttggatcaattcagccttcctggttggcaactgatcaggattcattcctctccaaagtccgtgtggctgcagactactcagattcagtgccagattccaagtacatgagagatcggggataccattctcttgaagaaat

SEQ ID NO: 3588 - DNA, 427 bp, Triticum aestivum
  Clone ID: LIB3281-001-P1-K1-E5
ctccttgccgcggttcttggggaccgccagcgtcgctaatgcggtgccgcgctgttccttgtgtcggtggagccagattccggtgggatttccgcagattcgtctttcccggggcttcgacctgtgagatgcgggcagggattgggctttttagtcggtactatatgtatttacggacttcttttattctgagtttttggggaattactgggaatatatttgtcttgtggtcgaggaatcatttctcacctaccacttcttggctgctatttctagtcgtaatttcttaaactaaaaaaggggtagtatttggcttcttggtttttcaaaaagatgcctagatctggcactaagtcattcgtctttttttttttatgcgggcggctagttcatcgatctgaaacgggcattgccccccgtgagcttt

SEQ ID NO: 3589 - DNA, 346 bp, Triticum aestivum
  Clone ID: LIB3281-001-P1-K1-E8
ccctgcatggcggcgctggcgcctactttaccccgcaccctgcgccgctcttctcgcccgtacgttccggctcccccgcgcggtgctcttaggcagtagtgctactgcgacctcgcctgcgcagacggatggcgccgcggtggtgcttcgcgttgctcctgctgctgtgtgcggcggccagggcgcgggcgggggccgacgcctcgaaggggaagtgggacccggtgatccggatgccgggggaggaggagcccgccacgggcgacgagagttccgaggaggaggacggcgtctggacgaggtgggcggtgctcgtcgccggatccttcggctacggaaactacaa

SEQ ID NO: 3590 - DNA, 137 bp, Triticum aestivum
  Clone ID: LIB3281-001-P1-K1-E9
tccatcgttcgccctgagaggaggtgttcacgcattttataccacgcacccggtgcacttttctcaagctcgtacgacatcgctttccgctgaccgtggttttaagccttatggctaacgctaccccgcccacacaa

SEQ ID NO: 3591 - DNA, 359 bp, Triticum aestivum
  Clone ID: LIB3281-001-P1-K1-F1
ctttattctttgttggcagtgaagttgtccatccagcacatcagagttgggtagtaattgggcccaatattctcgacatgctctatgctgaaccttgatgacgtgctcatggcagacactacacgggccaaagaaggaaggcaaccaccaggaaatatatattctgttaagaagtctggcctttttctgtattgctcgtaccgttcctctggagctgagatgaactaaacgcacatgtatgtatttgcagataatggttagttcatgatagtgtaagcctaaggtcttgcttggatagaaggagtacgtttcattgggttttctgcaccttccgtcttcaggagcaacctgcttttgac

SEQ ID NO: 3592 - DNA, 376 bp, Triticum aestivum
  Clone ID: LIB3281-001-P1-K1-F10
cccacgcgttcgggtgtgcaagttgtaccagccggtctttggtcgtgtgtagcagttgccggtgaataccatatctggctgcgatcggggcgatgatgtggtggcatccatgggcgtcgcgaccctgttgagggtgtcatcgctgcatcttgtctccctgactatgtctcctgcttcggggactcgaggttgttggagttgccggagcggcaaccccgggttttggtggtggcgggtcctgacacggggcggggcgtgcctgggcgggaccaataaagggatctcgccaccagattgggatgagcgttcggcaggggtgctgtgctcagtagggcgaggtcagatggtggtaggttggtccctacacctccgggag

SEQ ID NO: 3593 - DNA, 414 bp, Triticum aestivum
  Clone ID: LIB3281-001-P1-K1-F12
cggacgcgtgggctgcacgacagccatcatcctccgtgcggttccaagctccaactcccacgcccgtctccccctagatcaggaggagcacgccgcaccggagcgccgagacctcgaagccttcgtctccacctcggagcagagatggggctcacgttcaccaagctgttcagccgcctcttcgccaagaaggagatgaggattctcatggttggtctcgatgccgctggtaagaccaccatcctctacaagctcaagctcggagagatcgtcaccaccatcccaaccatcggattcaacgtcgaaactgttgaatacaagaacatcagcttcactgtttgggatgtggggggccaagacaagatcaggcccctgtggaagcacttctttcaaaatacccaaaggcttattttt

SEQ ID NO: 3594 - DNA, 381 bp, Triticum aestivum
  Clone ID: LIB3281-001-P1-K1-F2
ctcaagaatccaaatcggcccattgctagcttcatattctctggaccaactggtgttggtaaatcagaattagcaaaggctctggcatcctactactttggctcagaggaagccatgatcagattagatatgagtgagtttatggagagacatacggtgtccaaactcatcggatcacctccaggttatgttggctacaccgagggaggtcaactaacagaagcagtccgccgccgtccatacacagttgttctctttgatgagattgaaaaggcacatccagatgtcttcaacatgatgcttcagatcttagaagatgggaggctgacagatagcaagggacggacagttgacttcaagaacactctgctgatcatgaca

SEQ ID NO: 3595 - DNA, 439 bp, Triticum aestivum
  Clone ID: LIB3281-001-P1-K1-F3
cggacgcgtgggcggacgcgtgggggtagcggagctcttctagcgcgagaagagccaccaccccattcaatcgtccgcctgggtttgcgaagggtcagagatggcggaccgagctaaccacccgtatgtcatgcagaaggttggtggacagagccaccttgcctccaacttcattgagggtgctcgagctcgcaacatctacccttcggtgccatcctatgaaaggcgcttcaccacaagcagatacataactgataactctgacatgagtgtacgaaacatgtcatcttcttcaacgtgagcgcaatgcaccctctgagaagaaaggtgtgacaaactttgcgatcggatcccttatgggaagagcgtcagttgtaattatgcaagactgatgcagctaccattgagcgtgttaagctgcttattcagaaccaggatg

SEQ ID NO: 3596 - DNA, 426 bp, Triticum aestivum
  Clone ID: LIB3281-001-P1-K1-F4
gttattctgtaggaacatatcaaaatcaatttatgggaaagacacaacgcttgtgcacaattcttgatgaggaggtgtgatctgagacagtctcacaacagcagggtttctggaggaatgtcatcctctttacctattctgccaaattctctgaaagaaaccttccatgggccttacaatccgcagctcactccgatgcaaaggcaactgacgagtgatcttgtgcccttacatcagagtgcacttccatctgctactttgcacccaagagctggtgctatgagatcatcatatgcagcctcattaggatactcacctaatcctctggattctgcgcctaaccatgaaaggcagtctatggttgctccttttgctcctcagccatcagatatcgaagtatttcaaaccttatctaataatatccct

SEQ ID NO: 3597 - DNA, 272 bp, Triticum aestivum
  Clone ID: LIB3281-001-P1-K1-F5
tgggaattgtactagcattgcttttgccaacggtgcaaaccgcacaaaactagagcataggattcgaaaaagcggtgtgctcttaaccagactcacgtcaagactgccggtcatagtactgtgattcacaatactgatttctgctccggttacacacgatgaacttggaaggctgtgcacactagcacgacctcatgggcgatgctgagcgtcctgagagctcgtccccctgacccctaggcacatggcataagaagtgtggctccccacta

SEQ ID NO: 3598 - DNA, 205 bp, Triticum aestivum
  Clone ID: LIB3281-001-P1-K1-F6
cggacgcgtgggtattggtctcttgtgtagaattcaatttatattatttcgtttcatggtttgcatcgtgtaggcgaagggtgcatgttttattgttcctgttcgtgtctaggtttgttgcagatgtatggagacatttgcgacgcattttatttgaaatgcaattgtgtgtatatggtattacgattattttgccagccactgc

SEQ ID NO: 3599 - DNA, 209 bp, Triticum aestivum
  Clone ID: LIB3281-001-P1-K1-F7
tcgcggacgcgagggcattcgcgccgataaccatggcgccaagcgggagagggacgtctaggtcttcgagatgctgtcttcgagggagtccggccgcttcggaggcggcgatcttcgttcggccgaccgcgcctacgccggcgagtagcaccttccgcaggaaggaccctggggcgtgtaagacatggatagcgcggtctatgtctcgc

SEQ ID NO: 3600 - DNA, 403 bp, Triticum aestivum
  Clone ID: LIB3281-001-P1-K1-F8
gtgggcgtctgcagcacccattggacacaaaccccgaaaccctagactccaatcctccttcgccgcatccctcgctacctcgtccgccgccgcaccctctttcccctcctctctcttcagcgtccttcctctttttccttccgggtctctcttgcccgctccttgttgttgctgtgccggggaaccaccacggccgcaccgccggatgaagccaccatccgcggcgctgttccgttgccttggatccgtgcagggggcctccccggggtagcagaggaggcagttggacgaggaggcgcgaggcgagcaggaagttggggtcgccggaggagcacagccgcacgggggctggtcttcgccagagcaaagtgaaggaggtagatgtagggggacccaactcggc

SEQ ID NO: 3601 - DNA, 344 bp, Triticum aestivum
  Clone ID: LIB3281-001-P1-K1-F9
cccacgcgtccgggtgtgcaggttggaccagccggtctttggtcgtgtgttgcagctgccggtgaataccatatctggctgcgatcggggcgatgatgtggcggcatccatgggcgtcgtgaccctgttgagggtgtcatcgctgcatcttgtctccctgactatgtcttcggctttggggactcgtggttgttggtgttgccggggcggccaccccgggttttggtggtggcggctccagccagggggcggtgcgtgcctgggcgtggcggataaagggatctcgcgaccagattggggtcagcttctgcaggggtgtggtgctcaatgggcgggggtttatg

SEQ ID NO: 3602 - DNA, 374 bp, Triticum aestivum
  Clone ID: LIB3281-001-P1-K1-G1
cggacgcgtgggctccactgatgcttccatcagggagatgattcctccgggtgctttggtcatgctcacccccctcattgtcggaaccctcttcggcgtggaaaccctgtctggtgttcttgctggtgcccttgtttctggagtacagatcgccatctctgcttccaacaccggcggtgcatgggacaacgcaaagaagtacattgaggccggcaacagcgagcacgcgaggtcccttggccccaagggttcagactgccacaaggcggccgtgatcggcgacaccatcggagaccccctcaaggacacctcaggcccgtcgctcaacattctcatcaagctgatggccgtcgagtccctcgtgttcgcgccct

SEQ ID NO: 3603 - DNA, 362 bp, Triticum aestivum
  Clone ID: LIB3281-001-P1-K1-G10
atcagagccagagatgcctttagggcgtccctcactcagtcttcaaggaagaagacagcgcaacttgcgcatgctctgctatgaacatcgtagatggagagagcagcagcttccaattgctacaatgaaggctgccttctgcccagatgtgtttatgcctcttaggagagttcctcctggatctgtcggaccggatctaaatgcaccggccacagtcgagcccatgttgtctgagtgcaacctaccgttcgaccctgctacctgttttgccgcgccatacaacacggtgtcggtttttactagtgccaaaaacctggtgttctgcgacggtaatctgtatcaaatctggaggaatgcaagct

SEQ ID NO: 3604 - DNA, 345 bp, Triticum aestivum
  Clone ID: LIB3281-001-P1-K1-G11
cggacgcgtgggctctctctctctctctctctctctgagtgtgtgagtgagccccagtctccccacagctaggcgaacaagatcttatctccccaggggcacgggccctccccgagatcctccagagccgccgccgcgtcgcgaccttcaaaaaatgccggcaccgatcgggggccggcgccggctgtgaggctgctatggcgccggccaagcctaggttctggctcggggcgggcctgctcaccctgctgctctgggccttcgtcgcgcagctcgtccccctcggacgccttcttgaccttttcggacttcccggcggccccaagaatttacaaaagccatggt

SEQ ID NO: 3605 - DNA, 400 bp, Triticum aestivum
  Clone ID: LIB3281-001-P1-K1-G2
cggacgcgtgggcggacgcgtgggctgacgcgtggggaagtctaagcttcctggggctcccaagtttctcttgtgtattcttgctgagaggaagaactcagatgtttatggtccatggaagcgaaaatgccttgctgactttgggattgtcactcaatgtgtggccccaacaagggtcaatgaccaatatctgacaaatgttctgctcaagatcaacgcaaaacttggtggaatgaactcactgctacaaattgaaatgtccccaagtatacctcttgtatcaaaggtcccaactctcatcttgggaatggatgtgtcccatggatcccctggacagtctgatataccgtccattgcagcagttgttggttctcgggaaaggcctcttgtcttcgaaata

SEQ ID NO: 3606 - DNA, 393 bp, Triticum aestivum
  Clone ID: LIB3281-001-P1-K1-G3
cggacgcgtgggtaagggtacaaaaatgatgcagttggcaggattatctgctgatgacatgatcgctgtgaataatatgcactgcttatgcactgacacaaaaaagtcctcaggaggaggttttacactgaaatttgatgttcagaagaaaaaacatgcacatagaaaagagcgaacaacggaacaatcagcatgggcactgtcccgattttatccggttctggaggaattgattgagcagctcagcaagggtgaattaccaaaagatgaatataactgcatgaacgaccctagtcccagtttccatgtaggacctaccactaccagtaccttagcccgcacaagcccagctcactcgatgagatctaggaggactggtggatcatgggctag

SEQ ID NO: 3607 - DNA, 404 bp, Triticum aestivum
  Clone ID: LIB3281-001-P1-K1-G4
gtcggctagttcatacggcgaggagcacgggaagggaggcggaactcgggagaggagatgggtgcgccgaagcagaagtggacgtctgaggaggaggaggcgctgcggcgcggcgtgctcaagcacggcgctggcaagtggcgcaccatccagaaggatcccgagttcagccccgtcctctcctcccgctccaacatcgacctcaaggacaaatggaggaatttgagttttagtgcaagtggactgggttcaagggataaactaagggttccgaggccgaaagcaccttcgtcctccccatcacctagcccgcagcttctgcttctctcagccccgaataatgttgccgaggcttctccaccagaagattgtgaaaaaagcccacaggatgacaagacttcgag

SEQ ID NO: 3608 - DNA, 238 bp, Triticum aestivum
  Clone ID: LIB3281-001-P1-K1-G5
tgggggtagttagtacggccaggtattcggacagtgaggcgatcctccggagaggagatgggtacgaacgacacacgattggtccaagcgagatccgaggagagcggctgcgggtcatgcgtcatgaaggccgaggagaaggctggcgagatcttcgcatacgatgaggaggaaatcaacattgagatgctgcaacttgacgtagctgtgaaagagaaaatcaggcatgtatattttc

SEQ ID NO: 3609 - DNA, 117 bp, Triticum aestivum
  Clone ID: LIB3281-001-P1-K1-G6
tcgaggacaccctgacatttttttcttttttagaaccctcccgagcgcacaagaatataacaccaccgttatttctccaaccaaatccaacatattgctgcgttacatcccccatga

SEQ ID NO: 3610 - DNA, 418 bp, Triticum aestivum
  Clone ID: LIB3281-001-P1-K1-G7
cccacgcgtgcgctttcgcgtgggttaaaaccctaaaccctgtggaccggcgtcatcgtcagccatggccctattcgacgacgaccgacgggcggactaatcctcgctgcccgtgattctggccttcacctgctactaccgcggcgctatttttcaagaggcggcctggatcatcccataatttccatggtgcttccagtctgttggtagtatcaccaccaccattattgattgatagatagcaataatttgctgctgctgctgcttggggttggtgatgttcgccccagccttggtccacctgtacccgttaaggtcaaaacctaattttttggtgattaaattataggtggttcagaggctacataattttgtttttttattacctccccgcggggacattggaaattttttttcc

SEQ ID NO: 3611 - DNA, 417 bp, Triticum aestivum
  Clone ID: LIB3281-001-P1-K1-G8
cccacgcgtccggtcaggtcttgtttcctaatgttggaccttgactgtgacgacttgatccaggaaacattcacacactttttcaggatcataagcccaacacttcaagaaagtgtcgtcacctctatggaaactataatgatgtttgtaatccaggagagtgagcctgtccatccaggtctggcatcttgcctccttcggaatcttaaaaaggaaaagaaggattctcttctagcatcttatcggcttgcaaagaggataacacgtctttgtcctgaaaaattaaagccggcgtttgctgagttacttcaaggcagccccttaaatgagtacagcaaagttgttgcatcttcaatagaaagttctttaaatgctggaagagacaacaacattgatgctgtttgaaatgacacggga

SEQ ID NO: 3612 - DNA, 338 bp, Triticum aestivum
  Clone ID: LIB3281-001-P1-K1-G9
cgcctccgtccgggttccgccgtgccggggctgctcgagagagcgagcgagtcgccggcctcgccgcctccgtcccgtattttcctccgatcctgccctctccgtgtccctgctttgggtctcaaggaccaaaccatcccaccgcggcttgctggcgaggtgaagacataagattgtccttcgctggagtttaccaatgtcggcaggagccactataaactggatcagaaccccatttcacgcccagagatttcatgacttctcaagtttaagttttagatgccgaaacacttttggatcaattcagcctttctggttggcaaccggatcaggattca

SEQ ID NO: 3613 - DNA, 344 bp, Triticum aestivum
  Clone ID: LIB3281-001-P1-K1-H1
tggtcgccggaagcagcgccccacagtcggacaatcgtcagatccgccgtcgccgacgccacgatgaacgacaccgatgtctccaagcagatccagcagatggtgcggttcatccgccaggaggccgaggagaaggctggcgagatctccgtctccgctgaggaggaattcaacattgagaagctgcaacttgttgaagctgagaaaaagaagatcaggcaagaatatgagcggaaagagaagcaggttgatgttcggaagaaaattgagtactctatgcagctgaatgcttctcgcatcaaagtgcttcaggcccaggatgacctggttaataaaatgaaaga

SEQ ID NO: 3614 - DNA, 295 bp, Triticum aestivum
  Clone ID: LIB3281-001-P1-K1-H10
gcgtggcttctttggttgagcctaacttttgccaagtagcttgtggtcattgtttcacggtggcactaacaacctcagggcatgtgtacacaatgggaagttctgtctatggtcagcttggaaatccacaagcagatggcatggttcctgcgcgtgttgaaggaaagctacataaaaactttggggaggagatttcatgtggcgcttatcatgttgctgttttgacttccacgacagaggtgtatacatggggtaaaagtgctaatggccggttaggacatggtgatactgatga

SEQ ID NO: 3615 - DNA, 242 bp, Triticum aestivum
  Clone ID: LIB3281-001-P1-K1-H11
cccacgcgtccgtgttgattgatttccaggagaatccaagggctgctcaagacggctcgggagcacgaacgcaacggcggtcgggattgggcatcgttgagttcagtgattggagacgtggccattcgtccccgacagatctgtgccgccatggcctgagagagcctatagaaaggagggttcagacgagcacctgtaggacgacccgtcatcacggtcagcgattgtcgactccgacaaca

SEQ ID NO: 3616 - DNA, 58 bp, Triticum aestivum
  unsure (1)...(58): unsure at all n locations
  Clone ID: LIB3281-001-P1-K1-H12
gccaaagatctacatatctgatacttgtacagnnttgcatatatcaatgggatgcgtt

SEQ ID NO: 3617 - DNA, 428 bp, Triticum aestivum
  unsure (1)...(428): unsure at all n locations
  Clone ID: LIB3281-001-P1-K1-H2
tgaggcggaaaaagcctgtaccgttcacgcataagtttccaaatgcagatccacttgcattaaatttgttagagagaatgctagcatttgatccaaaagacaggccaagtgctgaagaggctcttgctgatctttatttcaagaacattgcgagtgtggatagggagccttctgcacagcccattactaagcttgagttcgagtttgagagacgaagaattacgaaggacgacataagggaactcatatacagagaaattctggaatatcatccaaacatgctgagggaattccttgagggggctgagccaactaatttcatgtacccaagtgcagtagatcatttcaaaaagcaattcacattccttgaagagcattatgcanagggatcaacagcagcaccgtctgagaggcaacataattcatta

SEQ ID NO: 3618 - DNA, 132 bp, Triticum aestivum
  Clone ID: LIB3281-001-P1-K1-H4
cctacatgtctgattacgtggtctctgacctgttctcccaagctttacagttcatacataaacaaaagcaacgtaagatggtgtgcacagcttgatgaggggaagatcatcgagtacttcacgaacaagagc

SEQ ID NO: 3619 - DNA, 177 bp, Triticum aestivum
  Clone ID: LIB3281-001-P1-K1-H5
catgctacatggaatgcatagaatgtttctactttttctgcactcaaaatattacagcgtggtgtaaaagcactgcgtggttctgcaggactaaaatatgccatagctgcactggccaaagctgcaagggcgatccaatctgcgaagacaatatactagtttcttgtagatgaaaat

SEQ ID NO: 3620 - DNA, 301 bp, Triticum aestivum
  unsure (1)...(301): unsure at all n locations
  Clone ID: LIB3281-001-P1-K1-H6
gcggatgtttctcacaagcctgttatttccacacttagtgttgaaaaaacaatacccactaaatggagtatatattgagcacatcataagatgagcccatgcgttcagtccatatattcatttatctagagagaaatangtacnattgaactggtatagtatggtcagaaaggcagaaaagcttaaactacctatgagggtaataaacctacactggtgggaaaatttgcttatttacacatatttactaacggatgttgccaatttgatttattttaatacaaacttcaaagattccaaa

SEQ ID NO: 3621 - DNA, 353 bp, Triticum aestivum
  Clone ID: LIB3281-001-P1-K1-H7
agctcatcattgtattcatgaattcgaagtccaaatcataagacctgtacataagagcgagctacgaaaagggacaacaagaacttgcttatgaggccagcgtgcaagttgtcgtctgccctttgttttggatccaccacatactccgccgaatctggaacgccactatcgaccactgcatttgctggtgtcatcggtgaatcagaatgtagcctggttggttcagctccaccgtctacagcttgacctgcaatacaaaacacattccacgtgttagcccagtacaaactaaagagctgaatgaagctctgggacactgggctctagtgggtgtgcaaactgaaccgacggca

SEQ ID NO: 3622 - DNA, 286 bp, Triticum aestivum
  Clone ID: LIB3281-001-P1-K1-H8
cccacgcgtccggtcacctgtccatatcccccaagtccacccatccgagatctcccaaatccacccgaccaagccatggccggcggcgacgaggaggccacgacggcgctgctgccgccgccagcggggtcggcggaggcagagcgcccgccttccccgacggccgaccggatcggggtaggctacctcatcttcttcacgctcagcgccgggttcctgctgctctggaacgcctacatcaccgtgcgcgactacttatactacctctaaccgggcgcgcccgttg

SEQ ID NO: 3623 - DNA, 314 bp, Triticum aestivum
  Clone ID: LIB3281-002-P1-K1-A10
gcatccgcggagatgaagatcacggtgcggggatcgacggtcgtggtgccggcggaggagacgccgcggctccggctgtggaacgccaacccggacctggtcgtgccgcggttccacacgccgagcgtctacttcttccggcgcggcgcgggggaggaggaggcggacggctacttcgacgcggagcggatgcgccgggcgctggcggaggcgctggtgccgttctacccgatggcggggcggctggcccgcgacaaggacaggcgcgtggagatcgactgcaacgcgggaggggtgctcttttttgagggcga

SEQ ID NO: 3624 - DNA, 358 bp, Triticum aestivum
  Clone ID: LIB3281-002-P1-K1-A11
cggacgcgtgggcggacgcgtgggctgacgcgtggggtagactgatccgctgttacggcaagcacgacaaccactttagaaatttgagctttagtcatgtcgctgcatatttggaacatcataatgttattcctactgaaccttgtgtcagccatttgaataattacaactaaaatgatatgtgaccttctatattccttttgtaaatgtaatattgtaacgaattctatatctggctaaattgactacctaatgtccatgcttatatagcacaaaaagtgaagattaatgtccacgcttatacagcccaccttttcccatacaaggatgtacacgattattttgtttctgaaaatat

SEQ ID NO: 3625 - DNA, 407 bp, Triticum aestivum
  Clone ID: LIB3281-002-P1-K1-A12
gcccgcccgcccgccgcgacgccattagcagagccagagcagtgggggagaaggttctagaggaagaggaagaggaagatgaaggtgatcgagaagatccaggaggcggcggcgaatggccggaccgtcttctccttcgagtacttcccgcccaagacggaggagggcgtggagaacctcttcgagcggatggaccgcatggtggcgcacggccccaacttctgcgacatcacctggggcgccggcggatccaccgccgacgtcaccctcgacatcgccaaccgcatgcagaacatggtatgtgtggaaacgatgatgcacttgacatgcaccaacatgccagtggagaagatcgataatgctttggataccatcaagtccaatgggattcaaaatgttctggcact

SEQ ID NO: 3626 - DNA, 441 bp, Triticum aestivum
  Clone ID: LIB3281-002-P1-K1-A2
aaaccctccaaaatatgccgccctcttgggagcagtccgacgtcgccgccgtcgatggcggcgtcgaggagaatgtgatggccatcctcgactctttcgtcggcatcaaggattcccgtgacctccacgacgaccgagccagttttttggaggccgtgcgctccgtctgcctggccggcgacaaaccctcgacccccactgagagaatgtacgatgctgtctttcagatctttcaaagcagcagctctttggagctaaccattgcaagttttcatctcttaatggagctgggcaagcaatatccaagagtatatttgacaaattctggttcccattcaactctagttatagttaaagagtcatggtcaccatttccctttgacacaatgtagcttctggtgagcttgggagaaacaccagtcgctcagatcacctctttga

SEQ ID NO: 3627 - DNA, 430 bp, Triticum aestivum
  Clone ID: LIB3281-002-P1-K1-A3
cccacgcgttcgcccacgcgtccgcttccagacacttctcccgtcccgtccccagccaacctcccatccccgtctcgcgtcgcagcggcagttccactccctcgccatgggcaagattaagatcggaatcaacggtttcggaaggatcgggaggctcgtcgccagggtcgccctccagagcgacgatgtcgagctcgtcgccgtcaacgacccctttatcaccaccgagtacatgacctacatgttcaagtacgacaccgttcacggccactggaagcacagtgacatcaagctcaaggacgacaagacgctgctctttggcgagaagccagttaccgtcttcggcgtcaggaaccctgaggagatcccgtggggtgaggctggtgccgattacgttgtggagtccaccggtgtcttcactgacaaggac

SEQ ID NO: 3628 - DNA, 303 bp, Triticum aestivum
  unsure (1)...(303): unsure at all n locations
  Clone ID: LIB3281-002-P1-K1-A4
agggacanagagaacagaataaaagagcgctgtatatttgaggccaaagctggctaccttaagaaatggttgtatgtgactaactcgtcatattctaaattcaagccagaggaactagaaagctgtatggttgactattcagatggtgaacagcatctaaaatattttgacatgcaatctataaccactcaaatngaagcaattgcctctaataaagaacctagaggcaccttttgcaactgatattactgtgcccaatctagaaaattcaccatcatcgcgggaaacaaatgaacataccaa

SEQ ID NO: 3629 - DNA, 295 bp, Triticum aestivum
  Clone ID: LIB3281-002-P1-K1-A5
agggacaaagagaacaggaaaaaagttcgctttatatttgaggccaaagctggcgaccgtaagaaaaggtcctatgtgactaacttgtcatattctaaactcaagccagaggaactagaaagctgtatgggtgactattcagatggtgaacagcatctaaaataggttgacatgcaatatataaccactcaaattgaagcaattgcctctaacaaagaacctagaggcacccttgcaactgataatactgggcccaatctagaaaacccacccatcatgattgaaacaaaagaac

SEQ ID NO: 3630 - DNA, 437 bp, Triticum aestivum
  Clone ID: LIB3281-002-P1-K1-A6
cccacgcgttcgcccacgcgtccgtgattcgtatcaaagccgaactgcctccaggggcaagttgccgatgccaacgactacaggccactggagtccaaatgatgcgaacacggtcctgcgggtcctgtgctaccggcacgaggaggcggctacaaggttcctcaagaaaacctatggccttcccaagaagctttgacgcatgggatgacagctcatgacacacaggttgtacatttccagccgccgccgctatctatcacaacagatatttgctcgggataatgtattcggtatggcacgaccctgcgagtaacaccattgtaaaggttccacagaggggagggggttttgtttttcttttctcacccttttttggagggggggggtatttggtgattattatttgtatacatgtttctttgaccccattcttttgc

SEQ ID NO: 3631 - DNA, 465 bp, Triticum aestivum
  Clone ID: LIB3281-002-P1-K1-A7
cccacgcgtgcggttggctctttgacattggagctgcgattcgtgaacgggtgacaacatggtgtattggcttgctggttgtcttggttgttatgttttgttctcttcaaagcgggagctttatacagaagaaagagagtgaacgttctagcggtccggtccaactttccaagttccttggtcgcgaggaggaggaaagcggcaaaaggagtgttatctctggtaaaaagataatgatgaagcttgagaaatccaaagaagataaggcggctgagagcaagcgcaatgaactgttgaagtttctgaatgccagttatgattgacaacttgtcgaaagtggtgatgcttggctggatggcttggatttgtcttgatgccactgcttagtcatgtgtgcgtttggagataccaagaagttttttgtccggttttttaaagttaatgactgtgaccatcagtgcttta

SEQ ID NO: 3632 - DNA, 296 bp, Triticum aestivum
  Clone ID: LIB3281-002-P1-K1-A8
tcggtcgaaggcgcggaggtttaagagttgtaggtccctgagatcctgaacgagggagtccttggcaagatgggcgccccgcccaagaccgacgtgccggtgatctccccgcaagagctggcggaggccgacggcgttctgttcggattcccgacgagggtcgtgcttatggccgcagcaatgaaggcattctttgacgcgaacgtcggactgtggaggcagcatagtcagacgagcatgccggcgggcgtgatcttcagcacggtcacgcagggtcgggggcagggcaacgacac

SEQ ID NO: 3633 - DNA, 337 bp, Triticum aestivum
  unsure (1)...(337): unsure at all n locations
  Clone ID: LIB3281-002-P1-K1-A9
tcgcccacaactcccacacattctccggtgaaaccaaaccccagcccgccgcaccgtcagcacccatggcgcccaaggccgagaagaagccggcggcgaagaagcccgcggaggaggagcccgcggcggagaaggcggagaagacgcccgccgggaagaagcccaaggcggagaagcggctgccggcggggaagtccgccgccaaggagggcggcgacaagaagggcaagaagaaggccaagaagagcgtggagacgtacaagatctacatcttcaaggtgctgaagcaagttcaccccgacatcggcatctcctccaaggccatgtncatcatgaa

SEQ ID NO: 3634 - DNA, 357 bp, Triticum aestivum
  Clone ID: LIB3281-002-P1-K1-B1
gcttctcctccccttccggttcgggttcgggttctggttcggttcgggtccgagagtagctagcctagtctagggttttcgtagagaggaggaggagaggaagagagagatccatggcggagacggagtaccgctgcttcgtgggcggcctcgtctgggccaccgacgacaacaacctccagcaggccttcagccagtacggcgagatccttgacgccaagatcatcaacgaccgcgagacggtgaggtcccgcgggttccgcttcgtcacgttcggcagtgaggagttgttgcgccaggccatcgaggagatgtacggcaaggagctcgacggccgcaccattaccgttaaatagg

SEQ ID NO: 3635 - DNA, 250 bp, Triticum aestivum
  Clone ID: LIB3281-002-P1-K1-B10
agatctcggaacccttgccgtcaccttggtcatggcgaaggagccccccttctccctgcccccggtggtcttcaacccctccacaccggcccaccgtcgccaacctatccccgggcccggcgccgtaccgacacccggcttatagcctgccgagccctacacctgcttcgtcgtcaaccacctggccttcatgtgcttcagcatacccgctgagtccaacttcacgcctgccatctttaccgggcccatc

SEQ ID NO: 3636 - DNA, 462 bp, Triticum aestivum
  Clone ID: LIB3281-002-P1-K1-B11
cggacgcgtgggcggacgcgtgggtaagaatatctgaatattaagttatggcgggattaccttgattatgttgaagagcatgatcagtcagtgtctcaatgttcgcaatctggtctctcgaaaatgagggatttgtatgagcgtgcaatcactgcagggggtctacacgtgaccgaaggcagcaaactatgggaagcctacagggaatatgagatggctattttgaccataaatgatggtaatgatgaggagaaggcaaagcaggttcaacgtgtccgcgcgctcttccaccgccagttatctgtgcctttggctgacattgagtcaacacttgctgcgtataagagttgggaagctgaagaaggcaatacaagggacccagattcccaagttgatgatgttcccccaaatgttttatctgcttacaaaaaggccagcgagatgtacaatgcacgaaagcag

SEQ ID NO: 3637 - DNA, 326 bp, Triticum aestivum
  Clone ID: LIB3281-002-P1-K1-B12
ccgttcgttcgttcgttcgttcgttcgagcttagagaaggacgagatgaggatgtcgctgctgagatccgcgtcgcagcacctgcgccgccggcgcgactactcctccgcctccgcctcgcccgagcgcaaggtggccatcctcggcgcggcgggcggcatcggccagccgctggcgctgctcatgaagctcaacccgctcgtctcctccctctccctctacgacatcgacgccacgcccggcggtcgcgccgacgtatcccacatcaacacccgcgccctggtgaagggcttcgtcggggacgaccagctcggggaggcgctgga

SEQ ID NO: 3638 - DNA, 471 bp, Triticum aestivum
  unsure (1)...(471): unsure at all n locations
  Clone ID: LIB3281-002-P1-K1-B2
gattagtggtagggagggactgcatcgttagcctcttgaatcattcttacatcattaccaccatcaccaattgctagagttaaagaaccagaggatttcaggatcccaacaagctgtgctttctgcaaaggtgtcatccgacagcatattgctgttcttgacatcatggccagcttagtgaaagattccagtgaacgcttcagaattatttcgagtgcccaaccatccaaaacgaatggaaacctagccgcgttctcctctgcggcacgcaacctttgtccccctctagatatagaacaacacgcctcgtccacccatacctctacaagtcagatctaggcctgacctgtagtttcctgaccgtgctcgcctcgatctcggagtaagctgaattcggcgtccatgattngttccgatcacccgtttgttatctgattcccaggtttgtccttctgatcggcgagttggggc

SEQ ID NO: 3639 - DNA, 332 bp, Triticum aestivum
  unsure (1)...(332): unsure at all n locations
  Clone ID: LIB3281-002-P1-K1-B3
gannagcggaagggagggaccgcattttgcattttcttgaaccattcntacagcaggacgagcatcaccaatggcgagaggcaaagaaccagaggatttcaggatcccaacaagcagggctttctgcaaaggcgtcatccgacagcatataggggggggggacaccatggccagcgcagtgaaagaatccagcgaacgccccgagaacaatgggcgagggcccaaccatacaaaacgaatggaaacctagccgcgggctccgctgggggacgcaaccttggggcccctctaaaaatagaacaacacgcctagtgcacccataccgggacaag

SEQ ID NO: 3640 - DNA, 283 bp, Triticum aestivum
  Clone ID: LIB3281-002-P1-K1-B5
tcgggactgcagaaggaaggaacaaaggtcttcggtgttccaaaacctggaaagaagaagaagttcatggatgtaagcaaacattatgttggcgatcaatctgatagaatttctgagggtagtgcatccaccagatatgcaaaacattcagtgccacaggtgccaagaccacgggaaagtaccctaaaactcgaccagagagccaagagggcaagtgacatgcgatccagaggacttaaatctgtcaagcctcagacaacatcaactaacggtgttcctggcg

SEQ ID NO: 3641 - DNA, 471 bp, Triticum aestivum
  Clone ID: LIB3281-002-P1-K1-B6
ggactgcagaaggaaggaacaaaggtctttgttgttccaaaacctggaaagaagaagaagttcatggatgtaagcaaacattatgttggcgatcaatctgatagaatttctgagggtagtgcattcaccagatatgcaaaacatccagtgccacaggtgccaagaccacgggaaagtaccctaaaactcgaccagagagccaagagggcaagtgacatgcgatccagaggacttaaatctgccaagcctcagacaacatcaactaacggtgttcctggcgaggatcctttatccactcctgtcccaagctctagtgctcttgaaagtacttttgcttttgcggcaagtactacaagctcttccaaccctgtgaacccaactggagaaaagaataatttggctcatgccactgaacttagaactgaagatgcttttattttggaatcacgtttacaagccacaccaaccgtt

SEQ ID NO: 3642 - DNA, 467 bp, Triticum aestivum
  Clone ID: LIB3281-002-P1-K1-B7
cacgcatctctctcacctccggcgaaaacacaccagcgcgcccctctcccctcgcttccccgccgcaatgtcgaccgacgccgctgccgccgacatcccggtgcctcaggtggaggcgaccgccgaccccgtcgtggagaccacggctgacgccgccgccggcgacgcgaaggcgaccaaggctaccaaggccaaggccaaggccgccaagacccccaaggcgaaaaagccctccgccccgaggaagcccaaggccacccccgcccacccgacctacgctgagatggtgacggaggcgatcgccgcgctgaaggagaggaacgggtcgagcaccgtcgccatcgccaagtacatcgaggacaagcacaaggcgcaccttccggccaactttcgtaagttcatgctgacgcagatcaagaagctcgtggccgccggcaagctgaccaaggtcaaggccttctacaagc

SEQ ID NO: 3643 - DNA, 420 bp, Triticum aestivum
  Clone ID: LIB3281-002-P1-K1-B8
cggacgcgtggggggttttgctacgtggcatggaattcatggcatagttggttctttcttcttcctcttcctacctctgcctcttgctcttccttcttcgcaagcagcagcctctccgccctcgcagccagccgctgtcgataggggggaggtcgccaccgccggctgctctctgccacgccgcttcgaccagagacagacggcggcaagccccaagaagtgaagctgcgggaggccggccatgggcgtcgcttctgggacgtgaaagtggtgttggacgccgacggccacatgtacctagagcgcggctgggagcagttcgcccgtgcgcacgacctgcggctcgggtactttctcgtgttcagctacgacggcgacgccgtgcttaccgtcaaggtgttcgacgtgagcatgtgccgc

SEQ ID NO: 3644 - DNA, 474 bp, Triticum aestivum
  Clone ID: LIB3281-002-P1-K1-C1
cggacgcgtggactcgcgtcgtcggacgtggtctccgattagtggtggcgcggacgtggcgatggattttcccgtagctccgatggacaggttgcccatattcccggatgaggcatctagcgcggaggccctaattgaattgattgatggggctggtcgtgcgaaaaggaattagccaacggatctcgccgggcggtggtcggaggatttgggcgcagctcagctgggcagttcgggggtggtgccatgtgcggcgaggaaacaagtgtggctgccggcagctctgccgtgtaaacgcagatgccgttgaccagagcggcgttgaaacacattttgattgagatcagggcgctgtgatttaagatcgaacaggaagtggcgatggaggctctgcgcaatcgactggcaaggtggatcctcaagcctctggatggactaagaggtaattggaattttgtgtagaactgcattctg

SEQ ID NO: 3645 - DNA, 385 bp, Triticum aestivum
  Clone ID: LIB3281-002-P1-K1-C10
cgcgttacctcaagcccgatgtcgacacctttaatcgtattttttcagtacaacattgctgtggctgctaccacggacaagatacttggtgcgaggaatcccgagatccccatccgcgagctgagggtcaggttctgtttgaggcatgatgagtgtctctccatcagccaagctgttgcccgcaccatggcaacccacaagctcgatgtcgctgagtttgtcgtcctcacggagaagactagttggagatgcactcaacatgatctcctctcctttgccaagcggttcaatacttggtttggtgattagccagttgtgtttgctggtctcacgcacctgtggctgcggaatttgaggtttggtgaactggacattcacaacattc

SEQ ID NO: 3646 - DNA, 303 bp, Triticum aestivum
  Clone ID: LIB3281-002-P1-K1-C11
cccctttcccctctcgcgcacctttctctcgccatggccttcttctcccaccaccaccttcagcagccccaccccgcggcgccgccaccgcagcagcagcagcagcagccggcgcctctctccttcaggaacgcgctggcggtgccggtcgatggacagatcccggcgccgctcgccttcttcaacgcgccgcccgctttcccggaccaggccgggcagccacagatagtggacgcggcgggcctgacggctgcggcgggtatggggtggaggcagccgagggagcaagagctgctgggggag

SEQ ID NO: 3647 - DNA, 434 bp, Triticum aestivum
  unsure (1)...(434): unsure at all n locations
  Clone ID: LIB3281-002-P1-K1-C12
tattttttgctctggagctgtcttgtatttttccttgtcgcgatgatgcgctagctttatgtatcctgggaccatatgttgaatactctctggtgtttcattttccagtgaaagatggaacagggctgtgggcattttgatccttnntttttttcatattctggtgtttgctgaagagcaccaagatcctcttcatgcaccaaacgactgacaagcagttcagtgcctaccttggagccagtcacgcaaggaagcacccaactcacgcttgggccgcctgcaccgtcagatgttattttcgatggctaccgacttttgagtcgccgtggaactgagcacccacattaccattatcgacacgttgcagcaagtaaacgtgcttcgtctatgacattgcagctagcaagatcctacgtcggccatgaggattaccg

SEQ ID NO: 3648 - DNA, 470 bp, Triticum aestivum
  Clone ID: LIB3281-002-P1-K1-C2
aaaagatcgaaggtcacgagcagcattgcaaacgattggtcctgcaatacatccctctcatcctggtcaacggagagaagttcctcgagaagaacgatatatgcaccatcgtccaagcatgtgatgccggcaaaaagacggtggtcgggtcattctccgaggagggtttgctgcgtgatgcatgaaggtagaaaggctacaccaagccgtgtgaacccggagggaacataatgcactagttcttcttgttgtacataggtgtctaaaattcaacttgctgttgccttgtgctgctcctgcattctgtggatgctttgtattataaagggagcggcatgacgaacagtatattatgtcaatttgaagccgtgttgtacttattacttggtcaatgttttaatttgtatggcatctgaacaactgtagatactaaatcgagtttcagtctgtctactaaatcaatgttttaa

SEQ ID NO: 3649 - DNA, 292 bp, Triticum aestivum
  unsure (1)...(292): unsure at all n locations
  Clone ID: LIB3281-002-P1-K1-C3
agcaaacccaaatcggccgccgtcctctcttcttctccgtccacccacgccgncgtcgtcgncttctttccagatcccgaccatggagggcggcagcagcagcctcgacgcggcgatcgagtcgctcctgaacacggagaagcagtgccgcctcgccggagatgtggccggcacccggaaggccgccgtcgacatcgtcgagctctgcttcaaggacgccgtctaggagacgctcaacgaccagatcgtcgtcctctccaagcggcggggccagctcaaagcagctattact

SEQ ID NO: 3650 - DNA, 326 bp, Triticum aestivum
  Clone ID: LIB3281-002-P1-K1-C4
cggacgcgtggggaaagtctgaggaaagcaccgatcaaagagctcccagaaatcaattgctcatccttccgcttccaacaccagccaaatcgtcgatccattccaccagcagctccaatccccaccgatacgaccgacaatgtcgctgatccgccgcagcaacgtgtttgaccccttctccctcgacttcttcgacccattcgaaggcttccccttcggctccggcaacagcggcagcggcagtctcgttccgcgcaccttctcagacacggcggtcttcgcgggcgcgcgcatcgactggaaggagacgcccgaggcgcacgtgt

SEQ ID NO: 3651 - DNA, 255 bp, Triticum aestivum
  unsure (1)...(255): unsure at all n locations
  Clone ID: LIB3281-002-P1-K1-C5
tcgcccacgcgttcgcccacgcgtncgcggacgcgtgggtgtncaactagcccacccccctccccatcccaatccaatttcgttccccaccgtttccttcgttctccaccgcgctcactagctagggttccggccgccgccggtgagcgcctgccatttatggcggatcaagaagctgccgagaggcccatagtctncattcctcgccgtcccccgacgccgctgcttccctggaccccgtcgcgctccgggaca

SEQ ID NO: 3652 - DNA, 362 bp, Triticum aestivum
  Clone ID: LIB3281-002-P1-K1-C7
cgcgagagcgatcgattccgaccgtgcgtagcgcacctcctgttccctttccttttctagctcgtttcctttttcctccgccgcagctgccctgccgcttccctcccccctcctcgctgtcggctccttccaccggcgtcggacttatcgtcgtgaacaccgccgccgcactcatcggcgtgaacactgtcgcattcccatccacacagccccgcctagggctgctggtacattccccaccaccacgccgtcggaccctgttgctctacccacgcccattgagacggagggagggaggacatggtcgctgggggtcgccacacgcctggatctgggtgccattgtgcacatccgggcggatc

SEQ ID NO: 3653 - DNA, 406 bp, Triticum aestivum
  Clone ID: LIB3281-002-P1-K1-C8
gcaattcggttggaagaagatggtgacaacattgataccactctttcccttgctctagtagatgctgcgaggccagggactacagatagaagtattcaatcgcttgatccactcgcctccagttcatgggaaagggttccagaggagagaactttaatctcccctgtccagtgcaagtctctgtggaggcaatttaaagctgaaactgagtataccgtcactcaagccatagctgctcaggaagcaaacaagaggaacaacaactggctgcctcctccatgggcgctcgctgcgatggctgtccttggtttcaatgagttcatgacattactgaggaacccattttacctggccgtcatgtttgtagttttcctagtcgggaaagccatatgggtacaactagaca

SEQ ID NO: 3654 - DNA, 149 bp, Triticum aestivum
  Clone ID: LIB3281-002-P1-K1-C9
tcgattaatttacccatgtcaaactacttgaagtatgtggctttaggaacttagagagtgattcttaagtgaagacactgtgtctttgtctccattcaaacatccagtgacatgtttgttcactttaagatcaaactcttaggtcctaa

SEQ ID NO: 3655 - DNA, 359 bp, Triticum aestivum
  Clone ID: LIB3281-002-P1-K1-D10
cggacgcgtggggcagaaaaatatcatgcagctcttgcagaaaacagaaaattgttcaatgagatccaggaactaaaaggaaacatcagagtttactgtcggattagaccttttcaacctggggaggatgagggctccaattcagttgaatatattggcgacaatggtgaactcgttttatcgaaccctacaaaacaaaaggaagggggcaagaatttcacattcaacaaaatatttgggcctaccactacacaagatatggtcttcaaagatattcaaccactaattagatcagttcttgatggctacaatgtttgcattttcgcatatggtcaaactggatcaaggaaaacatacac

SEQ ID NO: 3656 - DNA, 156 bp, Triticum aestivum
  Clone ID: LIB3281-002-P1-K1-D12
cccacgcgtgcgaagaaaaaaccctttttgtgccctacacacctcgaagacggctggcgggcatacccacaggaaagccggctgtccgcgagctcttactgcttacatccatggccgctactcaaggtgccagtgatggcttgtccatgtgcaaag

SEQ ID NO: 3657 - DNA, 316 bp, Triticum aestivum
  Clone ID: LIB3281-002-P1-K1-D2
gcatctcccctcctcccgtcgcccgtctaggtctcctccgaccgagctcgctcgctctccacgatattctgtaggaaatggctgacggtgaggacatccagccccttgtttgcgacaatggaaccggatgggcaaggctgtttgctggaatgatgcaccaggctgtttcctagcaagtggcgcctcgcacacgggtttggtgggagggcaaagagcctatgtgggatgggccatccaagagaggttctacactaatcccgacgagcacgatctaagcactgggtgcaggaaaaattggctacaccttacaagagct

SEQ ID NO: 3658 - DNA, 426 bp, Triticum aestivum
  Clone ID: LIB3281-002-P1-K1-D3
ggaaaaggagaatgtctccagcgaggctcttgaggctgcccgtattgcttgcaacaagtacatgacgaagaatgctggaaaggatgcgttccacctgagggtcagggtccatacataccatgtccttcgcatcaacaagatgctttcatgtgctggggctgataggctccagactggaatgaggggtgcttttgggaagcctctgggtacctgtgctcgtgtggacattggccaagttctactatctgtgcgctgcaaggagagcaatgctgttcatgctgatgaagccctccgccgtgccaagttcaagttcccaggccgtcaaaagatcattcgcagcaggaagtggggctttaccaagttcaacaaggccgattacatcaagtacaagagtgagggaagaatcgtgcctgatggtgtcaatgc

SEQ ID NO: 3659 - DNA, 439 bp, Triticum aestivum
  Clone ID: LIB3281-002-P1-K1-D6
cccacgcgtgcggggtattccttaatgttgggtctactacatgtccagatcactagatgatacaaaggtgtcttcccttcctttgtttatattcctttatgttggaactggccctaggttccactggatcaaattttagctgttgtttcttatgttctagagaagctagaggagtaattagtgttctctgtttttctaatgagtgtatgtgtggaactatggatgcatacaaatagtaaaggagcaattaactttcttttttgcaagtatatgtggatgcgcataaagtgttggctgtctgcttatatcaagtatggtctatattttggtcatatcagccccagtattgagcataccgactgatattctggtcatatcagccccaatattgagcatgccagctgatattctggtcatatcacactttctacagtctaca

SEQ ID NO: 3660 - DNA, 226 bp, Triticum aestivum
  Clone ID: LIB3281-002-P1-K1-D7
agcatgataactgaacttttccattgcaatttcagtcaagcatcacgatacatcatatcaacaccaacaaacagaagcaccagacacacacccggatcacaggacaagaacagctactacccggtactgccggcgaaccaagacctaggccctctccccacggatgcggcgggcgagctggatgtccttgggcatgatggtgacgcgcttggcgtggatggcgcac

SEQ ID NO: 3661 - DNA, 407 bp, Triticum aestivum
  Clone ID: LIB3281-002-P1-K1-D9
cggacgcgtgggctccatctcacaaggcttcttccgcaaaagccaatgagaagagcaacggtcatcagaagaacagcaaagctgtattgcggaagagcttcatgctgcccagcatcacaggaatgttccaccataagaagaagaacaatgccgatggcagttcccactcataatatgtcccaggctcttgcttgcaaattcaaacttttaacacatgttcatttgtacgagtatattctagtagtgttgtacctttgtaatgtgctgaactcctaacttttgtcgtgtacccatgttcatgttgtatatgtatgtctgtgtactttttgggggtaatctactgtttctaaaagttcaaatcaaatcacaccttattgatgcttttcaatggtatggtatggagtgac

SEQ ID NO: 3662 - DNA, 100 bp, Triticum aestivum
  Clone ID: LIB3281-002-P1-K1-E1
actagagatagatagcgagcggtctatatagagcaaccaagcttacgcacgcgtgcaagcgacgagatatcttatatatagagccacctaaaatcaattg

SEQ ID NO: 3663 - DNA, 446 bp, Triticum aestivum
  Clone ID: LIB3281-002-P1-K1-E10
ccgagcagaagcgcagccgacgccgttgaccctcgcgacgccgctgaccctcgcgacgccgtcacttctccttggggcgcaaccatggtgacctccacgaagaagacgaagaagttcggggacaacatcaacaacaagctgcagcttgtcatgaagagcggcaagtacacgctcggctacaagaccgtcctcaggaccctcaggaactccaaggcaaagcttgtgatccttgctaacaactggcctccgctccgcaagtctgagattgagtactatgctatgttggcgaagatcactgttcaccactaccatggaaacaatgttgatttgggaactgcgtgtggtaaatacttccgagtctgctgcctgagtatcatcgaccctggcgattccgacatcatcaacgcaacaccagctgggcagtaaacctgtgtatgccattttca

SEQ ID NO: 3664 - DNA, 348 bp, Triticum aestivum
  Clone ID: LIB3281-002-P1-K1-E11
gaagaagggcgaggttgctcttgtcactattccccctgaatacgcttatggctcaacggagtcaaagcaggatgctgtcgttccacctaacagtactgtgatttacgaagtggagcttgtatcatttgtaaaggataaggagtcatgggacttgaacaactcagagaagattgaggccgctggaaccaagaaagaggagggggatgccttgttcaaatcgggcaaatatgccagagcttctaagcgctatgagaaggctgcaaagttcattgactatgacacttcgttcagtgaggatgagaaaaagcagtccaagcaactgaagatcacctgcaacttaaacaatgc

SEQ ID NO: 3665 - DNA, 392 bp, Triticum aestivum
  Clone ID: LIB3281-002-P1-K1-E12
ctcctctgcccacaaaaccctagccgttgtctcacagctcgccgccgacgcagcgagctcttcctccaccgccgcaaccatggcgacccagatcagcaagaagaagaagtttgtgagcgatggcgttttctacgccgagctgaacgagatgctgacccgggagcttgccgaggacggctactccggcgtggaggtgcgcgtgacgccgatgcgcacggagatcatcatcagggccacgcggacgcagaacgtgcttggtgagaagggccgcaggatcagggagctcacctccgtcgttcagaagcgcttcaacttgccggagaacggcgttgagctctacgccgagaaggtcgtcaaccgtggcctctgcgccatctgccaggctgagtcac

SEQ ID NO: 3666 - DNA, 216 bp, Triticum aestivum
  Clone ID: LIB3281-002-P1-K1-E2
cccagccgctccttcccccccacccccgccgtccgctcaagccccaccgcccgccggcgccgacgccgagacccacccgctccggcaagatgaacaaggagaggctcatgaagatggccggcgccgtccgcaccggcggcaagggcaccgtgcgccggaagaagaaggcggtgcacaagacggcgaccacggacgacaagcggctgcagagcacgc

SEQ ID NO: 3667 - DNA, 297 bp, Triticum aestivum
  Clone ID: LIB3281-002-P1-K1-E3
ctggacgattcttgcaaccaaacacatccaactagtggcaaattgtctcgggcatatggcatcctaccgagcatgccctctccgccttcacagatcgcatcgccgcccagggaaacgatgagccgcgaggccagcggcgcgtcggtgagctctgtcccggtacccgagccagagcggcagcaggggcaggggaaccaaggggaggaggcggcgtggacgccgctggagaaggtggcggataaagtggaggagctgtacagtctccgcgacaccttcttcccccgagacccctccgag

SEQ ID NO: 3668 - DNA, 459 bp, Triticum aestivum
  unsure (1)...(459): unsure at all n locations
  Clone ID: LIB3281-002-P1-K1-E4
cggacgcgtgggattgtatctcatccttatatttgttacaaggaccaaggagcaccttacctacagaagtacagagtatcatctcaaggaacacagtgttgcatatttattaatctataaagatgcaacacaaaagagatgtttgttggttattacttcagaaaaagatgcatagaacagaacatatgtgtgtcctttccttctagattctgacttaaaggttgcctagtttggattattaattccttgcctcctataagagtatttgctacaactaggacaactgatgggattccaaagatcgagatattgtacttagaattgaggatcaaaaagttaatattagactgtggggtgataaggtcgaccaaattgatgaagattctatgggacgtgttgtcatagtnacatcaacaactgttagaaaactgaaagagtactcggtgtcatctacaggtg

SEQ ID NO: 3669 - DNA, 209 bp, Triticum aestivum
  Clone ID: LIB3281-002-P1-K1-E5
tcgcccacgcgttcgaggacgcgtgggcgcagtctaagcccgccgacccggagcttcccaacggtgccggggccccgtaccacccggaaccggagccggcgttgtccgctgtcgccgcgccggcggtagaagaagaggtggcggttagatcggagccgttcaagggcgcggggaccaacgcggacgggtggcgcccctacaccatgggg

SEQ ID NO: 3670 - DNA, 472 bp, Triticum aestivum
  unsure (1)...(472): unsure at all n locations
  Clone ID: LIB3281-002-P1-K1-E7
catccgtccgtccgccgtcgcgatctgtccggcccgaccagacccgaaagcccatccacccacccggaccgggccaggcggcgggcgacgaccggggcggaggcggatcgacggacggatgggcggcggcgggcgcgggcagtaagacggcggcgggacgcggctggagcggcgggaggaggacggcggcgcggcgcggcggggcggcggcaccaccatgtctgcggtagtctgcggcaagagagtcttcttcatcttcgcggacgacctgctgctccaacaggcctncttctncccttccttccaccaccacaatagtcccgcggtcaagcgctcgcgctacgcgcaccaccaccaccgtcgggacggtcgggacgcgctccttcaaacacctcggggcgtctttcccgcatggatccccaactgtttgagagggcccttggagcgtttggagatgatttggatgatgcaa

SEQ ID NO: 3671 - DNA, 211 bp, Triticum aestivum
  Clone ID: LIB3281-002-P1-K1-E8
cgattccggcacgcgcggcctaaccgagcccaccaccgaagccgagccctctctctcctcgccgtccccagctccgtccgtccacccatgtcgtcctcgtcgtcgctgatccaaggcatctcaatctcggtctccgacgacgacgaggcctccgggaaggtgcgcgtccgcgtgcgccgcaagcgcaaccgccacccggtctcggcccacc

SEQ ID NO: 3672 - DNA, 469 bp, Triticum aestivum
  Clone ID: LIB3281-002-P1-K1-E9
cccacgcgtccgactcaatggtgcttgcacgtccatggatctagaagtagcatgttcattcttcttagttcatgttttatgtgtagcatttcgtaggctaaaaattgaaaggagatgtgatgatactgtcttttgactccctccatcctacctgtacagaatttatagttgccaggcatatggtgggctaatcaaatgcaagctatgaggagctaaaagaagtaggatattcccagcaagggactctactttatgggtttgattgttgtggcagaatcaatggactacaccaactgctattgaagaagtatatgtagaaagcatagttatggtgtgatagggccagtgttgttgtctgacagttgtgcattcttcaccttggatggtcaaagatatgttcgctagcctgatgctgctccatcggtggatctacaggctaagagccatgaataggatcaaggcagcacac

SEQ ID NO: 3673 - DNA, 391 bp, Triticum aestivum
  Clone ID: LIB3281-002-P1-K1-F1
gtcggtagtgctggtagctatggcggcggtggcggaatctacaataatgccagcaactcaggtggaaatgttggtggctacggcggcggtggcggaagctacaataatgccagcaactcgggtggaagtgctggtggctacggcggcggtggcggaagctacagtaatgccagcaactcgggtggaagtgctggtggctacagcggcggtggcggaagctacaataatgccagcaactcgggtggaagtgctggtggctacggcggcggtggcggaagctacaataatgccagcaactcgggtggaagtgctggtgactacggcggctgtggcagaagctacaataatgccagcaactcaggtggaagtgctggtggctacggcggcggtg

SEQ ID NO: 3674 - DNA, 440 bp, Triticum aestivum
  Clone ID: LIB3281-002-P1-K1-F10
cggacgcgtgggatctagggttcatggttcttgcggcggcagcgcgacttccttccccctgttgcgaaggtctagggtttggccgagtagaggagagaggctttccccctcgtccagccgggagccgccatgagccgatcggggcagccgccggatctgaagaagtacatggacaagaagctccaaatcaagctgaacgcgaaccgcgttgtcattggcacgcttcgtggatttgatcagttcatgaatttggtggtggacaacactgtggaggtcaatggagatgagaagaccgacatagggatggtggttctgagaggaaatagtgttgtgatgattgaagcccttgaaccaattgccaggtctcagtgatattttggcttacctgcttctggtttagtacttaatagagtgtggtcaaaaccgatgcttatggaatc

SEQ ID NO: 3675 - DNA, 430 bp, Triticum aestivum
  Clone ID: LIB3281-002-P1-K1-F11
caaacatcacagctggtaaccgggaccagattcaggctgtcatccaggcaaacattattggtcctctggtccatctcctgcaaggtgctgaatttgacattaagaaggaggcagcttgggcaatttcaaatgccacttctggtggaacacatgatcagattaaagtccttgttgcccagggttgcatcaagccgctctgtgatctgctcatttgcccggatcccagaattgtaacagtttgcttggaaagtcttgagaacatcctgaaggttggggaggcagaaaagaaccttggtgcaggggatgtcaacaactatgcgcagatgattgatgatgctgagggactggaaaagattgagaaccttcagagccatgacaacacagaaatatatgagaaggcagtgaaaatgcttgagtcctactggttgga

SEQ ID NO: 3676 - DNA, 458 bp, Triticum aestivum
  Clone ID: LIB3281-002-P1-K1-F12
gagcccctcatcccaaaagcaaccgccatggctcagagccttctttcctctgcttacatcttattcaaccactgtgcgcctccctccctcgtcgcttccacttggtctgtggctaactcggccggatctcgggaggcagatcaactttgggtggatcctggcgaggagatccgtgtctcgcggcctgcacgcaactagatccggcgatacgtccatgtcccttgttgccaaccgtgggggcctcgcttgaagctggtgatgcatcctctgtattaggccatggcgttctttttccggagaaagctccggtgtgctggaagcagcgggggaggcacaccggacagctcggccgacggggaggcctcaagttgacgagaggaccggcgccggtgaagaggattgaagggtctcttggtcaagtgatgaattatgtctgtattttcagatctgcgcaaacg

SEQ ID NO: 3677 - DNA, 439 bp, Triticum aestivum
  Clone ID: LIB3281-002-P1-K1-F5
agtatatctcccagatcgatttgctcgtcagtttggtcaagaacagcatccggtcggcgatgttggtgggttccagcgacatcagtggaacgcgtcagtggattggagcctcgagtatgcatcagagatcaaacatttcgagcagttgatcaatgctactcgtcctgatcatacagcagttgctgccacttgtaaaacgactgaggatgtttttacgccagcgagcacggcacgagaatttcctggtctcaatttgcttgcagtggtggagagcatcaagaaggagctcccaaccatcacgcggtttctcgagcaacggtcacttcccgtcgaggtagccacgtcgtttgctcggatccatgaactactggaggattctcactagaaggaaggaaatgccgcagtggatgctgggggcgatgggacctctgagttgact

SEQ ID NO: 3678 - DNA, 468 bp, Triticum aestivum
  unsure (1)...(468): unsure at all n locations
  Clone ID: LIB3281-002-P1-K1-F6
cggacgcgtgggctcgcagccgccgcctcctcggatcgtccctgccggagagacgccagagagcgccagcaaaccctaacctccgacgatggtgctccagaacgacatcgacctgctcaacccgccggcggagctcgagaagctcaagcacaagaagaagcgcctcgtgcagtcccccaactccttcttcatggacgtcaagtgccagagctgcttcaacatgtaattcttctaaaccttttctcttcattgcaagtaaatagtttcactaggttcatttgctactgattagccttggatgttcgtttgattacaagacatagtcatgctttaaaacgttctcgctatttgtgtagtttaactgttaacgttagttggctgccaagtacatgctcatagtttatttcactgctgtgtgttntctacttcagtactagtttgctttgactgcacatgctttataggtta

SEQ ID NO: 3679 - DNA, 92 bp, Triticum aestivum
  Clone ID: LIB3281-002-P1-K1-F7
gtttgaggaaacccgttcgtctcgttcgctcccgcgagcggcgaggcgaaccctagcttccggctcctgcagccccccgtttcttcccccct

SEQ ID NO: 3680 - DNA, 363 bp, Triticum aestivum
  unsure (1)...(363): unsure at all n locations
  Clone ID: LIB3281-002-P1-K1-F8
cggacgcgtgggggccttctgggcagttcgagtatgttcaaaaacttgcttctggtggctgcgacaacacagtgaaggtgtggaagctcaccaacgggagttggaggatggactgcttccccgcccttcagatgcacagggactgggtgagagacgtcgcatgggcaccgaacctaggcctcccaaagtccacaatcggcagcgcttctcaagatggaaccgtcgtcatctggaccgcaccgaangaaggtgagcagtgggaaggcagggttctcaatgatttcagaacccctgtttggaggctgtcgtggtcgctgacaggcaacattctggcggtcttcgatggcaacaacaatgtgaccc

SEQ ID NO: 3681 - DNA, 335 bp, Triticum aestivum
  Clone ID: LIB3281-002-P1-K1-G1
ggaacggcgtagcccatcctagagctggtcctacttctccgaccagttcgcgaacaggagctacatctgcgacatttggaggactggtttgtgcgtgactcaaagcgaggacggtctcgtgaccaaagaagaggtgaagataaaactcgaacggctcaccggcgacaaaggcattgcggagagggcgcgggtgctcaaggatgcagctcgcaagagcgtgaacgaaggtggctcctcgtacgagaatttcaagagatttgttgatctcctgacggagtgagctgcaccatttcactcttcctatctttatcgtagcattctgagataggctcacg

SEQ ID NO: 3682 - DNA, 371 bp, Triticum aestivum
  Clone ID: LIB3281-002-P1-K1-G10
caacccccaagcaccagaacctcctcaacctccccgcgcatcgacgacatggcccgcaccaagcagacggcgaggaagtccaccggcggcaaggcgccgaggaagcagctggcgaccaaggccgcccgcaagtccgccccggccaccggcggcgtgaagaagccccaccgcttccgccccggcaccgtcgcgctccgtgagatccgcaagtaccagaagagcacggagctgctcatccgcaagctccccttccagcgcctcgtccgggagatcgcccaagacttcaagaccgacctccgctttcagtcctccgccgtctccgccctgcaggaggccgccgaggcctacctcgtgggcctcttcgaggacac

SEQ ID NO: 3683 - DNA, 466 bp, Triticum aestivum
  Clone ID: LIB3281-002-P1-K1-G11
acccacgcgtccgctgaatcgccgagaggttcttctgagatttgaaggtatccaactgttagcagggtctatttgctctggtatttctggcgataaagatcttttggatgctaccaagcgaaaaggcacttcgctacctatggttgacccggaaagtgagggtgaaatatttcctgatattcaattttggaagcaatgtgctgatccaatccttgctcaagatccattttcttcattaatgtcagcacttttctgtctacctgttgaagttttgacatccacagaattcttcatccctattgttcatctattctacattgtttgtgtcattcaggcactaataacatgctatcgggaagaagcctttgacagatcaaactttcgtaactgccttctcaacgatgtttgccaggagatgtcaggatatgatatagctagagaatattttgtatctaagcacatcgat

SEQ ID NO: 3684 - DNA, 357 bp, Triticum aestivum
  Clone ID: LIB3281-002-P1-K1-G12
ggcggtgagctgctgagaccgaggagcgtgcccccggggctcagccgttgccgcctgagatggcgggggcgctcgcgggagccgggatcgtgtggcagacgccggccaacccgcccgaggcgcaggactacatcttccgcaacgggcggcgctacgtgaggccctattacttcgagttcatctcccatgcgaagaacagatgggctgggaagaccattgtagatctcttcacggatgaattcaaggggcgcccccgtgaatactatgttcatgcagtgaagtgtgggaggcttcaggtggatgagcaaatggttcatgcagactatattgtgaaatcatcacaaaagataagccatt

SEQ ID NO: 3685 - DNA, 279 bp, Triticum aestivum
  Clone ID: LIB3281-002-P1-K1-G2
cggacgcgtgggtttttttttttttttcatcaataggccttcagcaggcgtcattaatcagtttccgatcaagagtttcagctctcgcgactactctttattattcgtcccaacgctggttccgttcggaacatcgtccgcacgatcaaaactgtcaacccatcgacaataaaattacatcaaaaatgggactacacccaaaaaaatcccctaaccaatatgttccagtttgcttcacatagcgtgcgtattcatggcttagtagtccattccacccat

SEQ ID NO: 3686 - DNA, 315 bp, Triticum aestivum
  unsure (1)...(315): unsure at all n locations
  Clone ID: LIB3281-002-P1-K1-G3
cggacgcgtgggctttgtgacttgtgactgtggagcgcggagaggcggccatccccttctccttgacccgattaaaaccccactcccctcgcaccttcggctccgggaccccgacgaacgccgaggaagccactaggaggagagaagaggaggggcanatctatgggcaactgcaagagttcatctcgtgcactcctaagaaaggcccatgttgctccggatccagaatggaggattcgggacttcggaaagacccatgttccagatttcgaatggaggattgatgatttctcatcactggttaagactggatct

SEQ ID NO: 3687 - DNA, 348 bp, Triticum aestivum
  Clone ID: LIB3281-002-P1-K1-G4
aagaaaaagaccagaaagacaaggtctgagctgggacagagtgccatcaacctgcccgagctcctcgcagaaccaacatcagctcgatcgatgtcatttgttggaactcatgagtacttggccccagaaatcatcaaaggcgaaggccatggaagtgcggtcgactggtggacctttggtatcttcttgcacgagcttctatacggcaagacaccattcaaggggtcaggcaaccgcgccacgctgttcaacgtggtcggtcagcagctaaagttccccgagtcgccgtcgacgagctacgctggcaaggacctcatcagggggctcctggccaaagagccgcagcag

SEQ ID NO: 3688 - DNA, 474 bp, Triticum aestivum
  Clone ID: LIB3281-002-P1-K1-G5
gctgttgattcgattgagggagaaataactcaatccttttcacaacaaaggaagaaaagagaggcagctggtcctacatattatgactcttttgcttatgctcaaggtccatttgcccctgtacctgaagtattccataccaaggcagagtctcctgcccaacaacgagtatatgaggagtttgttcatgtatggcagagtagtcatggccaaagtgttggtgctgcaagttctggtacagctgctgtatcgagcaattttggtgtacctcgagcttacagcccaagtttagcacaagcttccagtggtttcttgtctgctcaaacagcttcacttacattaactcagcctacagagctggtgtatgaggaattgattcctggcgcttcacaactttctagtgattctcctgctcaagttgggaccagcgactcttctggctggcttggtggaaccattggcgatgcatccaca

SEQ ID NO: 3689 - DNA, 341 bp, Triticum aestivum
  Clone ID: LIB3281-002-P1-K1-G6
tacgcgttcgaggaagcgtgattttactcattgctgtaaacaccaaacccaggaaagagaaacgggtcattctacatattatgactcttttccttatgctcaaggtccatttgcccctgcccctgtagtctttcataccaaagcaaagttttctgcccaacaacgagtatatgaggagtttggttatgtatggcagagtagtgatggccaaagtgtaggtgcttcaagttctggtacaattgctgtatcaagcaattttggtgtacctttgagcttacaacccaagtttagcacaagctttcagtggttttttgtttgcttaaacaacttcacttacatta

SEQ ID NO: 3690 - DNA, 258 bp, Triticum aestivum
  unsure (1)...(258): unsure at all n locations
  Clone ID: LIB3281-002-P1-K1-G7
gtcagccggactcgcctggagattggaggagccaaaaagagagtggggagagcttctctcggtcagcaaccaaagcgcgtccccaccccctctgcattgagggaggagggcatttggtgcgggcgggagatggggacgaggaggaggggtggcggaatgccgggcgcggcgtcnctgctgctcctggcctgctgctgctccgtctggccccgggcgcaaattttggtcgccgtcaccaccgacgccactgaccttact

SEQ ID NO: 3691 - DNA, 311 bp, Triticum aestivum
  Clone ID: LIB3281-002-P1-K1-G8
cggacgcgtgggctccccaccagcgtagcgcagcgcgcgcctccgccgctccgacccgtagccatgagggagtgcatctcgatccacatcggccaggccggcatccaggtcgggaacgcgtgctgggagctctactgcctcgagcatggcattcagcctgatggacagatgcctggtgacaagaccgttgggggaggtgatgatgctttcaacaccttcttcagtgagactggtgctgggaagcatgttccccgtgctgtctttgttgatcttgagcccactgtgattgatgaggtgaggactggcaccta

SEQ ID NO: 3692 - DNA, 436 bp, Triticum aestivum
  Clone ID: LIB3281-002-P1-K1-H1
cggacgcgtgggcggacgcgtgggctgccatggagggattttgccttgtggtcgattcagttcgccgttctctcctactcgagccgctgcatcgttcaacctttagctttgagtgtaatttgttatcgctgctttggagctgcgcagggggccgccgccaaggacctcccggagatcctctatggtgtcctccacgcccccccgcgacgagcgcaaggaccaggacgacgtcgccgtccagtaccgccgcggcggccccgggggcaagagcggcaaacggcgctgcgtcagcggcgggtgaggccgccaaggcccggcgcgagaaggaggcggagcaaacgcaggccatgctcgcgtgctatgactctgacgaggcctttcgcaacctctatgatggcgtcgctaacctttttggcgggctgctcaagttgggcct

SEQ ID NO: 3693 - DNA, 419 bp, Triticum aestivum
  Clone ID: LIB3281-002-P1-K1-H10
agaaataaaggaggcggttgagctttcgctgacccaccctgagctatatgaagacattggaataaggccacccaagggggtcatattatatggagaacctggaacagggaaaactctacttgccaaggctgttgctaactccacatctgcaactttcttacgtgtcgttggaagtgaacttattcagaagtaccttggcgatggtccaaaactagttagagaactatttaaagaggcggacgagctttccccctcgatagtcttcatcgacgagatcgatgcagttggaacaaagaggtatgacgctcattcaggaggggagcgtgagattcaaagaactatgttggagctgctgaaccaactagatggttttgattcgcgtggagatgttaaaattattctagctacaaatcgcattg

SEQ ID NO: 3694 - DNA, 398 bp, Triticum aestivum
  Clone ID: LIB3281-002-P1-K1-H11
ataaataaaggaggcggttgagcttttgctgacccaccctgagctatatgaagacattggaataaggccacccaagggggtcatattatatggagaacctggaacagggaaaactctacttgccaaggctgttgctaactccacatctgcaactttcttacgtgtcgctggaagtgaacttattcagaagtaccttggcgatggtccaaaactagtgagagaactatttagagaggcggacgagctttccccctcgatagtcttcatcgacgagatcgatgcagttggaacaaagaggtatgactctcattcaggaggggagcgtgagattcagagaactatgttggagctgcttaaccagctagataggtttgattcgcctggagaagttaaagtta

SEQ ID NO: 3695 - DNA, 396 bp, Triticum aestivum
  Clone ID: LIB3281-002-P1-K1-H2
cggacgcgtgggcttctactaattctctagtgtagagcttctaactccggtccattgtaaatattggctgtagttgaggaagctttcggcctcctgtaacccccctcgcgaagatgtcgtcagctggtgtcatagcgcttgctccgatgaccgatgacctcgccttcttgcccatcaggtttgatggaagtcgttcagcacactgcttctccgggtcacagctgcaggattccattctcatcttcctcgctgtgcctggtgcgccaccaatgccgatgagtgtgctgggcactgattccattgcctcggtcaagctgcgcattcagaggttcaagggctttgtggtgacaaagcagcggcttgtgcttggtgggcatgagcttgcacgcaacaact

SEQ ID NO: 3696 - DNA, 370 bp, Triticum aestivum
  Clone ID: LIB3281-002-P1-K1-H4
agtttatggggggcaataccagatttttggtgttgcaccaaaaaaaaaaaaaaaaaaaggggaaaaaaaaaaaggggaagggggggggacaatttttaatggaaaaattggaataagaaaaaaattagtggcagggttgttttttactcctccttctgcaactatatttacttatttggggggggcggctttaggggatcaaagctttggtacgggggcaggagaagttaaagtttttttttggggggcccgaaaagcatttcccggcgggggtgtttccaccgcgggggtggggaaacccggggggggccccatattattccctttggaagaaatccccttttttccgggggggttttaggagaagggg

SEQ ID NO: 3697 - DNA, 418 bp, Triticum aestivum
  Clone ID: LIB3281-002-P1-K1-H5
gacaaacattacaggttgcaagaatacttgcatgggaaattgctcatgcatcgccgtgttcttcgaccaaaaaacaggcaattgcttcatttttgaccagattggtagcttgcagcagaaaggtgcaagtaaaactaatttttcatctttcatcaaggtatctagcagtggctcaaggcaagctgggagtggcagtgacagtggaaatcacaacattattattgttgtcattatagtcgtaactttggctgtcatcggtggccttagttatgtcggtttcttcatttataggaggaagaggtatcctccatcctcacaagatgaggctggttcatcagaagacgatggatatctgcagacgatatctggagcaccagtgcggttcacttacagggagctccaggatgcaacaaacaac

SEQ ID NO: 3698 - DNA, 200 bp, Triticum aestivum
  Clone ID: LIB3281-002-P1-K1-H6
cgttcgttcaaccgagcactaacgtcgtctacaccaccatacctctagagccctcgttgtcggagaagcaggcaagcaagcaagatggcctgtaggaaggtcggcgagaggaagaaggctgtgacccggtccgcgaaggccgggctccagttccccgtcggtcgcatcgggcgctttctcaagaagggccgctacgcgca

SEQ ID NO: 3699 - DNA, 290 bp, Triticum aestivum
  unsure (1)...(290): unsure at all n locations
  Clone ID: LIB3281-002-P1-K1-H7
cggacgcgtggggattaccgttgcttcgttgggagcctgtcatggaacacaactgatgtggatctgaaggatgcgttcgggaaatttggtcgagttactgagaccaaggtggttcttgacaagttctctggccgatcacgtggctttggatttgtgacttttgatgacaagaaggccatggaagaagctgttgaggctatgaatggaattgatttggatggaaagaatattactgttgaaagagcacaacctcaaggttcangcagggaccgtgatggaaatcgagacta

SEQ ID NO: 3700 - DNA, 319 bp, Triticum aestivum
  Clone ID: LIB3281-002-P1-K1-H8
ccccgcccgcctcgccccgttccttccccgcagcggcgagctactcccgagccagggagagacaggcggcggcggcagcttccccttcccctccttctcttctccctcgccctcgccgagaaacaacgagagtttcctcttccgtcagcaatggagaacatgagatccgagaacaaccgtggcgcggccatggagggcgtcaagctcgcgtctgaggcggcggccaacaccaaccgcagggccctgagggacatcaagaacattctcggcgcccctcaccagccccaggccgtcaacaaggagggcttgcaagaaaaac

SEQ ID NO: 3701 - DNA, 429 bp, Triticum aestivum
  unsure (1)...(429): unsure at all n locations
  Clone ID: LIB3281-002-P1-K1-H9
ctacactagaaataaataaggcctcttctattccagaacaacgtgtcgagcatgatcttggtgtttctactgggagacaataaaacaagaagagcttgcttttaatggtgtccaacataaaaatggccgcatacgaaagctctttatgatgtaacttctctggagcaccttcattttctgataggaatctctagatgagtctcgtagcatcttattgccctctggatattagaagtgtggttcatgtatgaattcttttggtcaccaagatcaattggaccagagtttactgtgaaagagcatttacattggagctctatactgtctaaacgactaaaccatgtggtttaaactcagcaatggtgttactttntatgcaatgtaattcacccctatcatttatttagacttatgtgctcaattgagttt

SEQ ID NO: 3702 - DNA, 392 bp, Triticum aestivum
  Clone ID: LIB3281-003-P1-K1-A11
cggacgcgtggggtggccatcaagaagctcttctcccccgacaaagcaaagggtatacaatgaagtttctgtagcgctctccatgtttttggtaactgttacactggttagaagtactctagctcattgtccctgcttgtattctgtggtgtctttgttttgagcagagaacatggtgatcaatggagactttgaggaggggccatggatgtttccaaacacaagcttcggtgtcctgctcccgacgaaccttgacgagcagacatcggccttgccagggtggatgatcgagtcgaaccgcgcagtccgcctcgtcgactccgaccagtacaccgtgccccaggggaagcgcgccatcgagcttctctccggcaaggagggcatcatctcgc

SEQ ID NO: 3703 - DNA, 403 bp, Triticum aestivum
  Clone ID: LIB3281-003-P1-K1-A2
cccacgcgtccggagagcggcggcgaagatggtgtcgctgaagctgcagaagcgcctggcctcgagcgtcctcaagtgcggcaagggcaaggtctggctcgaccccaatgaggtcaacgagatctccatggccaactcccggcagaacatccggaagctggtgaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctcaggcgccttctgcgcaagtaccgtgaggccaagaagatcgacaagcacatgtaccatgacatgtacctg

SEQ ID NO: 3704 - DNA, 400 bp, Triticum aestivum
  Clone ID: LIB3281-003-P1-K1-A3
cggacgcgtggggtcgcagtggccatcgatggtggattgataacccccgtgctccaggatgctgataagcttgatatttattcactgtcaaggaaatggaaggagctggttgataaggctcgtgcaaagcagctacagccccaggagtacaactctggtacctttactctttcaaacctcggtatgtttggagttgatagattcgatgcgatcttgccacctggaactggagcaatcatggctgttggctcatcacaaccgacagttgttggtacaaaagatggtagaattgggatcaagagccaaatgcaggtcaatgttactgctgatcatcgggttatttatggatctgatcttgctgcttttctgcaaactctgtccaagataattgaggatccca

SEQ ID NO: 3705 - DNA, 394 bp, Triticum aestivum
  Clone ID: LIB3281-003-P1-K1-A5
aaccccctcttctctgtcggtgaggaactccactagagattgcgttttggagctccctctactgtcgctcgatctggcctcccccgctcagttgttgccccatgctccggatcatgccacagcaggcctcgccctgaccaacaggctcggatccatcccttccctcctcctggcctccacatgcgtagactgtggcgccagatcaagggagcctgccaatggaggtcgccgcctctccgtctcgatcggtccgccgccggatccaccatgctgtgccatgggatgggcgccttgcagctagctcctctgccgtcgcctgatctgcctgcccccgcccgtgctccagattcggctaacagcctcgcctctgacccgattcagacatgcacccaca

SEQ ID NO: 3706 - DNA, 394 bp, Triticum aestivum
  Clone ID: LIB3281-003-P1-K1-A6
gagttccagagttgttataagtgcggtcgcgacagtgggagctctgctattagtggctctgatgtgtttctggggttgttttctgtacaaaagtttcgggaagaaagatatccatggtttcagggtggagctatgtggaggctcttctgttgtgatgttccatggggacctcccttactccacaaaagatatccttaagaagttagagaccatggatgaggaaaatatcattggagcaggtggctttgggactgtgtacaaacttgcaatggatgatggcaacgtttttgcattgaaaaggatagtgaaaacaaatgaagggcgtgacaaattctttgatagagaacttgagatattgggaagtgttaagcaccgtaatttggtcaatctccgt

SEQ ID NO: 3707 - DNA, 315 bp, Triticum aestivum
  Clone ID: LIB3281-003-P1-K1-A7
cggacgcgtggtcggacgcgtgggcggacgcgtggtctgactcgtggtgggacacatggtcgcgccgaccgaccacaaaccagcgacggtcacgtcgtcgtttgactataatgaggggaagtagatcttaatagtcttctcgtggctgaacattcggaagctggttaatgatggtttcatttttaggaatccttataagattcatttcaggtcttttacatggtgtgtatttttttccaagcattatgttcgttactcttgatatggtttgcttacgtgttccagggatgcttggctttccaccaagttcctttt

SEQ ID NO: 3708 - DNA, 398 bp, Triticum aestivum
  Clone ID: LIB3281-003-P1-K1-A8
tgaatggtgtgtattgctccactcggccaattcgcattggacctgcaactcctagaagaacttcaggtgattctggcacctctccaccaacacaatcagatggtgactcgactaacaggacagtatatgttggcgggcttgaccccaacgttagtgaagatgaactaaggaaagcatttgcgaaatatggtgatgttgcttctgtcaaaattcctgttgggaaacaatgcggttttgttcaatttgtcaacagagctgatgcggaagaagcattacaagggttgagtggatcaacaatcgggaagcaggcagttcgtctttcttggggccgcagtccagcaagcaaacagtctaggggtgattctgggcatcggcggaatggcatgtactatggcacg

SEQ ID NO: 3709 - DNA, 402 bp, Triticum aestivum
  Clone ID: LIB3281-003-P1-K1-A9
cggacgcgtggggcaaacccaaatcggccgccgtcccctcttctcctccgcccacccccgccgccgtcgccgcctcctcgccagatcccgaccatggagggcagcggcagcagcctcgacgcggcgatcgagtcgctcctgaacacggagaagcagtgccgcctcgccggagatgtggccggcacccggaaggcagccgtcgacatcgtcgagctctgcttcaaggacgccgcctggaagacgctcaacgaccagatcgtcgtcctctccaagcggaggggccagctcaagcaggctattactgctgtggttcagaaagcgatggagtacattgacgtgacaccagacgtggagacacgtattgagcttatcaaaacattgagcagcgtcgctgctggaaaa

SEQ ID NO: 3710 - DNA, 51 bp, Triticum aestivum
  Clone ID: LIB3281-003-P1-K1-B1
atcgcgggacacgcggtgcggcacacgcgtggctcttttttcccccctttc

SEQ ID NO: 3711 - DNA, 392 bp, Triticum aestivum
  Clone ID: LIB3281-003-P1-K1-B10
gaaggcggagagagagagagagagagagagagagagagggagagcagtgtagggaaatcgtgactgaccaccggagagagagaagaagaagaggctgccaaggtcgacggcggagaagaagaagaggcaatggcgtccgggtggggcatcaacgggaacaagggccggtgctacgacttctggctggacttcagctcgtgcatgagccgctgccgccagccctccgactgcggcctcctccgcgaggactacctcgagtgcctccaccactccaaggagttccaacgcaggaacaggatctacaaggaggagcaacgtcagataagagctgctgctcgcaaggccaaggaagaagccgaaggagctcctgctgttgcagctcaccactagca

SEQ ID NO: 3712 - DNA, 382 bp, Triticum aestivum
  Clone ID: LIB3281-003-P1-K1-B11
tttgaagattcagtttttgaggaggaaaaaactggaatttcttgagatgcgggaagaacttatcaaggtgatgtatatgtctcacaaatattagaaatggactgtttttacatcatctgcaaatgcaaccatgatacttgtcgtagatatgaaactcacattggtcgtacttctggtaaagctagtagtgagtggggcatgtagtcactcttcttttactaatttattgtcttggctcaaaagtcattcatattgccatgctacctcgccgttctggatcgacgccgtcccttcgggtttctggtgtggcgtcgatctggacgatggcgcgactttgtccggttgtagttcttcggtgcaggtccaatctctctgggtgatg

SEQ ID NO: 3713 - DNA, 298 bp, Triticum aestivum
  Clone ID: LIB3281-003-P1-K1-B12
cggacgcgtgggcgccgtgctgatgtaaaaccgccgaagggacttccggcgggccaagtaccagatggagcacgttatgcgcacgcacaatggcgcctacgaccgttccttatgatctgtaaaccaagacgtggtccagctgggaaataaggaactgacaatgagcctacttctggtaaaggttgtagtgcatctctcatgagaaaatcaccactttctaaccgattgtgttgccttaaaaggaacttatattggtatgctacctcgtccttttggatcgactccatccatttagttt

SEQ ID NO: 3714 - DNA, 275 bp, Triticum aestivum
  Clone ID: LIB3281-003-P1-K1-B2
aaacccaaccagcggcaccgtctccacctccacatcctacaactccgcctggagctccacctcgatccccttcgagctcctaggccagcagctgcacgccgcccgccggcccgagccagtgggcgcgaactggggcccgactcagggttcgtattccgtccccggcctctgctgcgccgacattcatggagctgctgttcgagctgctcctcacggcggcggccaccctcctcgtcgtcgtcctgctcgccaagctcttttccggggccaatgat

SEQ ID NO: 3715 - DNA, 403 bp, Triticum aestivum
  unsure (1)...(403): unsure at all n locations
  Clone ID: LIB3281-003-P1-K1-B3
cggacgcgtggggtcgccgccaagcctgttgggaacttctttgcctttgatatgcccctgctgtacgtgcacggtgagaagttcaaccaaccgatatttcactgcaacaatatttctggattcgttgagccggttgttccagagagccagaacagggctctgtactcgacccacaccttcaagatcttgttcaaggaaggtggatgtggtacctttgtgccactcttcctgaacctgataacatcagtgcggcgctacaatcagtttgaagcccagcctgctactgtgccccgtgtggaccccatgcaggcagcgcaaactcctgttgacgacatgatgcgccatgcgtacgtcgatccacatgatcctaccaagatcttnctncagcagcccgcaccggaat

SEQ ID NO: 3716 - DNA, 95 bp, Triticum aestivum
  Clone ID: LIB3281-003-P1-K1-B4
ctgacgcgtggggtcaccgacaatttttttcggaactgctttgcctttgggggggccctgctgtacgtgcacggcgagaagtacaaccaacccat

SEQ ID NO: 3717 - DNA, 397 bp, Triticum aestivum
  Clone ID: LIB3281-003-P1-K1-B5
gtgactggagagcgtggagaggcaaaccccctccgggaccccgacgaacgccgacgaacgccattgtgagaggagagaagaagaggaaggagcagatccatgggcaactgcaggagttcatcccgtgcactcttagggaagacccatgttgttccggattcagaatgggggattcaggacttcggaaagacccatgttccagtttttgaatggaggattcaggacttctcgtcactgcttaagactggagctaagagcacaatatctggtgcttttcactgctctgggtataactggttcctacaagtgattccaatgcataaagaagctggtgctggaactccatatgttgctcttcgtcttatgccatcccaattgagcttggtgccaggtcaca

SEQ ID NO: 3718 - DNA, 389 bp, Triticum aestivum
  Clone ID: LIB3281-003-P1-K1-B6
cggacgcgtggggaaacactgtcgctgccaacaggatccttgatgagatggcgcagaaggggtgtgccccaaatttgttcacctacaatgttttgctggagagtttgtggaaagctggtaggactacagaggtagaaaggttgttggagaggatgggtgagaaaggatatagcttggatacaacaagctgcaatatcattattgatggactatgcagaagcagtaaattagatatggctatggacattgtcgatgaaatgtggaatgaaggaagtttggctcttggcagattgggtagttcgttttcaagtttagcgagtgattctttcctcagcaaaaaatgtctacctgaccgaatcacttacacaactttgatgaatgcattgtgc

SEQ ID NO: 3719 - DNA, 116 bp, Triticum aestivum
  Clone ID: LIB3281-003-P1-K1-B7
cggacgcgtgggcaaacactgtcactgccaacaggatctcttgatgagacggcgcagaaggcgtgtgccctaaatttgatcacctacaatgttctgctcgagagttagtggaaagc

SEQ ID NO: 3720 - DNA, 401 bp, Triticum aestivum
  Clone ID: LIB3281-003-P1-K1-B8
ggattatataccgtgatctcaagccagaaaatgtcctagttcgggaggatgggcacatcatgctgactgattttgacctctctcttcgttgttcagtgagcccaaccgtgatcaggggtgcaaatcctggcttagatgcgctgcagaggaacaatgcagcgtactgcgtccaacctgcgtgcattcagccatcctgtgttgttccaaccacatgctttggtcctcgattcttctcgaaatccaagtccaagtcaaagtctaagaaggagaagccaaagccggacatcgtgaaccaggttaacctattccctgagatgatcgccgagccaactgatgctcggtctatgtcctttgtgggcacccacgagtacctggccccagagatagtgaaaggggaaggc

SEQ ID NO: 3721 - DNA, 401 bp, Triticum aestivum
  Clone ID: LIB3281-003-P1-K1-B9
cctcgctcatctttctcccagatccgatcaaggcaccgccgccacccccacccaccaccgccgacctctccaccatctcctccccgtcccccatcgcgccgccatccacctcgtcgcctcccatctcctccctcccccaccttccccacccccacaacaagatcgccgacgtgacgacagcaatggcggcgggtaccgggcggaggacaactacgactacctcttcaaggtcgtcctcatcggcgactccgacatcggcaagtccaacctgctctcccgcttcacccgcaacgagttcagcctcgagtccaagtccaccatcaggggggtcgagttcgccacccgctccctctaggtcgacggcaaggtcgtcaaggcccagatttgggacactaccgact

SEQ ID NO: 3722 - DNA, 398 bp, Triticum aestivum
  Clone ID: LIB3281-003-P1-K1-C1
cactcactccccaccgccactcgtcagatccacacgccacagcgcgcggcatgggctccctccccctcccctccctcgccgtgctcgcggcgcttctctgcttcctcgccgtcggcggcgccgtggacctcaacaccaccgacccctcccccttcgacgtcgacctgaacgccaccgacgccaccaagtactggggcccctggaccccggccagggcgacttggtacggccagcccaacggcgccggccccgacgacaacggcggtgcctgcggcttcaagcacaccaaccagtacccgttcgcgtccatgacctcctgcggcaaccagccattgttcaaggacggcaaggggtgcggctcatgctacaagatcagatgcaggaaggacatgtcctgc

SEQ ID NO: 3723 - DNA, 392 bp, Triticum aestivum
  unsure (1)...(392): unsure at all n locations
  Clone ID: LIB3281-003-P1-K1-C10
cccacgcgtccgccattttcttgtcaaccttcgatgccgaccaacatcgacgccagaagtttgagggcgaggaggcgaaccagaggagaagaggaccaccggagctcgctcatcatctctgccaccacggagctcacatcggacggcgacctgctggtcagccggcggcggtagccatgtggtccgccggcgctgacaaagttgggtttcgacggaagggcaggctggacgagaacgcgctcgagcgccacttctagtacggggaggcgcacccgctgctcgcctgcatctgctccaacgcgctgctcccttctccatttttttctctgtcgagcaaatcggcngtgggaggaggaggcgaaggcaagcgtcgccggttcaagtacaagtag

SEQ ID NO: 3724 - DNA, 348 bp, Triticum aestivum
  Clone ID: LIB3281-003-P1-K1-C11
cccacgcgtgcggcgatgggtggtctaactgcgtccacgcccacgatggcgggcaggagacctggggcgggttttatagccacacgaaaatacgatcaacggagctcggtcatcatctgtgccaccatggagctcacataggactgccacctgatggtcactcggtggacgctgccatgtgggccgctcggatctgcgaagtgaggttccaacggaaggccattctgtactagagcgctcatcgtcaccactatgagaactgtgatggccacgcgctgctagtgtgcctctgctgcggcacgcaggcttcttgtccattttagtctctggccagctagttggcggtgg

SEQ ID NO: 3725 - DNA, 397 bp, Triticum aestivum
  Clone ID: LIB3281-003-P1-K1-C2
ccaaacccaatcagaaatctcaagcttagcacagcaccaagggcgtcggagcagaccttcatcatgatcaagcctgatggcgtccagaggcgcctcatcggtgaggtcatcagccgcttcgagaagaagggcttctacctcaaaggtctgaagctccagaacgtggagaagtcgttcgccgagcagcactacgccgatctgtcctccaagcccttcttcgctgggctcgcggagtacatggtctccggccctgtcgtcactatggtctgggagggcaagagcgtgcgctccactggacgcaagataattggcgccaccaaccccctggcctatgagcccggcaccatgcgtggtgactttgccgtcgacatcggcaggaacgtcatccatggaagcg

SEQ ID NO: 3726 - DNA, 403 bp, Triticum aestivum
  Clone ID: LIB3281-003-P1-K1-C3
cggacgcgtgggctgcgccgacaccttcgtcaccgacgccctcctcagctacatctccggcagggcaccctcgctgaagagccttcaactaagcctgtgtgatgaagtatccaacgaggcgctggcagatgcagtcaagggctttcctcagcttgaggagctggagatcacattctgctcactgaacagcaacgtgtgcgagtcagtcggcagagcctgcccacacctgaaatcctttcggctgaacgagcgctggacggtcctccaaagggggtttgcagtctttgagggcatggatgatgacacgggtgcgctagggatcgcgagcagcatgcccgagctccgggacctccagctgatcggcaacaacctgaccaacgccgggctggcggcgatcctcgac

SEQ ID NO: 3727 - DNA, 396 bp, Triticum aestivum
  Clone ID: LIB3281-003-P1-K1-C5
cggacgcgtgggctgtaaccaagaaatactgtttggtgaattgattgaagacttgaactcctttttctgtatttttcttgttctaaatctagtatgcatagcagcttaaattctgataatatgctagcacatgcagttaacaatctaacataccacaaaactatgtctgggtctctggggtagagcagacgtttagatgcttaacatgataaaatactcaacaattttgaggcaatgaatctttatatagatgaagttcttccatgaagcttcctgcattatgttaattaccagcttgccaggatgctatgttataaatacccaacattcacaatttcttctatgctgtctatatcctttaaaacaccctttccttctgcaaattaaccacgaaat

SEQ ID NO: 3728 - DNA, 396 bp, Triticum aestivum
  Clone ID: LIB3281-003-P1-K1-C6
cggacgcgtgggcggacgccggccgaggaagcccccgaattcagaggagaagagaagagaagaggaaggggcagatctatcatctatgggcaactgcaagagttcatcttgtgcactgctaggaaaagcccatgttgttccggatgctgaatggaggatgcaggactttgtaaagacccatgttccggatgctgaatggaggattcatgacttctcatcgctgcttgagacgggagctaagtcagcaacatctgccactttttactgctctgggtataactggcagctgcaagtgattccaatgcataaagaaactggttctgaaacaccatatgttgctcttcgtcttatgacatccccagaaaggatggtgccaggtcacacgatgcatgtggt

SEQ ID NO: 3729 - DNA, 403 bp, Triticum aestivum
  Clone ID: LIB3281-003-P1-K1-C7
atctcctcgctgccgccgccacctcctccccgtcccggcccctcccgatccacctcctccccgtcctctcccacccaccgccgacctcgccgtcctcctcgaccacgcctcgccggagagagagagaggcgtcgcccccagcgactacggctgttccccctcctccctcctccttcgcgcctcacccgcgccgcgccgccccggcgcgctgctgctatttattccctccaaatcgccattgcccacagcagcaaggaatcaagatccaatcccgtcccctcccatccaatcctcccccgcggcaacagagatccagccagatccgcctagttccatggcgaccgccggcaacgcccccgctcccgcaagcgcatcgaggccatcgtcctcaagcacgcgcgcg

SEQ ID NO: 3730 - DNA, 374 bp, Triticum aestivum
  Clone ID: LIB3281-003-P1-K1-C8
cggacgcgtgggcgcgacgtgttcaggctgcaggtgcacctggtggcggcgcagatggcggcgcggaagggccggcgcgacggtgccggccgggtgcgcgtggtgctgcggagcgagtgcgagccgatgatggacctgttccggtgcgacgaggccgcggggcgggagggggactggtggatgtacaccgtcgacgcgccgcgcatggaggagaagctccggctgcccgtcggctcctgcaacctcgcgctgccgctctgggggccaacaggcatccacgaggtgttcaacgcgtcagacctgacggtggtggacgccggcagccagcggcgcgaggcgtacgcgactgttctgcactcgtccgaccgatacct

SEQ ID NO: 3731 - DNA, 293 bp, Triticum aestivum
  Clone ID: LIB3281-003-P1-K1-D1
cggacgcgtggggtgagcgtcctttctgcagcgtgcggcgtgcgcgtgcgagcgcgagaaaaaaaaaaaaggaggcggcttccgttgcatgtgagcggagcggaccggaggggcggtagagcatagtagcgtatcgcggctcggggccatgttgttcgcgctgaatagctgtctctttctagtttattggctgtttatatttttgtttttttcgtttatttggtttcttcttttttcttattttatctttattatatattttttttatgtttttttctttggcttctcttttt

SEQ ID NO: 3732 - DNA, 385 bp, Triticum aestivum
  Clone ID: LIB3281-003-P1-K1-D10
ctccgtagcacaggaatttgttgctgctgattatgtcttcaagtgtttctgcgagacaaatcccaatggtcaggcattattagcatcaactattgctccacatccaaaccaaggaactgctacccatggtgcttctagtgacatgccatttggaagtgcacttctgcaagctctggtgtcaagtgatgttaatggagatatggaggcatgttgcagagcatctagtgttcttactcacataatcaaggacaacttgcaatgcaaagatcgcgtattgcaaattcagcttgaaacacctacgccatccttgggacgcaccgagcctctcttgcatcggattgttacgtgtttatcctttgcagctttagcagaaggagaaaatgac

SEQ ID NO: 3733 - DNA, 394 bp, Triticum aestivum
  Clone ID: LIB3281-003-P1-K1-D11
cccacgcgtccgcggacgcgtgggctcaccgcctccgctcccacgccgccgaatccgagacctgatctcggattcaccgcagcgcgaccaaaccctcaggcgatccccggcacctcctccccgacgcttcagccatggcaggaatggcaccggaaggttcccagtttgacgctaagaactatgattctaagatgcaggagctgctgaaccaaggtgagactgaggagttcttcacctcttatgatgaagttcatgagagctttgatgacatgggtctccaagagaacctcctcagaggaatttatgcttatggttttgagaagccttctgccatccagcaaaggggaatcgttcctttctgcaaggggcttgatgttatccagcaagcacaatc

SEQ ID NO: 3734 - DNA, 340 bp, Triticum aestivum
  Clone ID: LIB3281-003-P1-K1-D12
cccacgcgtccgcccacgcgtccgctttcccctcccctctcgcggaggaggcgaggaccggtcggatcgatcccattcgagctcgattttagccgccaaaaagtttagcgtgctccagacaggggctggccgtacggcccaagcttcgggcggcggagcgctcgcggcgggcggcgggatctgagacccaaaccctaggtggcggcggcgccgccgtgggggtgaaatggacgcgaggtttccgtactcgccggctgaggtggccaaagtgcagctcgtgcagttcggcattcttagcccggatgaaatcgtaatacctggacttccccaccctcaccga

SEQ ID NO: 3735 - DNA, 402 bp, Triticum aestivum
  unsure (1)...(402): unsure at all n locations
  Clone ID: LIB3281-003-P1-K1-D2
cgctgcgacatttcaaatcgaatcaaccccaacccccacaccccaccccgagtcctccccaattccaagatcccacgcttccccgctccaaattccctccccaattccaagatccctcgccgcgcggcgcgattccggagctaggcagctagggtttgcaggtcctcggaccgagctgcgcgatctcgccgtccgctcgggggctagggtttggattggggtacagccctgagcgagctctggattgagatttgggagagtggtcgcggttctggatcgagctgccccgtgtgctgcgatggtggttagtggaggaggacgccagtgacggttggtttcggtgggataaggagaaccccccgcagccatggtgcggcttctcgggctgcggngcctcagctt

SEQ ID NO: 3736 - DNA, 403 bp, Triticum aestivum
  Clone ID: LIB3281-003-P1-K1-D3
gcaagtagcttcaagggagtcagagagagctgaaagggccacccttgttacccaggagaagctccagcaggcaagcaacaaaacaaagcaaatgaggcttaatgatgtctggataaggcctccatttggtggtcgtgggagaaagctgacaggaactcttgaggcccatgttaatggtttcagatattccacttcacgggctgatgagcgtgtggatatcatgtacgggaatataaaacatgctttcttccagccagcagagaaagaaatgattacccttcttcatttccatctgcacaaccatatcatggttggaaacaagaagacgaaggatgtccagttttatgttgaagtgatggatgttgttcaaactgttggtggcagcaggaggtcagcccttgat

SEQ ID NO: 3737 - DNA, 397 bp, Triticum aestivum
  Clone ID: LIB3281-003-P1-K1-D5
cccgtaccggatgcgcgacggcggcgacagcgacggcgagggcgagctggaggtgctggtcatcagctcgcagaaggggcacggcatgatgtttcccaagggcgggtgggagctggacgagtccatggacgacgcggcacggcgcgaggccctcgaggaggccggcgtccgcggggagatgggcaaggtgctcggctgctggcactaccagagccgccgctaccagaccacctacgagggcatcatgtacccgctccgcgtcaccgacgagctccagcagtggcccgagatggcgtcccgcaagcgcacctgggcaactgtgcagcaggtcatggagggatgccagcactgctggatgcgggaggcgctcgaggagctcgtcgcccggcacgccaag

SEQ ID NO: 3738 - DNA, 358 bp, Triticum aestivum
  unsure (1)...(358): unsure at all n locations
  Clone ID: LIB3281-003-P1-K1-D6
cccgaaccggaggcgcgacggcggcgacagcgacggcgagggcgagcaggaggggcaggacaacagcncgcagaaagagcacggcacgaagcaacccaagggcgggagggagcaggacgagaccanggacgacgcggcacggagcgaggcccacgaggaggccggcagccgcggggagacgggcaaggagcacggccgacggcacaaccagagccgccgggaccagaccaccaacgagggcaccagggacccgcgccgcgacaccgacgagcaccagcagaggcccgagaaggcgnaccggaagcgcaccagggcaacagcgcagcacgacaaggaggaaagccagcacagcaggaag

SEQ ID NO: 3739 - DNA, 393 bp, Triticum aestivum
  Clone ID: LIB3281-003-P1-K1-D7
cggacgcgtgggcggacgcgtgggcggacgcgtgggcttctcccgccgccgccccgcgaagcaaagcaggaggagaaggatgccggcgggccacggtctgcggtcgcggacgcgcgacctgttcgcgcgcccgttccggaagaagggttacatcccgctcaccacctacctgcgcacctacaaggtcggcgagtacgtcgacgtcaaggtgaacggcgccgtgcacaagggtatgccgcacaagttctaccacggccgcaccggacgcgtgtggaacgtcaccaagcgcgccatcggcgtcgagatcaacaagcaggttggaaaccgcattatcaggaaaaggatccatgtccgtgttgagcatgtgcagccatccaggtgtgctgaggagtt

SEQ ID NO: 3740 - DNA, 376 bp, Triticum aestivum
  Clone ID: LIB3281-003-P1-K1-D8
cggacgcgtgggcggacgcgtgggcggacgcgtgggcttctcccgccggcgccccgcgaagcaaagcaggaggagaaggatgccggcgggccacggtctgcggtcgcggacgcgcgacctgttcgcgcgcccgttccggaagaagggttacattccgctcaccacctacctgcgcacctacaatgtcggcgagtacgtttacgtcaaggtgaacggcgccgtgcacaagggtatgctcgacaagttctaccacggtcgtaccggtctcgtgtggaacgtcaccaagcgcgccatcggcgttgagatcaacaagcatgttggaaaccgtattatcaggaaaaggatccatgtccgtgttgtgcatgtgcagccattc

SEQ ID NO: 3741 - DNA, 400 bp, Triticum aestivum
  Clone ID: LIB3281-003-P1-K1-D9
cggacgcgtgggcggacgcgtggggccctccgcctccccgtctcgctcgttcccgcctctcgccgccgccgccgccgccctcgcagccgcaaaatgccgttcaagaggtttgtggagatcgggcgggtcgccctggtgaactacggcaaggactacggccgtctcgtcgtcatcgtcgacgttgttgaccagaacagggcacttgttgatgctccggacatggtccgctgccagatgaacttcaagcggctctctctgaccgacatcaagattgacatcaagcggatccctaagaaggcaactttgatcaaagctatggaggaagctgatgtgaagaccaagtgggaaaacagctcatggggcaagaagctgattgtccagaagaagagggctgcgctca

SEQ ID NO: 3742 - DNA, 400 bp, Triticum aestivum
  Clone ID: LIB3281-003-P1-K1-E1
gcggcgacgctcgcatccggcaacggttccaccactccgtccatctcttcctcccaccactccatcaccatccccacatcgctgctgatttcccatttggaggtggtcctgtggcgccgatgctctcacccagctgccggtggcggcacattttgttcgtgcccaagcgctcggtgaggtcacctctcacctccctcctatggtgccaccgccccaacccatacgcagctccctcttccccactcccatggttgcagatctgagcgggacaaggtcccttcgaccctggtggttcgaaacgaggtgtgcggcctctgctctcttaacttctggagactaggggcgcggtggctggtgcccccatctctcttagccatccacggcgtaacatcatcaggtc

SEQ ID NO: 3743 - DNA, 392 bp, Triticum aestivum
  Clone ID: LIB3281-003-P1-K1-E10
cggacgcgtggggaggttaccatcctgattgaggcctacagaaccctccgggacaggggcccgctcccagccagccaggtcgtgagagatctcagtggaaggttcgcttttatcctgtacgacaccgtgtcgaaatccaccttcgtcgctgctgatgctgatggcagtatccccttcttctggggcgtcgactctgaagaccaccttgtgttctctgacgacaatgagcttctcaaggcaggctgtggaaactcatttgcgccattccccaaaggctgcttctacaccacatctggagggctgcagagcttcgagcacccgctgaacgagctgaaggccgtgccacgtgtggacagccagggccagatgtgcggctccaccttcaaggtcga

SEQ ID NO: 3744 - DNA, 393 bp, Triticum aestivum
  Clone ID: LIB3281-003-P1-K1-E11
cggacgcgtgggatgatatatgtgctcttgaggtcagaaaccagtccggtgagtggatatacgccaagccggtccctggaaccttcgtttgcaacatcggcgacatgctgaaggtttggtcgaatgggatataccagcccacgctccacagagtcgtcaataactcccctcgctaccgtgtatctgtcgccttcttctacgagtcgaacttcgacgctgcggtggaacctgtagagttctgccgggagaaaacgggcggcgttgccaagtatgagaaggtggtgtatggggagcacctagtgcagaaagtcctcaccaacttcgtcatgtaacagtttgggggaggggaggtgcaagcctgaaagggaacaaatttctgtagctgtactgaaa

SEQ ID NO: 3745 - DNA, 374 bp, Triticum aestivum
  Clone ID: LIB3281-003-P1-K1-E12
cggacacgtgggcagcagccaagcaatccccacacacatctctccactccgcgattcctttctccagctcgccatggacgcctcagccaccgtagccaccgggaaggggaagaagggcgccgccggtcgcaaggccggaggccccaggaagaagtccgtgtcgcggtccgtcaaggccgggctccagttccccgtcagccgcatcgggcgcttcctcaagaagggccgctacgcgcagcgcgtcggctccggcgcccccgtctacctcgcggacgagctggagtacctcgccgccgagctgctggagctcgccggcaacgccgtcgaggacaacaagaagagccgcatcatgccccgccacctgctggtcgcca

SEQ ID NO: 3746 - DNA, 283 bp, Triticum aestivum
  Clone ID: LIB3281-003-P1-K1-E2
cccgtctccccccacacctgcgacctttcaaccaatccgtacatttgttggggggaccactccattaccatccctacattgatgctgattttccatttggaggttggctctgaggcgccaatgctttacacagctgttggttggtttcattttgatcgtgcccaagcgctcggggaggacacctactacactttttctatggagttaacgtctcatccttatcgcattttacttttttttactcgcatgaattgttgatatgatgctggtacaatggtccctt

SEQ ID NO: 3747 - DNA, 385 bp, Triticum aestivum
  Clone ID: LIB3281-003-P1-K1-E3
gtccttcctcctctcgatgcggcggcgttactccctcctcgatgcgctgtcgatccgcgacatgatgctgcgggactacttctccgccggtatggtccaaccccctcccctctacacttcctccatagcccctaacggaacggaagaggcacccagccagtctatcgaggggatggcaaaggcgcatggcgcggcggcggctctatcccccgacggcgggtacacgtcggacacgcacgacgagggcgggccgcaagaaaaagaaggagatggcagacgattcgccgccaccgaccaaggtcccaaaccagtgggtcgccacaactccctgagcgaccacgtcagcgagtgggttagtagcattgacagcgaaagcctctgcatc

SEQ ID NO: 3748 - DNA, 393 bp, Triticum aestivum
  Clone ID: LIB3281-003-P1-K1-E4
cttctccttttcctctcccccatggttttgccaatctgggctctcttggcagagggattagctttgctggatctcatccattgtttcaggtatggcttgccctgtttgccgttgtctgggtgctccgtgcttaccagttgtggaagctcatgaagtcccagaggttttcgatgttgtagttgatgatgcttgcttcaggaggatgcagatctgctgttgttggtttggtggacgaaggagaaggtagttgccagcaagaatcgtctggagaagttagtcagaaacatcagaaggcaacaggagatctgagctttttttctcctttcatggtggcggctgtgtgggtgtcgagaaagaaagaagaggaggcatgagggtagacctagtgagctg

SEQ ID NO: 3749 - DNA, 344 bp, Triticum aestivum
  Clone ID: LIB3281-003-P1-K1-E6
cggacgcgtggggtgagagagagcggcaccaccggcggcaacaccaacacatctatagagccctggtcagcggagaagtacgccggcactcacgatgggctgacggatgggcggacagtggaacaaggcacggacccggtcccgtactgccgggctccagttccctgtttatcgcatggggcgcttacttaagaacggcctttacgtgcagcgcgttagcttcgtcacacaggtttacctgggcgccgtcctatgagtgcctcgcctgctaggtacctgtagctggtcgggcacgctgtcaaggacaacaagaagactctcatgcgaccgcgttaccatgctgc

SEQ ID NO: 3750 - DNA, 332 bp, Triticum aestivum
  Clone ID: LIB3281-003-P1-K1-E7
atcgccgggggggcgaggcataccaagcaaaccctagccagagccagagacagaaacacctaaagcgccggtcggcggatcgccccgtagcgtgaccgaccggccaccaccagggcagtgcatcgacatcgacgccgccctccctccttgcctagaggctacagcaagcaagaaagcgagcaggcaaggaggtgtggtggatggccgacagcggcggtgtcagcgaccacaacgccgtcagacgcaacgacaacgaggagggcaacaccgacccgttcgccgagacggtgcagataggaggatctcccacgtacaggatcgagaggaagctc

SEQ ID NO: 3751 - DNA, 400 bp, Triticum aestivum
  Clone ID: LIB3281-003-P1-K1-E9
cgtcctcccctccatctcgccgggccatggctcgtctcctcctcgtcgtcctagcgcttcacctcaccgctgccagagccttcgccgcgtcaagcgtcggcggccgtaacggagacttcgacccctcccgcgtcgtccagctctcgtggcaccccagagcgttcctgcacaaggggttcctctcggacgcggagtgcgaccacatgatcgagctggcgaaggacaagcttgagaagtcgatggtggcggacaatgagtcgggaaagagcgtccagagcgaagtgcggaccagctccggcatgtttctcgagaagaggcaggatgaagtagtagcaaggatagaggagaggattgctgcttggactttccttccgtcggagaatggcgagtccattcaaat

SEQ ID NO: 3752 - DNA, 403 bp, Triticum aestivum
  Clone ID: LIB3281-003-P1-K1-F1
cccacgcgtccggaggccaagtcgaacggcgcgcgggaggtggcggcgcaggcgacggcgacgctgatgagctgcccggcgaacgcgagggacgtgaagaaggacgagaagagcgtgccgaacctggtgcagctgctggacccgagcccggggaacacggccaagaagtacgccatctcctgcctcctggcgctgtcggcgagcaagcggtgcaagaagctgatgatcgcgcagggcgccattgggtacctgaagaagctctccgagatggacgtggccggcgccaagaagctgctcgagaagctggagcgtggcaagctgcgcaccctattcactaggaagtaaagcaaggagaagcgttccgttttgccgtgaacctgtaaaaagagccgccgtcctgtgt

SEQ ID NO: 3753 - DNA, 378 bp, Triticum aestivum
  Clone ID: LIB3281-003-P1-K1-F10
gaagtcgcgctcccaaaccctagctcccaccgcagcggcccccgccccctcccggtgcgcgcttgctgctgcagacgagaagcggctgaggcgaagaagaggaatcgaccatggcgacccgtatccagtttgagaacaactgtgaagttggtgttttctccaagctcacaaatgcctactgtctggttgcaattggaggatcagagaatttctacagtacatttgagtctgagcttgcagatgtcattcctgtggtcaagacctctatcggtggcactagaataattggtcgcctctgcgttggaaacaagaatggacttctcttgccacacacaaccactgatcaagagcttcagcatctgaggaactgcatacctg

SEQ ID NO: 3754 - DNA, 394 bp, Triticum aestivum
  Clone ID: LIB3281-003-P1-K1-F11
cccacgcgtccggacgatttctccatgccgagcgctcgccttctgttgtccgcatatggatccgggtgccgccgtcccttcccagcctcctccagtgacatggttggtgacaccaacctatgctcacctcctcccatccctccaggagctctcccgtcaccctgtctgacggcctcctctccctgcaaactcccttcgccgaggtccagtatatgttcatccccggcggctcgagtacagttcggcgtacgacggcgtacagtacggcgtattacggcgtgcagtattgcatcccacatcgtacgtgcgcgctcgtgtggctgggagtggactgcatcccacaagcagcaaaggctttttttcttttccttttggattttggatgtgcagaact

SEQ ID NO: 3755 - DNA, 333 bp, Triticum aestivum
  Clone ID: LIB3281-003-P1-K1-F12
ctcaagtacgccatgaaggcgagaggcgtggacgcgaggccggggtggagctggtacgcaagccgggcggagcgtccacgtcttagaggtcgacggcgggtcgccggcgcacccggagacgccggagatatacggcgagatgagccggctggtgtcccaaatcaggatggtggggtacgtgccggacaccgtctgtatcgcctacgacatcccctaggaggagaaggagcgtctgctgctctgtcacacacagaagctctgccgtactctacagtatgtgtcggactgacacaagccacacgctccttagggtgtttaagaacaccaggatgt

SEQ ID NO: 3756 - DNA, 399 bp, Triticum aestivum
  Clone ID: LIB3281-003-P1-K1-F2
gtgaaagtgcacgtcttataagagaaatgtttaactatgcacgtgagcatcaaccatgtattattttcatggatgagattgatgccattggtggccgaagattcagtgagggcactagtgcagatcgtgaaatacaacggacattgatggagctcctaaatcagttggatggattcgatgagctcggaaaggtgaagatgatcatggcgacgaaccggcctgatgtcttggaccctgcgctccttcgtcctggacgcctagaccggaagatagagattccgctgccgaatgagcaatccaggacggaggtcctgaaaatccatgcagctggtatcgccaagcatggcgaaattgattacgaggctgtggttaagctggccgagggcttcaatggcgctg

SEQ ID NO: 3757 - DNA, 399 bp, Triticum aestivum
  Clone ID: LIB3281-003-P1-K1-F3
ggcgaggtcggcgccctcatcgagaagcacgcggcactggctgcggggtctggccagcgacgccgatatctgctgcggcgcgacgccgacgcggtccaacacgaccgcctgcagattccgcacgcctagcgacggatgcacggcaaccgtgcccaggtccacgctctgctcccgccagtatcggcgacaacaagaaggcctggaagaccgaacactgcagggcactgaagataaagcttacagaaagaaataaagatggccatgttctccaatactcctggatttcatttacatcaacttctcaagagaggagtactcctttttagtagtctcagtttaaagtaaattaaatgaaaggagtactccttttcagttgtctcagtttaaagtaaatgaaag

SEQ ID NO: 3758 - DNA, 299 bp, Triticum aestivum
  unsure (1)...(299): unsure at all n locations
  Clone ID: LIB3281-003-P1-K1-F4
gggggagcgacgcgaacgggcgaggacggcgcccncaaagagaagcacgcggcacaggcagcggggacgggggagcgacgccganaacagaggcggcgcgacgccaacgcggaccaacacgaccgggggcagaaagcgaacgccaagcgacggaggcacggaaaccgngcccaggaccacgcacagcacccgccagaagcggcgacaacaagaaggccaggaagaccgaacacggcagggcacggaagaaaaagcggacagaaagaaaaaaagagggccaagaacaccaacacgggggg

SEQ ID NO: 3759 - DNA, 291 bp, Triticum aestivum
  Clone ID: LIB3281-003-P1-K1-F5
gcccgctatcctatcatggctcctcacaccgctgtccttctctccctcctcgggctcaccacctgcgcggcggacacgcatcttcactttttcctccatgatgtggtctccggcagcatccctacggtggtgcaggttatcatgggttctgcctagttgttcatattttttcttttcgtgtattttatttgaattttttattttttttttttgttatatctggtgttttttttgtttgttttattttttttttatttatatttttatgtgtttttttaattttcttttatg

SEQ ID NO: 3760 - DNA, 399 bp, Triticum aestivum
  Clone ID: LIB3281-003-P1-K1-F6
cccccacacacccacacgcgcacgcgtttgacattttccgcccaccaccgccggagggagggagctccagccatggccgccaagtgctacccgacggtcagcgacgagtacctcgcggccgtcgccaaggccaggcgcaagctccgcggcctcatcgccgagaagaactgcgcgcccctcatgctccgcctcgcgtggcactcggccgggaccttcgacgtggccaccaagaccggcggccccttcggcaccatgaagtgccccgcggagctcgcgcacggcgccaacgccggcctcgacatcgccgtcaggctgctcgagcccatcaaggagcagttccccatcctctcctacgccgacttctaccagctcgctggagtcgtcgccgtcgaggtcacc

SEQ ID NO: 3761 - DNA, 397 bp, Triticum aestivum
  Clone ID: LIB3281-003-P1-K1-F7
cggacgcgtgggtggcaaacctgcattctgaatctcaggaagaagtgggtaagcttgttatggatcttcaaaagttaaacgatgagttaagtgaagtgcaggacagcaatctgattgtggaggacttattgtgtgaacttatgaacaccatctctgttttgaataccgagaaagatgcagcacttcttcaactgcagctgtccttagaaagagtaaccgatctgaagtcagaagtctcggagacacagttggaggcagagaaaactgaggagaagttgcaggtactggagcaagaatttgctcagaagaatgtcatggtggattttctgcagtcaagtctgcaagatgagggcaagaaacgtgtggaagctgagacattgctcatgtcaaaagagaa

SEQ ID NO: 3762 - DNA, 390 bp, Triticum aestivum
  Clone ID: LIB3281-003-P1-K1-F9
ccaggattcccaaggtccagcagctcctcagggactactttgacggcaaggagccaaacaagggtgtgaaccctgatgaggctgttgccttctgagctgcagtgcagggaagcatcttgagcggcgagggcggtgactagaccaaggatatgctcctcctcgatgtggcgcccctcaccctctgaattgagactgttggaggagtcatgaccaagctgatccccaagaacacagttatccccaccaagaagtcgcaggttttcaccacctaccaggaccagcataccaccgtctatatccaggtctttgagggtgagcgcagcatgaccaatgactgccgtcttctcggcaagtacgacctttctggcattcccccagcttcaaggggca

SEQ ID NO: 3763 - DNA, 352 bp, Triticum aestivum
  Clone ID: LIB3281-003-P1-K1-G10
ggggggggggggagggggaggggagggggggggggggggggggggggggggggggggagggagggggggggggggggggggggggggggggggggggggggggaggggaggggggggggggggggggggggggggggggaggggggggggggggggggggggggggggagggggggggggggggaggggggggggggggggggggaaggggggggggggggggggggggggggggaagggggggggaggggggggggaagggggggggggggggggggggaaagggggggggggggggggggacggggggggggaggagaggggggggaagggggggggggggggggggggg

SEQ ID NO: 3764 - DNA, 399 bp, Triticum aestivum
  Clone ID: LIB3281-003-P1-K1-H1
ggagagagtccccatctccatctcgctccttatctcttcccttctcataaaccccctccgccgagtcctactccccgtctccgagcacctccgccgagtctagggtttaaccgcccgcctcgtcggcctccgtatcgccaggggtaaggaggaacgggcggtgatggcggcgccgataccccgtgagtgggttggtctgcagcagttcccggcggccacccagaccaagctgcacgagctcctcggcaagctcaaggaggagaatgtgagcacattgacgattctggtgatgggaaagggcggtgtggggaagtcgtccactgtcaactccattgtcggagagagggtcgccaacgtcagcgcgttccagtctgagggtctgaggccaatgatgtgctc

SEQ ID NO: 3765 - DNA, 393 bp, Triticum aestivum
  Clone ID: LIB3281-003-P1-K1-H11
cccacgcgtccgcgaacatgaaccgaccggtcacactgcaatgctgcaacctgatggcgaagctacaaaagtggaacaggagcaactcagtgacacagcaatgctgcaacctgatgatgaaggtggaagagtagaacatgagccactcagcaacgctccaatggtgctacataatgaggaagctagaaatgtaaagcaggaagcactcatcggcactgcaatgccccaaccttacgtggaagatagaagagtaggagcagagccacctagagatgctgcaatggtgcaacctaatgatgaagctagatgcgtaaagcaggagctactaattgacactgcaatgcctctccccaatgaggaggccggagcagctgcaaatcctgtgccattgag

SEQ ID NO: 3766 - DNA, 378 bp, Triticum aestivum
  Clone ID: LIB3281-003-P1-K1-H12
tttagagggtccatatgctgagatccacacaatagaaaatggtccacctccagttattattgatttggaaacttcaaaacccctgaccaagtcaagaaatgcaaaagctgcatcagcggcaagtcgtgaaactaaaatcgttcaagccgtgtagaagaacaaaacacagaagcagtctagacatgacaatgtgccccaagatgtcttccctgcagaggcaccacatgttgatctaatgaagaaccgtgctttggaacatcaaaatatggatgtgtcagaaaagtcaggtggcaccacctagtacaccaatgaccagatatattattcactgcgatcaattcagaaaatacgggatgatcttcttcgcaaggaatgcat

SEQ ID NO: 3767 - DNA, 62 bp, Triticum aestivum
  unsure (1)...(62): unsure at all n locations
  Clone ID: LIB3281-003-P1-K1-H2
gatgacagcaaggaggtgacatcagtaactgaaatgaaaatgttttttagaacagatnncac

SEQ ID NO: 3768 - DNA, 399 bp, Triticum aestivum
  Clone ID: LIB3281-003-P1-K1-H3
ggtttttccagccagcagcatttggctggccgactgcgccgcacgaagggggaaggaagagggctacttggaaaactgggggcggcgcggcgggacggaaagccgaggtaggagagaggaagcagtctcagttctcgatctccgaggttggtggcggcggctagggctggcagccggcggcagaagcagatctgatccgcgggtgtccggcgcagagaggaggctccccggagcttcggccgggccggccatccgattccgcagcccgcctctgcgatggtctctggctgctgactgcagtgatgaattcgaggccgatcgtgctcgtcttcctcctgctcgtgctcatcatatcatcgcagttcgagtggaagcagcagatcggtgaggccgaggcga

SEQ ID NO: 3769 - DNA, 394 bp, Triticum aestivum
  Clone ID: LIB3281-003-P1-K1-H4
cggacgcgtgggaagtgagggacctgaaagcgtcctaccaccaaggaacgttccaccagtcgacagtcgcctgcccgggcttcatggccgcccaggccgtctcgtcgctgcagatccgagaagactcgtcctctccgggccagggagtcgccgccgcgaccgtcgttaataggatgctcggcggcgccaacgggctcaacctttacagggagatgtgaaaaaggaagatatatatatacaaccgacctcgtcgtcatagtggtgttgtacataatagtcacccgaaggtgtgctgactattttgcctgcgtgctggaagctgttccggccatcagattagaatctgatggcgcaacttggttcgcccttttgttttcgtcggtccgtgtgatag

SEQ ID NO: 3770 - DNA, 390 bp, Triticum aestivum
  Clone ID: LIB3281-003-P1-K1-H5
ggagcgtgggcctctagtccaatcccctcgcccacacgctgaacccctccctccctcgatttctctccctcgtcagccgtcacagcagaggccacgaaccctagccccctcccactcaccgcctctcctcccgcttccccaccattgccgcgaattctctaaaggctaccacggatccatgtctatttggagggtacaaggcagggaaggacgccatcgtcggcccatcgcttaggctggcggcgcccggatcgggaagcagcagggttggtgcagcggcaaatgcgagcggagtcggccgtggagggaggtttgccggctagagcagcaggagcaaggaggcgtggtcagccgtgaaggatggtcggagcggcaggaccaacttcagcc

SEQ ID NO: 3771 - DNA, 399 bp, Triticum aestivum
  Clone ID: LIB3281-003-P1-K1-H6
gcgtgcattagcagatggaaatcagtccacaaatgactcctttaagggaaataatgcccatgctgtacctgttgttccatcactattgggactaagtggttttgttcctcctgggcagatggctgggatgcattcatatatgctgcatcctcaaggcattcctcaatctttagcctcacccaactctggtgttcctcaatttggtacttttcagcctacaatccaacccaccatgcactggcctaatcaacaggaagcacaagctgcctcacaaacacctgatgccacaaactatcacccatcacaatcagatcagaatgcattacagccagctgcattgcaaccagctgcattgcaaccagctgctagcaacaatgttgagctgccgtctgggcagag

SEQ ID NO: 3772 - DNA, 280 bp, Triticum aestivum
  Clone ID: LIB3281-003-P1-K1-H7
gcattagcagatggaaatcagtccacaaatgacttctttaagggaaagagggcccatgctgtacctgttgttccatcactattgggactaagtggtattgttcctcctgggcagatggctgggatgcattcatatatgcagtattctcaaggaatttctaaatctttagcctcacccaactctggtgttccgtaatgttggactttttagcctacattccaacccactatgcactttcctaatcaacaggtagttcaagctgttttcacatacacttgat

SEQ ID NO: 3773 - DNA, 382 bp, Triticum aestivum
  Clone ID: LIB3281-003-P1-K1-H8
agaagatcgagcgagcgagaaatccccaatccccaccaaaccctaacccaaaccctaaccctgattgaaacgaccaggagaggagaggagaggagcggatccggcgatggccgtcgagaagatgcacttgtccatgccgttgcccgccggcttggagggtttccccttcaccacgttccaggcggagctggaggccttcaccgtcaagttgagggcggaggcgaagaaggccaaggccaagccggaggtcaaggaggccaaggccaaggaggagaaggccaagccggaggtcaaggccaaggtgaagaaggccaaggcgaaggaggccaagccggaggtcgaggccaaggcaaaggaggccaaggcaaaggaggccaaggcg

SEQ ID NO: 3774 - DNA, 400 bp, Triticum aestivum
  Clone ID: LIB3281-003-P1-K1-H9
ggcaggacccttgctgactacaacatccagaaggagtccaccctccaccttgtcctccgccttcggggaggcatgcagatctttgtcaagaccctcactggcaagacaattacacttgaggtggagtcgtctgacaccatcgacaatgtcaaggcgaagatccaggacaaggagggcatccccccggaccagcagcgcctcatctttgctggcaagcagcttgaggacggcaggacccttgctgactacaacatccagaaggagtccaccctccaccttgtcctccgtcttcggggaggcatgcagatctttgtcaagaccctcactggcaagaccatcacccttgaggtggagacctcggacaccatcgacaacgtcaaggcgaagatccaggacaagg

SEQ ID NO: 3775 - DNA, 389 bp, Triticum aestivum
  Clone ID: LIB3281-004-P1-K1-A1
caccccttctcctcgttgctttcagccggcttgccctcctccctccccagtctcccctcgtcgccaaccccgccaccgccgccgcagttgccgaaacccgccgcccagtccgccaccccgagagaaggaggttctctccttcatcgcccctccgtcctctcctccgccgggctcgcggggagcgaagatccgcccggacacggctcctcttgctgatttcgggggttgttctcttgccgcggcgagttttgaggatgatgagctaagaaggtatagctcgtgcaagccgccgcccctttgttgtttctgataaaccgctgagcaggcgagagtcttgcttgaggtggtagtgagagatggatgcagtgtccgaggttgcggatgccatg

SEQ ID NO: 3776 - DNA, 382 bp, Triticum aestivum
  Clone ID: LIB3281-004-P1-K1-A10
cggacgcgtgggttttcaaaatagcggcacaaagctaggagtgctgaaagctgccaatgagtcattgactcgagtggtagtttatgtttccctaatggcgctttacattcttggtggaagcaaagtcagtgcgggcaagttgtctattggaaccatggcatcttttattggttacacattcacactgacctttgctatgttcatttctcctatccactgagatctgatgtggatgtcttaaatgggcttgatcttgtaattgagtgtggaaaagtcacagcacttgttggctctagtggtgctgggaaaagtacagtggtgcaacttttagcgcggtactatgagcctactcaaggtcgcatcacggtggcaggggaagaca

SEQ ID NO: 3777 - DNA, 386 bp, Triticum aestivum
  Clone ID: LIB3281-004-P1-K1-A11
ggagagtatccacaagtccaaggctgagaaggcaagagagaagaccctctctgaccagttcgaggccaagcgcgccaagagcaaggcaagcagggagaggaagattgccaggagggaggagagattggctcagggcccgagagatcatgcaccagcaccagcggctgcagctcccgctcaggcagcagcggcaccaaagaaggccaagaagtgaaggtctgacatgaagctttagctttctggtactattaagggttagcctaattttggaacatcagaagttcagaactgttttctgtgcaatatcttgtttgtgtcagcgtgtcagataccttaaatatcatatcgtgtttgttctgttggatgtttcagagatgcttatgcag

SEQ ID NO: 3778 - DNA, 294 bp, Triticum aestivum
  Clone ID: LIB3281-004-P1-K1-A12
ggtgtacgttcacacaacggacactatcgccgtgcgcagctagggtctcgcggatccccacccagttagggttgccagccggaccaattcatggccgccgaacccgtcgaggacgcggacccgggcgccgacacaatcatggaccgctcatcggagctgaagcggaagtacgagatgctggccagctgcacgcgcctctaccagacaaatgaccgagcactattgtgttcctctagactccccacacgtgccagttcaactcgctccgggccaggtgccaacatatagagctaa

SEQ ID NO: 3779 - DNA, 389 bp, Triticum aestivum
  Clone ID: LIB3281-004-P1-K1-A2
ccaagaggggtatcctcaccttgaagtacccgatcgagcatggtatcgtcagcaactgggacgacatggagaagatctggcatcacactttctacaacgagctccgtgttgcacctgaggagcacccagtactgctgactgaggcgcccctgaaccccaaggctaacagggagaagatgacacaaatcatgtttgagaccttcaatgttccagccatgtatgtggccatccaggctgtgctttccctatatgctagtggacgcacaacaggtatcgtgttggattctggtgatggtgtcagccatactgtgccaatctatgaaggatatgcccttccacatgccatccttcgtcttgacctcgctgggcgcgacctaactgactgtttg

SEQ ID NO: 3780 - DNA, 251 bp, Triticum aestivum
  Clone ID: LIB3281-004-P1-K1-A3
cccttttcttcccctcgcccccgatcccccaatctcctcctgcggggcgatgcggtggaagctcggcaccgcggcgtacaagcgcgtgccgttccgcgacgccgccatggatcccgacctcgagacgccagagaagacgcccgacggagcaggaggagcaggggcagcaggggcgggcccgtcgtggcgccggtcgctgccgcacgtgtgcgtcgacaccgtcacctccttcctcttcggctaccacacag

SEQ ID NO: 3781 - DNA, 386 bp, Triticum aestivum
  Clone ID: LIB3281-004-P1-K1-A4
tttgttttccagaatccattggctccctaagaaaccttcaagtattgagcttggattattgtggttctctgcatagtcttccttcaacaatgacccagttgtgcagtttaagatgtctttctcttgatggtacaaaaatagatcagattccaaaagggatagcaaaactgaagttcctcaatactttacaaggattccctgtaggtgatggaagtgataatgttaatgtacaagatggatgcaagttggaagacttgtcttatgtgtcgcagatgagggatcttggccttgttaaattggaaagagcagctcattgtgctacaaatgcagtgctgacagacaaaatgcatctaaaaaacctaagtctaaggtggactgaacgtgga

SEQ ID NO: 3782 - DNA, 103 bp, Triticum aestivum
  Clone ID: LIB3281-004-P1-K1-A5
gttctggggttattgtgtgtctctgcatagtctaccttcaacaatgacccagttgtgcagtttaagatgtctttctctcgatggtctcaaaaatagatcatat

SEQ ID NO: 3783 - DNA, 381 bp, Triticum aestivum
  Clone ID: LIB3281-004-P1-K1-A6
taacctctcttgttctgctagaaaacctatctatcatggaatgctttcacctgtgttcttctgcaaatttgacttgctagcttccattgttgattgttttcaaaaagaattgatgatatgttctaagttgatatgtgatttacatgtttccaccagttgaggggaaacattccaagtatccctagggttgtgacaattgataaaatcccatcttaagggttatttttagtttaaccctctggcattggaaatgaccaatttctctagttgttttggtctactctccctctttctagctgtctgtatgtgcagcactaacatagtggcagtgaaagtttactgcacttgtttcttttcttaatcttagattatatgatgact

SEQ ID NO: 3784 - DNA, 395 bp, Triticum aestivum
  Clone ID: LIB3281-004-P1-K1-A7
ccaagaggggtatcctcaccttgaagtacttgatcgagcatggaatcatcagcaacggggactacatggaaaagatctgccatcacactttctacaacgagctccgtgttgcacctgaagagcacccagaactgctgactgaagcgcccctgaaccccaaggctaacagggagaagatgacacaaatcatggtggggaccttcaatgttccagccatgtatggggccatccaggctgtacttgcactatatgctagtggacgcacaacaggtatggggttggattctgaggatgttgtcagccatactgtgccaatctatgaaggctatgcccgtgcacataccatccttcggtttgacctcgttgggcgcgacctaactgactgaccgatgaag

SEQ ID NO: 3785 - DNA, 383 bp, Triticum aestivum
  Clone ID: LIB3281-004-P1-K1-A8
aaagaagaagaacaacaaaccaaaacgaccaaccatcaaatcattatttgagtgtgctgaaagtgacgatcagcctgaaggcagttttttgggtccattgccgcctcagttagagttgcctgagagcccctcacctcactccagtatctcctccgaagattcccaagcacaacacagataacaggtgtgtgttttctggtacccgtctcctgtaaacggaagcagaaaagcataggtggatgtcagtctgctcaagtggctattttaaagggcaaatcttaagagtatctataagtctgtggaatttgctctcgagcagccgtttgaggtgctccaagccattgtgtatgttggagctccaggtcatcctgtacattgttacc

SEQ ID NO: 3786 - DNA, 386 bp, Triticum aestivum
  Clone ID: LIB3281-004-P1-K1-A9
atcctagctagtaggaaactgcatcaggcaggggtagggtaataagttctgttctactgttagatagctagagtttacactccagcatctgttcccatcttatattctgtaggatatctgcatattatattcttctgatacatacattcttcctcgccatcttgacactcctctaatcacaccgacttccctggtgctctgcaaagaacacaaggatctctcctcactggctcttctgtattttttggaatgaagaggccagtggaggttcaagaagccccccttcgatgccctttctccctcatctgtcaactaacttttatctccgcacctcccctcccaccttagtttgttgcatatgtagcatgtcagatcccctcccctgc

SEQ ID NO: 3787 - DNA, 390 bp, Triticum aestivum
  Clone ID: LIB3281-004-P1-K1-B1
cggacgcgtgggttgagactcccttcctggtggtgaccctgggtgagatagagattgttaatctggagagggtgggctttggaacaaagaactttgacatggctatcgtgttcaaggacttcaagaaggatgttctccgcatcgactccatcccgtcaacctcacttgacgcgataaaggagtggcttgacaccactgatctcaagtactatgagagcaggctgaatctgaactggcgccctatcctgaagacaatcattgatgaccctcagaagtttgttgacgatggtggctgggagttcctgaacatggaggcaagtgattctgaggcagaggaaacagaggaatcagaccaggggtacgagccttctgatgctgagcccgagtctg

SEQ ID NO: 3788 - DNA, 380 bp, Triticum aestivum
  Clone ID: LIB3281-004-P1-K1-B10
gcgtcgcactcgcaagaaacagagcccagcaaggaaagcaaaaccaaccccggcgagagaaggaacccccgacatccggcgatggcttcgcaggcgatcgaggagcaccggtcgggcgcggaggtgcacacggagctgtgcgaggccagggcccgcgagttcctcgtcgagctgggcctccccgacgggctcctcccgctgccgtccctcgtggaggtgggctacaaccgcgccaccggcttcgtgtggctccgccagggccagtccggcggcctcacccacaccttcgacgccatcggcaagcaggtctggtacgcgcccgaggtgacggccgtggtggagcgcggccggatgcacagcatgacccgggtcaagagcaa

SEQ ID NO: 3789 - DNA, 332 bp, Triticum aestivum
  Clone ID: LIB3281-004-P1-K1-B11
cggacgcgtgggagaggagagccatggccaaggaggtgagtgaggagccggagcacgccgagccggcgcacaaggactacttcgacccggcggcggtgccgatgttcgacatgggggagctccggatgtgggccttataccgggccctgatcgccgagttagtggtcacgctgctcttcctgtacatcaccgtcggcaccgtcatcggctacaaggtgcagatggcggacgtcccgtgcggaggcgtacgagtgctcggcatcgcctgggccttaggcgacatgatcttggtgctggtgtactgcaccgtcgacatcttggagggccacatc

SEQ ID NO: 3790 - DNA, 376 bp, Triticum aestivum
  Clone ID: LIB3281-004-P1-K1-B12
agaccacgtccgtgctgctcacctggacgctggtcgtcctgggaatgcaccccgagtggcaggatcgggccagggaagaagtcctcagcgtcttcggcaaggacaagcccaacttcgacggcctgggtcgactcaaaacggtgaccatgatactgtatgaagtgctcaggctgtacccaccggcggtcacgctgaaccggaagacatccagacagatgcagattggaggcatcacctaccctgcgggcgtgctgctggagctgccaataatcatggttcaccacaacccggatgtatgggggaaggacgtgctggagttcaagccggagaggtttgcggaggggatttccaaggcaactaaggaccagccggtctt

SEQ ID NO: 3791 - DNA, 392 bp, Triticum aestivum
  Clone ID: LIB3281-004-P1-K1-B2
cggacgcgtgggcactgaactgcgactggaagaagtacctgagatgggttatgatccacttggtgttccttctcgtggtgaaatcctcattagagggtccactgtcttcactgggtactacaaaaatcctgagctcacaaatgaggtcatggttgatggatggtttcatacaggagacattggggagatgaccccagatggaatcctgaaggttattgaccgaaagaagaacatatttaagctatcgcaaggggagtatgtcgcagttgagtatctggagaaagtatatgtcttccctccaatcattgaagatatctgggtgtacggggacagctacaaatcaatgttagtcgcagtagttaacccacatgaagaaaacaccatgaagtggg

SEQ ID NO: 3792 - DNA, 328 bp, Triticum aestivum
  Clone ID: LIB3281-004-P1-K1-B3
catggctccgatcaagatcggcatcaatggtttcggccggatcggcaggcttgtggccagggttgcgctccagagccccgatgtcgagctcgtcgccgtcaacgaccccttcatcaccaccgactacatgacctacatgttcaagtatgacactgtccatggacagtggaagcaccatgaagttaaggtgaaggactccaagacccttctcttcggccagaaggaggtagctgtgtttggctgcaggaaccctgaggagatcccatgggctgctgctggtgctgagtacgttgttgagtccaccggtgttttcactgacaaggacaag

SEQ ID NO: 3793 - DNA, 386 bp, Triticum aestivum
  Clone ID: LIB3281-004-P1-K1-B4
cggacgcgtgggcggacgcgtgggcaaggttggatgatgcaattaagatggccaagggtattcttttggatgagagtattgtatttactgatgaattgaaggcacttctatacggggcattgcagaaagaggggagaaacggggatatgacaaagttgtatgaggatgttgagacggagaaagcagaggctgcagcacgtgcagctgaagagaaggctagggcagaggctcttgctaaagaagaagaggagaagaagaaggctgaggctaaggctaaggaggaatctgctgccagagcaagtagagcagctattgacgcggtgctgggtcgcaagagcggagcagaaaatggtgaatcgtctcaagaaatgagtgttgaggaggca

SEQ ID NO: 3794 - DNA, 133 bp, Triticum aestivum
  Clone ID: LIB3281-004-P1-K1-B5
gacgaaaaaaaaaaaatctaaaataaaaaaaaaaaaaagaaaaaaaaaaaaaaactataactaaagtataataggagaagaagaatgcttaaacctaacgctggggaaaaaaaaaatataatagcttgtttat

SEQ ID NO: 3795 - DNA, 322 bp, Triticum aestivum
  Clone ID: LIB3281-004-P1-K1-B6
gttgcatacacggagagagaaagagaggacgagagatcagcagctgctcgagtagctcgcgtggaggtgtccaaggtgggagacccaagcccaggctagctagccgaccaactgctccaccggagccgatggctggcgccgacgtcgacgtcgggacggagctcaggctcgggctgcccgggggcggcgccgaggcggccaaggccgggaagaggggctatgaggacaccattgacttgaagctcacgcttcccaccggcggcatgcaagaagactccgcaagcaagccggagccggccgccgacaaggccaagaggcccgc

SEQ ID NO: 3796 - DNA, 123 bp, Triticum aestivum
  Clone ID: LIB3281-004-P1-K1-B8
cccacgcgtccgcggacacttggtcagatcaatcaaccatatataatggatgtaaaaaataaagatccgcaaccctatcctgcctgtcatgacgcgcaatgtcttgtcaccgttggctcctgc

SEQ ID NO: 3797 - DNA, 348 bp, Triticum aestivum
  unsure (1)...(348): unsure at all n locations
  Clone ID: LIB3281-004-P1-K1-B9
cccacgcgtccgcggacgcgtgggcaaatcaatcaaccagatttaatagattaaaaaataaaaatccacaaccctagcctgcctgccatgacgcgggacggcgtgccaccggcggcgcctgccggcggcggtgcggnggacgggccgaggcggtgctcgcagtgcgggcaccacgggcacaacttccggacgtgcacggcgcgccccgtgaagctcttcggcgtgcgcatcggcgacaagccaatcaggaagagcgtcagcatgggcaacctcgcgcagctcgcggagggtagcggcggtgccagggccgaggggtacggcttcgagggcgacgatgacaaaccccac

SEQ ID NO: 3798 - DNA, 208 bp, Triticum aestivum
  Clone ID: LIB3281-004-P1-K1-C1
tccacgcgttcgttggaagtggctttgttttttctgcagcagctgctgcagccaccggagctaccggatgtgattctggtgtggacccaaatgtggatccagagttggcacttgccctacgtttgtttattgatgaagagcgcgctccgcaagaggctatcgtgaatgaggctgcagagcacaacttggatcatgcctagcgctctac

SEQ ID NO: 3799 - DNA, 135 bp, Triticum aestivum
  unsure (1)...(135): unsure at all n locations
  Clone ID: LIB3281-004-P1-K1-C12
cttttagcttcgacctcgacgatctcctgctgttccacttcccctagggttcgacagtatttaatatctcatactccaaactcaaccagataccgaaaagagtctcnnncgactttggtagaggggggagaagca

SEQ ID NO: 3800 - DNA, 278 bp, Triticum aestivum
  Clone ID: LIB3281-004-P1-K1-C2
ggaactgctccgatgaaacctgtcacaggattaactgttgctgtcaagacactcaaccatgatgggcttcaggggcataaggagtgggtggcagaagttgatttccttggaaaccttcaacattcacacctagtgaaattggttggttactgcatagaagatgaccaacggttgctagtatacttatttatgccccgcggtagtttgcagaatcattttttcaggaggtcattttcgtttctatgtgctatcagaatgaataatcctctttgtttgtt

SEQ ID NO: 3801 - DNA, 57 bp, Triticum aestivum
  Clone ID: LIB3281-004-P1-K1-C3
cgcccgcagggaccttgccaaaacatcgcgctcgaacagagccaccgaaaaccaatt

SEQ ID NO: 3802 - DNA, 278 bp, Triticum aestivum
  unsure (1)...(278): unsure at all n locations
  Clone ID: LIB3281-004-P1-K1-C4
ccaaancccaagtgnncggggcctccccggcgctccgancctcgccggccggccggcagcccagacccagagccgaatccccgacgcgnctcgccattgccgccgtccccgaccttcttcccggcagggaatggtgcactgcgggcggcggtaggcagacacgagcaggaccgcgggggcaagaagcggtggcggcgagatggtcggcgcggagagggagaggagaaagatgccgttgccgccggcgctgcccctggtcacgctgatcggtcgcgagc

SEQ ID NO: 3803 - DNA, 254 bp, Triticum aestivum
  Clone ID: LIB3281-004-P1-K1-C5
ggctgggcatcgcggggttcagttgttggagaggataagggggacggcagctgcactcggcaccatgggacacccaacgtggttggagaggataaggttgatggctgatttctttgttcgcctttgttgaggtcaatggtttcacatccttcttaatcccttgccatgtggcaataaatcgcaaaagagcagacaccatcctatgctccaccttccatgtacatgtattcttctttgtaccctgaaccgaaggc

SEQ ID NO: 3804 - DNA, 304 bp, Triticum aestivum
  Clone ID: LIB3281-004-P1-K1-C6
cccacgcgttcgcaaatccacgcctgggtgccgccgccgcatacgccgctgctcacgggcggctcgctggcgcgcctccatcttcctcggatgaggagacgtcgatggcgcctgcagcggcgccgttgggtagatcgggggcgagaccggagcgacgactagggcggcggtcgatggcggcgatggcgcgaccgaagaggcggcggcgtccctccatgctcgcggagtcctggcggtgcggtcggtcgaccgtgcgcggggacggtggtgcctcttccggcacggaggcggagacactcggaga

SEQ ID NO: 3805 - DNA, 270 bp, Triticum aestivum
  Clone ID: LIB3281-004-P1-K1-C8
tcaatggctactcacccagcattggcgcgtcatggtaactatgtatttccagctggtcacatggtccagggcaatgcatggactacacaccctgcaaatattattgctgacggagtcccacactgggcatacaacattgcactccacaatccttcaggtcatgaggcttattcaggaacaatgcgcatgccaaatggtagtttttcaagactatcaagctggcccttctgctacttttcatgggccctttccctcaattaaaccaatttt

SEQ ID NO: 3806 - DNA, 246 bp, Triticum aestivum
  Clone ID: LIB3281-004-P1-K1-C9
cggacgcgtgggctgtcgcacttttatgctacgtctgctactctgaagcgggcaccagtcttgtgaatttggttagtcttccgaagcgctatttgtgtggccaacacagcataatatatggatctaggccttatttccaaggttgcactgcggtatagctgaactgtttgagacgcaacgagctgatctgttctggtactgtgtgcttgtttactgaaccaagtggaacggaatgctatttttatt

SEQ ID NO: 3807 - DNA, 392 bp, Triticum aestivum
  Clone ID: LIB3281-004-P1-K1-D1
ccttcctctccacggaccggaacgcgccatgacgagctcctccacgccgtcccgcaaggcgctgagcaagatcgcctgcaaccggctgcagaaggagctcgccgagtggcaggtcggcccgcccgccggcttcaagtacaaggtctccgacaacctccagagatgggtgatcgaggtgggcggggcggagggcacgctctacgccggcgagacgtaccagctgcaggtcgacttccccgagcattaccccatggaggcacctcaggtcattttcctcaacccggcgccgatgcacccgcacatttacagcaacgggcacatctgcttagatatactgtatgactcgtggtcgcctgcgatgactgtaagttcagtctgtatcagcatcttgt

SEQ ID NO: 3808 - DNA, 365 bp, Triticum aestivum
  Clone ID: LIB3281-004-P1-K1-D10
cccactcgtaaggcggatagcaacgccaaaaggatttgcatacacaactccaaaccctacgcgaggcaaggcacggagcagccatggatgcggccatggattccgatgcggtctcgaaggactactaccagaactactactagaccttcgactccaaccgggccgtgctcgaggagctgtaccagcacagcttcatgctcaccttggagggcgagaagttcggcatccccggcaagatcggctgtatgctcttatatctccccttgcagaagagccagaacaagatctgcaccgtctactggcagcactgggggccccagggctgcgtcctcgtcttcatctccagcaccatcagcaacggcccc

SEQ ID NO: 3809 - DNA, 386 bp, Triticum aestivum
  Clone ID: LIB3281-004-P1-K1-D11
cggacgcgtgggagaacggccacttagcagtagccaagccacccacgaccacgcccacgccgacgccgacggaaccgccactgcaaaactgccagaacgtccgcagcgccgatggcgtgttggcggaagaaggtcgtgttccgggcgcgccgtgcgtgggccgccgtctccggccgcctcctccgcggcagcaagtccggtcagtctccctccccgcacccctctccaactcaaccactgtccaggcgtatgttcgtctagaaaaaaacggtgatgatttccggttggtttcttgattggaagcgctagatggccaagattttctctccattttgcttccttcggtgttcctgaaatgaaagaataaacagatgaaatgtgggtct

SEQ ID NO: 3810 - DNA, 385 bp, Triticum aestivum
  Clone ID: LIB3281-004-P1-K1-D12
atccaccaccgagagattccggaataaacccgagagagcccggcgagaagggtcagcgcaaaaaccctagccagctagctccccatggcggccaactcctcctccccgttggccggcggcgacgcgccggccccggcgctgccgccggtgcggctcgcggcggggcaggcggcgacgatccagccctcctccccgcgctacttcttctcctcgctcgccggcaaggacgcctcctcccaccgccgcatcgccatcgccgtcgacctctccgacgagtccgccttcgccgtgcggtgggccgtgcagaactacctgcggcccggcgacgccgtcgtgctccttcacgtgcgccccacctccgttctctacggcgccgactggggct

SEQ ID NO: 3811 - DNA, 286 bp, Triticum aestivum
  Clone ID: LIB3281-004-P1-K1-D2
gctccacccaccccagccggcctcaccgcgcgccaggcagccgctccaccgtgcgtgccaatggcgcccgtccgagcagccctcctcgccttcctcgtggccgcgctgctcccgctcgccctgtcccgcgggcaggggcgtggcccgcacctgccggggcacggactggtgcatcgccaccggcctggcattggtcaccacgcccacacgctcttaggaggtggcgcctgggcctcccaggacgccaccttctacggcggcggaggcccctcctgcaccatgggtg

SEQ ID NO: 3812 - DNA, 241 bp, Triticum aestivum
  Clone ID: LIB3281-004-P1-K1-D3
gctccacctaccccagccggacttatccgcgcgccaggcagtcgatccaccgtgggtgccaatggagcccgaccgagcagacctgcttgccttactagcggcgcgagctgctaccgctcgccctgtaccgcggtcaggggcatggtccgcacctgccgggacagggacgggatcatcgtcaccggcctggcatgcataatcaagcccactcagacttaccaggtggaggttgagtttccct

SEQ ID NO: 3813 - DNA, 299 bp, Triticum aestivum
  unsure (1)...(299): unsure at all n locations
  Clone ID: LIB3281-004-P1-K1-D4
ccctggagcggagcagaacagcccaccgacaggaagcaagcggggcggcatggaggcggaggcggggnctacgccaccacacgacaccgtcggctggtcaaggccttcaaccccaccgtcgagccgcgcaacttcggcatcggcctcgtcgccggattcctcctcgtcacctgcgcatacttctccaccgccaagttcgacgccatccacatcgcgcccctcgtcagccccttggagacccggattggctcgccggcgaccgccgncgncgncggctccaagacccaattagatttggg

SEQ ID NO: 3814 - DNA, 64 bp, Triticum aestivum
  Clone ID: LIB3281-004-P1-K1-D6
acaaggaacatagtacttgaatgtgtttcaaccaagaataataacaaaagaaacatagtacttg

SEQ ID NO: 3815 - DNA, 384 bp, Triticum aestivum
  unsure (1)...(384): unsure at all n locations
  Clone ID: LIB3281-004-P1-K1-D7
cggacgcgtgggcggacgcgtgggggccttcatggcctccgccgacatgccggccttcccctggggcgctgcggccaccccgccgccgccggccgccgtgccgcagcagccggccttcaaccaggacacgctgcagcagcgcctgcaggccatcatcgagggctccagggagacctggacctacgccatcttctggcagtcctccaccgacgccggcgcctcgctcctcggctggggcgacggctactacaagggctgcgacgacgccgacaagcgccggcagcagcccaccccggcctncgccgccgagcaggagcaccgcaagcgcgtcctccgggagctcaactcgctcatagccgggggaggcgccgccgcgcccgacga

SEQ ID NO: 3816 - DNA, 385 bp, Triticum aestivum
  Clone ID: LIB3281-004-P1-K1-D8
gacaaatcacaaagtgcacttgaaaagatatatactttcaacgtaatgaagttcaaggatggtaacaggggagcaatcaatgggatgtggccagatggtacattggacatgtccacaatgcaatctagggagatatggccaggcgtgacatacgcgcttgctgcatctatgattcaagaaggcatggttgaggagggtttcaaaacagctgaaggagtctatcatgctgcctggtcttcagaaggacttggatacgcattccaaactcctgaatcttggaacaatgacgatgagtaccggtccttgtgctacatgcgcccactcgccatatgggcgatacagtgggcactctcaaatccaaagctccacaaggagcctccgacag

SEQ ID NO: 3817 - DNA, 386 bp, Triticum aestivum
  Clone ID: LIB3281-004-P1-K1-D9
acgagtccgtcccagcgggtgacggtttggtatgtctctggcgttttattaggcgactctgtgggaggccgccgccgtcctggttcgtgcgccgccgccgccgcccaccaccgccgacctcctccctcagcagccccacccctcgcagctgagctccgccccttcccccctccctcccaccaccataggccgtgggggtgcggctggggcgcgccgtcgtctcagcaccgacgaaccctaggtcccaagtctctggatctcttggtctagtttgttttctggttcgaggttccaatggagagggtgtcggggttgatggagaagctacggttgtcagaggcagagaagaaaggggtgcgaatcgggtggtcggagggattgaagag

SEQ ID NO: 3818 - DNA, 390 bp, Triticum aestivum
  Clone ID: LIB3281-004-P1-K1-E1
cggacgcgtgggcggacgcgtgggcggacgcgtgggcacagctccatgtctcctgagctcaccgccgatcaccgctgaggcgctgagttgcgccgaccgaaaaagatataataatcctaggcgacttccatcgaccgtatgctgtatggcggcgacggtgaggaagctggtggtggaggtggtggaggcgcggaacctgctgccgaaggacgggacgggcacgtcgagcccgtacgcgcgcgccgacttcgacgggcagcgccgcaagacgcgcaccgtgccgcgggaccttaacccggcatggaacgagccgctcgagttcagcttcccgggccccggatccggcggcatcgaccccgtcgccggcgagccgctcgaggtggccatttt

SEQ ID NO: 3819 - DNA, 297 bp, Triticum aestivum
  Clone ID: LIB3281-004-P1-K1-E10
cccacgcgtccgcccctccacctcctccccagcgtcgcctcccgttcggaaccccaagctcccccgccgccggcgaaatggccccgaagcgaggcggcacggccccggtgccggcgaagaacaaggcggcggacaaggtggtgaacccgctgttcgagaagaggccgaagcagttcggcatcggcggggcgctgccgcccaagaaggacctccaccggttcgtcaagtggcccaaggtcgtccggattcagcgccagcgccacatcctcaagcagcgcctcaaggtgcccccggcgc

SEQ ID NO: 3820 - DNA, 381 bp, Triticum aestivum
  Clone ID: LIB3281-004-P1-K1-E12
cggacgcgtgggcggacgcgtggggtcgtcacactcccccgccttctccgcataccataactagtaatagctccaccgcttgttctgctcctcgtccctttcttgcttgctcgatgcaacggcaggaattgacgacgtggtaagggtctgcgcgtgagctgagctgagctcgtcggaagaatgggagaatttgcggcggcgggcgaggcggggagccaagaagcggagcaagacgagcaggggatgctcgcgacggcgctggacgccataaactctctcatctctgcttccttctacgcgtccctcttgccgctcaagtggcagctcatcacggacaagttcaaccggctccacgccggccttgcggacattaccgtcatg

SEQ ID NO: 3821 - DNA, 321 bp, Triticum aestivum
  Clone ID: LIB3281-004-P1-K1-E2
cccacgcgtgcgattttcccaaccagcagctaatcggcgcacgtgaagcctgagctgagctgagctgtagagcgagcgaccagagcgtagaagaagccatgaggatccagtgcgacgcgtgcgagggcgcggcggcgacggtggtgtgctgcgcggacgaggcggcgctgtgcgcgcgctgcgacgtgcagatccacgccgtcaacaagctggccagcaagcaccagcgccttccgctcgaggacgccgtcgccgtcggcggactgacgcgctgcgacgtgtggcaggacaggccaggcttatttttctgcggggacgaca

SEQ ID NO: 3822 - DNA, 386 bp, Triticum aestivum
  Clone ID: LIB3281-004-P1-K1-E3
cggacgcgtgggctctcactccagagcacttctgtagcaaatggacaacctcaggctgttgcggatccgggctcgatttgcaagcttcaggctgatcttcccatcgccaggagacactcccttcagcgcttcctggagaagcgccgtgacagggtggtgagcaaagctccttacggcgccgggaagccattcgaaggcatgggagcatcttctgggatggaagcggtcgcggagggcaaggcccagtaaccctgaaagaagaaagacggccctgcccctgatgtttggaaggaaaggggcgtgtgttagctgatgtgatgttacaccgtagaatcatcatcgttcgtgacgataataatgatccgacgagaacctctattgtcatt

SEQ ID NO: 3823 - DNA, 384 bp, Triticum aestivum
  Clone ID: LIB3281-004-P1-K1-E4
cactgacagccggtttgccgttgcagagcatgggcatgctgaccctgtcctgggcgctcccggtgttccactcggacgggtgcaccagcttcacctcgttctcgggcgcgtgctcgccgtcgccggtgcaggtgaccatcttctacgtctcgctctacctggtggcgctggcggaggccgggcacaagccctgcgcgcaggcgttcggggccgaccagttcgaccagcaccaccccgaggagtccgtctcccggagctccttcttcaactggtggtacttcggcatgtgctccggcaccgccgccaccaccatggtctccagctacatccaggacaacatcggctggggcctcggcttggcatcccctgcctcgtcatggtcct

SEQ ID NO: 3824 - DNA, 380 bp, Triticum aestivum
  Clone ID: LIB3281-004-P1-K1-E5
cgccaacatgatgcctccactccgtcctatcttataggcgactgccctaatcaccggggcgttatccatttgccatcaaactaatgctttagggactcctcgtaccgaaggcctgcaaataccgaacgacaactacacgtcgaactcgaacggtgatgcgggcgtccgataagcagaagcagcattaggcagggacacaatcaaatttataccatacgttgtgatgatacaaggaaagtaaacatagatgcatattttgttcaacgttacgatacaagggagagttggcctacgtcgtcaactgatctgcggtagcgtggaaggtgagttcaaaagcagcaggagcggctgttctactgctggtcggagggagagcttgt

SEQ ID NO: 3825 - DNA, 344 bp, Triticum aestivum
  Clone ID: LIB3281-004-P1-K1-E7
catcaaacgatataaacatacacctttgcctttgttgagtaacatatatggcagagcatattgtaggatagaaatcataagcctgatcaggacagcatgcctcctgtatatatttacaaggctcaaatggtacatggtggggccccagttgaaaaggcaaagttctgtgacgaactttgttgacccaagcccttgtcttacaccagatcatttgtttccaacagctcatcgctgatcactgccaactgcattggctcggaaaacccttgttgtgaagtgaacgtaccacggttaaacattactgtgatgtattccagtgaaatctaaaactgttaggggcattt

SEQ ID NO: 3826 - DNA, 384 bp, Triticum aestivum
  Clone ID: LIB3281-004-P1-K1-E8
cggacgcgtgggtgttctcccaaatccagccaaaaaacccacccccctcctctcggttcggcgatcggcggcggcggcggcgatgagcgcggtgaacttaacgaacgtggcggtgctgaacaaccctacctctttcgtcaatcccttccagttcgagatctcgtacgagtgcctcgtcgccctcgaggacgatctggagtggaagcttatatatgttggatcagctgaagatgagaactatgatcagcaacttgagagtgtgcttgttggccctgtgaatgttgggacataccgttttgttctggaggccgacccccctgatccctcaaagatccgtggggaggacataatcggtgttacggtgcttttgttgacctgttcata

SEQ ID NO: 3827 - DNA, 285 bp, Triticum aestivum
  Clone ID: LIB3281-004-P1-K1-F1
cggacgcgtgggcggacgcgtgggtccccacctactccctcgccgcgccgccgcgcagccgcgagtgcagcgaacatcggcgccagtgccacgcttatggccgccacctcccattccctcctctctccggcgcccacctcgcccccccgcgcccgcctccccttaccctccgtccgggccggagacccccgccgacgctactttttcccggccggtgcggcacccgcctccttgatggcatgctcatatgccgaggagaagaaaggaaccatgctccggtgcggt

SEQ ID NO: 3828 - DNA, 147 bp, Triticum aestivum
  unsure (1)...(147): unsure at all n locations
  Clone ID: LIB3281-004-P1-K1-F10
cccacgcgnccgcccacgcgnccgcccacgcgnccggancaagagcgcgagcggccgcncaagaggaaccaagcnnacgnacgcgngcacgcgacgncaaaagcacgcaaaagagacaccaaaaggcaaggcacgggccggcggaga

SEQ ID NO: 3829 - DNA, 386 bp, Triticum aestivum
  Clone ID: LIB3281-004-P1-K1-F11
cggacgcgtgggctagccctcccccgcgccgccgccgcaccgtcgtctccaggtaaggaggaggagaggagggcgagatggtgaagcacaacaacgtcatccccaacggccacttcaagaagcactggcagaactatgtcaagacgtggttcaaccagcccgcccgcaagcagaggcgtcgcatcgctcgccagaagaatgctgtgaagatcttcccccgccctacctctggacctcttcgccccattgtgcaatgccagacccgcaagtacaacatgaaggccagggctggcagaggatttacccttgaggagcttaagtccgctggcatcccaaagaagctcgctccgaccattggcatttctgtggaccatcgccgcaagaac

SEQ ID NO: 3830 - DNA, 307 bp, Triticum aestivum
  Clone ID: LIB3281-004-P1-K1-F12
cccacgcgtccgagaatttggtgttcctgtgtgccggtaacagcaacttcaccgtccagctcgagtctttgcagttcaagaaacttcccacacccagaatgaattgctttcatccatttgaaagtgtctatgctgcaggtatctagagttgtattctggttgctgagatgcaggagtgggcttgttgctgaaggtttttccattttgccaacttcgctctgttatctaatttctggacatgattagccaacaggcatgttgaagatacattgactggcttcgattaattagtacttatgttgccgtt

SEQ ID NO: 3831 - DNA, 389 bp, Triticum aestivum
  Clone ID: LIB3281-004-P1-K1-F2
cggacgcgtgggctgcttgcccggcttcttctccactcgatccaagccatctctgctttctccaagctccacttcttcccttggaggatggagggggcaaagaagcaggttttcacgatccaggtggaggatggaaagcccgggaaggatggccggccggcggtggggccggtgttccggaacatactggccaaggatgggttcccgccgcttgatcctgacatgaggacctcatgggatgtgttcagaacggcagcaggcaagtatccagacaaccggatgcttggatggcgtccatttaaagatggagtgccagggccctacttatggaaatcatacaaggaggtctatgaggaagtcctgcaaattggatctgcgctgcagcagct

SEQ ID NO: 3832 - DNA, 388 bp, Triticum aestivum
  Clone ID: LIB3281-004-P1-K1-F3
cggacgcgtgggctgcttgcccggcttcttctccactcgatccaagccatctgtgctttctccaagctccacttcttcccttggaggatggagggggcaaagaagcaggttttcacgatccaggtggaggatggaaagcccgggaaggatggccggccggcggtggggccggtgttccggaacatactggccaaggatgggttcccgccgcttgatcctgacatgaggacctcatgggatgtgttcagaacggcagcaggcaagtatccagacaaccggatgcttggatggcgtccatttaaagatggagtgccagggccctacttatggaaatcatacaaggaggtctatgaggaagtcctgcaaattggatctgcgctgcagcagc

SEQ ID NO: 3833 - DNA, 387 bp, Triticum aestivum
  Clone ID: LIB3281-004-P1-K1-F5
agcatcctaagatgggaaaactgaagaaacgtattcgtccaagtgatattactataaacattgggaaaggcactgcagtcccagagtgtccaatagagggagaaagctggaaagaagtcaaacatgacaatactgttacatggttggccttttggaatgacccgattagccaaaaagatttcaagtatgttttcttggcagcaagcagctcactaaagggacagagtgacaaggagaaatatgagaagtcccgaaaattgaaggatcacatacacaacattcgtgtaaattacacgaaggatttcaagagcaatgatgtctcaaagaagcaaattgcagtggcaacatacctcatagataaactagcccttagggctggtaatgaga

SEQ ID NO: 3834 - DNA, 385 bp, Triticum aestivum
  Clone ID: LIB3281-004-P1-K1-F6
caagacaagacagagcagcgattcgtgggccggctgggacgatgcgaaagatgacggttttgatagttacagccatcacagccccgccaacaagggtgggagcaatcagaatggaactgctggcgggtcatattgggccgacggcggcttccgctgatgttggtctctttgcgagagccatatacttgcagagttgttatatgccagaaaaatgtgagcgtgcggttgtggttcttatttcaggatataccgaagtgttgaagagtaaaagagttttgtttttttgtaagttgtctacaattgttatgcctagcggcatgttcatatggccaaggctcatttgaaactgccatccagctattaagaaatgtcgaattgaaattgt

SEQ ID NO: 3835 - DNA, 383 bp, Triticum aestivum
  Clone ID: LIB3281-004-P1-K1-F7
aaagtactgtcactgacctccaaagaccagcttaaggttgaagtaactacagtgtttggttctgcggcacctcccctcagagtgaatcttgtccaagtcttgggctctgattctaagatcatcaccactgacagcaaggaacttcagtttgacctcgacaacaatgttcattacttggacattactccattgaaaatagatgtcgggaagtactcgctagtttttgagattactcttcaggattcagaacatgaaaccgtttacactactggagggagaaacactgagtctgtcgtcgttacaggactgatcaaagttgacaaggcagaaattggaatttctgagaatgatgctgggagtgcggagtctgtcgaaaagttaga

SEQ ID NO: 3836 - DNA, 390 bp, Triticum aestivum
  Clone ID: LIB3281-004-P1-K1-F8
cccacgcgtccgcggacgcgtgggctccagcaaactcacgccccccaccaccgaagctcccaaccccacccgaagcggcagccatggcccccaaggcagacaagaagccggcggccgagagcaaggtggagaaggcggccgagaagacccccgcgggcaagaagcccaaggccgagaagcggctgccggcgggcaagacggcgtccaaggaggccggcggcgagggcaagacccggggccgcaagaagggcagcaaggcgaagaagggcgtggagacgtacaagatctacatcttcaaggtgctgaagcaggtgcaccccgacatcggcatctcctccaaggccatgtccatcatgaactccttcatcaacgacatcttcgagaagctcg

SEQ ID NO: 3837 - DNA, 386 bp, Triticum aestivum
  Clone ID: LIB3281-004-P1-K1-H10
gccactgcccgcctatctccggccgccaccgccctccctgctccgaccaccgccgggtaagtcctccctcattgccgtccctctgctgtccccttccaaatctgccagtgaccccccaggtcgctgcccaaactgcgccgccccccggaatccccaattcacaaatccagatccggcgtctactccaattccttcctcttcccagcccaatcggatcctcgcaggtatccgagttcaggttgtaattagatttttcttcatatatatatatatacagatctctcagccaggattcgatacggtgcaagtcgacatgtcaaagcgcaagatctcgctccacagctgcagcaccgccgccgcggcggtcgaaatgtcaaagcgcaaaa

SEQ ID NO: 3838 - DNA, 122 bp, Triticum aestivum
  Clone ID: LIB3281-004-P1-K1-H11
cgttaggtttacgggccggtggttatcagggagagcttcctttccaacccggtctggggctactaaggcgccggtccctgccccccttcttttggctgggagtcccagtcgggcacgcccaa

SEQ ID NO: 3839 - DNA, 388 bp, Triticum aestivum
  Clone ID: LIB3281-004-P1-K1-H2
cccacgcgtccgatgacgacgacactggagtgcactcttctcctaatactgccggagttcacgtcattatcaatgatgtcacttctgaagggcctcctaaggctaatgggactgacgttcaaactgaagttgatctgcggctgcctgaaagcgcaccgcattttcaagatttgtatccgtctgaatcacattgtagtggtgatcagcatcaggatgctgaatcacattgtagtggtgatcagcatcaggatgcctccgcttcccattgtcagccagagcctgaagatggtgcaagattcagtccagacttctctgcagatgaaacaagcaagtcaaatgcctccgcttcccattgtcagccagagcctgaagatggtgcaagattcat

SEQ ID NO: 3840 - DNA, 267 bp, Triticum aestivum
  Clone ID: LIB3281-004-P1-K1-H3
cgactacaatccgagacgctggtcctgtcgtactctctgcacggatcagtgctcgccacgacgtcattttcctatacgtccacgtagaaccaaatcggtaaccttagcctttcgacgtcgaaactggaaaagctctggccgtgcgcaaattcatagcgttgcaacacgtgacgctttcgtcagatttacttattgcgaatagtcctgctcagaatgctctatcaaacagtagcgcagactgaatggcggatgggtcgcgtcctgatt

SEQ ID NO: 3841 - DNA, 293 bp, Triticum aestivum
  Clone ID: LIB3281-004-P1-K1-H5
gcgagttatacgcgcgggtgttcaccagggagagctccctcgccaacccctctttccgctaatacggggccggccccgccgccgtgcctttagtttgggagtcccagccgggcaccccaaaggacgccacctcctggtgcaggaaggcgctccccgtcgtcccggacataaccccgccggcgtactacaatgcgcgggccttcccagcctattcgaaccttgcagggattcggatttaaggttgtaagagaatggccgccccctgacacatgaggacctatatgtgctgctgg

SEQ ID NO: 3842 - DNA, 392 bp, Triticum aestivum
  Clone ID: LIB3281-004-P1-K1-H6
cccacgcgtccgggaaagagtccaccacatcaccagcagccaccaccgttcctccgattccacatctgctcgcagctcgaagaggatcgtcagccatgtccgcccctctcgctcgccgcctcacctcgccgcacccgctccccgccatcatccccatccgccccttccgcgcagccgccttcccaaccccatcccgcgccctcaccaagctcccctccgccgccagcgcccgccaccccgatctgctccggatcgcccgccgccagacccatggcgactcctccgccgtcgccggcctcgagcagcgcatcagccgcgtcgaggcggacctcgcaaaccacgtctctcgcctggaggttgatttggcaaacaacaccgcccgcatcgaggtc

SEQ ID NO: 3843 - DNA, 387 bp, Triticum aestivum
  Clone ID: LIB3281-004-P1-K1-H7
ctgacgcgtacgctgaaatagttgcaacttaactgcacacacactgggcctgagactgcgcccaagtgggccgtcaactctgtcatgtaaccggccacgtggcttggagtaacgctcctgattacaaacctcaccatcacactggccatgtttgagggcgcgtgccagatgtgccgacaactttaccagactagtgacgtgactcacacaggggatcactaaggtgctctatagagctgccgctcgtgcttccagacctggccctaggccgggcactggacaagccaatggagtgaccaaacaagtgaccaaaaccgacaccggggctcactgaggggctctgtggaggctgctgctttggatttcgggacggacttgtggctagac

SEQ ID NO: 3844 - DNA, 277 bp, Triticum aestivum
  Clone ID: LIB3281-004-P1-K1-H8
cccacgcgtccgctgaaaagtttttcacataaatgcacacactcagcgcgtgagagtgcccacaactgggcatacaattttgaaatccgaccgggaacgacgcctggatcagagcaccggataacaaaactcaccagcacagtgacaatctttgaagacgatgttcagatgtgccggctattctaccagacttgcgacgggagacagaccttgggtcccaagggtggacgatagagctgccgtattggctgccagaccgggccttaggcatggcaat

SEQ ID NO: 3845 - DNA, 384 bp, Triticum aestivum
  Clone ID: LIB3281-004-P1-K1-H9
ccacgatgccgtcgcacaagaccttccggatcaagcagaagctggccaagaagcagcgccagaaccgccccatcccctactggatccgcatgaggaccgacaacaccatcaggtacaacgccaagcgcaggcactggcgccgcaccaagctcggattctaatccggggatgacggcgatgacacccgttgctgccgacgggagaagggtctagggtacctagggtttatgatgtctcgttgtttttgcatgctagcaagtgactccgggatgccagttttaagatttcgcttgtgttgaaagatattattattattactgcttgtagcctacctgggataccgtcatattttgctgattatggaaccccttttatcctgcttaa

SEQ ID NO: 3846 - DNA, 295 bp, Triticum aestivum
  Clone ID: LIB3281-005-P1-K1-A10
cggacgctgggaagacggccctgcccctgatgtttggaaggaaaggggcgtgtgttagctgatgtgatgttacaccgtagagttacaccgtagaatcatcgttcgtgacgataataatgatccgaccagaacctctattgtcattgttctgttgtcattgtgtagtttaccctgtatctgaacttgttttactcagcggaaccgcactgctattgatgaatatgtcgatgtaaatcgtggctgtcgtgcctgtctgactgatacaattgttttggaggcggtggaatatattacc

SEQ ID NO: 3847 - DNA, 316 bp, Triticum aestivum
  Clone ID: LIB3281-005-P1-K1-A11
cggacgctgggtttttttttattaaaagacacaaaccaggtctcataacatccaggtttcaccaaagcttacattaggacagtatgtaaggcacaagacagacaccaccaagggcacgatatgcagcgctaacagctgaacagctaaaatatacccagtacgaacaatgcccttaacaaaactcagccaatactaaaaactgcttggtgtctgaaacagtgatttggatatcaattgtggaattacttcttcttgatggcagccttggtcaccttggccccgggtgggttcttcttttcaacgcccttgatgacac

SEQ ID NO: 3848 - DNA, 78 bp, Triticum aestivum
  Clone ID: LIB3281-005-P1-K1-A12
cggacgctgggtttttttttattaaaagacacaaaccatgtttaatgacatttaagtttcaccaagtctcacattttg

SEQ ID NO: 3849 - DNA, 391 bp, Triticum aestivum
  Clone ID: LIB3281-005-P1-K1-A2
ccacgcgtccgcggacgcgtcgggagactagcacatgacccagcctcccgatccccttgcagccgtcatcgccgcccgaccatggagtcccggccgccagctccccggagatttccgcctccctaaaagtccagatctccagtccagcgcgccgccacctcctgccccgaacgcctcacctcgcgcctccggtccgccccccgtcgccgcacgccgtcagtccccgccccctgtcgcagcgcgccggcggaccgcctaccgtcgctggctctccccagccctgaggtcacatctctttcgaagatcctctccaactcatagttcctcgcagagggcacccgctcgtaccggcgttttaagaggaggttggtcgccccttcttgcggacgca

SEQ ID NO: 3850 - DNA, 377 bp, Triticum aestivum
  Clone ID: LIB3281-005-P1-K1-A3
gagcactggagcagagaacagagcgagcgagtgagagcagagagcatgggctcaatggcggccagcgtggaggagatcggtgcggcggcggcgccacaggcggtggagcgccgcctgggcgagctgcgggcgaccttcgagagcggcaggacccggcccctgtcgtggcggcagtcccagctgcgcggcctcctccggctcctcgccgacaaggaggaggaggcgttccgcgcgctccacgacgacctcggcaagcaccgcgccgaggcctacagagacgaggtcggcgtgctcaccaagtcggccaacgccgcgctgcgggagatcgggaaatgggcggcgccggagaaggtctgggtgccgctggtggcgttccc

SEQ ID NO: 3851 - DNA, 363 bp, Triticum aestivum
  Clone ID: LIB3281-005-P1-K1-A4
cttgccgtgattgttccaactaacgttgaaagaaggactaactgtccaatgacacccaaaattgcagcataatcaccatcagtggcagcttctggtgatgctagcacaagtctagattgaaatacgttcaagctcttgttttccattgctcccatattgaaatcaggaacaacaacaatgttgaacaaatcaagatcatattcaagaccaaaaacctcctcatcccatttcatagcttctttaagagaatacatagcttgtgatgtcaacatcaaatttggagcagggattcatactcagagtgacacattgctggcggaacatgacacaaatgcggcctatctgcgctcccactgaccagca

SEQ ID NO: 3852 - DNA, 205 bp, Triticum aestivum
  Clone ID: LIB3281-005-P1-K1-A5
gttttgtttttttttttttttttttttttttttttttttttttttttttttttttttttttttttttttttttagggaacaaaagctggggcaattttttcaggggggaaaaaagaatacccccttgggctggccccctagccgaaaaaaaaccgccgggggggcaaccaggaaatcaattcccccccggaggtgcaatccaaac

SEQ ID NO: 3853 - DNA, 363 bp, Triticum aestivum
  Clone ID: LIB3281-005-P1-K1-A7
gaacaatgcgcggtgtcgttcaacgagatcgacaccaactcggtggagcacgcggagacggtcctcaacaccaacttctacgggaccaagctgctgaccgaggcgctcctgcccctcttccggcgatcgccggccaccagccggattctcaacatcagctcgcagcttggccttcttaacgtaagtgcaagcatgttctttcagctcagatggatggtatttcaaagtctgcaaacatgccgttgtgggctcgactagtcgataacacaatcaaactatcaaagtgtgaacgcacgtggctagctacgtatagagacaagataattttcaattctatctcaaaccatatcgcaatcagcaacg

SEQ ID NO: 3854 - DNA, 378 bp, Triticum aestivum
  Clone ID: LIB3281-005-P1-K1-A8
cggacgcgtggcgcgccgccgtcgtcctccgccctcccgtctccgccggacgccacccgtcagattcgtttcgttcgtttaggcgtcactagctgctgctcatttgcggtcggctgactgtggtgtactgaagctgaagcaggagcccccacctccgtcaccggcgagacatggcggcggcggcgaaggaggtggacatgaagaaggtggagcttatgaaggaggtaagagcgcaccaagtggcgatcggcgagctcaacaacctgtcttcatccagggccgcgtaccagaagacctgcaacatcttctttcgcaaggacatcaaatctgccgtggcgtcccaacagaagcaacttgatactgccaaggcaaagctgc

SEQ ID NO: 3855 - DNA, 291 bp, Triticum aestivum
  Clone ID: LIB3281-005-P1-K1-A9
ctcaagccacggcactcacactacactcatccactcacaagctaatctagcggcgtagctcacttcagtccagtcggcatggcggctccgaggggcgcggcactggtgctggcgatggtgctcgcggcgatgctggtggcgccgccggcgacggtgcacgccatatcctgctccacggtgtacagcacgctgatgccgtgcctgcagtacgtgcagcagggcgggtcgccggcccggggctgctgcaccggcattcagaacctgctggccgaggccaacaacagccccgac

SEQ ID NO: 3856 - DNA, 252 bp, Triticum aestivum
  Clone ID: LIB3281-005-P1-K1-B10
cccacgctccggtcggcggagtccggcgcgctgatcgacacgacgggcgtagacattcggctgcccatgctggtgtacgtttcgcgcgagaagagacccgggtacgaccacaacaagaaggccggcgccatgaacgcgctggtcaggacgagcgccatcatgtcgaacgggccctttattctcaacctcgactgcgaccactacgtgcacaactggggggcgctccgcgaagggatgtgctacatgctcgac

SEQ ID NO: 3857 - DNA, 116 bp, Triticum aestivum
  Clone ID: LIB3281-005-P1-K1-B11
ctacgctacgaggactcttggtcggacgcgtgagttaaacaagagaaaagtaaaatcttactagcaagcatgaaattttcttcatttaagaagaaatcaacattttatttattcta

SEQ ID NO: 3858 - DNA, 78 bp, Triticum aestivum
  Clone ID: LIB3281-005-P1-K1-B12
cacgcggacgcgaacgcgacaaaaaggagaaagcaagagccgaaacaaaagaggggggggaaaaaaaggaggggagac

SEQ ID NO: 3859 - DNA, 375 bp, Triticum aestivum
  Clone ID: LIB3281-005-P1-K1-B2
agcgaaacacctctcctcactctcacctccgagaagctccagcggcagccatggccccaaaggcagacaagaagccggcggccgagaacaaggtggagaaggcggcggagaagacccccgcggggaagaagcccaaggccgagaagcggctgccggcaggcaagacggcgtccaaggaggccggcggcgaggggaagacccggggcaggaagaagggcagcaaggcgaagaagggcgtggagacgtacaagatctacatcttcaaggtgctgaagcaggtgcacccggacatcggcatctcctccaaggccatgtccatcatgaactccttcatcaacgacatctttgagaagctcgccggcgagtcggccaagc

SEQ ID NO: 3860 - DNA, 385 bp, Triticum aestivum
  Clone ID: LIB3281-005-P1-K1-B3
cggacgcgtgggcaaaattgcaccagcaacacttggtgagagagaaacatttttaccacgcgcaccaaatttggataatcgtgctagtgctctcctgcaaaaggaatatgccaatctgagtggaaagagctcaaaagccaaaggaggtgctagccaaaaagtcaataatgaaaatggtggtgctcgatcgtttaaaggccggcaaaaagatgcaaaaccacaagaggatattaagtcaaacaaagatgacattaagaaacgcaaggtagtggaagaagctgaagcaagagaagagggtgaaatttcagagtctgaagaacagattaaatatcgtttggaaaaggaggaaaagtggctggaatggtgctctgaagctttggatgaa

SEQ ID NO: 3861 - DNA, 373 bp, Triticum aestivum
  Clone ID: LIB3281-005-P1-K1-B4
gtgcctactactcaagaacatttggggtgatcatgttgcaattgtaaagccaactgatgaggaaccatttgctccaaataatcctaaaggctttgtagggaagacccttggacagccaggcctcaaaaggtctgtacgagttggtgagacagggttcagagaggttgctgcttacctccttgaccatggcaactttgcaaatgttcctccaaccatgctggtcaagatcacacacagtgtgttcaatgtgaatgccactgttggctgcaatcataagatgttccacaacaaatcacaggctgtgagcaagattgcatcattgcagcagttcatccctcatgattttgatgccagcgaccatgggacatcaagc

SEQ ID NO: 3862 - DNA, 152 bp, Triticum aestivum
  unsure (1)...(152): unsure at all n locations
  Clone ID: LIB3281-005-P1-K1-B6
ncgatctttattattttaaaaatctttagcagcagtgccagcaactcatgcagaagatttcttcatagctttatccagcctcacattaaagggagtcgagtgccagtttacccttctgtcctttttggatttgcttgttgaattggggttgc

SEQ ID NO: 3863 - DNA, 377 bp, Triticum aestivum
  Clone ID: LIB3281-005-P1-K1-B7
cacctacgcgtgctctggaaccccagccaggtggtgtttcttgacgacgacaccctcattcgcgtatacgacaacaagaacgccttcgtcccaagcccaagggccaccaccgacaccccagtaacgtcaccaacaccaccgacacccaggcccaaacggcgttcgcgtttccgtcttcggagcccatggtcgtgtacagctccatctggaacgcggacgactgggccacgcgcggcgggctggtcaagacggactggtcgcacgcgccgttcgtggtcaccttccgggacgtgcgcgtggagggcttgtcctgggccggcaacgcctacgacttggactccggcgaagtggcgcgctgcagcggcagctcgtggggc

SEQ ID NO: 3864 - DNA, 368 bp, Triticum aestivum
  Clone ID: LIB3281-005-P1-K1-B8
cgaacccgagtctctcgcacacgcagacgagccagataccgccagcgcagcgcctctcctccctctcgcctcgcgcccgccgcccgccgcccgccggagaggacgccatggcgccggagccggaggacgacatcatggcggagaagaacccgcgccccctcgacgaagacgacatcgccctcctcaagacctacgggcttgggccatactccacgagcatcaagaccgccgagaaggagatcaaggagttggccaagaggatcaatgacctttgtgggataaaggagtctgatactgggctggcttcacctaaccagggggatctggtgtcagacaaacagatgatgcaagaagagcagcctttacaa

SEQ ID NO: 3865 - DNA, 374 bp, Triticum aestivum
  Clone ID: LIB3281-005-P1-K1-C1
cggacgcgtggggattctatccatccatgcatatctggcacgcgaggtttttgtgtggcatctttctgtacataaatcaggtacagctttcagagtagttaatgagtaatgccgtttctaagaaggtaagaggttttcctgtaacagagcaccgactctgacgctactactttccgtcagaagttgggtccgtgtagaagtcggcaggaaaggtggatgagaagtttgcttgagagaagttaatgagtaatgccatttctaagaagagcaccagctgtgacgctactgctcaccgtcagaagatgggtcgatgcaaaagttggaaaggtggatgagagggcttaattactttgcaactttttcttatgagcttc

SEQ ID NO: 3866 - DNA, 337 bp, Triticum aestivum
  Clone ID: LIB3281-005-P1-K1-C10
cccctctcaatctgagatcccctcacgagcccgacccggagccgaaaccctagagtagagcaggagcggcggccatggccatcatctcggacatccaggaggaggaggcgccgccgccgcagcagcaggcggccccggcggcggtcgacgtggacctggaggtcctcgaggcggtgctcgagcgcaagggcggcgcgctcccgttcctccacgcggccatcgacgtcgcgcaccggcgctccgacctcttccgcgacccctccgcggtcggcaaggtcaccgcgatggccgcggggtgcaaggcgcaagtggaggcggaggaaaagaaggccaagga

SEQ ID NO: 3867 - DNA, 375 bp, Triticum aestivum
  Clone ID: LIB3281-005-P1-K1-C11
cggacgcggggcggacgcgtgggcggacgcgtgggggctagcatcagtcagtgctgtccttaaggctctagctgccagctgcccgatgcttcaggttgttgagctcactttcgcattctgcgaacccgactggcctaccgaaataggcttcacacaagagggtattgtgacgctcatccaatcttgcccaattcgctctcttttgctaaatggtgccagcattttgtatgacgaggggatgaagtgcctctcatcctcacagttcctggagaagctcgagctcgtggattgcagatctataactgatgctagtatgaatttcattattcaggctccttgcttgagcaatctcacactccgcaaatgcaagaaagg

SEQ ID NO: 3868 - DNA, 371 bp, Triticum aestivum
  Clone ID: LIB3281-005-P1-K1-C12
cacgcgtacgcgtgggatttatacaccgttttactagatcttgtatatagtactagtagggtgcagaatttgctattctatagccacgcttatatatataagaataagtaattcttgatcctgagccaacctatctctcagtctgatcccactcacgtgttgtaccttgggggctccgaccctccaccgatttatgacaagcgaggttaattttctacgcgactacgtaagtttttcccttttcttacatccccaaaaacggatacctgttttttttgttcacctaatatatcctctccgatccaactctaatccctgcggatatgaacggcagactcactcgcgttagctggcttcggggtggtggtctg

SEQ ID NO: 3869 - DNA, 381 bp, Triticum aestivum
  Clone ID: LIB3281-005-P1-K1-C3
cccacgcgtccgccatgcgtccgcagatatttcccccgaggtcaagtcgtctcgtcccgtgttgcctttctcctcctccccgcattcgccgtctgcggttcgcaccaccggacaagctcacacatcaagacaataaatagagccttgtctgtttggggccaatcaaaccaaacaacaagttcatgtctgatctcgacgtccaggttccaactgcttttgatccgtttgctgaggcaaatgctgaggactccggcgctggtgctggatcaaagaactatgtgcatgtgcgtgtccagcagcgcaacggaagaaagagtctgacaactgttcagggtctgaagaaagactacagctacaacaagattctcaaggatctcaaaa

SEQ ID NO: 3870 - DNA, 379 bp, Triticum aestivum
  Clone ID: LIB3281-005-P1-K1-C4
cggacgcgtgggcgacgacgaggggaagctcgggtcgtcgtcgtccgtcaaggccaagatctaccgcctcttcggccgcgagaagcccgtccactccgtcctcggcggcggcaagcctgccgacctcttcctgtggaggaacaagaagatctctggcggggtgctcgcgggcgccaccgccatctggctgctgtttgaggtcctggagtaccatctcctcaccctcctctgccacggcttcatcctcaccctgggcatcctcttcctctggtccaacgcctctgccttcgtcaacaagtgccctcccaacattccagaggtgaagatccccgaggacctggctgtcaatgttgcccgctcgctgcgatacgagatcaac

SEQ ID NO: 3871 - DNA, 378 bp, Triticum aestivum
  Clone ID: LIB3281-005-P1-K1-C5
cccacgcgtccggaggacctgcattacctctggctggacggcaaccttctcgaggggaccatcccgtcggcgctcgccaactgctccgcgctgctccacctcagcctccaggggaacgcgctccgcggcattctgccggccgcggtcgcgtccataccgtcgctgcagatactctcggtgtcgcgcaacctgctctccggcgccatcccggccgcggctttcggcggcgagaggaactcctcgctgcgcatcctgcagctgggggacaaccagttctccatggtggatgtgcccggtgggctcggcaagggtctccaggtcgtggacctggggggcaacaaactgggcggcccgttccccacatggctcgtcgaggcc

SEQ ID NO: 3872 - DNA, 381 bp, Triticum aestivum
  Clone ID: LIB3281-005-P1-K1-C6
ccgcatgatctggctgcgcgcggggaggagttgtgcttgccaccgggacagacggatccaggcttccgtcgagctcacgcgtcaccatcgccgccaggaggcacaaacggatgaagacgtcgagcgccaccatccgcgccgcttcttctcaacgcctctcttgcgtgtgcgcagctttgaaaggaggtgactaggttggagcggactatgacaaggcatacgaggggttggagcaggactgcaagaccaggtgaggacaagcgttgtttcatatccacctaaatcatcccatggtttgcaaggtctgcttctatgcaaaaagttcttccagtgagcaccctagccaattaattacagttaatcctttatgtctgatttatt

SEQ ID NO: 3873 - DNA, 323 bp, Triticum aestivum
  Clone ID: LIB3281-005-P1-K1-C7
agcaggttaacgtccatcggaaaaagtgcatgcaggagtttgtatgcgcgtgtgcgggcaagccattgcagtcgaacagccgctcgtcgaggtgtggatgccctgcgttgatgcgggtgcttagatcagatgataaagggtggtacatatgcgaacacaaagcagagcacaaccattctgtatcggttaactgtatggagaagttgcactggaaatcacacaggcacatagatagatacactagagacttggtgaaacagctaagagaaaacaatataagcctgagcaaggtttatagtgtggttggcagtttttttggatct

SEQ ID NO: 3874 - DNA, 162 bp, Triticum aestivum
  Clone ID: LIB3281-005-P1-K1-C8
ctagcattagaagatttcgtggaatcctgtgtgtacccggcttcttgcaacacctttgttagtacttggcggttacacacaggattctacaggtgtataagcagattgctggtccgtcatcttacaccctatgcttaagggtgaggcttatgcgcacacaaa

SEQ ID NO: 3875 - DNA, 204 bp, Triticum aestivum
  Clone ID: LIB3281-005-P1-K1-C9
ggagggagccacaccacgccaatgcactgtttattcctgtactggaccggccgccctttattcttgcatgcacacaatagggacgactaacagctgattaccttgggaccacacaagcgcaggcgaacaaaggtgctagaggcccttgccatgggaggagcacgcatggtgatacgttgatgaagacatggacgtttcacaagc

SEQ ID NO: 3876 - DNA, 381 bp, Triticum aestivum
  Clone ID: LIB3281-005-P1-K1-D1
gcatacacctgtagcaaagcccttgatgaaatagctgatatatctgtgccagggtcaaaggatcatgtaatggtgcagggtgagattcttgaaggtctggttgcccgtattgtcagtcgtgaaagttcagttcaaatggaagaggttttgaggaactttccaataccttcattagatggaggtgactctgatttaggaccaagtttacgagacatatgtgctgctaatagcaaattaaagcacttcttgaaaatgttggatcttcaatgtgtccagaccaccgtgattggtttggatacagtggtcttgagccccagtctcgaaatgctgataaatcagttgtcactcatttttttgcaagcacattccacggactatgca

SEQ ID NO: 3877 - DNA, 218 bp, Triticum aestivum
  Clone ID: LIB3281-005-P1-K1-D10
atggcttgctatgttctacatgtgtatacccactgggatagcactgggttatgtttatggtgggttggttgggggtcatctgcactggcgtgctgctctctgcggagagtcaattttgaagcttacctttgccattctgggctgcgagatcaagcccctatacctcaaaggatttactcacaacaaaaacacaaaagagtatggtcaaatgctcagtg

SEQ ID NO: 3878 - DNA, 51 bp, Triticum aestivum
  Clone ID: LIB3281-005-P1-K1-D11
atgaattgtatttaattcatgtgtatacccattgcgatattacggggtgat

SEQ ID NO: 3879 - DNA, 355 bp, Triticum aestivum
  Clone ID: LIB3281-005-P1-K1-D12
gtttgatgatcgcttggagaatgtacggtagacgtaaatgaactgagaggtggacaaagacatgacaaatggatatcgctgaagaatgtcaagaaaggaaggatccacctggctataacgattgaagatgtatcagaggagacggaggcaacaacgagtttggaagaatcaccggcgaaaactgatgtgaaactgccactgcccacctctgctgatagcaagtcggatgctgctaagctgcttgaagaaaggaaagtcataatggatgaagttgagcacattgactttgatggacaagaacaacctggaggtgtatatgtacatcggcctggaactggtgttccccagacatggg

SEQ ID NO: 3880 - DNA, 256 bp, Triticum aestivum
  Clone ID: LIB3281-005-P1-K1-D2
tcggtatacacctgttgcaaagccttttatgaaatagctgatatatctgcgccaggggcaaaggatcatgtaatggtgcaggttgagattcttgaaggtctgtttgccctaattgccagtcgtgaaagtttagtttatagggaagaggtttaaaggaactttctaatactttttttagatgggggggaccttgattaatgaccatattaaccgtacgttttgtccgttaatagatatatatagctactttttgaaa

SEQ ID NO: 3881 - DNA, 377 bp, Triticum aestivum
  Clone ID: LIB3281-005-P1-K1-D3
ctcgtcccccccgccccccaccgcggcctgatccacctcctgccctgcctggccgcgccgcccacccagcttcttccacctcaaggcgacggatccgggcccctgcgcggccacgaccagccccaaccgcgacatccagcggtgacgacccgatccatggcggcgtgctaggagctggatctcgacgggacggcggccgtccatgacgcagcgacgcggggtcgtgctcctcctgaagatcagcccggccggcagcgacgccaaacctcccctaaccccggatccacaccgcccccggcgggaatcaggtggacgcagtctaggtcgatccgctctgtccacggatccggcatctcctgcctcacatccggccgcta

SEQ ID NO: 3882 - DNA, 372 bp, Triticum aestivum
  Clone ID: LIB3281-005-P1-K1-D4
cggacgcgtgggatttatacaccgttttactagattttgtatatagtactactagggtgtagaataagctattctatagtcacgcttatatatataagaataagtaattcttcatcctgagccaacctttctctcagtttgatcccacccacgtgttgtaccttggaggctccgaccctccaccgttttatgacaagcgaggtaaattttctacgcgacgaggtaagttttccccttttcttacgttggcaaaaactgttttctgttcgtggggttagcccactctgcctcctccgatccaactctaaatcctgcggttttcagcggcgactcactcgcgttagctggcttcggtgtggtggtcgacgactc

SEQ ID NO: 3883 - DNA, 381 bp, Triticum aestivum
  Clone ID: LIB3281-005-P1-K1-D5
ggctccaggaagcgctccagcccagatcgacaccgcctcccccttctccccacaccgccgcgcgatcccatctgacgccgccccggccgacgaccccagcacgccggccgccatggcgcacggcgaccgcatgaccaccttcgaggagggcgagcgcgagagcgagtacggctacgtccgcaaggtctctgggcccgtggtcgtggctgatggcatgggcggtgccgccatgtacgagctcgtccgtgtcggccacgacagcctcatcggcgaaatcatccgtctcgagggcgattcagctacaattcaagtttacgaggaaacagctgggctaactgtcaacgatcccgtgttgagaacgaaaaagcctctttcatgtga

SEQ ID NO: 3884 - DNA, 378 bp, Triticum aestivum
  Clone ID: LIB3281-005-P1-K1-D6
cggacgcgtgggcaagatcagtttgtgatccgtgctggaacgtttactgaagtgtactggaacgatgccagacgggcaatgcctgagcttgtgtaccaaaagcagtactggacggatagttatatccaatggtcccctcttggaacacacttggctaccgtgcataggcagggcgcacaggtgtggggtggtgatgataagtttgttcgtctaatgcgctttgctcatccacaggtgaaactcattgatttctctcccggtgagaaatatttgatcacttacagcaggcaggagcccagcaaccctagggacacacatagggtcgtactaaatatctttgatgtacgcacttgaaaagtgatgcggtactttaaggga

SEQ ID NO: 3885 - DNA, 149 bp, Triticum aestivum
  Clone ID: LIB3281-005-P1-K1-D7
cacaatttcaccagcccccctaccaccgcactcgaaaacctctcggtgtctcactccaacagtttgcaggaaagacagggagtagatctatcttgcgtcgccaagatgttcattgagagctacctcttggatagccctaacgtgcggta

SEQ ID NO: 3886 - DNA, 376 bp, Triticum aestivum
  Clone ID: LIB3281-005-P1-K1-D8
gtggaagctcgcgttctcttgcttgtttcccaagaagaagaaggagaagagcggcgtctgatctcgtcagcggcgatggcggcgattcggcgtctgatcccgtccttcaaccgggtgctggtggagaaggtggtgcagcccaagaagagcgccggcggcatcctcctcccggagacctccaagcagctgaactctggtaaggtgatagctgttggccctggcagccgtgacaaggaagggaagctgatccctgttgctctcaaggaaggggaccatgtgctcctgcctgagtatggtggtcttgaagtcaagcttgctcccgagaaagagtaccttctctacagagacgacgacattctgggcaccctccacgagt

SEQ ID NO: 3887 - DNA, 374 bp, Triticum aestivum
  Clone ID: LIB3281-005-P1-K1-D9
tgggcctatgggcccgttagtcttagggttaattagagataagggtcgtttgcttaggggtcaagtaagccttgcttggaagtcaagtaaacctctatataaagagaggagatgtatcaatctaatcaagcaagaattaagaaggaaatcccttccctcttgcccggccgtgggcaaaaagacccccggccggccctctcgcgccctccttctagcagcgccataacacatacccattcatgctttcccatgtaattttaatttgtattacgtttgttgatcaatacagtactataatagtgattttttgtaggagatgctggtcgtatttgctttgtctcaggtcgtctatgcggcctgcattttcattggat

SEQ ID NO: 3888 - DNA, 340 bp, Triticum aestivum
  Clone ID: LIB3281-005-P1-K1-E1
cgcgccggtggtcatggcgacggcgacggcgacggcgagctcttcgactgcgccatctgcatggagacggtgcccggcgtccgcaagttcagcgtcggctcgtgcggccacgccttctgctcgggctgcgtcgcccagtacgtcgctgctaagctgggcgagaacgtcgctcgcgtcaaatgccctgaccccagctgcaagaacggcgccgtcgagccggagagctgcttcggcatcatctcctcggacctgctcgacaagtggggtttcctgctgtgcgagtccgcgctcggcggcaagaagatgtactgcccgttcagagaatggtaggcgcctcttt

SEQ ID NO: 3889 - DNA, 374 bp, Triticum aestivum
  Clone ID: LIB3281-005-P1-K1-E10
atttgtgttcagggcatgattcaagacccagaccactttttcagaattttctgcctgaagaagtagaatcacctttatgctctagtagtgacaagaaagcaagtaggcagctcttgagtaatccagcattttgcaatatgttcaaggcatttgtaaaagaatggttagaactaagaccaattgatcagaggaaactcctgggaaagccgttacagcttccattgagccttgagttgtgctatttgacaaatagcatcagccacagtacacaaggattgattaaaggggggagtaagaggcgtatagctccattgagtgttgtcagtgatgatttgcctgaaaatgctgaatggagaaaggtggttttacgtcgt

SEQ ID NO: 3890 - DNA, 362 bp, Triticum aestivum
  Clone ID: LIB3281-005-P1-K1-E11
acccacgcgtcgcggcgggtcggcgctcccaccaagcagcagtggacaccggcggtttgcgcggcgcggcggcggggagcggcggcagaccggccgtgcggcggcaggccatcgggctccgtcaaggttgctaaaatggataagctcaagggctctgcgcgtcttatgattgtttcagatctcgatcacacaatggttgatcatcatgacgaagagaacttgtctttgcttaggtttggggtcctttgggagtctgtttactgtcaggattctcttcttgtcttttcaacaggaagatcacctactctgtataaggaattgaggaaagagaagcctatgctaacttcagacatcactatttt

SEQ ID NO: 3891 - DNA, 307 bp, Triticum aestivum
  Clone ID: LIB3281-005-P1-K1-E12
cccacgcttcgaacatattatgatactgagagagagagtgctttgcccagtgtacgaccgatacatgcgatacatacgaagccaagttctaccatagtggacatgcttattttgcttagaagttatgcttgtgttctgaacggaaaggccgaacctaacctagcatgatctggtgcgtgccttcttgatcctggtggctacttaattgtgaatggaaccgacaaggtcatcctaatacaacaacagttattaatgaatcgtgtctattatcgacactgattttaaaggaagggtaacttcttttttt

SEQ ID NO: 3892 - DNA, 358 bp, Triticum aestivum
  Clone ID: LIB3281-005-P1-K1-E2
cggacgcgtgggccaagtacatccattggccacccacccacccacacacgacctacacccccactccactgcacgagtagctagctagccagcaagagagtcccagggggcgaccagctgccactgctcctcccctagaggcactcaggcgagctaggctgcctgcggcggcctgccggtacgcggggagaaggccaagaggctcgtgaggacaatgcatggcatgtgttaacatgtacaacccggagcaccaccagtcgtccttcatggcgccgcggatgtccttctccagcgacttcgcgctggagccgccgcccgcgtaggtgctgacagcgcgcgggcccggtgacgccaactt

SEQ ID NO: 3893 - DNA, 379 bp, Triticum aestivum
  Clone ID: LIB3281-005-P1-K1-E3
cggacgcgtggggagtccgtcccagcgggtgacggtttggtatgtctctggcgttttattaggcgactctgtgggaggccgccgccgtcctggttcgtgcgccgccgccgccgcccaccaccgccgacctcctccctcagcagccccacccctcgcagctgagctccgccccttcccccctccctcccaccaccataggccgtgggggtgcggctggggcgcgccgtcgtctcagcaccgacgaaccctaggtcccaagtctctggatctcttggtctagtttgttttctggttcgaggttccaatggagagggtgtcggggttgatggagaagctacgggtgtcagaggcagagaagaaaggggtgcgaatcgggtgg

SEQ ID NO: 3894 - DNA, 318 bp, Triticum aestivum
  Clone ID: LIB3281-005-P1-K1-E4
ctcaaattttgggggggtttgtttttttaaagagttataagagctaaggaaatcccgcccacttttttttaaattggaagggtgaactcaccggaaatgttgagttattaagagggctcacaaccctcggttggtggaaaaactctccatacctttaatgtgttgggggggaattttgctttttttgacaatatataagcaaagagaccttgtaacactatacaagggcttgagtgggactttaataattaccttttacaagatatggaagtgatttgatatttttctttaaaaggttttttacttgagttgttttat

SEQ ID NO: 3895 - DNA, 380 bp, Triticum aestivum
  Clone ID: LIB3281-005-P1-K1-E5
gcagctcaatgagccgccaagctctcgatgctcaggaatgccacatggacactctccaacttctgccgtgggaaaccacagccaaactttgaacaggtcaaaccggctctctcagcactgcagcgccttatccactctcaggatgaggaggtgctcactgatgcctgctgggctctctcgtacctgtctgatggaactaatgacaagatccaatctgtgattgagtctggtgtttttcctcgccttgtggagcttctcttgcacccttcggcttctgttctcattccagctctgcgcacggtgggtaacattgtcactggtgatgatttgcagactcagtgtgtcattgatcaccaagcactttcctgtctcttgaacct

SEQ ID NO: 3896 - DNA, 382 bp, Triticum aestivum
  Clone ID: LIB3281-005-P1-K1-E6
cggacgcgtgggggtaacgacagcaatgccgacagccaagggaggaattggaaggattcagttcactatagcaccgctgccatcattgttgtgatgagcgccttggcgctgctgcttccgtgtggtggcgctgttcaacgtccgctacaaaaccaaccaggatgagctcctctccttgcctccggttctaacatacatgcagcaatcaaaataaatggctatgaatgagaaagataaacttgcaaagataattcatttgtttagaactcaagaagaaatagaaaacttgaggagttgaagttccttctcgtttgctcattttcggtggttcaggcacgtgtcgttgatgttggtcaagccagtgccctcctcttgaactaat

SEQ ID NO: 3897 - DNA, 378 bp, Triticum aestivum
  Clone ID: LIB3281-005-P1-K1-E7
ctctctcccgccccgctccgtcctcccctcctagggttcgacgccctcgccagcccgcggcgaagccaccgcccacctcgccggcggcgtccgcggccaggaagatggctggcggctttcgggtgctacatcttgtcaggcccttcttggctttcttgccggaagtgcagagtgctgacaggaaaataccatttagagaaaaagtgatctacaccgtcatttctctcttcattttcctggtgtgcagtcagctcccgctctatggcatccattcaaccactggagctgatcctttctactggatgcgtgttattcttgcatcaaaccgtggtactgtcatggagctgggtattaccccaattgtgacatctggaatgg

SEQ ID NO: 3898 - DNA, 374 bp, Triticum aestivum
  Clone ID: LIB3281-005-P1-K1-E8
gccgctcaacgtcggcaagtcgtcactgctctttatgaaatccgctgaccacctcgacgccgaagagccgcaggagccccaggagccgcaggaggtgctggtaaagctccccctcgaccggctcttcctgccaccgggggcgagcgtgaccccgggggacgaggaggtcgtgaccgcgcgtgtcctcaagggttccaacatcgtgctgggcacgtacgcgcggggcgatgcgcaggtggttaacgcggatttcataaagagcagcgtgcgacccgatgactgccccagggatgggctgcccgagttcgcgctcgtcggccgctccaacgtcggcaagtcgtcactgctcaactcgctcgtccgccgcaagcgcc

SEQ ID NO: 3899 - DNA, 370 bp, Triticum aestivum
  Clone ID: LIB3281-005-P1-K1-E9
cccacgcgccgacaacatccagaaggagtctacccttcaccttgtcctgcgtctccgaggtggtatgcagatctttgtgaagaccctcaccggcaagaccatcactctggaggttgagagctcagacaccattgacaacgtcaaggccaagatccaggacaaggagggcattccgccggaccagcagcgccttatctttgctggtaagcagctggaggacggcaggacccttgctgactacaacatccagaaggagtccacccttcaccttgtcctgcgtctccgaggtggtatgcaaatctttgtgaagaccctcaccggcaagaccattactttggagggtgagagctcagacaccatcgacaacgtt

SEQ ID NO: 3900 - DNA, 378 bp, Triticum aestivum
  Clone ID: LIB3281-005-P1-K1-F10
cccacgcgtcgcatgaatatacaagttacacaagaaaaaacgttgtttgtccactcattatagtactagtgtttggtagagctcatacaagggtatgagcaatacaacaatgtctggaatggacatgcaggaatataacaacatagcccacagcaaagggtacaggctatacaatcataacatagtttttccactaggtacagagtaggtatttaaactggacacaaatagcccctgtgatgattgagtagatacagagtaggagtatgtaggacttgatcatgaggtaatatgaaaatcaactaaacaaagcaaaaaggtattttggagcatcttgaactccttgacacaactgtaagtcaaaatcgaaagtctaga

SEQ ID NO: 3901 - DNA, 376 bp, Triticum aestivum
  Clone ID: LIB3281-005-P1-K1-F11
cccacgcgtcgggcgtcaccgccgccgccgccgccgaagcttccgatccccggtcgccgcaacatactcatcaccagcgctttgccctatgtcaacaacgtcccgcacctggggaacatcatcggctgcgtgctcagcgccgacgtcttcgcgcggtactgccggctgcgagggtacaacgccatctacatatgcggcaccgacgagtacgggacggccaccgagaccaaggccttggaggagaagtgctcacccaaggagatctgcgacaagtaccatgttatccatgacgaggtctacaagtggttcgacataaagtttgacaagtttgggcggacgtccgctcctgaacagacagaagtctgccaggcaattt

SEQ ID NO: 3902 - DNA, 121 bp, Triticum aestivum
  Clone ID: LIB3281-005-P1-K1-F12
cggacgcgtggggtggactctttgggctgctggatctctgtccggccgccttggttatcttcctgtgtctgctgctatcttaccgtttgaatgagatgaactccgctatgaattatccatt

SEQ ID NO: 3903 - DNA, 345 bp, Triticum aestivum
  Clone ID: LIB3281-005-P1-K1-F3
cttctcctcccctccggttcgggttcgggttctggttcggttcgggtccgagagtagctagcctagtctagggtttccgtagagaggaggaggagaggaagagagagatccatggcggagacggagtaccgctgcttcgtgggcggcctcgcctgggccaccgacgacaacaacctccagcaggccttcagccagtacggcgagatcctcgacgccaagatcatcaacgaccgcgtgacggggaggtagagggcgttcagcttcttcacgttcggcagggcagcaatgatgaccaattccgtcgaggccttcaaccgcaaggcattggaagggttcaacattttc

SEQ ID NO: 3904 - DNA, 305 bp, Triticum aestivum
  Clone ID: LIB3281-005-P1-K1-F4
gccacgcgttcgtgagccaagcatggtgacccctggtgccgagtgcaaggacagggccacccccgaggaagtggccagctacaccctcaagctccttcagagaaggatcccccctttcgtccccgggattatgtttttgtctggcggtcagacggagggggaggcgacgctttacctgtacgcgatgaaccaggcgccgaacccgtggcacgtgttctttttctacgcgcgggcgctccagaacacctgtctcaagacatggggtgggcgggcggagaacgtggccgcggcgcacgaggcgcttt

SEQ ID NO: 3905 - DNA, 383 bp, Triticum aestivum
  Clone ID: LIB3281-005-P1-K1-F5
aagacgcccgaggagccgccgccatcaccatcaaatcagggctggacctcaactgcggcaacttcctggcggagcacacggtggcggcggtgcaggccggcgagctgtcggaggaggacgtcgaccgggccatcaccaacaacttcatcatgctcatgcgcctcggcttcttcgacggcgacccccgggagctcgccttcggcagcctcggccccaaggacgtgtgcacgtcttccaaccaggagctggcacgcgagacggcgcgccagggcatcgtgctgctcaagaacaacggcgcgctcccgctctcggcgaagtccatcaagtccatggccgtcattgggcccaacgccaatgccagcttcaccatgatcggcaactac

SEQ ID NO: 3906 - DNA, 383 bp, Triticum aestivum
  Clone ID: LIB3281-005-P1-K1-F6
cttttccccaagctgaatctgacccaacggcgaacgcggctctagacccagagtagtctaccaccgccgtgccctacagtttccgccgtgccgcatcctacgacaccaccgacgcctcaccagccacccccaacactccgcctctcacgcgcgtcaccgccgtcgccgtccccgttccacctcatcgccccccctgccgccccccaccccgtccgcgatcttggacggcattggttcctgagttattatcatggcagcaatgaatagtgatctgggtggcttaggtcctaggcctgcaaatgcaccaccaaatccttttgaaagtgccatgtatggtgctggacctggacttatccgtactggacttggagcatatggagagg

SEQ ID NO: 3907 - DNA, 379 bp, Triticum aestivum
  Clone ID: LIB3281-005-P1-K1-F8
gcaagaagagtctttatagctaaactaatcccctctggccctgcctcttcctcctcatcacttcgcctgctgcccacccagcgacccggagagagacgccgaaacctagcgacgccgccgacgacccccccggatccgccggccatggcgacccccaacccgccgccgccccagcaggacgagccctcctcctccgccgatcccaaggcgaagaaggactactcgacagcgatcctggagcggaagaagtcccccaaccgcctcgtggtcgacgaggccaccaatgacgacaactccgtcgtcgccctccaccccgacaccatggagaggctccagctcttccgcggcgacaccgtcctcctcaagggaaaaaagagga

SEQ ID NO: 3908 - DNA, 360 bp, Triticum aestivum
  Clone ID: LIB3281-005-P1-K1-F9
gtgctgccccgctgacctgcggccaccgacggcgagtggaggcggacgacgggttcccgccgcgggctcttcggcggcgccgcgtcagggctcgcgcgggctggtgctgatttgagggagattcggggccggggccggagccggcgcggcctctggggatggggtggctttcctgctgcaagcggtcgaacggggcccaacccggcaggaagaagaagaaggacacgacatggcggatcttctcactcaaggagcttcagttggcgaccaacaatttcaactacgataacaagcttggtgaaagtggatttcgcagtgtctactggggccagctcttggacggatcacaaattgcggtga

SEQ ID NO: 3909 - DNA, 375 bp, Triticum aestivum
  Clone ID: LIB3281-005-P1-K1-G10
cccacgcgtcgcctgaagaaggtcggttacaaccctgacaaggttcccttcgttcccatctctgggttcgagggcgacaacatgattgagaggtccaccaaccttgactggtacaagggccccacccttcttgaggccctggaccagatcaatgagcccaagaggccctccgacaagcccctgcgtcttccccttcaggacgtgtacaagattggcggcattggaactgtgccagtggggcgtgttgagactggagtcatcaagccaggcatggttgtcacctttggtcctactggcctgaccactgaggtgaagtctgtggagatgcaccacgagtctctcctggaggcgcttcctggtgacaacgtcggcttc

SEQ ID NO: 3910 - DNA, 378 bp, Triticum aestivum
  Clone ID: LIB3281-005-P1-K1-G11
aaaggtaatcaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggaggcgagtccatctacggcgagaagttcgccgacgagaagttcgtccacaagcacaccaagcccg

SEQ ID NO: 3911 - DNA, 342 bp, Triticum aestivum
  Clone ID: LIB3281-005-P1-K1-G12
acgcagacgcgtgggttgctgattactgctgcactactgctgctgaatagtattagtgctactagtttgtttgggtcatgtttaattatgggttgattcgtgtcgcttatggtaatcctagaccattattagtacttattatgtgattggaatcttgcctatcgtgtcctgcgctcctacccagtggatatggataagaacaatgttattgatgtgggggagcacagcggattgtgcctatctttcggctgatattgaataccatcttgtcatgggacctatatatgtatgcatcaaattatttagctatacggtgctttggcaagggctttgttgaatttt

SEQ ID NO: 3912 - DNA, 182 bp, Triticum aestivum
  Clone ID: LIB3281-005-P1-K1-G3
aaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaa

SEQ ID NO: 3913 - DNA, 375 bp, Triticum aestivum
  Clone ID: LIB3281-005-P1-K1-H1
gcagctttgcgtcgaggcgaggcgaggccgctccgattcgacagacgcagggcagggatggacgccttctactcgacctcgtcggcggcggcgagcggatggggctacgactcgctcaagaacttccgcgagatctcccccgccgtgcagtcccacctcaagctcgtttacctgaccctatgctttgccctggcctcatctgccgtgggtgcttacctgcacattgccctgaacatcggtgggatgctgacaatgcttgcgtgtatcggaaccattgcctggatgttctctgtgccagtctatgaggagaggaagaggtttgggctgctgatgggtgcagccctcctggaaggggcttcggttggacctctgatt

SEQ ID NO: 3914 - DNA, 345 bp, Triticum aestivum
  Clone ID: LIB3281-005-P1-K1-H10
tcgaggacgcgtggttcctccctactgctcctcctcctagtagccagtctttccactccggcgtgcgcgacactgtctatcaccaccatagtgatgccgcagctgagatctgctgatcccaagcgccgccaccctcgtacccgacccctagctctttgttcgtcggcgaccgaatccaacgccaggaccccgtcacccctctacacttctttcccaggacatctgcctcttgcttatttatgtgcttgtcccgctgactgtcatctccctctatctctcttcctctatggtacagactcacagggtggccgtcatggacgcccgaggtcctccgctccgaccctc

SEQ ID NO: 3915 - DNA, 277 bp, Triticum aestivum
  Clone ID: LIB3281-005-P1-K1-H11
acgcctactcataagtggatcgtgctaactctcccaagagcagtggtgttctctggcgtggctcatgaagatgtaccactatttatgaagcccccatggactagtgctcccagggccctggtgatggctgcagtgcgaaagcaacagagagcctttgtacgagaagcatggatcaaaagcataccatagcattttttttcgtcgacagaattatttcccaacgtcagtaggggaaagctaacatatgtttccaaaattttcacggataagcttgtaa

SEQ ID NO: 3916 - DNA, 370 bp, Triticum aestivum
  Clone ID: LIB3281-005-P1-K1-H2
cccacgcgtccgttcctcaatcctcatcatgagattaacttgtagaagaatctattcataaccttatgatgtgtgtgatgttgggttatgttgaaaggctttttttttgccttgcttccattttcttccatgtgcattgactaaacatatgtttgaaaatgtggcatggtcaaacatttttttgccttgcttccatcttcttccatgctgatcaatagcgctttttcttgggccttgctttgagagggccgctggtcgaggccatttcggtcatttttccgtctgatacataggtcaaacctagaaggatttacactctctcgtcgacgttttcttttcttgttgcaccggtgtggcatcgcctttggac

SEQ ID NO: 3917 - DNA, 323 bp, Triticum aestivum
  Clone ID: LIB3281-005-P1-K1-H3
acgcccacgcgtccgttcctcaatccttatcatgagattaacttgtagaagaatctattcataaccttatgatgtgtgtgatgttgggtccatgttgaaaggctttttttttgccttgtttccattttcttccatgtgcattgactaaacatatgttcgaaactgtgtcatggccaaacctttatttagtcttgctttcatattcttccatgctgatcaatagcgctttttcttggtccttgctttgagagggcctctggtcgaggccattttggtcatttttccgtctgatacataggtcaaacctagaaggatttacactc

SEQ ID NO: 3918 - DNA, 329 bp, Triticum aestivum
  Clone ID: LIB3281-005-P1-K1-H4
acccgctgagtttaagcatataaataagcggtgaggcggatcttgaggaggcggcagcggcggaggtgggtcaagaggaggtggcagcggcggcggcgggtcctgcggtggcggatcgggaggaggcggatcaagcgggcgcgcgcggtgccccatcgacacgcttaagctgggggtgtgcgccaacgtgctcaacgggctgatcaacctgcagctggggacgccgccgaagcagccgtgctgctcgctaattcaggggctcgccgacctggaggcgggggtgtgcctctgcacggcgctcaaggccaacattctgggcattaacctta

SEQ ID NO: 3919 - DNA, 330 bp, Triticum aestivum
  Clone ID: LIB3281-005-P1-K1-H5
cctactcataaggcgagggtccggcctcgttttcggccacacgtgcggctatgctttctatatgaatatgtatgaactattgctgaatcacctattgactggtgctgagagacccgtcatgttggcatgatcgagccctcataatcgccactttttttcatgtggtgtggaacaaaccctaccgcgtttaaaaattgaatctcgcgaatgattttatgtttaccacaagtctggcctatcattggcatgatgtgtttttagttcagacggagagccaaaattgagccgtgtatcttatcaaaggctttgcttgtgggatttacatgggca

SEQ ID NO: 3920 - DNA, 342 bp, Triticum aestivum
  Clone ID: LIB3281-005-P1-K1-H7
gcggaagagaagaagaagctagaggacatgggggcgcagagagctctcctcgcgagcttcctgctcgccgcgttggccacccaggccttcgtctccgtctcggccaggaccggcccgacggacaaggcaggccaagatgacgtgaagaagccggactgcgtgccgtcgctcgacccgcacaatttccccggccacgggggcaccaccgtgccgcttccctcgcacggaggctccttcggcacgcccccctaccacggaggcttcggcacgacgccgtcgcacggtggcttcggctcgactccgtcgcacagcggctctggttcgttgcctgacccgtcgcac

SEQ ID NO: 3921 - DNA, 370 bp, Triticum aestivum
  Clone ID: LIB3281-005-P1-K1-H8
gtttagagcttttgtttggcgtttctctcggccggataatagagaaaaagagacttacgcagggtatgttttctctctctaacaataattaaattttgtactaagaaaactcgttagatgttcttactgcttgatctcacatcatatttacgtgctaagaaatgagttgtaactgaaacaataatgttaatttatgtaattatatactgtgttggatattagttttttataaaattaattccgtgttcaattggtttttctttttgtgtgtcaagaatttttttacaatctgtaacatgagtaatttttttgacatacataaatatatatatttttgtatacgtggaatatattacaagatccatcataa

SEQ ID NO: 3922 - DNA, 352 bp, Triticum aestivum
  Clone ID: LIB3281-005-P1-K1-H9
gtttagagcttttgtttggcgtttctctcggccggataatagagaaaaagagacttacgcagggtatgttttttctctctaacaataattaaattttgtactaagaaaactcgttagattgttttactgtttgatctcacattatagttactggcttataattgagtttgtactgaaacaagtatgttaatttatgtaaatatcaaaaagcttgtaattctattttatagtttttttatgagaatatatatttggcttttttttatggtaggcatggaattttttttccatttcttttaaattgcttttaatttttgtttgcatctcctttaaaatattattgttttttttt

SEQ ID NO: 3923 - DNA, 404 bp, Triticum aestivum
  Clone ID: LIB3281-006-P1-K1-A11
ggttgaaccaagtcaagtcaggaaggaacccattgttcctggagatgtcgtcgcataacttgcatgttccgaaggcaaattaagatgcttctttctgcgtgccttggggcgctggaagtttcatcacctaaacctcccgatcaggggggttacctccgtgttgtagacctgcatgccttgcaatgagctggctatgtgtttcatatgtactacttactagttatgtactaagtattaagtgtcttgtgctatgcattgtcttgtgtcatttaaaactcgtttgaatggaagcccccgagatgatgagaacatttgaatctgggatcgtcccgtgtgtcttgtgcatttcaacggaagaccaagaagaacgactcagtgtgctgtttgtataataataagaaaca

SEQ ID NO: 3924 - DNA, 403 bp, Triticum aestivum
  Clone ID: LIB3281-006-P1-K1-A12
ggttgaaccaagtcaagtcaggaaggaacccattgttcctggagaggtcgtggcataacttgcatgttccgaaggcaaattaagatgcttctttctgcgtgccttggggcgctggaagtttcatcacctaaacctcccgatcaggggggttacctccgagttgtagacctgcatgccttgcaatgagctggctatgtgtttcatatgtactacttactagttatgtactaagtattaagtgtcttgtgctatgcattgtcttgtgtcatttaaaactcgtttgattggaagcccccgagatgatgagaacatttgaatctgggatcgtcctgtgtgtcttgtgcatttcaacggaagaccaagaagaacgactcagtgtgctgtttgtataataataagaaac

SEQ ID NO: 3925 - DNA, 409 bp, Triticum aestivum
  Clone ID: LIB3281-006-P1-K1-A2
cggacgcgtggggaaaggatggccaacgagaatgtccttgcagaagtcaatagctcaagtctgtgtgtctgagtctccagcttttgtgttagatccctgttcagctccttcagcttggagcagttggatgactcgattctcagtgctcgcattaactcttctctctccactgctaactccgacatcaaggagttgatgttgtcaatcattctgagctgatcttctggaatgctagaagatgcgtctccgaaggaagggaaatcagacatattattcaactgtgcaccagatggtcccacgtcttgtgatggggcactggtactgggcagtgtgtgggaagagctgctctcccctcaatctaaatccttcgttacagttgatgcatcttttttgtggactgatggtattt

SEQ ID NO: 3926 - DNA, 346 bp, Triticum aestivum
  Clone ID: LIB3281-006-P1-K1-A4
gtcgtgatggcggtggcaggtttggccggtctggtggccgtgatggtggcggcaggtttggccggtctggtggccgtgatggcggcagaggaggcggccgaggctttcagagcagacagagtgctggcacagctagcgccgggaagaagaccacgtttggtgacgattagaaactgtttgagccacaaaatggtctgatgcaactgccgcgtgtctagacgactgtatccccgtgtttcccattgtcctagtggacctagtatcatttgtctgtagtattttcttgccgctatatgttgtaatgccagaattctactatatatgttaacacctagtgttttttaat

SEQ ID NO: 3927 - DNA, 354 bp, Triticum aestivum
  Clone ID: LIB3281-006-P1-K1-A6
cggacgcgtgggcggacgcgtgggcggacgcgtgggcggcgctgctcctcaccggctccatcgacgagaccgtccgcgcctggcaacccgacgacctcgccgccgcgtcccccccggcgggagggtacgcgctcggagtgatatccctcgcggcgcatcctgccggggtcatagccgccgcggtctccatcgacagccacgtccgcgtcttcgacgtcgactccggcgcattcgtcgccacgctcgatgccgcgccctccgaggtctggggcgtccagttccaccccaagggtgttgctctggctgcagctggtggtggcagtggatcagtaaaactctgggacacggagaagt

SEQ ID NO: 3928 - DNA, 418 bp, Triticum aestivum
  Clone ID: LIB3281-006-P1-K1-A7
cggacgcttggggttgtccgattatggaatggaactggaactggaactgcatatacaagactagtggagtagctaggcggcttctttgaatattacatggaggtctgagctgagaagatcatcgtattacttacagttgagctaagaaagcgtcgaggcctccgagcccccagccatgttcatatttgtcgacatcgcatcacaggcacatcccctgtcaaagggtccagtcttcctttcgcaagcgaagaatcatgtggtgtagcctatggcctatgtttattgttattcaagtacagtattgtcggataatccaccttcccataacttgcccttcctgtgcccgtaagttttcgccttggccgtctgcccctcatgggtgctcgttcctagatttggtgatgagagacccttgcag

SEQ ID NO: 3929 - DNA, 409 bp, Triticum aestivum
  Clone ID: LIB3281-006-P1-K1-A8
ccagatttgtgggcgtgttcccgcgggggaactgatggtgggttacatggagtggtcgcacgactggctgctgtgggacgccttcttggaatgcggagggatccggaggccgccgattagatagcggccggggaggaggagggaggagcggaggaccaggaggaggaggaggccgccattagcacccaccctgccaccaccccgacgcccgactcgccactcaccagccgggcgcccatgggggaggacctcgtcaccaccctctccatggagaacggcggcggcggcgggggccaccacggcctctgcaccctgctctccatggacccctccggccacctcgacgaccgcgccgtcggcgttatggtgcagccccgcgccggagggggcccgccccacgcccacgccg

SEQ ID NO: 3930 - DNA, 416 bp, Triticum aestivum
  Clone ID: LIB3281-006-P1-K1-B1
cccacgcgtccgcggacgcgtgggcagatggtgtcctttcgatcgagtcgtcttcatcttttgagactactgttgatgttgaagaaggaatggagattgaccgaggctacatttcccctcaatttgtgacaaaccttgagaaatcaattgtggagtttgagaacgccagagttcttataactgatcagaagatcacaagcataaaggaaatcattccacttctggagcagactacacagttgagatgcccgctgtttattgtagctgaggacatcactggtgaagctttggcaactcttgttgttaacaagctcagaggtattattaatgttgcggcgatcaaagccccaagtttcggtgagcggcggaaggctgtccttcaggatattgccatcgtgacaggcgctgagtaccta

SEQ ID NO: 3931 - DNA, 408 bp, Triticum aestivum
  Clone ID: LIB3281-006-P1-K1-B10
cccacgcgtccgagccaggacatccgctacgcgatgaagctcgccgccccgaccctcaccaagctcacccgcgccctcgtccagcggggcatcctcaaggaggtcacggatgtccgccaccgcgggaagaaggtcttcatggacgcccgcatcgagccctcccccgagatcaccggcggaacctggtatcacaacggccagctcgataccgacgccgtggcggccgtgcgccgcaggtgcctggaccagattgacaggctcggcgctgccaccccggacatggtccacaagggcgtcgagagggaagaccccagggcagggtacgctatcgaccagatcagggacatcctgcagaccatggcgcttgacagggtgctggaggagtgcaagagcacaagggagggggag

SEQ ID NO: 3932 - DNA, 409 bp, Triticum aestivum
  Clone ID: LIB3281-006-P1-K1-B11
cccacgcgtccgcttcgactgaagcagcggcggaagaagaagaagctagaggacatgggggcgcagagagctctcctcgcgagcttcctgctcgccgcgttggtcacccaggccttcgtctccgtctcggccaggaccggcccaacggacaaggcaagccaagatgacgtgaagaagccggactgcgtgccgtcgctcgacccgcacaatttccccggccacgggggcaccaccgtgccgcttccctcgcacgggggctcctccggcacgcccccctaccacggaggttccggcacgacgccgtcgcacggcggctccggctcgactccgtcgcacagcggctctgggtcgttgcctgacccttcgcacggcgggtacgggacgccgccttcgcacgggggctctggat

SEQ ID NO: 3933 - DNA, 384 bp, Triticum aestivum
  Clone ID: LIB3281-006-P1-K1-B12
cggacgcgtgggcggacgcgtgggcggacgcgtgggcaaaaggcagcctcccccctttgccttcccacacatggtggtccggctctagggccctttcgcctcgtgcttggcggcggtgatggagccgtcgtcgtccatcacggtcgcctcctcgtcgtcctacctgtccaacggctctagcccctgctccggcgctctggcgccgctgcccgcggcggacgggtggggcggggctgggggagggggagggagcagcagcagcgtcgaggctgtgagtctgagtcgcctcagcagcaacctcgagcgcctcctcctcgattctgaactcgactgcagcgacgccgacgtcgacgtggcggacggcgggccgtccatccccatcca

SEQ ID NO: 3934 - DNA, 418 bp, Triticum aestivum
  Clone ID: LIB3281-006-P1-K1-B2
ctcttatccccctcttcccgccattcctccccaaaccctctcatttccctccctcctctcgcccgcgtctttcctcctcgacccgccgccgccgccgccgccgccatggccgccgggacgaagaccgtcgactacgcggcggaaagagcgctcgccaaggacttcctcaccaatttcgccggcccgcacggcgagcccaagtaccagaacatcctgcaagacatcgcgaaccggaagatccgcgccgcccagatcgagctggacgacctgttccactacaaggatgtggacgaggagttcctgcagagggtcaccgagaacaccaagcgctacattggcatattcgccgaggccgtggacgagctcatgcccgagcccacggaggcctttcgtgtggacgaggacagggacatcttga

SEQ ID NO: 3935 - DNA, 327 bp, Triticum aestivum
  Clone ID: LIB3281-006-P1-K1-B3
ctcttatccccctcttcccgccatttctccccaaaccctctcatttccctccctcctctggcccgagtatttcctcctcgacccgccgccgtcgtcgccgccgtcatggtcgttgggacaaataccgtctactactctgcggaaagagcgctcgccaaggacttcctcaccaattttgccggcccgcacggtgagcccaagtaccagaacatcctgcaagacattgtgaaccggatgatccgcgccgcccagatcgagctggacgacctgttccactactaggatgtggacgaggagttttctgctgagggtcaccgagaacaccaa

SEQ ID NO: 3936 - DNA, 295 bp, Triticum aestivum
  Clone ID: LIB3281-006-P1-K1-B5
tcgaggacgcttgggcggacgcgtgggctatacgcgttggcggcgctgatccttaccggctggggcgactagaccgggcgcgcgtggcaaccccactaccttgccgccgtgttctctctggcgggagggtacgcgctcggagtgatatacctcgcggcgcattctgccggggtcaaagtcgccgcggtctccattgacagtcaacgacgagtatttaacgtttacttcggcgcatacgtcgccacgctcgatgccgcgctctacgaggtctggggcgttcagtttcaccccaagg

SEQ ID NO: 3937 - DNA, 388 bp, Triticum aestivum
  unsure (1)...(388): unsure at all n locations
  Clone ID: LIB3281-006-P1-K1-B6
cccacgcgtccgactgtgtctgctgtgctaggctagcccattcactgcgcgcggccgacctcgcctnggtatctccatcctcctccatacgccacaccttcgtggaaggggaaggctccgagccgtgtgagaagacgatgaagaagggggggctgctgcggtgcgtgtcgacgggggcgtgcagggtggcgccgggggccgtggcggagatggccatctcgccgtcggcgtcggggaaggtgccggcggggcacgtgccggtggaggtgggcgcggaaggggaggagacggagcgcttcctcgtgccggccgagctgctgggccgtccgcccatcgacgagctgctccgccgggccgngcaggagtacggttacgcacgacgcggtcc

SEQ ID NO: 3938 - DNA, 385 bp, Triticum aestivum
  Clone ID: LIB3281-006-P1-K1-B8
cggacgcgtgggactgcataccacgtgtggcagccctaactacatagcccctgaggtccttctcaacaaaggttatgatggctccatgtcagatgtatggtcctgtggcgttatcctctatgtgatgcttacagggaatcttccgttcgatgacgaaaatatggttgtcctttatcaaaagattctaaaaggggattatcgtattcctaaatggctttcgccaggagcccaagatatactgcgaaaactcctggatccaaaccccattacccgccttggcatggacggactaagggaacacgattggttcaatcaaagttatactccagcagtgccttttgatgatgatgacgataattacgttggtgatgaccactcccacatg

SEQ ID NO: 3939 - DNA, 413 bp, Triticum aestivum
  Clone ID: LIB3281-006-P1-K1-B9
gaaaggtaatcccaatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaagggcagcgccttccaccgcgtgatccccgacttcatgtgccagggcggcgacttcacccggggcaacggcaccggcggcgagtccatctacggcgagaagttcgccgacgagaagttcgtccacaagcacaccaagcccgggatcctcttcatggccaacgcggggcccaac

SEQ ID NO: 3940 - DNA, 198 bp, Triticum aestivum
  Clone ID: LIB3281-006-P1-K1-C1
ccacgcgttcggatatcatagtggctgatgaggttgttcactgggcagtgcaaaatggtggctatctatcgagaagtactgttgtttatttcaagcacaaatgattggcttcactcgctagcactttggaaaaacttactcgcggaaacaaacgtaccgagaagatttgtacgctacattgttgtgtaatctatctac

SEQ ID NO: 3941 - DNA, 249 bp, Triticum aestivum
  Clone ID: LIB3281-006-P1-K1-C10
cccacgcgtccgcccatacgtacgatcacgcgtccggacggacaccagcccgtacccagtagtctccgtcgacatggtcaccaccgagcgcccgatcgtctccgtcaaggccctggacggggacatgatcaacgacgcggatcggcgttcacatgctgaacgttatgaaggcgctgatccgccccgacatcatgaactccttccacaggtttgtgtacgtgcaacagaccagatgctccttatgtcgtt

SEQ ID NO: 3942 - DNA, 132 bp, Triticum aestivum
  Clone ID: LIB3281-006-P1-K1-C11
ggctcgccgccctcacgcgggagcagtcggtgtgggcttggtcccggtagttacaatcgattggtgggggcgggggcaggcaggacaggagagcgccgcggcgatgaaagccctgcggcgatccagcacctc

SEQ ID NO: 3943 - DNA, 295 bp, Triticum aestivum
  Clone ID: LIB3281-006-P1-K1-C12
gttggacttactgaagctccattgctgcatgcatattcattttgttggtgcagctgcagacctattttagataccgaatccttgctttggaaactagtgactaactggctgtttagcatgttaaatgggtcaaattcttttagtatatggacagtgaaagttccaacgcgttctcctaggtgctgttttatattgttcaaatgttaagtgcattgtttgtttgatcaaagactattaggcaggaatatggtgtagtttcggtaggggaaagttataccctgtaatctgttgtttt

SEQ ID NO: 3944 - DNA, 109 bp, Triticum aestivum
  Clone ID: LIB3281-006-P1-K1-C2
tcaacgcgtgggatttacttccgttttccgcagtaaccgaagccaagtttcgaagtcttcgcctaggaggagcatttgaccatactccatggtccgtaccatgtagacc

SEQ ID NO: 3945 - DNA, 372 bp, Triticum aestivum
  Clone ID: LIB3281-006-P1-K1-C3
cttctccccgcacccgacgacatcgcgggagaaggaagacgcatcatggccggagcagccgccgccgccgccgtcgtggcctccggcatctcggtccggccggtcgccgcgcctaagatcttgcgcgcgccttgctctcggtcggtggtgagggcggccgtctccataggcgagaaggcttacacggttcagaaatctgaggagatcttcaacgccgccaaggaattgttgcctggaggtgttaattcaccagtccgtgcttttaaattagtctgttggcagtccatagtttttgaatctgtgtatggctttcatatagtttattgtcctttgaaacgaattttatcgctttttttggtttccttggggttc

SEQ ID NO: 3946 - DNA, 404 bp, Triticum aestivum
  Clone ID: LIB3281-006-P1-K1-C4
gcagatctgaggacgaagggaagaataagaagttttttagctagagatctgaagaagatcaaggtgatttttctccctcctgttaagctttgttatctcattttgatgctattgtttgtgattgatgtaaacatgaggaagataagagatcacaacgaggctaaatgagatttgtggtgaccaaaattctttctttgtttacctacagaactttattgcactattgattatgtactattttcctttcctaaaggaagatgccgtgtcatgtaacatctttaaagaagagagaatcttcattttgttcattgtgctatcagttagggtggatttgtgttttcagaaaattggcaaccttacatgtacatatttacaaattttctttataacactaccagcacaca

SEQ ID NO: 3947 - DNA, 214 bp, Triticum aestivum
  unsure (1)...(214): unsure at all n locations
  Clone ID: LIB3281-006-P1-K1-C5
agaaaaaaaaaaaaaaaaaggagagagaagagaagaaaaaaaagggaaagggggggaacnaaaaaaaagaaaaaaagaaagaaaaaaaaaaaaaagagcagaaaagagaaagaaaggaaaaagaggaaaaaagaaaggaaaagaaaaggaaggaaaaaaaaaaagaaaagaagaaagagaaaaggaagagaaagaaaaaaaaaaggagaagaaa

SEQ ID NO: 3948 - DNA, 292 bp, Triticum aestivum
  Clone ID: LIB3281-006-P1-K1-C7
cggacgcgtgggcggacgcgtgggcgcggcctcgcccttgccatcgccgccgtgcgtgaccgtcggattggtattggacgacggcgcctagatgaagggccttttcaagtctaagtcgtggacgccggccgacgttgtgcggcagacgcgtgagcttcttattttacgtggatcttcacgccggcttacgcggcgccgactccaaacgtgaggaggtgaatgatgctgaattaattcaaaatttttagggaattgtagggtattttggatggtaacggggaacaggagcctt

SEQ ID NO: 3949 - DNA, 115 bp, Triticum aestivum
  Clone ID: LIB3281-006-P1-K1-C8
cccacgcgtacgcccacgcgtccgtccacgcgttcgggacactcttcttagggaaagtattaagaatggagtccacagggggttaaaggaagcccttgccaaaaatgatgtttaa

SEQ ID NO: 3950 - DNA, 361 bp, Triticum aestivum
  Clone ID: LIB3281-006-P1-K1-C9
cccacgcgtccgcccacgcgtccgttgatttcaacaagttgagtgctaagcttatcttcggtgctgacagtcctgctattcaggagaatagggtggctactgtgcagtgcttatcaggaactggttccctacgagtgggaggtgaatttcttgcaaggcactatcatgaacgcacaatctacattccccagccaacctgggggaatcacccaaaagtcttcactttagctggcctgactgctaggagttaccggttctatgatcctgcaacttgtggactggattttcaaggacttttggaagaccctaattcagcttccttaagcgcaattgtacttgtttatgcatgtgcccacaaccc

SEQ ID NO: 3951 - DNA, 115 bp, Triticum aestivum
  Clone ID: LIB3281-006-P1-K1-D1
gtctttgattgaaccaaacctttcaaatgaactgtttattcctttactgcaccgtttttcctttattcttgtcagcacacatgagtgacttcttacttcttattactttttgatt

SEQ ID NO: 3952 - DNA, 281 bp, Triticum aestivum
  Clone ID: LIB3281-006-P1-K1-D10
ggcgaaaacacaccagcgctcccctctcccctcgctttcccgccgcaatgtcgaccgacgccgctgccgccgacatcccggtgcctcaggtggaggcgaccgccgaccccgtcgtggagaccacgactgacgcccccgccggcgacgccaagacgaccaaggcgaccaaggccaaggccgcaaagacccccaaggcgcccaaggtgaagaagccctccgccccgaggaagcccaagggccgccccgcccacccgacctacgctgaggtaaaccccccgacc

SEQ ID NO: 3953 - DNA, 414 bp, Triticum aestivum
  unsure (1)...(414): unsure at all n locations
  Clone ID: LIB3281-006-P1-K1-D11
gggacagccgccgccgccccttccccttccaaacttgcgctcgccggccatgcttcccgtncgccggcgncgncgncaccgaccagccgnacccgcgctaccatccccttcccgttcctctccgagaagcagcccaagggcagccgcctgccgctcggcacaaacgcggatgcggtggccgaagggggaagcggcgctgctttggcgccgctaagcgccaccaccccccgtcccttcgtnccccgccgcccctttggcttctnccttnccgccacacaccctncctttccctgcgccgttgcgctgctgctccactgggtacgagttccatggctgtccgggatccatggcctccgacttggcgtcgtagccgtcagcctcggcgttgagacagtgccaaggaatttcacacgg

SEQ ID NO: 3954 - DNA, 412 bp, Triticum aestivum
  Clone ID: LIB3281-006-P1-K1-D12
cccacgcgtccgggccagggaagatcactgagatccatcccaagttaacgtatacatttaagttaagaacttcaggaaagaaggttcagttacaccagaacacactgaggcttcgatatgactggactgataaccaatggaagcaagttgcacagaatctgtcgggaacaaaattcacaggaggcgacagggttgaagtcagcagcgacgaggaaggtttccacggagcgtggttccaggggaccgtcatcaaatccgtgggacacaagttccttgtggagtatgatgcactgaaagacgatgacgagaccacgcctctgaaagaaaccataggggaggagcacatcaggccctctcctccggccatccctgtcaccagcggtttcaaggtccttgacgagatcgacgccta

SEQ ID NO: 3955 - DNA, 381 bp, Triticum aestivum
  Clone ID: LIB3281-006-P1-K1-D2
gcttcttccagggccccgccgaggcaccgctggaggccgccacggcgtgcgccggggtgtacggcaagggggcgtaccccggctacgccggctcgctgctcgtggacccggccaccggcgccagcttcaacgcgaacggagcccacggccggaagtacctggtcccggcgctcgtcgaccccgacacgttcgcctgctccaccttggggtaggctcgtacgtgtaggaccatgatggggtgtgtgtagatatagatgcgggggcgtttgtgctgtgtggagagtgttccacctttcacgcgcgcgctgatgttaatctgtgtgcccgtagaggcgctgagaataaaaaattttatttgttgaaagaagaaaaagttctact

SEQ ID NO: 3956 - DNA, 412 bp, Triticum aestivum
  Clone ID: LIB3281-006-P1-K1-D3
aagagttttagagttagaaataggtttcaggctggtccatttgaagtggaacctatccgcgtaactcattcaattcctgactgctgtggattagtgcttcgttgtggtgatggcacaattttccatactggtgactggaaaattgatgaatcaccagtggatgggagaatattcgaccgagaagcattggaggagctctcgaaagaaggtgttactctgatgatgagcgactcaacaaatattctgtcccctggaagatccaccagtgaatctgttgtcgctagttcattgttgcgtcatgtttcagaagcaaaagggagaagagtaattacaacacaatttgcttcaaatatacatcgcattgggagcatcaaagccgctgcagacttaactggtcgaaggctggtctttg

SEQ ID NO: 3957 - DNA, 160 bp, Triticum aestivum
  unsure (1)...(160): unsure at all n locations
  Clone ID: LIB3281-006-P1-K1-D4
gccgccgcccacacaccaaaccttaaccctaccgccgncgccgccatggccgacccgcggatgttcccatcgggatcaaacggcccggaagaccacgcccccggccgccggaagtacaacccctaccaggacctcaacatgccctacaactacaagaacc

SEQ ID NO: 3958 - DNA, 351 bp, Triticum aestivum
  unsure (1)...(351): unsure at all n locations
  Clone ID: LIB3281-006-P1-K1-D5
cggacgcgtgggggcggnctggcgctccaccccgtgtccttctatccaaaagcgacggagagactcccggcggcgagcaggttggcctgttgttctatccgattttgcactgctggttgtcctgctcttncagctgattgcagtggtgttcttctcgcagtttgaagatggatttgaaggacagcctctccagatttaagcagcaacaggagaggtgccagtcatctttggccagcatagctgcaagccaagcttcaaccacaaaaccaaagcacagggcccaaccgattaatgctccatctgctccagcaaggcctgcacaacctattaaattttcaaacgatacagaaa

SEQ ID NO: 3959 - DNA, 270 bp, Triticum aestivum
  unsure (1)...(270): unsure at all n locations
  Clone ID: LIB3281-006-P1-K1-D6
ccacgcgtccgcggacgcgtggggtcgtgaactggatattggtctgtcaataatgtgcattgagctgcattgtgctacgcagtctagctcttgcatcatgcctaggcaatgtgcatgtatgtcattgtcctcgcttaaattctgccggatatttccaagttgacaatgtattgctgaataaacagagtttatctgctggtatctgtgctggacaagggatgccagtagacactgaactgttatttgctgcctcanaaaaaaaaaaannna

SEQ ID NO: 3960 - DNA, 372 bp, Triticum aestivum
  Clone ID: LIB3281-006-P1-K1-D7
cttactctgcccagaaaactctagtcgtcgcctgacagttcgtcgtcgacagagagagcttttcctacaccggcgtaaccatggtgactccagatcataaagaataagaagtttgtgcgtgatcgcgaattctacccacagctgaaagtgattctgacccgtgctcttggcgaggacggctaaccctgcttaaggtacgcttgactcccacgcacacggagatcatgattagggtcacgcggtcgcagaacgtgcttagtgagaagggccggagaatcacggagctcacttacgtggtgcagtaactcttgaactttgcagagaacgggggatgactttactccgagtaggtggtgaaaaaaggctacttct

SEQ ID NO: 3961 - DNA, 230 bp, Triticum aestivum
  Clone ID: LIB3281-006-P1-K1-D8
ctctgcttgagatgatgatatttcacctcccctctccttcaaaggcccagaggtatcgtgtggagaacttatacgagggcccccttgatgacatatatgcaaatgctatcagaaactgtgaccctgatgggcctcttatgctgtatgtctccaagatgattccagcatctgacaagggtagattctttgcctttggacgtgtttttgctgggagggttgccactggcatg

SEQ ID NO: 3962 - DNA, 395 bp, Triticum aestivum
  Clone ID: LIB3281-006-P1-K1-D9
cggacgcgtgggctgaagcactggccttctctaatttctgattgtgttcttaccctgactgagaatttgcgtgattcgaaagccctggaacatgtggtgcttggttcttgcagcattcttgcatcacagactgttttgagacacttgacaactgattctgcttccctctcttcatttatcatgggaattttgggaagctctcatcatgaatcgataaagtgtcagaaagctattactgagctctttgtgaaatacaacatacgtttctctggaatatcaaggtcttttttcaagaattctcaaagtctggctgacaggccaggatttcttggattattttctcaaattaatgctttgggctttgagactaacagtctacattggaggtacaacct

SEQ ID NO: 3963 - DNA, 413 bp, Triticum aestivum
  Clone ID: LIB3281-006-P1-K1-E10
cccacgcgtccggagaaaagagtgtcttggctaaagactcttccatgcccattaatcgagttacatggagccctgatggagacttgattggagttgcattcgcaaaacatttgatccatctgtacgcataccaacaacctaatgaagcacgccaagttttagagattgaggctcattctggaggagttaatgacatagcattctcccggccaaataagcaactctgtgttgtcacttgcggagatgacaagctgataagggtctgggatatgcatggacagaaaatatattcgtttgaagggcacgaggcacctgtgtattctatttgccctcaccacaaagagactattcagtttatattctcaacttccattgatgggaaaattaaagcatggctttatgacaatgcgggg

SEQ ID NO: 3964 - DNA, 412 bp, Triticum aestivum
  Clone ID: LIB3281-006-P1-K1-E11
caagaatgttcttgcggtcgctttggatacagactactcatatgagtcatgctgataagatcaaggtgtacctcatggacccaactaagttggcctttcattcccataacatttgttccatctgtactcataccaacaacctaatgaagtacgccaagttttagagattgaggctcattctggatgagttaatgacatagcattttttcggccaaataattaacttttgtgttgtcactttcggttattacaagctgataagggttttggatatgcattgacagaaaatattttttttttaatggcacgatgcaacctgtgtattttatttgtcttatcacaaagagactttttagtttatattctaaatttcaatttatggaaaatttatgtatgtctttataactatttt

SEQ ID NO: 3965 - DNA, 407 bp, Triticum aestivum
  Clone ID: LIB3281-006-P1-K1-E12
gcggaccacaacggcagttctttcgccttcatggaggatgccgttgcgccagacaggagagccccgtctttcaagatcaacgcgacgcactcggtgaacattgtggccgagagcgtcgcgagcacaaaggcggggccggtgggccggtcgtcgaggaggtcgtcccgagacttcgaccacgccttcctgaatgaggccatggcgtcggagacaaaagcaccgtcgtccaggatgaacgcgacgcacacggtgagcatcgtgtcggagagcgttgccagccaaaaggccgggccggcaggccggtcgtcgaggcggtcatcccgcggcttcgaccacaacggctacttctatgcctggctgctcctcgaagacattcagagctaccaccagcagaacgccagcgacac

SEQ ID NO: 3966 - DNA, 414 bp, Triticum aestivum
  unsure (1)...(414): unsure at all n locations
  Clone ID: LIB3281-006-P1-K1-E2
cccacgcgtccgcggacgcgtgggctcccacactcaacacttccgccaccttggcctcctcctccacagctagctagcaaagctgagctagtagaaggtagccacccacaaccgcagggcgacgatggcgtcgaccgccgccttcctcccgctgctggcgctcctgctggtggcgacggcgcattgctcgccgctgctgccccagcggtgcccgcaggccgaccggcaggcgctgctccgggtgaagcaggcgctgggcagcccggcgacgctcaagacgtggtcgccggcgtcggcggactgctgcgcgtgggaccacctcacgtgcgacgaggccgggcgcgtgaacaacgtctttatcgacggcgccgacgacgtgcgcggncagatcccgtccgcgctggcggggctgac

SEQ ID NO: 3967 - DNA, 90 bp, Triticum aestivum
  unsure (1)...(90): unsure at all n locations
  Clone ID: LIB3281-006-P1-K1-E3
cggagcagggggggcaggaggcgaagcgggcggcggctgcntcctacgactacgaggcggacccgcgctgggccgactactggtccaacg

SEQ ID NO: 3968 - DNA, 415 bp, Triticum aestivum
  Clone ID: LIB3281-006-P1-K1-E4
cggacgcgtgggtgagactgaaggagacgatttccacttgcctgagggcagacatagggaactgggtttcaccttttctttcccagtacaccaaacatcgatatcgtcaggcaccctcgttaagtggacaaagggattttgcatcaatggcacggttgggaaagatgtggtggctgaactgagcagtgctatggagaggcaggggcttgatatgaaagttacagctttggttaatgatactgtaggcacattggctggcgggatctatgctgataatgatgtcgttgctgctgtaatattgggcactgggacaaatgcagcgtatgttgagcatgtagatgcaattccaaaatggaagggaccactacctagatcaggaaacatggtaatcaacatggaatggggaaactttaag

SEQ ID NO: 3969 - DNA, 419 bp, Triticum aestivum
  Clone ID: LIB3281-006-P1-K1-E5
atgaccttgctgccaacaatcctgttctggtgaccttgaacttctacttgacttacctcagagtggagccagctgacctcgagcttctcgccaagaattgcaagtcactaatttcgttgaagattagcgactgcgacctttcagatttgattggatttttccaaatagctacatctttgcaagaatttgctggagcggaaatcagtgagcaaaagtatggaaatgttaagcttccttcgaagctttgctccttcggacttaccttcatggggacaaatgagatgcacataatctttcctttttctgctgtactcaagaagctggatttgctgtacagtttcctcaccactgaagatcattgccagctcattgcaaaatgtccaaacctactcgttcttgcggtgaggaatgtgattgga

SEQ ID NO: 3970 - DNA, 370 bp, Triticum aestivum
  unsure (1)...(370): unsure at all n locations
  Clone ID: LIB3281-006-P1-K1-E6
nntccgcttctctctgccnnncacaaaaccctnnagccgtcgcctcacaaagctcgccgccgacgcagcgaggctcttcctccaccgccgcaaccatggcgacccagatcagcaagaagaagaagtttgtgagcgatggcgttttctacgccgagctgaacgagatgctgacccgggagcttgccgaggacggctactccggcgtggaggtacgcgtgacgccgatgcgcacggagatcatcatcagggccacgcggacgcagaacgtgcttggtgagaagggccgcaggatcagggagctcacctccgtcgtccagaagcgcttcaacttcccggagaacggcgttgaactttacgccgagaaggtcgt

SEQ ID NO: 3971 - DNA, 72 bp, Triticum aestivum
  Clone ID: LIB3281-006-P1-K1-E7
atcaagggaaaccgagcagtctcagccatgggcttcttcttctgcaatggaatcttagcagttttcctgctt

SEQ ID NO: 3972 - DNA, 314 bp, Triticum aestivum
  unsure (1)...(314): unsure at all n locations
  Clone ID: LIB3281-006-P1-K1-E8
ctctctcccccccctccgcctccggctactctcgaactcgtcgagcgccgagaccgacgcacgcgcgcgcggcggngagatgaaggtctccgtgaagacgctcaagggctccaaattcgagatcgaagtgaaccccgccgacaaggtttctgatgtaaagaagctcattgagagttcacaagggcagaatgtgtacccagctgatcaacaaatgctcatataccaagggacagttcttaaggatgagactacgttggaggaaaacaaagttgttgaaaacaactttcttgtgataatgcttagacagaataagg

SEQ ID NO: 3973 - DNA, 307 bp, Triticum aestivum
  Clone ID: LIB3281-006-P1-K1-E9
ctctcttcccccccttcgcctccgtctactctcgaactcgtcgagcgccgagaccgacgcacgcgcgcgcggaggctagatgaaggtcttcgtgaagacgctcatgggctccaaattcgtgatcgaagtgaaccccgccgacaaggtttctgatgtaaagaagctcattgagagttcacaagggcagaatgtgtacccagctgatcaacaaatgctcatataccaagggacagttcttaaggatgagactacgttggaggaaaacaaagttgttgaaaacaactgttttgtgataatgcttatacag

SEQ ID NO: 3974 - DNA, 396 bp, Triticum aestivum
  Clone ID: LIB3281-006-P1-K1-F1
cggacgcgtgggattctgacggtagcttcatcccaaaacctgattactggggtggctacagattgacaccaaatctttttgagttctggcaaggccaacagtctcgtctgcatgaccggctacagtattcacagcgagaaataggtgggggtacagaatggcacatccaaaggttgtccccttgatcagtaagctccttaaagctctcgcctcttggtaataaaagggggtgtcgttttggcacctgcgcacactttttcctggtacctaatggactgcaatttcttgattggagatgtgcgctagatgtatttttgtgatatatatgtgaatgcagagaagcaggatacgtgaggtgtatgagccgatttaatgcagcgggcccaaactcgcgag

SEQ ID NO: 3975 - DNA, 326 bp, Triticum aestivum
  Clone ID: LIB3281-006-P1-K1-F10
cccacgcgtccgcttacctcaggtgcgtaagcttagagttgctggtattagtagcggaaacactaaggagttatggtctgccattgctggtcacaatcaacttggatctctatcagtggcaagtgaaatatttcatggttctttggatggttgtttgggtgaaggtttgttgccaccaagcagcctggagagcctcactctggaaggtaggctagccaatgtaacaaaatggatccatatgcttcagaatctctccaagctggtactacgggagagctacttgagtcaagatggtgatgccatacaagcccttgggttcctaccaa

SEQ ID NO: 3976 - DNA, 222 bp, Triticum aestivum
  Clone ID: LIB3281-006-P1-K1-F12
cccacgcgtccgggagctggccgggaacgccgccaaggacaacaagaagacccggatcgtgcccaggcacctgctgctggccatccgcaacgaccaggagctcgggaggctgctgagcggcgtcaccatcgcccacggcggcgtcatccccaacatcaacccggtgctgctccccaagaaggccgctgagaaggctgagaaggccggcgccgcccccaagtc

SEQ ID NO: 3977 - DNA, 387 bp, Triticum aestivum
  Clone ID: LIB3281-006-P1-K1-F2
cccacgcgtccgcccacgcgttcgtggacgcgtgggcggacgcgtggtgtgaaacagtaggtgaagctcctaaaaaacagaagtttaaacaggccctaaaaagaaatcaggttacgttgctcgtaaacctaaaaagaagcctggggattgtttcaaaaagaagtcaatattctgtgatttggaatactgggagtacaacaagatatggcaaattttagatgttaatgcatattgagaaaaaacatcctgggacaatttatttggagccttacagtgtattgattttaaaagaaaggatgggcttaatgcacgacttgacttgtgataaatttgaatgcaatctagcctttaacctgatgaaggtgattaatggttaatattaattgc

SEQ ID NO: 3978 - DNA, 401 bp, Triticum aestivum
  Clone ID: LIB3281-006-P1-K1-F3
ccggcggcggcgcgtagcacaggagaaggagcaggcggcggtggtgcccgaagacgagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgccttcctctgatcctcatcctgaggaacagactgaaatatgctctcacctaccgtgaagtgcagtctatccttatgcagcgtcatatcatggttgatggaaaggtccgcactgacaagacctaccctgctggtttcatggacatcatttccattcccaagactggtgagaactacaggcttttgtatgac

SEQ ID NO: 3979 - DNA, 404 bp, Triticum aestivum
  Clone ID: LIB3281-006-P1-K1-F4
gaccacagcggcagttctttcgccttcatggaggatgccgttgcgccagacaccagagccccgtcttccaagatcaacgcgacgcactcggtgaacattgtggccgagagcgtcgcgagcacaaaggcggggccggtgggccggtcgtcgaggaggtcgtcccgagacttcgaccacgccttcctgaatgaggccatggcgtcggagacaaaagcaccgtcgtccaggatgaacgcgacgcacacggtgagcatcgtgtcggagagcgttgccagccagaaggccgggccggcaggccggtcgtcgaggcggtcatcccgcgacttcgaccacaacggcaactcctatgcctccctgctcctcgaagacatccagagctaccaccagcagaacgccagcgacac

SEQ ID NO: 3980 - DNA, 423 bp, Triticum aestivum
  Clone ID: LIB3281-006-P1-K1-F5
ctctcccttgccagccgcctcgtgccctcgccctctccctcctatctgcgactgcgccgccgccccctgtcccagcgtcgctcgctccggcatccacctgaccgacgcctcgttagcatcgactcctagacgacactacgcagagatggcggcgaggagagccagcgcccgcgcgcggcccaacgtgctggtgacggggacgccggggacggggaagacgacgacgtgctccctcctcgccgacgccgcgggcgtggcgcacgtcaacatcggcgacctggtccgcgagaagggcctccacgacggctgggacgaggacctcgactgccacgtcatcaacgaggacctggtttgtgatgagcttgaggacaggatggaagaaggcggtgtactagtagattatcacggatgtgatttctttcc

SEQ ID NO: 3981 - DNA, 401 bp, Triticum aestivum
  Clone ID: LIB3281-006-P1-K1-F6
accactcctccgaccactcgttctgttcacaacacgtggccatgcttactttagaatcactggctgaaactgcggaatttgcatggagatccatctcattttgcaagaagttctacattgagccacgcacttccgcgatatactgtctcacagaaaattgactacttgaaggacaaaatacacccgtctttcgtcaaggagcgtagggctatgaagagagattatgaagagttcaaggtgaggataaatgctttggttgtcaaggctcagaacacacctaaggaaggctgtgtcatgcaggatgggacaccatggcctgtgaacaacttttcggaccaccccggcatgattcaagtttttcttggtgagaccggtgctcgcgattactatggaaatgagct

SEQ ID NO: 3982 - DNA, 398 bp, Triticum aestivum
  Clone ID: LIB3281-006-P1-K1-F7
cccacgcgtccgcccacgcgtccgcggacgcgtggggccatgctcacgtttgaatcacttgctgaaactgcggaatttgcaaggagatgggttccattttgcaagaagttctccattgagccacgaactcctgagttctacttctcacagaagattgactacttgaaggacaaaatacacccgtctttcgtcaaggagcgtagggctatgaagagagattatgaagagttcaaggtgaggataaatgctttggttgccaaggctcagaagacacctgaggaaggctgggtcatgcaagatgggacaccatggcctgggaacaactctcgtgaccaccccggcatgattcaagttttccttggtgagaccggggctcgcgattacgatggaaatgagct

SEQ ID NO: 3983 - DNA, 401 bp, Triticum aestivum
  unsure (1)...(401): unsure at all n locations
  Clone ID: LIB3281-006-P1-K1-F8
cccacgcgtccgcccacgcgtncgcggacgcgtgggcgcaccggcaccgttccccatcttgatctaaaaccgagggtttcgtccagctccgtcgccgcgacccaaaccagagcccgccccacccaccccagccagccagccatgccgaagaacaagggtaagggaggcaagaaccgcaagcggggcaagaacgaggccgacgacgacaagcgcgagctggtgttcaaggaggacggccaggagtacgcgcaggtgacgcggatgctcggcaacgggcgctgcgaggccatctgcgtcgacggcaccaagcgcctctgccacatncggggcaagatgcacaagaaggtctggatcgccgccggggacatcgttctcgtcggccttcgcgactaccaggacga

SEQ ID NO: 3984 - DNA, 329 bp, Triticum aestivum
  Clone ID: LIB3281-006-P1-K1-F9
cggacgcgtgggtttttttttcctcataaactggatcacgttttttgacctggttttcctcataaactcgatcattttctttgaatagggatcatattcaggtggggattccccccggtgacatgttcaaaagaaaaaagaaaaacactacaagcaacaaacttgtactgtcaaagaggtaaatcttatatcatcaacaacaataccgttggtatcggcatcttccagtaaggagttgcagcaatctgttgaaataaattttccagaatgtagatttttcgcagcatgaattaaagctcccttggtatcagcaccagccttaagcagga

SEQ ID NO: 3985 - DNA, 262 bp, Triticum aestivum
  Clone ID: LIB3281-006-P1-K1-G12
ccgcagtaccggcccggacgacccacgccgacccaggcgtccggcaccctagctaccgcgctcaatggcctgccgtgccacatggtgcatttggcgcggaagcgtgtggtggtgacaagcctagccgtttttggggcggtttccggacggggccgagcgcaaggtggagctgcggcctgagacctggcaccagcgcattgcccggtggggggaccatttttgtcgtggccggtgggggtttggccggaatcaagcggttcat

SEQ ID NO: 3986 - DNA, 257 bp, Triticum aestivum
  Clone ID: LIB3281-006-P1-K1-H1
acgcgtggggcaaaaggacccctactttggtgacgaggcgcaatccaaggaggggtattttgactttcaagtaccccatcgagcacggtattgtcagcaactgggacgacatggagaagatctggcatcacaccttctacaacgagctccgtgtcgccccaaaggagcaccctgtccttcttactgaggcgccgctcaaccccaaggccaatcgtgagaagatgacacagatcatgttcgagaccttcaacacttct

SEQ ID NO: 3987 - DNA, 302 bp, Triticum aestivum
  Clone ID: LIB3281-006-P1-K1-H11
acgcacgcgtgcgggagagacacgaagggacctggtagacttcgactacagacaggaccaagacgaaacgactggcgggacttagacatcaagcgtagacgcttgttatgctcgcatctgcctcttctgggcgggggcgtaatcacaccttttgattgagtgggggaagtgacaatacctgtggtaggagtcggtcacagccttatgatagtgctggtgggtgaaactaaccctggtgcggcagctaacggcggttggcacattaccgacatgtctgagctacagtgacccgtgcatataca

SEQ ID NO: 3988 - DNA, 442 bp, Triticum aestivum
  unsure (1)...(442): unsure at all n locations
  Clone ID: LIB3281-006-P1-K1-H12
gtcccgggccgtactctgccgcgtagacccaggccgacccacgcgtgcgagaagaaacaagccatgactgaagcaggtcgtgtatctctatgaccctgacctacaaagtgcctagatttagccttgttggtatgctgcttgttcttctacagtttgggccttatgtcaagnggttaatcaccagctataggtggagtcggagaagtgacaacactgtgcttaggaatttggggcatacttatgatagggcagggaatgtaactccccatggtgacccacactgtagggggtgcgaacaaaattggacatcactggcgctgaatctggcctgacgaatgggactgtttgcggtgctgaccacaagcatcaacctccacttaactcaagtgagaccttgcctgctttgttgtatgtgccaaggaatggaaagcatgtcatgatc

SEQ ID NO: 3989 - DNA, 431 bp, Triticum aestivum
  Clone ID: LIB3281-006-P1-K1-H5
ggcgccgtcgtgagagacaggacggaggtgatcgacgtcgtcgccggaaagaaatgagaaggaacgacgatcgtggtgaagacatcaagcggcgaggagttccatgccgccaagtgcatcatcacggtgggtgcgtggacgagcaagctggtgaagtccgtcaccggttccgacctgccggtgcagccgctccacaccctcctctgctactggaaggtgaagcccggccacgagcgcgagctcacgacggaggccggtttcccgacgttttcgagctacggtgacccgtgcatctacagcacgccgtcgatggagtacccgggcctgatcaagatcgccatgcacggcgggccgcggtgtgacccagacagcatggactggaccgtcggcaccaccgagggcgagggtgggctggcggatcccgtggcacg

SEQ ID NO: 3990 - DNA, 424 bp, Triticum aestivum
  Clone ID: LIB3281-006-P1-K1-H6
cggacgcgtgggagagaacaagaaggccgtggacagcaagagtaaatccaagaccaagaccaagaaggtggcaagtgttagccttctcggtttgatgcttgttatgctcgtatttggcgcttttgttccagggttcaatcacaactttggattgagtgggggaagtgacaatgcaatgtttaggaattttggtcagcctcatgatagggtagtgaatgtcaataaccatggtcaagcacctaaagggggtttgaacaatagtgacatgactggtgttgattctggaatgatgattgggactgatggcagtgctgaccagaagcatcaacctccacttaactcaagtgagaccttgcctgctttgttgtatgtgccaaggaatggaaagcatgtcaagatcaatggcaatctgattattcattct

SEQ ID NO: 3991 - DNA, 338 bp, Triticum aestivum
  Clone ID: LIB3281-007-P1-K1-A1
gctcatcaccatgtgttctagttgcagccaagtttggttggtcagccaatatggaaaggttaatgagggcgcaatctataggtgatacatcttctctggatttcatgcgttccaggaaagtatttgaaataaatccagagcatgagataatcaagcgattgaatgctgcgtgcagaatcaaccctgacgacccagaagctctaaaggcaatcgacatcctctttgaaacttcaatgatttctagcggctttacgcctgataacccaactgacctgagcgggaagatctatgacatgatgagcacagctatggcgggcaagtgggcgtcgcaaccccaa

SEQ ID NO: 3992 - DNA, 247 bp, Triticum aestivum
  Clone ID: LIB3281-007-P1-K1-A10
cccacgcgtccggctagctccacagttccactttcgcgacagctccccgggaagagccctaactagcttcatcttcatcgcgcctcgccggaaggcatggaccgcaaggacaagtaccgcaagtgctcctcggcagcgttcatggccgcgctcgccgccgcatttgaggtcggcgacgtggtccgagcccacgccatgtacggctaggaggaccagaagctgaagctcgtgaacatttccgtggttt

SEQ ID NO: 3993 - DNA, 418 bp, Triticum aestivum
  Clone ID: LIB3281-007-P1-K1-A11
gcgctccgtcgccgtgcccccggtatcccatctcccacaccaaatcccaatccggctccctgccccgcaccagcgcccaaaaccctagctttaaacccccgaatccaaccgattcccccgccgattcccgccatttcccgccggaacggcgatccaccggacctggatcggttccttctgtcgctgaccaactctaggtttgctccggttgtcccgagagctctgttcttgtccctttttctttctaggacggatactccaatccaattcatcctccggtctgtggcaggtttatttcctgcgcggacagcaccaaggtgtctattcccagctaaatttcgaagaaacattgtcccttctctggttcctgtttggtaagcatggagttcgagggcgaggggggcattggtgttggtct

SEQ ID NO: 3994 - DNA, 415 bp, Triticum aestivum
  unsure (1)...(415): unsure at all n locations
  Clone ID: LIB3281-007-P1-K1-A12
cccacgcgtccgcccacgcgtncgcacacttcagatagggtatactcaggagcagataaacaacgcatgcgtggcggcgtcgttcatgccgacatggctgccctgaagatcgacgacccaaccagctaataaatgtgcgatggtgcttgcacagccgtcgcattctacctaggtacgtacgtatattccggggccgggagcgactactatcgcgttcgcgtacgtcccatagttctgtgtctgttgtgtccttgtgtgaaaaacttttgtgatcgataatgatcgacgtgtatgtcaagactgtctggtacaaagggctgtccgtgcgtcgccgttactataggctggctagctgcagcataaaagacgtgcctgtacgtttcataatttccagtgcagctacatgtagctgtat

SEQ ID NO: 3995 - DNA, 379 bp, Triticum aestivum
  Clone ID: LIB3281-007-P1-K1-A2
tgcagcggaggacatgcagcgggttgtggggtttgggtggaggtgggttagagggatgaccggtggcagcaacggcaactcgggcagaccagggcggcgaggctgtagtgcgggcgttcgtgtgcctggaggaagaaggttacagtccgttggatgcataatatgggagggcggagggaaaactgactgaagaaaaaatcttttcgagcctgaaatagtcgctctcatagaagcttggcacgttttgaagaaccagagttgcctgtgtgttatagagttttttcttgcaactttaaggcctttgtttgctctatcttgaagacctttgttctacacgtcttactatgggtttttaataaatagagttgtgtgatctgac

SEQ ID NO: 3996 - DNA, 412 bp, Triticum aestivum
  Clone ID: LIB3281-007-P1-K1-A5
cggacgcgtgggatcagctatcccatctttttttggacggagaagaccactgagaaggaaatttttgacgatgaagatgaggatgagaagaaggatactgaggagggcaaggttgaggaaattgatgaagagaaggaagaaaaggagaagaaaaagaagaagatcaaggaggtttctcacgagtggaacctgatcaacaagcagaagcccatctggatgaggaagcctgaggagatcacaaaggatgagtatgctgccttctacaagagcctgacaaacgactgggaggagcaccttgccgtcaagcacttctctgtggagggtcagcttgagttcaaggccgtcctcttcgttcccaagagggccccctttgacctttttgacaccaggaagaagctcaacaacatcaagc

SEQ ID NO: 3997 - DNA, 407 bp, Triticum aestivum
  Clone ID: LIB3281-007-P1-K1-A6
cggacgcgtgggatcagctatcccatctctctctggacggagaagaccactgagaaggaaatttctgacgatgaagatgaggatgagaagaaggatactgaggagggcaaggttgaggaaattgatgaagagaaggaagaaaaggagaagaaaaagaagaagatcaaggaggtttctcacgagtggaacctgatcaacaagcagaagcccatctggatgaggaagcctgaggagatcacaaaggatgagtatgctgccttctacaagagcctgacaaacgactgtgaggagcaccttgccgtcaagcacttctctgtggagggtcagcttgagttcaaggccgttcttttcgttcccaagagggccctctttgacctttttgacaccaggaaagaagcttaacaaca

SEQ ID NO: 3998 - DNA, 404 bp, Triticum aestivum
  Clone ID: LIB3281-007-P1-K1-A7
aaatttgtaggatatgcattgtgcttaaacatgagtgcttgctcgccgaacattggccctcggatgaattcggcgcttgaatcgagctgacgagccccatgggggtgagaggcggataacaatatgagaaggagcatgccatggaggagtgcaagcagcggcactcctccgcaatggggtatggctgcaggggaggggacgcagccaacgacaggaagaagaagcaggtcgtcgaggactacaagcagcaggtttcctttgactggaagtctgaaactgaagatagggcatattgttttggttctgagtggccggagatattgttgcttgatgtccctagagcactcggacccttccaagatagaagatctttgggattgacgttctgatgagaaaagagcata

SEQ ID NO: 3999 - DNA, 332 bp, Triticum aestivum
  Clone ID: LIB3281-007-P1-K1-A8
ggttggtggatgatccactgaccgtggtgaataacaggaacaaggcgcttatgctgattgaggcttggggagagtccggcgaggagctccgctacctgccggtctatgaggagacatacaaggtacctgaagaattgttgtatcacattctagttgcctgattctgtctcgtagcaatgagagtctatattttcatttcttgggcaatgaaaagttggcccaaatagcgtgatgtgctttgcaatgtaagtacagaaaacaataatttaggaccaaaaggttgaagtaacctgaagatacctgcatgaatgggaagccagcatgtggatttt

SEQ ID NO: 4000 - DNA, 362 bp, Triticum aestivum
  Clone ID: LIB3281-007-P1-K1-B1
cggacgcgtgggcaggtcggtcgacgggcgcacggccatcgccgccgcgtccggtgccgtggcggccatgggcaacccggcctccgctgcgatcacgcacgttctccacaacaagcaggagttccccctcgccgtcagcatggacgacatcctcgtcctgtccatcggcaccggcgcgttgttctctgccgccacctgcggcaacgggtggagcacgccgatgcccacgcgctcgccgtcgcgagacgagctggcgcgcgtcaccgcccagggagtcgctgacatggtcgacgaggccgtcgccatggcattcggccacgcgagcgacagcaactacgttcgtctacaggccagcagcgcac

SEQ ID NO: 4001 - DNA, 395 bp, Triticum aestivum
  unsure (1)...(395): unsure at all n locations
  Clone ID: LIB3281-007-P1-K1-B10
cccacgcgtccgcccacgcgtncgtgaacttcttgtcattgatgaagctgccgctattccattgccaattgttaaagccttgcttggcccgtatcttgttttcctatcttccactgtcaacgggtatgaagggacaggccgatccttgtctttgaaactcctccagcagttagaatcccaaagccagccatcagcttcaagtgatggacccagttccagcaggctgtttaaaaaaattgaattgaatgaatccattaggtatgcctctggtgatcctattgaaacctggcttaatgagttactttgtttggatcttgcaaactccattccaaatatcagtaggctacctcatccaaaacactgtcagctgtattatgtcaaccgggacacacttt

SEQ ID NO: 4002 - DNA, 146 bp, Triticum aestivum
  Clone ID: LIB3281-007-P1-K1-B11
ggactcaatccctacgctgtgcttgtctagtgtctgcgcggatcgtgaggtccatgtcaattcctcacgtctttcggaccagagcgggaaccctatcctctagcgacgcgctgtcgagggtcccgcggagcgggttcgaacttctc

SEQ ID NO: 4003 - DNA, 396 bp, Triticum aestivum
  Clone ID: LIB3281-007-P1-K1-B12
cggacgcgtgggcggacgcgtgggttggaactgtgccagttggccgtgttgagactggtgtcatcaagcctggtatggttgttacctttggtcccactggtctgacaactgaggtcaagtccgttgagatgcaccatgagtctctcctggaggcgcttcccggtgacaacgtcggcttcaacgtcaagaatgttgccgtgaaggatctgaagcgtgggtttgttgcatccaactccaaggatgaccctgccaaggaggcagccaacttcacctcccaggtcatcatcatgaaccaccctggtcagattggcaacggctatgccccagtgctggactgccacacctcgcacattgctgtcaagtttgctgagcttgtgaccaagatcgacaggcgat

SEQ ID NO: 4004 - DNA, 355 bp, Triticum aestivum
  unsure (1)...(355): unsure at all n locations
  Clone ID: LIB3281-007-P1-K1-B2
cctcacgcgttcgcccacgcgnttcgcacacttttagatagggtatacctcaggagcangagtgaacaacgcatagcgtcggcggcgtcattcatgtccgacataggcttgcctctgaagaatcgcaccgacccaactcagctatatataatgtgcggatggttgcttgcacacgccgtctggattctactctaggtaccgtacgtatatatccggggcacgggagcgactactatcagcgttcgcgtacgtcccatagttctgtgtctgtggtgtgcttgtgtgaaaaacttttgtgatcgataatgatcgacgtgtatgtcaagactgcctggtacaaagggctgtccgtgcg

SEQ ID NO: 4005 - DNA, 414 bp, Triticum aestivum
  unsure (1)...(414): unsure at all n locations
  Clone ID: LIB3281-007-P1-K1-B3
cccacgcgttcgcggacgcgtgggcgcaagcagaggcaagaatggcgatggcgaggaggagggccctcgcgctcgtgtcccagatcctacagaggcgggttctccccgcgccgcgcttcctctcgtcggcggccggcggcgctctagaccgcctcaattcgccgcccttcgcgcgccaggccgcgcacaggaaccccgctcctccttccccatgggatcggctcggagggcagaagaggaccatgttcatccagacgcagtcgacccccaacccgcagtcgctcatgttccatcctggaaagccggttatggaagttgggagctctgatttccctcatgctcggaccgccatgacatctnctttgggcgaaggcgctgttgcgatagaaggcgttacgagagtattttttggat

SEQ ID NO: 4006 - DNA, 405 bp, Triticum aestivum
  unsure (1)...(405): unsure at all n locations
  Clone ID: LIB3281-007-P1-K1-B5
cccacgcgtccgccctaaaccaaaagtgcatttccaagtgatggccgtccacttcgagtattcactgatataccccaagtagaggagttcttaacacgtncagagnttgttctcacaactgatccgaaggatgcagacatcatctgggcaggcatgcaaattgattctgaattaaagagttcactaggtctcacagaccaacaatacatgaatcagtttccttttgaggcttgtctggtcatgaagcaccacctagcggatactatccacagggcatggggctcacctgagtggcttcaacctacatataacctagagacccatttgtctcaactaattggtgattactctgtgaggaaacgggatggtaaggacaacttatggatcatngaagcctggaatatg

SEQ ID NO: 4007 - DNA, 358 bp, Triticum aestivum
  Clone ID: LIB3281-007-P1-K1-B7
cccacgcgtccgcggacgcgtgggatgcgggaggaggtcaggagctcgtcgggggcggcggccgagccgcagttcgccgtcgtccgctcgtcgtcgccgccgcccaccccggtcgccagttctgctggtgcctcatcacctgctatgcaaattaatatattaagcatagattggttgggtagcagacaagcttccagggttgattcctcgtcacatgttgcaccacatgcctatgggcctgctcatagctttgatgctcctggaactgctttgtattctgcaccatcttgtagaccatgggagcgtggagacttacttcgtcgactggtaacattcataccttcaacttgggatgcta

SEQ ID NO: 4008 - DNA, 384 bp, Triticum aestivum
  Clone ID: LIB3281-007-P1-K1-B8
cagcgggttcggccctgccccgtcgcttgccgccatcatcgccaaccgctaccgcatgcccaccgacgtcaagaccttcaacctgtccggcatgggatgcgccgcgggcatcgtcggcgtggacgtcgcgaggggcgtcctgagggcgcacgccggcgccgtcgactacgccgtcgtcgtcagcgcggagatcgtcacgatcgggtggtacagagggagggaccgcagcaagctgctgctcaactgcttcttccgcaccggatgcgccgccgcgctactgtcgaacaccgcatcggcggcagcgccggtcaagtaccggctcgtcgcgctgaagcgcacgaccatcgcggtcgacgaccgcggctacaacttggccatgaggga

SEQ ID NO: 4009 - DNA, 381 bp, Triticum aestivum
  Clone ID: LIB3281-007-P1-K1-B9
aggcaaagcaaatcgcaccaggcaaatcacacagagagcgccgccgtcccaatattccggcgaaccccaaagcgagcgagcgattcccaggagaggagaggaggcggagatggccaagggcgaggggccggcgatcggcatcgacctcgggacgacctactcctgcgtcggcgtgtggcagcatgaccgcgtcgagatcatcgccaacgaccagggcaaccgcaccacgccctcctacgtcgccttcaccgacaccgagcgcctcatcggcgacgccgctaagaaccaggtcgccatgaaccccaccaacaccgtcttcgatgcgaagcggctgattggcaggaggttctctgacccctccgtacagagtgacatgaagct

SEQ ID NO: 4010 - DNA, 144 bp, Triticum aestivum
  Clone ID: LIB3281-007-P1-K1-C1
ctcccttgcagtttcagccatgggtaaggagaagactcacattaacatcgggggtattgtgcatgtcaactctggaaagacgaccactacatggccatttgatctacaagcttggaatgtatcgacaagtcggctgatccgaga

SEQ ID NO: 4011 - DNA, 336 bp, Triticum aestivum
  Clone ID: LIB3281-007-P1-K1-C10
ggggcgactgaacagagatcgatttcgactaaaacctctcgccgccggcggggaagctcggagacctattgacctagttcctgatgtccgacgccgatgattaccgttgctttgttgggagcctgtcatggaacacaacttgatgcggatctgaaggatgcgtttgggaaattaggacgagttactgagaccaatgtggttcttgacaagttatctggccgttcacgtggctatggatttgtgactcttgatgacaagaaggccatggaagaagctgttgaggttatgaatggatattgattttgaggggaggaatttttattgtcgaaagagcat

SEQ ID NO: 4012 - DNA, 405 bp, Triticum aestivum
  Clone ID: LIB3281-007-P1-K1-C11
ctcctgtccatcatcacctccacgacgcctgcctcctccctttctcaagctgctacaaaagaccacacacaagcaagcaagcagagtcacatcacaccaccggcttggctagctccccacctcacctggggcaattccctctcgcataaactatttcttggatccttgagagaggatctagagcagcagcagtgggatctgcgcgcgctcaccagatattatgggtctagacgccgccgaaatctctgaattggcggcgctccggccgatccacacggacgtgagcggcgcccggcccacccaagtgccaggggcggtcgacgatgacgctgccgacaccggctgtgttacacccaaggcgagcggcgggcgatcggcctctgcaagaggtgcggacgacgacta

SEQ ID NO: 4013 - DNA, 266 bp, Triticum aestivum
  unsure (1)...(266): unsure at all n locations
  Clone ID: LIB3281-007-P1-K1-C12
ctggaagccactttttgggatacgaagggcacggtgtcattctttatatagggactatggcaaagggcatagggaacggaatacccatcggagcggtcgttaccacacctgatattgctaaggggttaaacaacaaaaactactntaacaccttcggtggtcaccctgttagcacagttgacggccacgcttttattaaggtactggagaatgagaagtatcaggagaatgccttctttgttttcttctacctgaaggagaaactt

SEQ ID NO: 4014 - DNA, 230 bp, Triticum aestivum
  unsure (1)...(230): unsure at all n locations
  Clone ID: LIB3281-007-P1-K1-C3
agagaggcgacagaggaggcgncacgggcccggcccgagcccggaactncgccgccggcgacgccggacggagaggagaagggggaggagcccggagcgccgctgaagaaaggagaaggagccaagccgcncccaaaccggaagaagggcccgcgccggagaaaggcgacaagccgaaggggaccanggcgccggcgcgcccgagccgcgagcggggganaaaggagggg

SEQ ID NO: 4015 - DNA, 232 bp, Triticum aestivum
  Clone ID: LIB3281-007-P1-K1-C5
cggacgcgtgggcctagagataaatttggacaccggcgagcccctgtcagtagagttacaccaagtctatgcttgggtggagtttggtccagatatgatcggcagcactaaccgcgagctgggagaaagcccaaagaactcgacgaagaagggaatgttcttattttttggggagaaataccttgcgactgtacgtgaggaagacaccctggaatatattgcttgattttgt

SEQ ID NO: 4016 - DNA, 369 bp, Triticum aestivum
  unsure (1)...(369): unsure at all n locations
  Clone ID: LIB3281-007-P1-K1-C7
aaagaaanaaagggaaagaagcaaaaccatanaaaaaaaacaaagaaaaaagaaaaaaaagtaaaaataaaaaaatcaaaaaaagaggggaaaaaaaaaaaaaaagaaaaaaaaaataaaaaaaaaaaaaaaaaaaaaaaaaaaaaagataaaaaaatttaaagaaaaagagaagaaaagagggaaaagaaacaagagtaaaaagaaaaggggaagagataaacaaagaatgaaaaagaaggtgaaagagaaaaaagaaagaaaaaaatggagaaaaaaaaaaaagacaaaaaatagaaacaaaaaaaacgaaaaaaacaaaataaaaagagtatgccaaaaaaaaagaaaaaaaaaaagaagacaagg

SEQ ID NO: 4017 - DNA, 348 bp, Triticum aestivum
  Clone ID: LIB3281-007-P1-K1-C9
cggacgcgtgggcggacgcgtgggtcaatgacaagatccaatctgtgattgatgctggtgtctgtcctcggcttgtggagcttttcctccatccatcaccttcagtgcttatacctgcactacgaactgttggaaatattgtcacaggagatgactcacaaactcagtgcatcattgatcatcaagctcttgggtgtctcctaagtctgttgacacaaaatcacaagaaaagcatcaagaaagaggcctgctggactgtttcaaatatcactgctggtaacaaaaaatagattcaggcttggattactgctgggattatttggacctctggtgcattttgctgcaaac

SEQ ID NO: 4018 - DNA, 257 bp, Triticum aestivum
  Clone ID: LIB3281-007-P1-K1-D1
ctcgacagcatgtaggtgaaaaggaagcatgacttgtgtcaaaagtatgcttcttctccgtgtaaaaactaaagagatggagataagttgttggtggttcaattattattgtttgctgaacctaactagattctcagcccggtataaattgtatttggctgctaaccagtttgttgcctatgaacaatcctaatattggattcttttaaaatatattatcgaggaaaatacggtgcagactgtaccattgtgtgggg

SEQ ID NO: 4019 - DNA, 365 bp, Triticum aestivum
  Clone ID: LIB3281-007-P1-K1-D10
tgcgcgcaggtgctctcaacaagtctatcagagtagagaagattcctggcgggcacttggcggattccatgggtcttaaaggggtcatgtcccatcaagatgtggcccctcctggaacaatgtcaaggaggatggtacatccacgcatcatgcctttggattgtcctgttgagtgcaaaaagggagacatttaatcacttgctgagtcgatgagtgaagaagattggaaggttcctcttgacttcgtggaagacaccatcaagaatctctgtgtgcaaattttgaaattcaagcctgcacctggtatctcatagaatggacacattgacatcgctctgcattatttgagcaacgctggtgtagtg

SEQ ID NO: 4020 - DNA, 375 bp, Triticum aestivum
  Clone ID: LIB3281-007-P1-K1-D11
gctgccggcaatggcggcggcggcggagcaggactactggggcctgttccgggaggagacgggctggtacaacgagatctttctcagcgccgtcgtgccgggcggcggcggctggtggcgggcgctgccgcacccgctccgctcctggctgcgcaactgcatcggcggctacctcctctacttcgccaccggcttcctctggtgcttcgtcatctactactggaagcgcaacgcctacattcccaaagatgctgtccctacagtagaagctatgaagaagcaaataattgttgcatcaaaggctatgccgttctactgtgctcttccgtccatatctgagcacatgattgagagtggatggacacggtgtttttt

SEQ ID NO: 4021 - DNA, 386 bp, Triticum aestivum
  Clone ID: LIB3281-007-P1-K1-D12
gttggtctggtctgatgaagtgaaccctagctcgattcgattccggcgccgccggccaagcccgaggaggacgattagattccaccgccgccgcccaagcccgaggaggacgatttgatttcgccgccgccgcccaagcccgaggaggagagaaggggagaggatggcgtacgtggggccgacgctcgagtccctcgtcgaccaggtgatcttcgtcatcaccaacgacggccgcaacatcgtggggactctgcgcgggttcgaccaggccaccaacataatcctcgacgagtgccacgagagggtctacttcactaaggagggagtacagcagcttgtccttggtctgtacatcatcaggggtgataacatatgcgtggtgggtg

SEQ ID NO: 4022 - DNA, 340 bp, Triticum aestivum
  unsure (1)...(340): unsure at all n locations
  Clone ID: LIB3281-007-P1-K1-D2
tcgcacgcatntgtntcaactgcggcgaaaacacaccagcgctcccctatacgcttggtttgccgccgcaatgtcgaccgacgccattggcgtcgacataccggtgcctgaggcggaggcgaccgccgaccccaacgaggagaccacgactgacgcacacgacgacgacgctaagactaccaaagcgaccaatgccaaggtcgtaaagaccagcaaggcgcccaaggtgaagaagccctggcgcccgaggaagccaaaggccgaaccaacccacccgatctacgctgagatggtggaggaggcgatcgtctagctgaaagagagaggcggtttgagcacc

SEQ ID NO: 4023 - DNA, 371 bp, Triticum aestivum
  Clone ID: LIB3281-007-P1-K1-D3
tcgccacgaaccgccttcctcgccccctcccgtcgcgtgccccagactccgtggcggcggcggcggcggcggcgctgctcctgccgaggctccgtccatccagatggacagccataattcatctacgccccatgttcctgaagtaaccatggacatctcatccgcttctggagcagctgggaacaaaatttgcagaggtgctgcttgcgacttttctgatgtcagtaacacctccaaagattcaaaggaaaggtctgcatccatgaagaagctcctaattgctgtgatcctttgtgttatattcatggcgcgtgaagtggttggaggcatcaaagcaaacagtcttgcaatcttgactgatgctgcccatc

SEQ ID NO: 4024 - DNA, 381 bp, Triticum aestivum
  unsure (1)...(381): unsure at all n locations
  Clone ID: LIB3281-007-P1-K1-D4
accggccgatccggtcgccacgcgccggcgagggcggtcacccttaggaggcggtccgggcggcgggactggactgggagggccgcctgcactgcgggttggatgacgcgcgcaacacggcgcggcttcttgttgagctcatgttgcgtggngtcaagatgaccatcacgggctcgctggcgccatcgccgccgatccagcagcagccgcagcagcttctcacaagcccttgcggtggctcatctgcgctggcgccgccgccgccgatccagcagaagcagcagtcgccgcagcttcgcacaagcccttgcggtggctcatcggcgctggcgccggcgctgatccaacagcagcagcagccgccgcaacctcacatgataa

SEQ ID NO: 4025 - DNA, 398 bp, Triticum aestivum
  unsure (1)...(398): unsure at all n locations
  Clone ID: LIB3281-007-P1-K1-D5
cccacgcgtgcgtcagccttcattgctatcgtgccaaccccaaatccccagtgtgcggcgaggttcccacatcccatctggtgcgtagcagcgagcgccggcgatgggcggaaagaggaagagcaccggngacgtgaagacaccgccgacagtgggccggcggccgggccgcccgaggaagaacacgccgccggaggcgatccggcgcccgggccgcccgaggaagagcgagccgggcgtcgaggtgccgctggcgcgcagcccggtctcggtgcagacgctggcgtcgcccagatccaagcgcgaggaggaggcgaacggcgggctgctggagctcgcgcgcggcgcggcggtcatagcctcggcggaggaggaggaggagcacgtcatgatgcgct

SEQ ID NO: 4026 - DNA, 386 bp, Triticum aestivum
  unsure (1)...(386): unsure at all n locations
  Clone ID: LIB3281-007-P1-K1-D6
gcgcgccgtcacacgaacccccccacccaacccgagcgagcaccggccgaggaggaagaggaaggtgagatggctcgcggcacggcggcgacggcggcggcggctgccaagggcaagaagaaggggtccgtctccttcgtgatcgactgcaccaagcccgtggaggacaagatcatggagatcgcgtcgctggagaagttcctccaggagcgcatcaaggtcgccggcggcaaggccgggaatctcggcgactccgtcaccgtcacgcgcgacaagagcaaggtcaccgtcacctccgacggcgccttctncaagaggtacctcaagtacttgacaaagaagtacttgaagaagcacaacgtgcgggactggcttcgtgtgatcgc

SEQ ID NO: 4027 - DNA, 137 bp, Triticum aestivum
  unsure (1)...(137): unsure at all n locations
  Clone ID: LIB3281-007-P1-K1-D7
ccgtctcgctagttctagggatcgcggnngcggccgcttcnntagaggatctcaacgctttacgtaccgcggttgctatgcgacagtacatagcttcgttctattagtgtcnnacctaaattcaatatcactcggcg

SEQ ID NO: 4028 - DNA, 411 bp, Triticum aestivum
  Clone ID: LIB3281-007-P1-K1-D8
gacgaggggcgtgtcaaggaggcgaaggaaggggaggggaacgacgacgacggcgacgacattattgacctgtgcagcgacggggaggaaggggagaggacggcggtggccggcgagatggaaatggaaggggacgaagatggggatgacaaagtgccgctgagccagcgcttcaagcgactacggcgagccgagcccggtgagttggaatcggggaagggagatggacaggggcaaatcgattctgtcagtattctggggaatgatcagcagaaatcttcgtttgtaaagatggaggagcagatgacaagaactgggaagatggcctgtatgcccgaggcttcaaaggtggcagctttcgtgcaggagagtgcagttgtgaaatcagaaaaagttgatgatgagataccc

SEQ ID NO: 4029 - DNA, 343 bp, Triticum aestivum
  Clone ID: LIB3281-007-P1-K1-D9
cggacgcgtgggcccaccaccccgcgggaagcagcctgggaagtagctagggtagcttcgaggagtccgcacgcgccgcagccgccgcctctccccagcgccgccacagccgcgccccatggccaagggcaagttcaagggcaagcccaccgggcagcgcaccttctcctccaaggaggagctcgaggctggtacttcagcagatcgcccaaagaccttttctaagaagaagcaagaggtatctaacagaagggaagagtcaattgaggaggaaagcgatgaagaggttgagaagaccaaacacaaaggcactgcaggtctcatcgagattgacaatccaaac

SEQ ID NO: 4030 - DNA, 351 bp, Triticum aestivum
  Clone ID: LIB3281-007-P1-K1-E10
ctcacgcgttctgggacgcgtgggcgttggctggctaggcctgttgttggctcttatcggccaagaagggctttggaagggcctctgccggtagatgcacgaatgacctggtggcaagtacgccgggcgactaccttctctggattgacttcggatagttgggtgacgagaacatgaggattgttaccgagctctaggagcagcagcgcttgctataaaaggtgcttgaggagcaactcaaattgagtagggcgactgccaacatatcgcggttggtgaagtaagtcttcgggctcatgaattacacggacgatattgtcaacctgatcagcgtcatcgattacgactacg

SEQ ID NO: 4031 - DNA, 402 bp, Triticum aestivum
  unsure (1)...(402): unsure at all n locations
  Clone ID: LIB3281-007-P1-K1-E11
cggacgcgtggggccagagaagaaggagatggttggcatgcaggaacaggtgtgtaactttattttactacacttataattgacatctgttacctaatgcttgttatttgcctttcaggtttttgtctggaaaatcattgagctgcatgacaagtatgtagcatatgtgacagattgttttcagggccatacactctttcacaaggtctgctggttgatacgtttgttttccacgttgctttcatcgtaaattgaaatggctgcctcattctcaaacttctctttgtccaggcacttaaagaagcctttgaggtcttctgcaataagggtgtctctggcagttccagtgctgaattacttgccaccttctgtgacaacattntgaagaaaggctgcagtgag

SEQ ID NO: 4032 - DNA, 391 bp, Triticum aestivum
  Clone ID: LIB3281-007-P1-K1-E12
tggacgcgtggggccagagaagaaggagatggttggcatgcaggaacaggtgtgtaactttattttactacacttataattgacatctgttacctaatgcttgttatttgcctttcaggtttttgtctggaaaatcattgagctgcatgacaagtatgtagcatatgtgacagattgttttcagggccatacactctttcacaaggtctgctggttgatacgtttgttttccacgttgctttcatcgtaaattgaaatggctgcctcattctcaaacttctctttgtccaggcacttaaagaagcctctgaggtcttctgcaataagggtgtctctggcaggtccagtgctgaattacttgccaccttttgtgacaacatttttgagaaag

SEQ ID NO: 4033 - DNA, 404 bp, Triticum aestivum
  Clone ID: LIB3281-007-P1-K1-E4
gaggttctattctcaagaaagagatgataactctgaaatgtgccgcctgtggctttctttcggatgttgacatgagggacaagctcactacattcatcctgaagaacccaccagaggcgaagaaaggaggcaaggacaagaaagctatgaggagggctgagaaggagcgtctgaaagaaggtgaagcagctgatgaggagatgaagaaactcaagaaggatgggaagaagaaaggtgcttcgtccaaggagagtactgcaaaaggtgttgccacaaagaagaagggtgctgggggctctgatgaagaacatatctcatcaccaagagatgctgactttgcggctgctgcagatgatgatgatgatgacgatgatgatgtacagtgggcgactgacacgtcagca

SEQ ID NO: 4034 - DNA, 301 bp, Triticum aestivum
  Clone ID: LIB3281-007-P1-K1-E5
cggacgcgtggagccccgacggttaagcccccagacacccgaatggcttcacttcaaccggagagggaaccattgggggcggcaagaacaaacgccttttcaaggggagggagggttgcaaaaagaagggcggcgatcccttcaccaaaaaacaagggtgttacattaaagggcccgttgtggtcaacaaccccaacggtggcgagacccttgtgttcaagacaccaggtaccaagattggcttaaaaggtcttaaacaccaggtggttcaagtatttttaacttgtctttagaaccatga

SEQ ID NO: 4035 - DNA, 409 bp, Triticum aestivum
  Clone ID: LIB3281-007-P1-K1-E6
gtacttcatgtctgtgaagctcccagtggcgaatggattttttatgtttgggatggaactgatactcctccaactgagcttcagacacgtttggacatggaagcagttacaccaacccctctgcatcctgaagaagcgccgttacccagggaggttctatgcacactgccttgtgttggaactgtcctgagggtattctcaaacagattttcaaaggaaatactacacttgcaaaaggatatttactgggcccggttctgcaatattacttgcaaacaggagtttggcatgtggaaaggctctttgctgccttctagtagaatccgtcttttatctaatgaagatggcagtgtcattgaacgtttgaagtaatcttctcttttctcatggatggctagtgcatcttaaa

SEQ ID NO: 4036 - DNA, 375 bp, Triticum aestivum
  unsure (1)...(375): unsure at all n locations
  Clone ID: LIB3281-007-P1-K1-E7
ctcgcggcggcgtcgtgggtggaacccgctccaggcattcttccaccgaagaatcgggacttttccgcggctagatttggcgtcgggagaggaaattcgatctgaaaatggggttgttccgggccgcgtcgggtttagcccgggtggcgctgcggaggagcctgtcgtgcgctccggcgagcccgttcgccggccccgcgccgcggtacttccactcgacgctcccccggcggtacgcggcgcctgagccccgcgccgtgccgctctcgcgcctcaccgacagcttnctcgatggcaccagcagcgtgtacctcgaggagctgcagcgggcgtgggaggcggacccgacctccgtcgacgagtcctgggacaact

SEQ ID NO: 4037 - DNA, 412 bp, Triticum aestivum
  Clone ID: LIB3281-007-P1-K1-E8
cggacgcgtgggtagggctatcagcggtggcttaatctatgtttttaaagcgtccctaaggtgacgcctaggcgacgcctaggcgtcgaagcgctccccctccgctttggaaaatcgactgctttgggcgcctaggcgtccaaagcgcccgcctaggcgtcgcctaggcgccaaagcgccccccctccctaaggcggtaaggcgtcgccttaaaaacatagggcttaatgcaaaaaaagtgcgcaagcatcattaggacaattttgttttagtgactaatgaatatcagaacattattctcgtactcgaatataaataatttgcattaagatcaagcatatgacggtacgctttgtgcatcaattatattaagttggtttctacggcaacaattatttatcagtcaacgtgt

SEQ ID NO: 4038 - DNA, 362 bp, Triticum aestivum
  unsure (1)...(362): unsure at all n locations
  Clone ID: LIB3281-007-P1-K1-E9
attcctcccaccctcgccgtctcgccgccgtcaccaccgcagctagataagagaaaaaaagagagagaagaactcgtcgggagggctcgagatctgtgttcggagaggggaattcttgaggtcggaatcggaacaagcgggcgcgctcgggatcggggttaccatacaatttttcccaggaacctttagtgaatgtgctaatggagtcaaagggtggcaaaaagtctagcagtagtagttccctgatgtacgaagctcccctcggctacagcattgaagacgttcgacctgctggaggcgccaaagagttctctgctgcatactcgaactgcgcgaaagagccatnctgatatcggttttgg

SEQ ID NO: 4039 - DNA, 258 bp, Triticum aestivum
  Clone ID: LIB3281-007-P1-K1-F1
tccaatctttcgcccactcgtccgctgtctcgtggcctcgccgctgataggtatgaggcaatattactgcgcgcagatccaaagcatgtctttgcattcgcctcccctgattacaaagcccaggcacgggttttaccgtggacaagcaccggttggttcgcttcgcaaacattttcgtcatgctcgctctcctaatagtgctacagggccgaacaggtcgccattactctcagcagcgcagcctcaatggcgaatggg

SEQ ID NO: 4040 - DNA, 353 bp, Triticum aestivum
  Clone ID: LIB3281-007-P1-K1-F10
atggaagggtgtatatacattaaatcatccacaatcatatcacaggatggtcatgagtttgcacatcaaggagtttagtacttgacaaaaattacacaataccaaagaagttcggacgacgacgctaggcagaagagtagaagatctaacgatagtaattacggggatagtcggaccctccctcaggtcccgccaacttcctcgacccaaacggaggaggcgtggagggcgccgacacgggtgccgcagcctgaccgcttttttcgtttcccggtgatcattgcccacatcggcttgaccgcctggaccttagagctaccgccggccttctttgacccatctgcacagaccac

SEQ ID NO: 4041 - DNA, 418 bp, Triticum aestivum
  Clone ID: LIB3281-007-P1-K1-F11
gccctacaccagcaatggccgatccagcggagcaccgcgaggaggaggaggaggccgcggcggccggcgaggaagaggacaccggcgcccaaatcgctcccatagtgaagctcgaggaggttgccatcacaaccggcgaagaggacgaggacgtccttctcgacatgaaagcgaagctctaccgatttgacaaggacgggggccagtggaaggagcggggcacgggtgccgtcaagctgctcaagcacaaggagactgccaaggtccgcctcgtcatgcgacaggccaagaccctcaagatctgcgccaatcacctcgttgtggccacgacgaagatgcaggagcacgctgggagcgacaagtcgtgcgtgtggcacgctctggattttgccgactgtgagctcaaggaggagatgtt

SEQ ID NO: 4042 - DNA, 416 bp, Triticum aestivum
  Clone ID: LIB3281-007-P1-K1-F12
cggacgcgtgggccctgccacaaatatctctccctccctccccttccacctacgcttctctctcctcctttgcccctcctctctccctccgatctgctcacctatccccgcctcgggagtcgggtccgtccctttctcgcgttcgctcgagcgggggcaggaaaccagagaaagggcggccgcgaggagcggcggcggcggccagaggaagagggaggcgacggcggccgctagggtttcgatcccggcggcggtgcggcggacgatccacaacatcaaggagatcgcggggaatcacaccgacgaggaggtctacgccgcgctccgcgaatgcgacatggatcccaacgagaccgcgcagaagctccttcaccaagatacctttcatgacgtgaaaagaaagcgggacaagaaaa

SEQ ID NO: 4043 - DNA, 428 bp, Triticum aestivum
  unsure (1)...(428): unsure at all n locations
  Clone ID: LIB3281-007-P1-K1-F2
tgcacgccgcggaccggccggatccggtcgaccacgcgtccggcctgggacatttaaaatggaataaacccaaaccccaaaacccaacccggggtcctgcccaattccaagatcccacgtttccccgttccaaattccttccccaattccaagatccctcgccgcccggggcgattccggagctaggcagctaggggtttgcaggtcctcggaccgagctgcgcgatctcgccgtccgctcgggggctagggtttggattgggtacagncctgagcgagctctggattgagatttgggagagtggtcgcggttctggatcgagctgccccgtgtgctgcgatggtggttagtggaggaggacgccagtgacggtttgtttcggtgggataaggaagaccccccgcagccatggtgcggctttcgggct

SEQ ID NO: 4044 - DNA, 247 bp, Triticum aestivum
  unsure (1)...(247): unsure at all n locations
  Clone ID: LIB3281-007-P1-K1-F3
cggacgcgtgggggcagtcaggccccacccacagacagacggacctctccccccttctcgtcttccatggcggaagccgacgcccaaacccagagcaacgcgcacttcttctcgccgncggcggaggcgtcgggcgagccgatccggccgccccaggtaggcgctccaagtgctgcttctcccacgtttccactcatgtacccgatgctcgtgccagggatgttcttccaacagggtatgggatgat

SEQ ID NO: 4045 - DNA, 419 bp, Triticum aestivum
  Clone ID: LIB3281-007-P1-K1-F4
tgcatttatagggaccagctcgcgaatgtatctccggttctcctcactatgtattgcatttgtctttcaagtcgggagaatgcaagtcagatatggcccgagtgctgattatcatgtaaagttgccccaccccacgtattccccgcaccgcaccttttcccccttccccggcctcggcgagaccgcgcgcggcgcaccatgacgagctccgcctcctcctccccttcccgcaaggtgctgagcaagatcgcgtgcctccggctgcagaaggagctcggcgagtggcaggccagccctcccggcggcttcacctacaaggtgggtcatcgaggtgtcgggggcagaggggacgctctacgccggcgagacgtaccggctgcaggttgacttcccggagcagtaccccatggaggctccac

SEQ ID NO: 4046 - DNA, 319 bp, Triticum aestivum
  Clone ID: LIB3281-007-P1-K1-F5
tgcattcataggaccagctcgtgtttgtatttccgagtctcctcactatgtatggggtttgtctttcaagtcgggggaatgcaattcagatatcgcccgcgtgctgattatcatgtaaaggggtcgcaccccacgtattcctcgcaccgcaccttttccccctttcccggacatggagagaccgcgcgccgcgcaccatgacgagcttcgtctcctgctccccttcccggaaggtgctgagcaagatcgcgtgcctacggctgcagaaggagctcgtcaagtggcaggccagccctcctcgcggtttcacctacaaggt

SEQ ID NO: 4047 - DNA, 420 bp, Triticum aestivum
  Clone ID: LIB3281-007-P1-K1-F6
cggacgcgtgggtttttgctaggtttccctctccgccgccacagccgcttctccccatctccctcctcgccgccgctctctgctctccgctcgccgccatgggacgcatgcacagcaacgggaagggcatgtcgtcctcggtgatgccctacaagcgggaggccccggcctgggtcaagacgtccgcgccggacgtggaggagatcatcgtgcgcgccgccaagaagggccagctgccgtcgcagatcggcgccctgctccgcgacggctacggcatcccgctctccaaggccgttaccggcgccaagatcgtgcgcctgctcaagacgcgcgggctggcgccggagatgcccgaggacctctacttcctcatcaagaaggccgtcgcgatcaggaagcacctggagaggaacaggtcgg

SEQ ID NO: 4048 - DNA, 78 bp, Triticum aestivum
  Clone ID: LIB3281-007-P1-K1-F7
cggacgcgtgggtcaagacagcatagcaacaaggtttaattaactccattcatttggaaagaatttggtttcagactg

SEQ ID NO: 4049 - DNA, 399 bp, Triticum aestivum
  unsure (1)...(399): unsure at all n locations
  Clone ID: LIB3281-007-P1-K1-F8
cggacgcgtgggcggacgcgtgggtccccacctactccctcgccgcgccgccgcgcagccgcgagtgcagcgaacatcggcgccagtgccacgcttatggccgccacctcccattccctcctctctccggcgcccacctcgcccccccgcgcccgcctccccttccccgccgtccgcgccgtcgccccccgccgtcgctcctctttcccggccgtcgcggcggcggcctcctcgatggcgtcctcggatgccgaggagaagaaggagaccaagctgtggggcggacgcttcgaggagggcgtcaccgacgccgtggagcgcttcacggagtcaatctcctacgactggcagctgtacaagtacgatatcatgggcagcaaggcccacgcgtncatgctc

SEQ ID NO: 4050 - DNA, 340 bp, Triticum aestivum
  Clone ID: LIB3281-007-P1-K1-F9
cccacgcgtgcgccctcccagacgttcttcttgcaggtgctcaacattcccaccaagattaacaagggcactggggaaattactatccctggggagctgataaagaagggtgacagggtgggctcctctgagtctgccctgcttgccaagcttggtatccgccccttatcttatgggctggtcatctgcaaagtgtatgacagcgggtcagactttaggcctgaggttcttgacctcaccgaggaagacctgatggacaagtttgcttctggtgtgaccatgggtgcctcactgtgcctggcgatctcatacccgaccatggctgctgcgccacacatgt

SEQ ID NO: 4051 - DNA, 197 bp, Triticum aestivum
  Clone ID: LIB3281-007-P1-K1-G11
gccatacatcagcactggtccttttagcggagcaccctcaggaggaggaggaggtctctttagccgacgaggaatataccaccaactcccaaatagctcccatagtgaatctccatggaggttgcccttacatccgtttaagagtactacgactttcctcttgacctaaaagctaagctctaccactcttacaagga

SEQ ID NO: 4052 - DNA, 416 bp, Triticum aestivum
  Clone ID: LIB3281-007-P1-K1-H1
ccacactccctccttgcctctacgccgccagcggttttatgggcacgtcaagcaagaagtccgcggcccctacagtcgtggcgccggcggacgtccttaccaaggggaaggccgggaagaagcgcgaagtcgatgaccagatcgagaaggctgtaagcgcaaagaaacagaaggctgcgccggcaaaggcggtgcccgggcccaaagaggccgccaagaaggccaagaagcagccgccgcccaagaaggttgagagcagcagctctgaggaggagtcatccgagtccgaggaggaggaggtccctaagaagactgcaaagcctgtcaaacacgagtcttcagatgatagcagcgacgatttctcctctgacgaggaacctgcaaagaagccttctgctaaacctgtgacctcagct

SEQ ID NO: 4053 - DNA, 405 bp, Triticum aestivum
  Clone ID: LIB3281-007-P1-K1-H11
ggacgaccagcataccttgctcttagaatcgagccatctggtaaaagtctgctgaaaatatggaacctgaacaatttgtctgctgctgtcggagtattcaattgtcagggagctggaaactggacttggttagtcgaagaaatttcacatgttcccaccgccgttaacataaccggtcagctctcgccatcagatgtagagtctctcgaggagattgctggtgatgattggaatggagagactgcagtatatgctttcaattcatgttctctttcaaggctccagaagcaccaaagtttggagctgtcattggtcactatgacatgtgagatctataccatatcaccgatacaggtttacggtggggctggtcggttcgcaccacttggactgctcaacatgttc

SEQ ID NO: 4054 - DNA, 414 bp, Triticum aestivum
  Clone ID: LIB3281-007-P1-K1-H12
gagctgacgggcatcgtactcaaaagacagttgagcgtgggaggtttcatagagatagacttgatgaatgtttttatgcggaggttccagcagctagagaatgcttgggccagaaaatatggcgactcaccatggaggcattacttggaaccagacttcatgagccacgtattgcgaggcggaggattcatccataatgactatgtaaggaacatttttgttgggcatcacatctcgcatgatgtcaacagatgccctatgatggtcttgccagtgcatcatgcgcacgcttggtcaacatatatattcgacttcccgaggaggaggacaaccattttagatcctatgatcaacaacggggacagaccagcagatgaattgcgcaacgaacacataaaaatagcagacgagcta

SEQ ID NO: 4055 - DNA, 401 bp, Triticum aestivum
  Clone ID: LIB3281-007-P1-K1-H2
ctcctctaatacgctcactggaggagtttctgttatgccagcgaccagagttcattgtcaattttcccttagtagactttatccattctaaggggggctttcttaaccttgcggctaagttacccccagatgccctacagtctgaagtaggcctaaagctgcttattgcatatggaaggcagcaacaacctggtaaaagcgattcagtgacaaatctgatggttaagatgggtgatgtggtacacatgttaatgcatagagctgaaatgcgttacctatgttcaaagagtctacaacctgagcagccggaaaggattgccaatgggatggcagtgcatgtaaatgctcatgcacctgtgcaaaacttgaatctggatatgggggaacaattaactgaacac

SEQ ID NO: 4056 - DNA, 298 bp, Triticum aestivum
  Clone ID: LIB3281-007-P1-K1-H3
gatcccgcctccgcttcttaatacgctgactggaggagtaattgatgtgccagcgaacaaaacccattgggaagtttgccttcgtagacatgattcattctaagtggggctttcttaacctggcgggtaaattacccccatatgccctacaggctgaagtacgcctaaagcagcctattgatagggatggcgcaacaacctgttcaaagcgattcagtgactaaagtgatggttaagagggttgatgtgcaacacatgataatgcatctagctgaaaggcgttacctatgttcaaaga

SEQ ID NO: 4057 - DNA, 371 bp, Triticum aestivum
  Clone ID: LIB3281-007-P1-K1-H5
gatggtgcagggcttgaagaccgacctacggttacagagcttcgccgggtacacgctggacgaggccgtccaggcctacctgcttgtgctgttcgaggacaccaacctgtgcgccatccacgccaagcgcgtcaccatcatgcccaaggacatccagctggcccgccgcatccgtggcgagagggcctacgctgctttctagaatgctagcgtctgatactggtctcgaggagtacagatgcgttactaggttcatattagcccttgcctgaggaagcaacgttcctcgacaggtgcgttatggcgcgatgtactgtatgcgatggaaccaccttgttatcatcaataatgagaagttagcaatctgattt

SEQ ID NO: 4058 - DNA, 297 bp, Triticum aestivum
  Clone ID: LIB3281-007-P1-K1-H6
gggcgggccgacccacccggcgggacgaccagcataccttgctacagatgagcgtgggaggtttcatagagtgctgaaaatatggaacctgaacaatttggctgctgctgtcggagtattcaattgtcagggagctggaaacaggacttgggaggcattacttggaaccagacttcatgagccacgtattgcgaggcggaggattcatccataatgactatagaaggaacattgttgtggggcataacatttggaatgagagacacagatgccctatgaagagtcatgcagtgcatc

SEQ ID NO: 4059 - DNA, 100 bp, Triticum aestivum
  Clone ID: LIB3281-007-P1-K1-H8
cggacgcgtgggcagatccacatatcggaagagcgagcgcacgaacatgtggctgcggaagaagacttcatccatactgatctcatagaaagacatcacg

SEQ ID NO: 4060 - DNA, 407 bp, Triticum aestivum
  Clone ID: LIB3281-007-P1-K1-H9
ctccaccgaacaagctcacacatcaagacaataaatagagcctgtctgtttggggccaatcaaaccaaacaacaagttcatgtctgatctcgacgtccaggttccaactgcttttgatccgtttgctgaggcaaatgctgaggactccggcgctggtgctggatcaaagaactatgtgcatgtgcgtgtccagcagcgcaacggaagaaagagtctgacaactgttcagggcttgaagaaagactacagctataacaagattctcaaggatctcaaaaaggaattctgctgtaatggtactgtagtccaggatccagaactaggccaggtcattcaactccaaggtgatcagcgtaagaatgttgctactttcctagttcaggctggacttgcaaagaaagagagca

SEQ ID NO: 4061 - DNA, 324 bp, Triticum aestivum
  Clone ID: LIB3281-008-P1-K1-A1
ctcctccccaaaccctcccctcccctcccctagcggatccacacctctccctcgcggcggcggcggcggccagagcgggaagcgaaaactcgaagcagcccccgagcggcgagcatggccagcgaaggcgagcacgcggcggcggcgggcgagcagacgccgctcaagaaggcgggcgaggcggagcagggcgaggagctccaggccccctccggctggaccaagaagcttaatcccactcggggtgggaaggttgaggttgcttttgttgcaccaactggcgaggaggtcaagaccaagagagctttaaccaacataccctaa

SEQ ID NO: 4062 - DNA, 268 bp, Triticum aestivum
  Clone ID: LIB3281-008-P1-K1-A10
cggacgcgtggggattaggaaagcaaagccgccgccgcccgccgattcctccgccttttccactgatcccctccaacccggcgaccgcgctccctccgatggccgttagctcgcggctacccgcccctcccgcgcggggcctcctccgccgctcgccgacgcgtatcctcccttcgagacgcctcgcttgtggcacccgcgctgtctacgggagccctgggccaggcggatcgcccctccccaggcggacgacggcgccgctggactc

SEQ ID NO: 4063 - DNA, 391 bp, Triticum aestivum
  Clone ID: LIB3281-008-P1-K1-A11
gctccgtctcctcggatctccgcctcaaatttgcctccccaatccccagttccaggttcttggaggaggggggaagccatgggcagcttcgccaagctggccaagaggtgcgtggagacggaggcgccggtcatggtgaagatacaagagctgcttcgaggggccacggatgtgatgtcgcttgcgcagggaattgtttattggcaacctcctgaggcagccctgaacaaggtcaaggaaattgtatgggaaccagcaaccagtaaatatggtgctgatgatggccttcccgagcttcgagaagcacttctcgagaagcttcgcagagagaataagctaaccaagtcatcagttatggtgaccgctggtgcaaatcaggcttttgtaaacc

SEQ ID NO: 4064 - DNA, 388 bp, Triticum aestivum
  Clone ID: LIB3281-008-P1-K1-A12
gaaggaggaagaagagggttttgctacgtggcatggaattcatggcatagttggttctttcttcttcctcttcctacctctgcctcttgctcttccttcttcgcaagcagcagcctctccgccctcgcagccagccgctgtcgataggggggaggtcgccaccgccggctgctctctgccacgccgcttcgaccagagacaggtgagatggaaggtttcgagttcttccagatcgtacttgacaactcctcgagcaggctgaggctgcctgacaagtttaccatggtgctactagacggcggcaagccccaggaagtgaagctgcgggaggccggccatgggcgtcgcttctgggacgtgaaggtggtgttggacgccgacggccaca

SEQ ID NO: 4065 - DNA, 337 bp, Triticum aestivum
  Clone ID: LIB3281-008-P1-K1-A2
ccggtaccggattgcagtgtcgacccaggcgtacgcggacgcgtgggcggacgcgtggccgcgaagcttaaggagcaatcctctggattcctcgtcaaagacagctgtgttttcggtatccagttcatcaaagttgtcgctgttaaaggtaacgatgtgtcagagaccctgtttgttcagaagattagcatcatctgcagtgacccccaagtctacacctggaacattgatgatttctttgtgttgaaaaacccgagcacctccccagagtttgagctctgtggacacaaatggttaatcactatctatccatctggttccgataagaatccgaact

SEQ ID NO: 4066 - DNA, 396 bp, Triticum aestivum
  Clone ID: LIB3281-008-P1-K1-A4
cagcacaccgcccgcgatggcgctccggctccactctgccctctccgccgccgcctccggacgcctcttctgccaccgggctctctccgcggaggccacctcgcgccctcagtggggtgtgatcgccggcacgcgtccggtcaagtcgccggcgctcggtgcgaccttccacctcgccgagcccccgcgcgcctcccgcctcctcgtccccgaccacctcctcgggtcggggccactcccgggcgtcgacagaggaatcatgggcgcgctcttctgcgacgtccgcaccgtgagcgccgacggcttcctcctcctcaacttcctcgacgtccgcaccacgggccccgtcctcgagagtcagcgcgctgacccatttcgggacgcgaccctttcagc

SEQ ID NO: 4067 - DNA, 395 bp, Triticum aestivum
  Clone ID: LIB3281-008-P1-K1-A5
ttttgcgggaaacgcgacgccacccggagaaaccctcctcccgcacctcgcctcccaccctgccaaaaccctcgcccctcctcctcctcctcctcctacgatggccgcgccgacgcctccgcccgccgccgcccccgccgcggcgccaggaccgacgccgccggcgcaagtggtgggcaacgccttcgtgcagcagtactacaacatcctccaccagtcaccggagctcgtcttccgcttctaccaggaggccagccgcatcggccgccccgccaccaccggcgccgacatggacaccgtcaccaccatggaggcgattaacgagaagatcatgtccatggacatcgcgcgggcggagatcaggggggtggacgcgcaggagtcgctatgtggcg

SEQ ID NO: 4068 - DNA, 323 bp, Triticum aestivum
  Clone ID: LIB3281-008-P1-K1-A6
cccacgcgtacgcggacgcgtgggtgcagaacaaacagataagctagggagcaggctgcttcaaggctccaggacaccatggccacaaaccccggcctcttcagcgagtggccatggaagatgctcggcagcttcaagtacgtggtgctggcgccatgggtggcgcacggtattcaacaggtggtgaccaaggggtggcgcgaggccgatctggggtacctggtgatcctcctgtcgatgattctccgagggctccacaaccaggcctggatcacggagtcccgtctccagaacgcgcgcggcacgcggtagatcgttctacc

SEQ ID NO: 4069 - DNA, 308 bp, Triticum aestivum
  Clone ID: LIB3281-008-P1-K1-A7
cccacgcgtccgcggacgcgtgggtgcagaacaaacagataagctaggtagcaagctgctccaaggctccaggacaccatggccacaaaccccggcctcttcagcgagtggccatggaagatgctcggcagcttcaagtacgtggtgctggcgccatgggtggcgcacggcatccaacaggtggcgaccaaggggtggcgcgaggccgatctggggtacctggtgatcctcccgtcgatgattctccgggggctccacaaccaggcctggatcacggtgtcccgcctacagaacgcgcgcggtaagcg

SEQ ID NO: 4070 - DNA, 237 bp, Triticum aestivum
  Clone ID: LIB3281-008-P1-K1-A8
acgctaaaccctgtacacgcacagcaggaagagaggccaggtagctagctagcttggtagcttggtaaccatggcgaagaaggcggcggtgatcgccacgctgctggccctgaacctgctcttcttcaccttcgccgacgcctgcggctgccactgcggatcctgccctagtccgggcggcggcggcggcggtgggggtggctgtggaggtggaagcggcagctgttgtggtggtgg

SEQ ID NO: 4071 - DNA, 146 bp, Triticum aestivum
  Clone ID: LIB3281-008-P1-K1-A9
caaaatgctcgaggcttggtaaaaaattgccgtcaaaagaagtttgtcgcttcatcttgccatagtacaattatacttacaactggaaaaattacagaccaaagaatattggctggtttaatcctatcaggtgtataaccaaatca

SEQ ID NO: 4072 - DNA, 289 bp, Triticum aestivum
  Clone ID: LIB3281-008-P1-K1-B1
cgaaggcggtcacgacctcgtcgctgcagagagggcatgccatcaaagggagcagccaatcggctgggacaggaagggaagatgaagacgatgcggacatggcagcgcggacgagattgaacaatggcgatggccaagcaggggcgagctcgggagagtaaatggagatgggtggtgtgctggctagagtgaatgagctggttgggctggtgagcatttatggagctggcgctccgacgccgtttgtgctgtgaatcttgcgtcatacggctcatgcaggcttagatgt

SEQ ID NO: 4073 - DNA, 390 bp, Triticum aestivum
  Clone ID: LIB3281-008-P1-K1-B10
cggacgcgtggggccttcgcatccagagctccaaaccctaggcgaggcgaggcgcggcgcagcggagggagaggccatggatcccgattcggtctcgaaggcgttcgtgcagcactactaccagacgttcgactccaaccgcgccgcgctggtggggctgtaccaggacggctccatgctcaccttcgagggcgagaagttcggcggccccgccgccatcgccggcaagctcggatctctccccttccagcagtgccagcacaagatcgacaccgtcgactgccagccctcggggccccagggcggcgtcctcgtcttcgtctccggcaccatcaccaccggccccggcgagcaccccctcaagttctcacagatgttccatttgcttgc

SEQ ID NO: 4074 - DNA, 383 bp, Triticum aestivum
  Clone ID: LIB3281-008-P1-K1-B12
cccacgcgtccgcccagcttgatagcagggggagaatgaagatgtcacagaggaagccgtgtcgaccactttgaaaagggcgctcagcaccttttctactctccaggcacacgatggatactggcctggggattatgggggtcctatgttccttatgcctggattgcttataatgctacatgttactggagcaatgaacactgttttatcaccagaacatcaaaaggagatccgtcgatatctctataatcatcagaatgaagatggaggttggggattacacattgagggtccaagcaccatgtttggctcagccttgacctatgtttctttgagattgcttggtgagggaccagatagtggagatggagctatggagaaag

SEQ ID NO: 4075 - DNA, 329 bp, Triticum aestivum
  unsure (1)...(329): unsure at all n locations
  Clone ID: LIB3281-008-P1-K1-B2
cggacgcgtgggccaggccatcaaggtcctcaagcagctgggcgcctacgccgacgccgagaaggccaagctgtccgtgggcatccgccccggcaagggtaagatgcgcaaccgcaggtacatcaaccgcaagggccccctcatcgtctacggcaccgagggctccaagatcgtcaaggccttccgcaacctccctggtgtggatgttgccaacgtcgagcgcctcaacttgctcgaccttgcccctggtggccaccttggccggtttgtgatctggaccgagtctgncttcaagaagctggacgaggtgtacggctccttttgaggcg

SEQ ID NO: 4076 - DNA, 284 bp, Triticum aestivum
  unsure (1)...(284): unsure at all n locations
  Clone ID: LIB3281-008-P1-K1-B3
gtccacccttcacctggtgctccgcctccgtggtggtatgcagattttcgtgaagaccctcaccggcaagactatcacccttgaggttgagagctctgacaccatcgacaacgtcaaggccaagatccaggacaaggagggcattcccccggaccagcagcgcctcatcttcgccggcaagcagctggaggatggccgcacccttgcggactacaacatccagaaggagtccaccctccacctggtgctacgactncgcggtggtcagtaattgccctggcgtt

SEQ ID NO: 4077 - DNA, 389 bp, Triticum aestivum
  Clone ID: LIB3281-008-P1-K1-B4
cggacgcgtggggtgaaggcctatgagttgttggctcgtgttgaagagcttcaatgcttggcaaagcgcatcgcacgttacaaagatccagttagacaataccggatccaatcaccttacaaaaagccacagtggtcagcaagctgtggatggattgaaactgatgatgcaagattgctgcttggaattcactggtatggttatggaaactgggagaagatacgattggatccaaagcttggtctgacaacaaaaattgcaccagcaacacttggtgagagagaaacatttttaccacgcgcaccaaatttggataatcgtgctagtgctctcctgcaaaaggaatatgccaatctgagtggtaagagcttaaaagccaaaggaggtgc

SEQ ID NO: 4078 - DNA, 375 bp, Triticum aestivum
  Clone ID: LIB3281-008-P1-K1-B5
cggacgcgtgggtttttttttttttttgggacaaaggaatatatctttgctgcatccactccagagtgttgtacaaattcagtatgttttgccgtagagctaatgaagtacgtatatacaattaatctctgcatatgcgagcaattcaaaattaatgaccatcaccgcgtacatgatctaaaatcttcagctacaaaatgctaattaaagggagaccaaaacgaaaacgacgccgctcgcttgatcaactatcggacggcgagagctcgaggatacggccggagagtgcggagacgagcgccgccttgaacccggggtccctcgtcagcgtcgctgccatctgctccgccaggttcttcctgtccgcggccgatc

SEQ ID NO: 4079 - DNA, 391 bp, Triticum aestivum
  Clone ID: LIB3281-008-P1-K1-B6
cccacgcgtccgcggacgcgtggggtcgtccgcacgcgaccagcttgactccctcgcgcacgagcaacaggagcgcgaggagatgcagatcttcgtcaagaccctcacggggaagaccatcaccctcgaggtcgagagcagcgacaccatcgacaacgtcaaggccaaaatccaggacaaggaagggattcctccggaccagcagcgtttgatatttgctggcaagcagttggaggatggacgcacgcttgctgactacaacattcagaaggagtcgactcttcacttggtcctcaggctcaggggcggcacaatgatcaaggtcaagactctcactgggaaggagatcgaaatcgacattgagcccactgacacgattgataggatcaag

SEQ ID NO: 4080 - DNA, 146 bp, Triticum aestivum
  Clone ID: LIB3281-008-P1-K1-B7
acgtgcaatccaagcggtcgacgaagaggggagggggggactagacggctagcgtgtggacgggtgcgggtctcggctcgtcacgcggagacggcacgagacccgatgccgccggcacatcaagccggagcgggcgataagagcgt

SEQ ID NO: 4081 - DNA, 202 bp, Triticum aestivum
  unsure (1)...(202): unsure at all n locations
  Clone ID: LIB3281-008-P1-K1-B8
cccaaaaccctacctctcgagcaaccgcgccgccgccgctccacccagcgttcgggttgctcgccgccggcgatctcgtgccgcgactccaccatgaagttgaacatcgcgaaccccaccacggngtgccagaagaaggtcgagatcgatgacgaccagaagctgcgcaacctttatgacaggagaatctccaggaggtagt

SEQ ID NO: 4082 - DNA, 150 bp, Triticum aestivum
  Clone ID: LIB3281-008-P1-K1-B9
acctacgcttccacgtacacctggggctaaatcttgataaataatggccttgttgggtgaaggaaaattatgacctccactattaatcttaatgatgaaatatgggaccccccgatccacatggataacattaaacaagtgctggaggag

SEQ ID NO: 4083 - DNA, 405 bp, Triticum aestivum
  Clone ID: LIB3281-008-P1-K1-C1
accgctcggaaggaatgccctcaccggcgcacactgcctatgtcgaccccgagggtggcgggttctggcgctgacggcgttctgccgccgtgccggcaatggccggcgacccctacgccttcttcgactgggacgtctcctacgtcaccgcggcgcccctcggcgtcaagcagcaggtgataggcatcaacggcaagttcccggggcccgtcgtcaacatcaccaccaactggaacgttgtcggcaacgtgctcaacgacctcgacgagccccttctaatcacatggaacgggatccagcaccggaagaactgctggcaggacggcgtgctgggcaccaactgccccattccgtccgggtggaactggacctacgagtttcaggtcaaggatcagatcggcagct

SEQ ID NO: 4084 - DNA, 386 bp, Triticum aestivum
  Clone ID: LIB3281-008-P1-K1-C10
cggacgcgtgggcggacgcgtgggagaaaacaactctagtctcgtggccgctcgtgtagcagttgatgcggctgatgtgaagtcggcgatagctgagaggatatcagtgatactgcagaacataacatccctgatgacatctttcatcgtcggttttatcattgagtggagagtggcgatccttattctggctacattccctcttcttgtgcttgccaactttgctcagcaactttcaatgaagggctttgctggtgacacagcaaaagcacacgccaagagcagcatggttgctggtgaaggcgtcagcaacatccgcaccgtggcggccttcaacgctcaaaacaaggtcatgtctctgttcagccatgagctgcgcataccag

SEQ ID NO: 4085 - DNA, 385 bp, Triticum aestivum
  Clone ID: LIB3281-008-P1-K1-C11
gcagcagctgagagactttcacaagaaacaactgagaatctgttgtcagctgatcttctgcgcatgcgcggttgtggtgaaacctgcgtttggcaggctaccctggttgttagttttggtgtctggtgtatccgccgggtactggatctttcccttgtggaaagtagaccagagctttgggggaagtacacatacgttctgaaccgtcttcagggaatcattgaacccgccttttccaagccccggaaacctctcaccgggtgcgcatgccttcagataacaggcccgggtgcgaggcccatttctggcaccttcaccacttctgctgcgatcttggagacgatcaaggacgtggaagtagctatctgtggacgcaagggtcgaa

SEQ ID NO: 4086 - DNA, 371 bp, Triticum aestivum
  Clone ID: LIB3281-008-P1-K1-C12
agcatccaaatcccaagccaacacacacctcaccctcctgctcctgctgggtcctactcaccacacacgctacacgccacctcctcctccccggctcccacgccgccccgatccccttccccgagagcagccccccacgtgacccggatccgaccgcgctgccgccccccggcttcatcccccgtccacggccgcccaattcgcgggaattcctcgattcccggaggcccggccgtcgaggcagatccatggagcggagccggccgcagcgtcgaggctagcacatcgggaggagctctcggtttcgtagctcacagagaattctcttgccgtttggctccggaaacgtggctggggcgatggcgatggcg

SEQ ID NO: 4087 - DNA, 314 bp, Triticum aestivum
  Clone ID: LIB3281-008-P1-K1-C2
cccacgcgtccgcccacgcgttcgctcctcagcgcagcagcagccagaggcttgggcatccatcccaatggcccgcacgaagcagacggcgcgcaagtccaccggcggcaaggcgccgaggaagcagctcgtcaccaaggcggctcgcaagtcggccccggtcacaggcggtgtgaagaagccccaccgttttcgccccggcaccgtggcgctccgggagatccgcaagtaccagaagagcacggagctgctcatccgcaagctccccttacagcgcctcgggcgggggatcgcccaagacttgaagaccgacc

SEQ ID NO: 4088 - DNA, 277 bp, Triticum aestivum
  Clone ID: LIB3281-008-P1-K1-C3
cccccaccggcggcgcacagcccgacgacccgagcgatcctgcggaggcggcagccatggtgcacgtcaacttctaccgcaactatgggaagactttcaagaagccaaggcgtccgtatgagaaggagcgtcttgacgctgagctgaagctggttggggagtacggtctgcgggccaagcgtgagctctatcgtgtgcagtatgccctcagccgcatccgaaatgctgccagggagctgctcactctggatgagaagaacccccgccgtatctttga

SEQ ID NO: 4089 - DNA, 391 bp, Triticum aestivum
  Clone ID: LIB3281-008-P1-K1-C4
ctcctcctcctcgcctccccgcggccacacctcgactcgctccctccctcgagatcatctgtgtcatccttttgaggcgagatggcggctacattcaatgttaacgctgaggcaggccttcaaaagcttgatggctaccttctgtctcgcagttacatctctggataccaagcttccaaggatgacttggctgtgtattctgagttctcagttgctccaccatcgacctgcaccaatgttgcaaggtggtacaatcacattgatgcgctcctgaagctgagcggggttactgcggccggtcaaggtgtgaaggttctgtcatcagttgtccctgaaacctcaactactgatgttgctgaggctcctgcagctgatgatgacgatgacagtg

SEQ ID NO: 4090 - DNA, 391 bp, Triticum aestivum
  Clone ID: LIB3281-008-P1-K1-C6
cccacgcgtccgctttcctcgcatcatggctgcgttgtcgaagagtggtaaagatgttccagaagtgtccaaggaagtctgtggagctatatattttcttgcccgaggttatgatgtggcaatctcatctgaggtggaccattcaaaaaagcgaatctcatctgagctttcaccttttcttggtggtgttattgatgctctcctttctgcttcagaacttgatatgaagacccctttcgggcttccagcatctgcatctgcttatggcgcattgattgaggttgtgagagtaagcaacatatgggatttgaaagctgtactagctattatagttttaatgcctcgtatcatgagaagattaaacaccgtgcttgatgccaaagcaatttca

SEQ ID NO: 4091 - DNA, 397 bp, Triticum aestivum
  unsure (1)...(397): unsure at all n locations
  Clone ID: LIB3281-008-P1-K1-C7
cacgcccgtccgnngctgcaactacctcnnatttcccaacacncnngccgagctcgatctcgcaatggtggcggcttttctggcgccctggtggtnngttcgccgcccgtnggccggcaatggcccgnngcgacccctaacgccttcttgcgagctgggacccgtctcctaacgtcactcgcggcggccctcttcggcgtcaaagcagcgaggtgaataaggcatcaacggcatagttcctcggggccccgtcgtcaaacatcaccaccaaactggaaccgtcgtcgtcaaacgtgctcaaacgacctcgacgagccctcttctaaatcacatggaaacgggatccagcaccggaagaactgctggcaggacggcgtgctgggcaccaactgcccca

SEQ ID NO: 4092 - DNA, 180 bp, Triticum aestivum
  Clone ID: LIB3281-008-P1-K1-C8
cggtcgtgtgggtggatgcgtggtctggagcggccactcttttgcttcgggttgtcctgccttcgacctaggagctggatcgtcaaaatgcaccaaacatgtgggttgatttcatttgagggggctttcttggcaggctcagattacatgctaactttgaacggcttgatttcctgcacc

SEQ ID NO: 4093 - DNA, 261 bp, Triticum aestivum
  Clone ID: LIB3281-008-P1-K1-C9
cggacgcgtgggccgaaattctgaaaaataatggccttgctgttgaaaagaaaatcatgacatccactgttgatgtcaatgatgaatcaaggggccgcccgatgcagaaggctaagattgaaatagtgctgggcaagacggagaacttcgacgagctgatggccgccgccgcggaggagagggaagtcgcagccgccgaggagggcgaggagcagggctaataaactgtcttgagccggcttgtgtagcttttatttagta

SEQ ID NO: 4094 - DNA, 390 bp, Triticum aestivum
  Clone ID: LIB3281-008-P1-K1-D1
gctgttcctctgctttcttgagtgcgctgcttgctttcttggcgattcatcactgtgccgcccctctggtttcttgattggctgccggaggccggggaagaccgggatccgccgaggtggcgaccggcatggcgctcgatttgggagccctcgctctcaagtacaccgggctggcggtgtcggaccacgactccatcgtcgccatcaacatcttcatcgcgctgctctgcggctgcattgtcttcggccacctgctcgaggggaaccgctgggtcaatgagtccaccaccgcgcttgtcctggggctcatcactggtggcgtgattttgatctgcaccaaaggggtgaattcacggatccttatcttcagcgaggatatttttttcatct

SEQ ID NO: 4095 - DNA, 386 bp, Triticum aestivum
  Clone ID: LIB3281-008-P1-K1-D10
cccacgcgtccgcccacgcgtccgcccacgcgtccgtgcagatccgcttctcgcagataccggacttcgaccagatatggtggctctccatcgttgccgccgtcatgtccttcacctactccaccatcgggctcggcctcggcatcgcgcagaccgtcgccaacggcatccagggcagcctcaccggtctcagcgtcggcccgggcgtgacctccatgcagaaggtgtggcgcagcctccaggccttcggcaacatcgccttcgcatactcctactccatcatcctcatcgaaatccaggacacggtgaaggcgccgccgccgtcggaggcgaaggtgatgcagaaggcgacggggataagcgtggcgacgacgacggtgttctac

SEQ ID NO: 4096 - DNA, 385 bp, Triticum aestivum
  Clone ID: LIB3281-008-P1-K1-D11
cggacgcgtgggcgggatcgtctccttcactactttccgggcgctgcgccaacagtcccatggggatggcaactcactggggttcccgtggtggaaagaggagcacttcaatgcttcggacgtcaacggggatggtttcctcaataaaactgagtttcacgactttcttaatccaagtgattcggagaatcctaaaattatcaacttgctctgcagacaagaattaaggcagagagataaagatggtgatggaaagttaaactttgaagaatactttcatgggctacatgaccatatacatggttatgatgacgagaatgcagctatttctcatattgggaacatgacaattgcaaaggagcggtttgccaagcttgacaaagat

SEQ ID NO: 4097 - DNA, 383 bp, Triticum aestivum
  Clone ID: LIB3281-008-P1-K1-D2
cccacgcgtccgcggacgcgtgggatcaaatatacaagacaactcccttgtacatgttgcaaagactaacattagcgggaaggtccttccgacaatcattggaagcaacgttacagtaggtcatagtgctgttttacatgcatgcaccattgaggatgaagcttttgttggtatgggcgccactttgcttgacggagtggttgttgaaaagcacagcatggttggcgccggatctcttgtcaagcagaatacaaggattccttctggggaggtctgggttggtaatcctgccaagttcctaaagaagctgacagaggaggagatcacattcatcgcccaatcggcagccaactacatcaacttagctcatgttcatgccactg

SEQ ID NO: 4098 - DNA, 394 bp, Triticum aestivum
  Clone ID: LIB3281-008-P1-K1-D3
tatatctgaacgccaagaggaagatataagcgaggtatctgcattactgttgattccaagggaagaagcatctgtccttcttcaccactataaatgggacatcagcaaggtgaatgatgaatggttttctgatgaagacaaagtccgtggtattgttggcttacttgtgaatggaactgattttcataactcgaggaagctaacttgtggaatatgttttgaagggtactcttcagatatgatgagttctgcgggctgcgctcatttttattgccatgaatgttgggaaggttatatcagcgctgctgtaagtcagggtccgggatgtttgtcattgcgatgccctgatccatcgtgcagtgctattgttcttcaaggcatgataaataagtta

SEQ ID NO: 4099 - DNA, 389 bp, Triticum aestivum
  Clone ID: LIB3281-008-P1-K1-D4
cggacgcgtgggctctactatactagctccgtaactaaatataagagcaacatgtaaaacaatttaaacttatagtacttagttacagaggtagtagttcctaaagatctctaccaaaacccctcaaaagaaaaatctctctaccaaactagattacatctgatatgagatagatcagcatggttgtacttttaccattcttctatctcatcttcatcttcttcacagttactcccttcagcaccaagcatatcaatggagtttgggccacctgcgacgtcgtggcacgaggggttgtttctggccatatcattgtgggggcttatccatctctcgaaaggcctgaagtcagtgaccacgtcggagaagttgcgagaaccagacgtgct

SEQ ID NO: 4100 - DNA, 389 bp, Triticum aestivum
  Clone ID: LIB3281-008-P1-K1-D5
attcgcccctctcggtgctcccacccccactactcgccggtgatctgatggcggcggccggcgcaccgccgccgcgcgccctatccgcggagctgaggagggctccgctcgccgcgggcctcgcgccgccgcggcaggggaccagggctcgcgcgtcgtggcccctcccccgccaggaaactgtttgtagtcgtggccggttgatatcgaccatgtctagttcaaggtcattggcgtgctctccttgtcgttgcgctcaggtggctttggctgacgcagagattgcttatcagcctgaggctgagaagcatgctggagttctggcctatgaactggttcaagggaaccttgtacaatggaactcttttatggacaaatcaatacctgat

SEQ ID NO: 4101 - DNA, 388 bp, Triticum aestivum
  Clone ID: LIB3281-008-P1-K1-D6
gctagattagtttctcactgcactttgtttcaattttttttagtttggatcgagtgtgaatgtaaggaagatattgttgtcacatagtaataatccatctatgagttactaggaggtatctcatgcatgttgattgtgcttcaaggtacagtagtttgtagcatacaaaattagtggttcgccatgttgacccaactgtgtgaattcatacaaccaaaactaggaacaaagtttgattcgtaggtagctgaagaagcggcatcatgcagagctgcaccagtgtgctgcttcgctagatgggggtcatcgaagaggacaaggagaatgcgatctcaggggccttcttgagggttattggagagagtttgatcaccttctttccgagccc

SEQ ID NO: 4102 - DNA, 358 bp, Triticum aestivum
  Clone ID: LIB3281-008-P1-K1-D7
cccacgcgtccgcccacgcgtccggtctctttccattccccagtcccaaatctgaagaactccgcacgggaagaagagacgccgagctccaaggcttcttcaacgaacagattgcttgttactacacgaccaacgagagaggaaggccgacgctgcttgtggaatggacaatatcttcaccacttgttccttgtcgtcttgtctgccgatgatctttgattcatcgacacaagaatgtgtttgcggatggacaatgtttggtgcctcggtacattgtaggaagtggaaattgttcatctctgcaaccagttcatccatcatctgaagggcatccttcatcttcctgttcatggacaga

SEQ ID NO: 4103 - DNA, 390 bp, Triticum aestivum
  Clone ID: LIB3281-008-P1-K1-D8
cggacgcgtgggatcatgccaactcagctgatggggatgttagttggcttaaggcagatagatttggtggcaggccagatgaggggtcttttcagtttttacacaaaagaagccgcaatattggttccaaaagcaggaggcttttgatggataacgaggaggccctggaactgaagctttcctgggaagaggcacaggagttgttgcgtcctgctccatctgcaaaaccaacaattgtgatgattgaggactatgaatttgaagaatatgatgaacctcctgtctttgcaaagagatcaattttcaccagtcgttctacaggggaacaagaccaatggattcagtgtgatgattgctcaaaatggcgtcgggtgcctcttaatgtcatta

SEQ ID NO: 4104 - DNA, 397 bp, Triticum aestivum
  Clone ID: LIB3281-008-P1-K1-D9
cggacgcgtggggcgcgcaagaagcgggaggaggacttcgacgccttcacctccaccaagtcgcaggacctggcgcagccgctcgtcgccgcgcagattcccttcaagatccacatcgtcaaggaccacgacatgaaggagcgcctctgcctcgaggccgagcgcctcggcctctccgccatgatcatgggcagccgcggcttcggcgcctcccgcagggcaggtaatggcaggctagggagtgtcagcgactactgcgtgcaccactgcgtctgccccgtggtggttgtcagataccctgatgacgccggagcgtcgggcggtgccgagtctgtgggggatgagctaaggacggtgcctgagaacgaggtggtgttccatgaggcaccagaggggc

SEQ ID NO: 4105 - DNA, 401 bp, Triticum aestivum
  Clone ID: LIB3281-008-P1-K1-E1
cggacgcgtgggatcgccttccctccgctcgcgtctgctacacttcctctcccggcccggctagatctcgccggcaggagatggcggacgcgaagcagcagcaggccgcggcgcccactggcgtctggaagacgatcaagccattcgtcaatggcggcgcctccgggatgctcgccacctgcgtcatccagcccatcgacatgatcaaggtgaagatccagttgggcgagggatctgcagctcaggtcgcaaagaccatgtatgctaatgagggccttggttccttttacaagggtttgtcagctggtttactaaggcaagcgacctatacgacagctcgtcttggatccttcagggttttgacaaacaaagcaattgaggcaaatgatgggaagccattg

SEQ ID NO: 4106 - DNA, 379 bp, Triticum aestivum
  Clone ID: LIB3281-008-P1-K1-E10
cccacgcgtccgcggacgcgtgggctgcaggcaagctgagccccgacggcgcggcgacccccgccggcctcatctcggcggcgatagcccacgccttcgcgctgttcgtggcggtgtccgtgggcgccaacatctccggcgggcacgtgaacccggccgtgaccttcggcgccttcgtgggcggcaacatcaccctcttccgcggcctgctctactggatcgcgcagctgctgggctccaccgccgcctgcttcctcctccgcttctccaccggcgggctccccaccggcaccttcgggctgagtggcatcggcgcgtgggaggcggtggtgctggagatcgtgatgaccttcgggctggtgtacacggtgtacgccac

SEQ ID NO: 4107 - DNA, 382 bp, Triticum aestivum
  Clone ID: LIB3281-008-P1-K1-E11
gtgggaggcgcgagtggccaggccttggatgtggaggtccaagccaaggaaattctggctagcaagaggaatgtcatccggctgatctcaggctttacggggcgtacactggagcaggtagagaaagacatcgatagggaccgatacatgggtcctcttgaggctgttgattacggtatcatcgatggtgtgatcgacgaagacagcattatcccacttgagccggttccggagagggtgaagcctaagtacaactacgaggaaatgtacaaggaccctcagaagttccttacgccgcatgtcccagacgatgagatatactaagctagcctgtcagtcacatgtatttcaaacagcaggcagtcgctgtagctttcgtcaa

SEQ ID NO: 4108 - DNA, 280 bp, Triticum aestivum
  Clone ID: LIB3281-008-P1-K1-E12
cacggctgaggcagtctaaaccctgtacacgcacagcagcaggagaggtagctagcttggtagcttggtagccatggcgaagaaggccgcggttatcgccacgctgctggccctgaacctgctcctcttcaccttcgccgacgcctgcggctgccactgcggatcctgccctagccccggcggagggggcggcggtgggggtggcggtggaggtgggagcggtggcggtggtggtgggagcggtggcagtggaaggagcggtagatgcggttctggagga

SEQ ID NO: 4109 - DNA, 397 bp, Triticum aestivum
  Clone ID: LIB3281-008-P1-K1-E2
ggacgcttcatgaggtggtgaatggcttcttttggaaaggaagcccggtccgtgctctcgatcgagggcctgatcacttgacggcacttggtctcatcccacttggaactggctcagactttgctaggacatttggatggtcaaatgatccccgtcaggcgattgatcgaattgtgagaggagttaaatcaaaattagacattggcatgatggaaggtccaaatggagacccacatttcttcataaatgttgctgacatccatctgagtgccaaggcaggttattttgcttctatgtacaagaggtttggcaacttatgttatgttctgggagctttaagaggcttttggggtcatactaatcgagatttgagaataaaggtaaatggaggagaatg

SEQ ID NO: 4110 - DNA, 399 bp, Triticum aestivum
  Clone ID: LIB3281-008-P1-K1-E3
cccacgcgtccggatcaacaccgacagaggtgtcatgatcggggatggcaagtcacgcttctctattgacgggaagccgatttaccatttcgtagggacttccaccttcagtgagtatactgtcatgcatgttggttgtgttgccaagatcaaccctgaggctccccttgacaaagtctgtgttcttagctgtggtatttccactggtcttggcgcatccattaatgttgcaaaaccaccaaagggttcgacagtggcgatatttgggctaggagctgttggccttgctgctgcagaaggtgcaaggattgcaggtgcatcaaggatcattggtgttgacttgaacgccagcagatttgaagaagctagaaaatttggctgcacggaatttgtgaaccc

SEQ ID NO: 4111 - DNA, 386 bp, Triticum aestivum
  Clone ID: LIB3281-008-P1-K1-E4
gtcgacgacacccccatccgcgtctacgacaacaagaacgcctccgccaccaagcccaagggccaccaccgccaccccaacaacgccaccaccgccgccacccagacggcgtccgcgttcccgtcgccgcagcccatggccgtgtacagctccatctggaacgcggacgactgggccacgcgcggcgggctggtcaagacggactggtcgcacgcgccgttcgtggccaccttccgggacgtgcgcgtggagggctgcgcctgggccgccaacgcctccgactcggacgccggcgaggtggcgcgctgcagcggcagctcctggggcaaggagggccgctactggtggaaggagaaggacatgcaggagctgtccgtgcaccagag

SEQ ID NO: 4112 - DNA, 390 bp, Triticum aestivum
  Clone ID: LIB3281-008-P1-K1-E7
cactcaccgaccatggccgtcatcactctctgtttcttctcttttttgacgggcgttctgataggggtgaccatggctcttaaaggagaggcgttcaagtttgccggcgacgtcgcagccatcttgccggctccagtgaagaagaccgcggtggcactggcgcgaagcagccccgcccgtgccgccgccgatgccctggtaggtctcttcctcggcatggtgtgcgtgatgttcacggccacgttcttcaacgtcgtcgcgtcccgagcctgcgacggggactgctgcctggccggcgtcctctctgagatctcggactactacgagacgctctccctgcttctcttggcgccggcgtctgcgctcttttttctgcgcgctgccggctac

SEQ ID NO: 4113 - DNA, 341 bp, Triticum aestivum
  Clone ID: LIB3281-008-P1-K1-E8
tatctcccgatcaattggtttccatggtgctgtgagctcgctgtgattcagcaatggctccgcgctggatctctcatgaccagacaagactggccgaccgcactgtcactccgacagccacatcttggtggtaatcagtggagtaccgccactgtccatcaaaatctttgacctcccgcatccaccgccagttccgtctctctgcaagcaaatcacaggcgccattgctcagcttctgaggagcggagcggagccgagatggagcccatccctctgctgacgccgtacaagatgggccagttcgacctgtcgcaccgggtcgtgctggcgcccatgacgcg

SEQ ID NO: 4114 - DNA, 305 bp, Triticum aestivum
  Clone ID: LIB3281-008-P1-K1-E9
gctcgctcgctcacgcacacacgcccgcccgcccgcgcgcattaaactccgagatgcccatcccgtcccgtgcaccagtgcttgcagctgcaggagcgagctagctaggtggtagctgctgccgagatttggccgcggcaatggggatctgctgcagcagggaaggaggggggagggagctcgaggagacggaggggtggttcccgtggaagcacgacgacttcttgcaggagcagctcgccggcgccgctggggtgtccatgcacaccaagcaaggctggaagggcgtcaaccaggacgccatg

SEQ ID NO: 4115 - DNA, 386 bp, Triticum aestivum
  Clone ID: LIB3281-008-P1-K1-F1
cggacgcgtgggcagcaagttgacaagttttactctttgtctaatggtttctcacgccataatatttcagataatatcagcactgtaagttatccagaaaagctgtggatgagggctgatggggtaaattcagtaagaagtaccaggagtactcctgtagatggttgcattggtagggatggaagaactagtagtgcacataaccatcttgatattcatagtaatttttccttgcaccccgacagaccaaactcccagcttctgcccttggtcatgaaaccatgtgagctgaattataattcagttgacgaagttgctgggcgaatctatatgttggctaaggatcagaatggctgccgctttctgcaaaaagtatttgctcaagg

SEQ ID NO: 4116 - DNA, 385 bp, Triticum aestivum
  Clone ID: LIB3281-008-P1-K1-F10
cccacgcgtccgcctcaccgccgccgccgccactgcgccgctgccgccgccgagatgggtcgcgtgatccgcgctcagcgtaagggtgcgggctccgtcttcaagtcccacacccaccaccgcaagggccccgcccggttcaggtcgctcgacttcggcgagcgcaacgggtacctcaagggcgtcgtcaccgatgtcatccacgacccggggcgtggtgcgccgctggccaaggtgaccttccgccacccgttcaggtacaagcaccagaaggagctcttcgtcgccgccgagggtatgtacaccggccagttcgtctactgcggacgccgcgccaccctctccgtcggcaacgtcctcccgctccgctccgttcctgagggag

SEQ ID NO: 4117 - DNA, 354 bp, Triticum aestivum
  Clone ID: LIB3281-008-P1-K1-F11
cccacgcgtccggaagtttgcagtgcgtgagggagtgagagaatggcgggtggcaaagccgctctgctggtggccctgctgttcctgagcctggccttggagacccagcaggcggtcagcggcggatacgaccccgacccgactccgctcaccacgtcccacaggaacaggaagcctcccaagccagagtgcgcatgcagcgggcccgtcccctggcgctcgacctcgcccgcgatcacctacacctcccacgccaatgccggccgcgtacactgcgtgcactgctgagcctgaacccacgccgccaccgtacattgctgagactgagcccacgccaacgccgccgacgtacac

SEQ ID NO: 4118 - DNA, 376 bp, Triticum aestivum
  Clone ID: LIB3281-008-P1-K1-F12
gacgacagcccgcgatatctgccatatgtgccattgtactcagagttacaaactctgcactagtgacataaaaatcgaggagccaggtcttgaggaaagtgcttttcttcattaggaggtggagacccttgtacaaggactggatgatacctaagacggaagagttggctacagtacccttgaggttggattcagggtgacagcatcagtaaggttatggggcgcttgcgtggttactgttggtatgctcctggggacaaacacatttgcatgtgatagttaatctcttgttggcagataaataagtcgtgaggaggatgatcgtatgcatgtttctttcttttgtatttacaattttcttcacttcaccgaatct

SEQ ID NO: 4119 - DNA, 393 bp, Triticum aestivum
  Clone ID: LIB3281-008-P1-K1-F2
aagaacttaacaggaacagcaagatatgcgagtgtaaacactcatcttggaattgaacaaagcaggagggatgacatggaatctcttggatatgtgctgatgtacttcttgagaggaagtcttccatggcagggtctgaaagctgggaacaagaaacagaagtatgagaaaatcagcgaaaggaaaattgccacttcaactgaggccctctgtcgtggatatcctactgaatttgcatcttatttccattactgccgctcactgcgctttgaagatacgccagattatcaatatctcaagagattgttcagagacctttttattcgagaggggtttcaatttgattatgtttttgattggacgattctcaagtatcaacagtcacagatgacc

SEQ ID NO: 4120 - DNA, 236 bp, Triticum aestivum
  Clone ID: LIB3281-008-P1-K1-F3
agcaaatgatgatgaccggtgcccgaagcccgagagaagttttggcatgttaacacatggtgatattgagttggccatgctaaggaaaaaagttagtgcaaagaaacatatctgtatcctatatgtaaactctgatcattccgtattgtcattgagttttatccttgatttgtaaaagcaagtgattgtaatggattcatattatgtttgtattcccatggctctatgtttacatg

SEQ ID NO: 4121 - DNA, 328 bp, Triticum aestivum
  Clone ID: LIB3281-008-P1-K1-F4
ggaaccgtgagcccccgcagcgtttcaggcgcagggatgatggcccgaggcctggacagggtggcccgccccgtgctggtggacctggtggcgcgcctgctggcgctggtgccgttcctggtgctcctgctccccgtgtctagtttgggaatgcttccgtgatatggagccagccctagttttactcgtccctggatattgaactattctacctagtttttgctgcaatcggttgtactgaaagttggttggtcaagcacaatttgtgatcaggtctttatgttttgacaatttcgctgctatctatatcagagagaaccttttggtt

SEQ ID NO: 4122 - DNA, 384 bp, Triticum aestivum
  Clone ID: LIB3281-008-P1-K1-F5
cggacgcgtgggcaagatggtgacattgtactggtcaacagacagcctactcttcacaagcccagcatgatggcccatgttgttcgtgtgttgcctggagagaagacaattcgaatgcactatgccaattgcagtacatacaatgctgattttgatggggatgaaatgaatgtgcacttccctcaagatgaaatatctcgggctgaggccatcaacattgttgatgcaaataagcaatacattggtccaaggagtggggaggctgtaagaggtctcattcaggaccacattgttggtgctgttctcctgacaaaagtggacacattcttgagccgtgaggaatacagtcagcttgtctatgggtcttgtgtgtcctcatctcgt

SEQ ID NO: 4123 - DNA, 378 bp, Triticum aestivum
  Clone ID: LIB3281-008-P1-K1-F6
cacaattcactccagcccccctaccaccgcactcgaaaacctctctctctctcactccaacagtttgcaggaaagagagggagagatcgatcttgcgttgccaagatgttcatcgagagcttccgcgtggagagcccgaacgtgcggtacggcgcgggggagatcgagtcggagtaccgctacgacaccacggagctggtgcacgagagccacgacggcgcctccaagtgggtcgtccgccccaagtccgtcaactaccacttcaagaccaacaccaccgtccccaagctcggggtgatgctcgtggggtggggcggcaacaatggctccacactcatggctggggtcatcgccaacagggaggggatctcatgggcg

SEQ ID NO: 4124 - DNA, 392 bp, Triticum aestivum
  Clone ID: LIB3281-008-P1-K1-F7
cccacgcgtccgctcgcagccgcagcggcgcgcacccctctccctccttcctgaagacagcgccgccgtcggccagagcacaggatggcgaccgtccccgctcccgcagccgagaccgcggcctccaccgcgcgcacggtgaaggatgtcaacccccacgagttcgtcaaggcctactccgcgcacctcaagcgctccggcaagatggagcttccagagtgggttgacattgtcaagactgcaaggttcaaggagctgccaccttctgatgctgactggtactacatcagggctgcctcgatggcaaggaagatctacctgaggcagggaatcgggatcggcggctttcagaagatctacgggggccgtcagaggaacggttcacgcccacc

SEQ ID NO: 4125 - DNA, 385 bp, Triticum aestivum
  Clone ID: LIB3281-008-P1-K1-F8
cggacgcgtgggttcttccagcacccacaccgcacccgcaaatcccccactctcccgaaccggcgatggcccccaaggcggagaagaagccggcggcgaagaagcccgcggaggaggagccggtgacggagaaggccgccgagaaggccccggcggcgaagaagcccaaggccgagaagcggctgccggcgggcaagacggcgttcaaggaggccggcggcgaggcgaagacgaggggccggaagaagggcagcaaggcgaagaagggcgtggcgacgtacaagatctacattttcaaggtgctgaagcaggtgcaccccgacatcggcatctctttcaaggccatgtccatcatggactccttcatcaacgacatcttcgagaa

SEQ ID NO: 4126 - DNA, 90 bp, Triticum aestivum
  Clone ID: LIB3281-008-P1-K1-G1
atcacccttacgtatgatgtctatgtttttgaaagcctatcttatgtgggcgggcatactttaaatgctaatcttagcccattaaatcca

SEQ ID NO: 4127 - DNA, 383 bp, Triticum aestivum
  Clone ID: LIB3281-008-P1-K1-H1
atcgcctctacggatgttgtcgaggttgttgtcagcccaccctatgtcttccttcccaccgtcaaggctaagctgcgcccagagatccaagttgctgctcagaactgctgggtgaagaagggcggtgctttcaccggtgaagtcagtgctgagatgcttgtcaacctcggcgttccctgggtcattcttggacactctgaaaggaggagcttgatgggagaatcaagtgagtttgttggagagaaggttgcatatgcactcgctcagggcttgaaggtcattgcatgtgttggtgagactcttgagcagcgagaagctggatcaaccatggaagttgtcgctgaacagacaaaagcaattactggcaagatcaaggactggac

SEQ ID NO: 4128 - DNA, 381 bp, Triticum aestivum
  Clone ID: LIB3281-008-P1-K1-H10
cggacgcgtgggcggacgcgtggggccggcatttcctcccacttgcggctgcagcggcggcggcggccaccgcccaccgggtgtggaggcgagatgtcgtacatgcgaggcgatctgctgacgaagacgcggaaactggtgaaggggctggccaagcccgcccctgcctggctcaaggccatggagcaggcacctccagtcacattccctagaactgatggtaaaatcgagaagatagaactgccagaggatgtctatgtcaagaggttcttcagaaggcatcctgattcactctaccatgatgcaataaagataagcgggtttgatccaccgccagcaagagtttttgcttggtgtgtcttagagttgaaaggacaggga

SEQ ID NO: 4129 - DNA, 378 bp, Triticum aestivum
  Clone ID: LIB3281-008-P1-K1-H11
tgtggacatggcaaaagaattagcccattggcaaaatttcatgatggaagacataggaggaggggataatattcacattctgttatggatgatgcggagataagagactgcggttcaaatgaatctctgtacgatgatacacaatctgttaatcggttcagagaccatgattcccaaccttcagtggggcaatactcaggtgtacctgtaagtgcacgggtaaggaggcgactgttgagtaatggttctgacagacagcatcaaatgtccagtgatgagtttcctcgcactattgtatctgattatcgtgatggtgttggtgtgctagcacaatatggttctgctggtctgctagataagtcagtgaggaggtattca

SEQ ID NO: 4130 - DNA, 402 bp, Triticum aestivum
  unsure (1)...(402): unsure at all n locations
  Clone ID: LIB3281-008-P1-K1-H12
gcctcaggcctaccgtgtacgtattactgcaaacacttgccatctcgccacgtgagaggagaagcccgcagcgctggtgcctgagcggatcgggaaaggatggccggcggcgcggacgcggacggggagcgccggatcggggtggccatggactactcagccagcagcaagagggcgctggagtgggccgtccggaacctgctacgacggggcgacaccgtcgtcgtcctccacgtccagcgccacggcggggaggaggccaagcacgccgtctgggccaagtccggatccccgctgatccctctgtccgagtaccgggagccggaggtgatgaagaactacggcgtcacctgcgacgccgaggtgctcgacatgctcgacaccgncgcgcgccagctcgag

SEQ ID NO: 4131 - DNA, 397 bp, Triticum aestivum
  Clone ID: LIB3281-008-P1-K1-H2
ggcagtggtgagagtcactgttctgatcgcgataacaaggaaggtccatctagtggaccaagtacaccaagaggagatgcaccacatggtgcctttggaacggaagagaattccgctgggaaatcaaccaaaacaaacggtgatgaatcagaagcgaaaataggtcttcacacgatcttgagttcaaaagcagaggcattgttgaacaagaaagggataacatggccttggaaagggcgggagaatgatgtgcctgactgcagaaatcaggtgacctggccatcgttgcatagtgagcaagagaatggccagaatcatccgaatgtctctgacactcaattggttgaatacaaccaacctaacaaaaacgaggcatcacgttcctggtcttctttca

SEQ ID NO: 4132 - DNA, 392 bp, Triticum aestivum
  Clone ID: LIB3281-008-P1-K1-H3
cccacgcgtccgcccacgcgtccgggaccgtgtcacactcatcaaggactaccgtggaaagattgaggttgagctcactaagatctgtgatggtatcctcaagcttcttgattcccaccttgtcccctcatccactgctccagagtccaaggtcttctacctaaagatgaagggtgattactacaggtaccttgcggagttcaagagtggaactgagaggaaggatgctgctgagaacaccatggtggcatacaaagctgctcaggagattgcactgaaagagctgcccccgactcatcctattaggcttgggctggcactcaacttctcggtgttctattatgagatcctcaactctccagaccgtgcttgtgacctcgccaagcaggctt

SEQ ID NO: 4133 - DNA, 382 bp, Triticum aestivum
  Clone ID: LIB3281-008-P1-K1-H4
cggacgcgtgggggcctctgtcttcttcaagactcaagctgatggccacgtttcctgtgccaaggagatgaccaagctctctggaatctctgacattatccctgagatggaggtctgtgacttcgacttcgagccctgcggctactccatgaacgccatcaacggatctgccgtctccaccatccatgtgacccccgaggacggcttcagctacgcgagctacgaggtcatgggcatggacgcctccgccctggcctacggcgacatcgtcaagagggtcctccggtgctttggcccttcagagttctctgtggcggtcaccatcttcggtggccgtggccacgccgccacctggggcaagaagctcgaagctgaggcatac

SEQ ID NO: 4134 - DNA, 283 bp, Triticum aestivum
  Clone ID: LIB3281-008-P1-K1-H5
gatctgccttcggtgcggtggcctgtttgggtgtcctgcttaccagtattatcgtttggttttcagagtcttgatatatccttcggatatcgaacctagtatggaacttgtgctctcaaaatagcttaggtagtttcgtttttggagtcgaataccctgttactcgggtgctgcgtatcgtaaatcggagcggtggtttttgttctactatggtcgtgtaattttgctgcttatacaatgggtaaaacctgttatatgctgagtacatgtcttgagttgctct

SEQ ID NO: 4135 - DNA, 386 bp, Triticum aestivum
  unsure (1)...(386): unsure at all n locations
  Clone ID: LIB3281-008-P1-K1-H6
caaagctgcggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagctngtgaggactcagacccttgtcaagaatgccattgtgcaagttgatgctg

SEQ ID NO: 4136 - DNA, 392 bp, Triticum aestivum
  Clone ID: LIB3281-008-P1-K1-H7
cccacgcgtccgcggacgcgtgggttcggacccctagggttatctgctcgggggccatggcgtgttccgcgtggtgctgccttcgccgccgccgccgcccggcggtgagggcactggcttttgtctcatgggtcgctgcctgacttccggtctggggagacgggcttcattggccaataaatagggacgggaaggtccgagactggaggtccctgctcgcaaactcgcaaccccggtagctattctactaccaatagaaaaagatttcatgaaggagaagaagaaggcgccaaaagggaatgggagcaacaagtctgaatggacgggtcaagatccctacaaagatcaaaatgatagaaggtccggtgtgctggcgctaatgcaaagcgtgg

SEQ ID NO: 4137 - DNA, 389 bp, Triticum aestivum
  Clone ID: LIB3281-008-P1-K1-H8
gtatccaagggatcaagtgtagttatatttggtctgggaacagtaggactttcggtcgctcaaggtgctaagctacggggagcttccaagattattggagtagataccaatcctgataagcaagaaaaggggaaggcttttggtgttacagattttattaatcctgccgaactgaatgagcctgttcagcaggtagtaaaacggcttactgatggaggggctgattactcttttgaatgtgtgggtgatactggagtagtctcgactgcattgcaatcatgttctgatggatggggactgactgtaactcttggtgtaccaaaagcaaaaccagaagtttctgctcattatggattgcttctctctggaagaacactgaaggggtcttt

SEQ ID NO: 4138 - DNA, 238 bp, Triticum aestivum
  Clone ID: LIB3281-008-P1-K1-H9
cccaccaaggcatcaactcttgttatattacgtctaggaacagggggactgtggacatctcatggggctaacctatctgtagctggcgacaatatcgcactataaaccaggcatgatctgcaggataaggggaaggttgttgacgttacatattgtataaatgctgcctaactgaatgagcctggtcagcagggagtaaaaccgcttactgatggaggggctgattactcttttgaat

SEQ ID NO: 4139 - DNA, 289 bp, Triticum aestivum
  Clone ID: LIB3281-009-P1-K1-A1
gtcaaattcgcggttatgcgagcagagggtggtgagatgggtttcctcttcttatacggctttatcgcccaattatggagtctgaagccctaccgcgatggtgtcgaaatatggacgccagggagaagtattgaactggacaagttacttgggctaaatccagagaaagatcccccacaggtgatagggtatgccgaggaaaacaatgtggtgttcttctggacagttgttggtgtcttcatggtccatctcgagtcatggcggttcaacaagctctctaagactagca

SEQ ID NO: 4140 - DNA, 392 bp, Triticum aestivum
  Clone ID: LIB3281-009-P1-K1-A10
cggacgcgtgggcccgggtgccattgctatcaactggatcctcaaggacggtgctggacgtgttggaaaaatgctttttgcacgacaaggaaagaagtttgacaatgacctaaagcagctccgcttttctagtgatctcttgctggagataggtgctgggatagagttagctactgcagccttccctcagtttttcttgcctatggcttgcgttgcaaatgttgtaaagaatgtcgctgctgttacgtcgacgtcaactcgcaccccaatctataaggcatatgcaagaggagaaaatattggagatgtgactgctaaaggcgaatccgtcgggaacattgcagatctgctgggcactggtttgagcatctttatcacaaagcggaacccat

SEQ ID NO: 4141 - DNA, 392 bp, Triticum aestivum
  Clone ID: LIB3281-009-P1-K1-A11
ggtggagggaaaagcaccgaaaggcgccgcgtttccgcttctttttttcaccgcacttccctccctttccagcttcagtccttcccatggcgtcctccgcgctgccggcaccgtccgtcgtcgccgtcgccgtcgccgtcgcgttcgtgttcgcggtggccaccctcgctgcgacggcgtcggcagccgtcacctacgaccgcaaggcactagtggtgaacgggcggcgccgcatcctgctctccggctccatccactacccgaggagcgtgcccgagatgtggccggatctgatacagaaggccaaggacggcggcctcgacgtggtgcagacgtacgtgttctggaatggccacgagccctctcctggccagtactatttcgaggggagg

SEQ ID NO: 4142 - DNA, 321 bp, Triticum aestivum
  Clone ID: LIB3281-009-P1-K1-A12
cccacgcgtacgagcacgcttaggctcattggaacgcatcattatctgcgccctattagtctgcctgtacagaaagggtgcccataaggcatcaccgtcggctgctgtatgacacccacattcaaccagagacaggtgatatggaaggtttcgagttcttccagattatacttgacagctcctcgagcaggcatgaagctgcctgacgacgttaccagggtgctgctagacggaaataagtccaaaaatgtgaagctactgtaggccctgcatgagcgtaacttatgggacatgaaagaggtgctcgacgcccgcggccac

SEQ ID NO: 4143 - DNA, 153 bp, Triticum aestivum
  Clone ID: LIB3281-009-P1-K1-A2
tgctatcagaagcagaccaaggaaatcttgcttagtaataattgccttgcccccaattccatcatttatgctggatggtgggcagaatacaataatgtcaaatattggagtattagagacacagctaaagcatttcttttagtgtacgacaca

SEQ ID NO: 4144 - DNA, 241 bp, Triticum aestivum
  Clone ID: LIB3281-009-P1-K1-A3
caccaatggccgcccgccgccgcctcctgctactcctcctcgcgctcgccccggcgctctcgcagaccgtgctcggcgtcagcggcggcggacaggccaggaagacgtacatcttccgcgtcgaccaccgggccaagccgtccgtgttccccacccacgcgcactggtactcctccgcggctttcgcgtcggcggcggccagcgccgacggcccgctcgagccgctcacgtctacgacacc

SEQ ID NO: 4145 - DNA, 375 bp, Triticum aestivum
  unsure (1)...(375): unsure at all n locations
  Clone ID: LIB3281-009-P1-K1-A4
caccaatggccgcccgccgccgcctcctgctactcctcctcgcgctcgccccggcgctctcgcagaccgtgctcggcgtcagcggcggcggacaggccaggaagacgtacatcttccgcgtcgaccaccgggccaagccgtccgtgttccccacccacgcgcactggtactcctccgcggctttcgcgtcggcggcggccagcgccgacggcccgctcgagccgctccacgtctacgacaccgtcttccacggcttctccgcgtcgctgtccgcgtcgcgcgccgaggagctgcggcgccacccggccgtgctcgccgcgttcgaggaccgggtccgncagctgcacaccacccgctcgccgcagttcatggggc

SEQ ID NO: 4146 - DNA, 392 bp, Triticum aestivum
  Clone ID: LIB3281-009-P1-K1-A5
cgagcgagagaagcacgtcctggcccgatccccaatcttccccggcggcgatgccggctggaggagagaagggagaggagcacggaggagctatgtatatattaagtctaagttgagtcttgcccctgtggcgtctggcgctatgccgaggtggagcgtaccgccgccgcgttcgagcagcggccggtggttagcggtggctgcagtcctggctgcgctggtgtgccagttgcttgtgaggagtgggttgccggcgactccacgaataagctcgtttggtccgctgatctggaggaggtccttattttcctctgcttccaaggttaccatggtggtgaaggaggaagagaggaaagatggagatccagttcgggttcgagctcatcaccgac

SEQ ID NO: 4147 - DNA, 393 bp, Triticum aestivum
  Clone ID: LIB3281-009-P1-K1-A6
cggacgcgtgggcaagcaggcatttgatgaagctattgctgagctggactccctcggcgaggaatcctacaaggacagcaccttgatcatgcaacttcttcgtgacaacttgactctctggacctccgataacgcagaggagggtggtgatgagatcaaggaagccgcctcaaagcctgagggagaggggcactgattggccctcgagcgtgcccaagtttatttctgagtccatttacgcagctacctgtatcattcggatcataagatgtactagggtcggttgcactatgtgaatcataagatgtggtaggatggtgctatgcgaagcgtgtcgagctgaagtacctagtggactacagtcatgaggacggtcatgtggacatcgtcgct

SEQ ID NO: 4148 - DNA, 140 bp, Triticum aestivum
  Clone ID: LIB3281-009-P1-K1-A7
acgacgcgcgggtccgccggctcatcctgaaggtccactttgtgcaggacgtcttgctcaggtacgactggcagttggcgctctgcggatcccgggactggaagctccacctctgccacctgtacatcggggtcaagacc

SEQ ID NO: 4149 - DNA, 181 bp, Triticum aestivum
  unsure (1)...(181): unsure at all n locations
  Clone ID: LIB3281-009-P1-K1-A8
gcatgatccaggagcaccagaactgcctcaagtacggccgaccggacctcggcttcctcaagtggcgctggaggccgtccggctgcgagctgccgcgcttcgaccccgtccagttcctgcgtntgccgcacaagtcctcgcttgtgggactcctggtcgaccatacagcctgcttgctctt

SEQ ID NO: 4150 - DNA, 247 bp, Triticum aestivum
  Clone ID: LIB3281-009-P1-K1-A9
acggcgtccccttccgccgcctcaccggccacggccactttgtccaggacgtcgtcctcagctccgacggccagttcgcgctctccggatcctgggacggcgagctccgcctctgggacctctccaccggggtcaccacccgccgcttcgtcggccacgagaaggacgtcctctccgtcgccttcttcattgacaaccgacagatcgtttccgcgttccgcgaccgcaccattaagctgtggaacac

SEQ ID NO: 4151 - DNA, 349 bp, Triticum aestivum
  Clone ID: LIB3281-009-P1-K1-B1
cccacgcgtccgccctgatgatatttcaggcttcaaacaaacactagaggcgaggatgaaggaatcaaataggaatagcagtgtgcaaagatttgtgaagagtgttgagcttctgcagaagcagacaattatgcattaccagccaaataaatctcagtccttcctcaagatagtagttgccctacctacaatggttgctagctgtcgtggcatccttgaaaggggcataacgattggcagtcttggttcaaagagtttcgtgacatatgaaaggcacattctcttttgcccttcgctttatgattgactgcaacattgttggtggcaattggattgaacttcctggtgg

SEQ ID NO: 4152 - DNA, 386 bp, Triticum aestivum
  Clone ID: LIB3281-009-P1-K1-B10
cggacgcgtgggcggacgcgtagggacgcggcggcggccatggcgattcccctcgtgctcgtcctgctcccgctcggcctcctcttcctcctctccggcctcgtcgtcaacactgtccaggccgtattgttcttgacgataaggccattctcgaagcgattgtaccggcagatcaacgtattcctggccgagttgttgtggcttcagctgatctggcttgtggactggtgggcaggtattaaggtacaggtgtatgcggatccagcaacttggaaactaatgggcaaagagcacgcccttctaatatccaatcatcgaagtgacattgattggctggttggatggattttagcacagcgttcaggatgccttggaagcgcaatagc

SEQ ID NO: 4153 - DNA, 389 bp, Triticum aestivum
  Clone ID: LIB3281-009-P1-K1-B11
cggacgcgtgggtttatgattaattacaaaggagctattgattaccagaattatattgctttcaatgaacaacaattgtggccatcaactatgtttcttccaggcctcaagaacaccacagccagacacaagtcggaggtaacggtcattccatttgcgtatgggtaatgcaaaaagcaaagccggtgaacatcaacaagaagaggacgtagctacaggtcaggcgagtggtaaaaatgttgaagaatatagtgcaacctttgatactgaaaaagatgaagctatttgcgcaacagaacccgcctctacgagcgagacaaatttgaaagaatataatccaagcatctaaaccgtagctgcaaatcttgacccaatttacacgacggaaa

SEQ ID NO: 4154 - DNA, 286 bp, Triticum aestivum
  Clone ID: LIB3281-009-P1-K1-B12
cccacgcgtccgcggacgcgtgggcttcttcgcaagcaccagtctctccgccctcgcagccagccgctgccgagagggggccgggaggtcgccaccgccggctgctctctgccacgccgcttcgaccagagacaggtgagatggaaggtttcgagttcttccagatcatacttgacaactcctcgagcaggctgaggctgcctgacaagtttaccagggtgctgctagacggctgtaagccccaggaagtgaagctactttaggccctccatgggctgttcttttg

SEQ ID NO: 4155 - DNA, 93 bp, Triticum aestivum
  Clone ID: LIB3281-009-P1-K1-B2
cccacgcgtacgccctaatgatatttcaagcttcaaacaaacactataggcgaggatgaaagaatcaaattggaatagcagcttgcaaagatt

SEQ ID NO: 4156 - DNA, 395 bp, Triticum aestivum
  Clone ID: LIB3281-009-P1-K1-B5
ctcttcctctccctcaccccttcctctccaccaccggccgccgccgcggccaggccggcgtagcggtgcgccacccagccatccatccattccatctccacaacgcacctccagcaccatctccttctcctccccgaatccatccatctatccatccaccacgccatcacatcaccagcacccctcaccaccagcgccattactccacttcctctgcttcccttcttttctgaacctcaacgccttctgctgctgctccctctctcaacgcctcctgctgctgctcctttcttctttcacccctccctgctgcccttctactcttcctgctgctgctcttcttgcgaccctgctgctgctccttcctcccttacgtcgctgctgttcttctcttt

SEQ ID NO: 4157 - DNA, 249 bp, Triticum aestivum
  Clone ID: LIB3281-009-P1-K1-B6
gtggcggaactggctcaggacttggttcattgcttctggagcgcctatcggtcgactatggcaggaaatccaagctcggtttcaccatctatccttcaccacagatttcgacggccgttgtggagccatacaacagcgtgctctcgacccactcgctgatcgagcacaccgacgtggtggtgctcctggacaacgaggccatctacgacatctgcaagaggtccctggacatcgagcgcccgacctaca

SEQ ID NO: 4158 - DNA, 287 bp, Triticum aestivum
  Clone ID: LIB3281-009-P1-K1-B7
cggacgcgtgggctctctccctctctctctgtctcgagaagagtcttcctccttggggggaggcaggcggcagggaagaagcaaagcccagcaagcaagcaagcttccttgcttgctccagatctggtctaggtcggaggaggagcgggagggcgcgctggggtcggcgtcggagatgaaggcggcgctgcggagccggcaggagccgcggcgggtcagcaacggcgtcatcatcgccgccatgctcctctccctctgcgtcctcagcatcgtcaaggccagatact

SEQ ID NO: 4159 - DNA, 318 bp, Triticum aestivum
  Clone ID: LIB3281-009-P1-K1-B8
gggaaatgcaacgacactcagcggctatgcgtcagcttgttcattacaaaggacaccctgaccccttaaaaggggatgcccttaataaggctgtccgcgaaactgcaaacgaggccattgctgctattttctccactgaggaccctaaagcagttgttgtgacagaaggtctaggcaagcgcatacagggctttggaaacactaattatgagccatcaagagatgacaagaagtctttcctcagcgaactaagtgaagtagtgggcatttggtggtgctttcattaaacaggggtttgagcaactttggctgccacac

SEQ ID NO: 4160 - DNA, 288 bp, Triticum aestivum
  Clone ID: LIB3281-009-P1-K1-B9
cggacgcgtgggcggacgcgtggggcgcgattcgctgctcttcctccagcctcctactgctcgcctccggtgtgggggtgcgctgcggtgggcggaggggaggccaggggatcgagaggcgaaccgaggaaggaaatggcggcgtggacctccgtgggcctggtggcggtggccgtgctggtcgtcggcatcgcaatgccggcctcagccgccgtgcagcctgccgcgcccgcgcccttcagcgacggcacgtcgattgatcaggggatcgcatacgttctgatgctg

SEQ ID NO: 4161 - DNA, 121 bp, Triticum aestivum
  Clone ID: LIB3281-009-P1-K1-C1
taaaaccattgcttacctagagagatgcacaagcgattttatgaatttgacggggtatcaaggttctacattcaaggaagttttatgcccatctcatgatcggatccacacatacgtggta

SEQ ID NO: 4162 - DNA, 202 bp, Triticum aestivum
  Clone ID: LIB3281-009-P1-K1-C10
gtgtcgcaaaaaatcatacagtggttgtaactgatgatgggaagtccttggcatttggccacaacaaatttgtacagttggtgacaggttccctaaataatgaaattgatgcatctaccagttctttctcttgttacagatgtgactggtgttgattgtgttggagtttatacttgtatgtctgtcgtcagtcttgggcttg

SEQ ID NO: 4163 - DNA, 156 bp, Triticum aestivum
  Clone ID: LIB3281-009-P1-K1-C11
ggtcctgttgggcagatcattgtccaactactgtcaaaacagttaagggcatttgtcgcgctcgatgtccaaagagatcggccggcagctgggatcgcactagatctaccaatttattttgtcggtcaaagaagcagagtggtgcagttcacagtt

SEQ ID NO: 4164 - DNA, 142 bp, Triticum aestivum
  Clone ID: LIB3281-009-P1-K1-C12
ctcacgcgtgcgtttacgattattttcatacgaacgaatcattatcggggttatttcgaattgaaggggcaacaagggttctccataatctatgtttgtcccatgctttaagaccaccacatttctacacagtttgaatgta

SEQ ID NO: 4165 - DNA, 224 bp, Triticum aestivum
  Clone ID: LIB3281-009-P1-K1-C3
acgagccgaacataaaaaaatagattatgaatgaaaattaaagaggaggagggggaatgacacatgattataataaaatcaagagcaaataaaaaacaaaaaagatgccaattagacaaataaaaaaaaaaggaaaataaaaaaaaaggataaaagtaggcagagaatagaaattaggtaaaagtgaaaaaaataaaaaattaataaaatatatataggggaaa

SEQ ID NO: 4166 - DNA, 377 bp, Triticum aestivum
  Clone ID: LIB3281-009-P1-K1-C6
cggacgcgtgggcggactcgtggggtctgaatcgctgctatttctacagcctgctactgctggcctgtggggtgggggtgcgctgcggtggtcggaggggaggccaggaaatctgagaggcgaaccgagtaaggaaaaggcggtgcagacctgcgtgggcctggtggcggaggccgagctggtcgtcggcatatgaatgccggactcagccgtcgtgcagccgcccgggcccgcacccttcagcgacggcacgtctattgatcaagggatcggatacgtacttgtgctggtggcccttgtgctcacctacctcatccacccgatggactcgtcctccccatacatgctcttctaatctaatcaaaaaatcggtttgt

SEQ ID NO: 4167 - DNA, 80 bp, Triticum aestivum
  Clone ID: LIB3281-009-P1-K1-C7
cggacgcgtgcgcggacgcgtgcggccagagtctgtgttgttcctacagccttctactggtcgcctatggtgtgtgggtg

SEQ ID NO: 4168 - DNA, 67 bp, Triticum aestivum
  Clone ID: LIB3281-009-P1-K1-C8
cggacgcgtgggcggacgcgtgggcagcgagaaaataacattccttgatactatggactgctaacca

SEQ ID NO: 4169 - DNA, 201 bp, Triticum aestivum
  Clone ID: LIB3281-009-P1-K1-C9
cccacgcgtccgcagcaccttacgcgaacaacaacggcacgctgctggatgtcccaacgggtcccatgattgtccaggtcgcataagtactgattgattaagagggctgtctttgctaactgtcatgcgtgcaagacagggatcgaagtgttttgtgtctgaagccaccatatttttgtcttatatatctgggcattaact

SEQ ID NO: 4170 - DNA, 357 bp, Triticum aestivum
  Clone ID: LIB3281-009-P1-K1-D1
cggacgcgtggggacgaggccaacaatgctattgtgaggacatggggagagaagagactggaggagaaattgaagaatcatgtggatctctgcataatgcttgacatcgtatctttggataagggtgctgatgtagctggtggaagaggtttctttttgaagggtgacggtgttctcctgaaccaggcgttgataaattttgggctatcattcctgggaaaacgagactttacaccaatgcaaactccttttttcatgagaaaggaaatcatggcaaaatgtgcccagtttgcccaatttgatgaggagctctacaaagtaacaggtgacggagaggataagtatctcatagcaaca

SEQ ID NO: 4171 - DNA, 391 bp, Triticum aestivum
  Clone ID: LIB3281-009-P1-K1-D10
cggacgcgtgggcggacgcgtgggcggtggacttctcggaggggagccgcgcggcgctgcagtgggcggcggacaacctgctccgcgccggcgacaacctgctcctcctgcacgtcctcaaggaccccgactacgagcagggcgagaccctcctctgggaggcctccggctcccctttgatccccctctcggagttctctcacccttcaactgcaaagaaatatggggtgaagcctgatgctgaaacacttgacatgctcaacaccatagctaatcaaaaggaggctgatgtggtttccaaagttctgattggagatccccgagagaagctgtgccaagccatccatgacatgcccatcagctgcctggtcattgggagcaggggccttgg

SEQ ID NO: 4172 - DNA, 391 bp, Triticum aestivum
  Clone ID: LIB3281-009-P1-K1-D11
cggacgcgtgggggaaaaacttgtagacatcgtgcacttcttgcattgggagatccataatacctttgggtgctcagataatgaagaatcgcaggaacctactaaacgacgtaatagattgggtccagcaggacttgcgctgcattatgccaatatcatcagtcagattgatgctcttgtttctcgctcaacttctgttcctccaaacacaagggattcattataccagagtttgccaccgaccataaaatctgctctccgttctaagctacattcatctggagttaaggaagagcttactgttcctcaaatcaaggcggaaatggagaagacattacggtggcttgtcccggttgcaaataacaccaccaaggctcaccatggctttggt

SEQ ID NO: 4173 - DNA, 315 bp, Triticum aestivum
  Clone ID: LIB3281-009-P1-K1-D12
ctagccaaaccaccaagtgccacaccatggcgtacgcgtacgatcgggaggacggtctcgctccgtggaaggcggacggggggcggcgcggcgactactacaatccgaactacgtgccggtcttgttgaagacatttgtggtgtacctggaccggcgcattcagaacgagaacgtataggagattcacctgatgtacagagggcgggttgcagcggctcttcgacgcggctttgctgacacgcgcggggcgcgaggcgtggcacgggaagtgtaatgcgacggtgaccacgtcttgctaggagtataccgcgagc

SEQ ID NO: 4174 - DNA, 154 bp, Triticum aestivum
  Clone ID: LIB3281-009-P1-K1-D2
caccctcccaacgggatttcggaaccggaacttgggttttttttggctcctcccctggccggacgggaaggtcccctttttcttcgggccgcttttcccttccgtccccgtggggttttggttcaccggggcccggtttccaaaccttggggtt

SEQ ID NO: 4175 - DNA, 101 bp, Triticum aestivum
  Clone ID: LIB3281-009-P1-K1-D3
tcggtctttcccggttttcttctcttcccttggattcggttcgcaaaccccttcttttttgcaaaacctaaattttggccccgaaccttcattggcggttg

SEQ ID NO: 4176 - DNA, 390 bp, Triticum aestivum
  unsure (1)...(390): unsure at all n locations
  Clone ID: LIB3281-009-P1-K1-D4
tcggtcttccccggtttccttcttttcccttggattcggttcggaaaccccttcttttttgcaaaccctaagttttggccccgacccttcattggcggttgaggcggctttttaacggcggcatgggcttaaaatccaacctggaaaaataccggttccaatatttcgaccaacaagccggaggagcaggactccaccatcgaaaccaagtcctccacctccaaaggatgggtggaaacaaacccgggggggcacttgctggttttgatgctgtaggtcgcatggagcctgaaaagggcggaatggggattcaaggctctcaaacaaactgtgaagcnttattataaagctgggaagtacaaagaaatgatggatgcttacagagagatg

SEQ ID NO: 4177 - DNA, 393 bp, Triticum aestivum
  Clone ID: LIB3281-009-P1-K1-D5
cccacgcatccccctcccgatcccgagcccacctgagcaaagccgccgtcacgccattgtcgtagacatcctctgaagccctatagcgccgcacactgttgtccaggagcagcaccatcgacctctacatcgactacatcaccggattggacgagaacgccactgcaatcgacgcatcgtccacctattcacccacggccgccgccgccattgacgctcgatccctcatctccagtacgttcccggccacctcgagctcaccttcggcaccgtgatccaaggcatggagaactccaaggagtttgctaacaagttgttcgggatatgtcgaggcagaggaacattgagtcggatgaaggcattaacaaggatcggctcaaagagtggaacatg

SEQ ID NO: 4178 - DNA, 207 bp, Triticum aestivum
  Clone ID: LIB3281-009-P1-K1-D6
gaagggtccaactcaacagtgtttgcatctggtgaagatgttgatcgacctgcgcctcaagtttatgttgggcatcgcaattgtgagactgtgaagggtgtgacttttattgggccaaatcatgaatatgttgccagggggtcaaaacgtgggccggtgtttatttggaggaaaagagatgggaaatttttaccggccaaggggggg

SEQ ID NO: 4179 - DNA, 371 bp, Triticum aestivum
  Clone ID: LIB3281-009-P1-K1-D7
catggaggctatttattttgatgaaggtgtcagaacatcaaaaagacatcaacttgagtctaaactcttgcagcttgtcaatcctgcgtaccaatctcttcttggtcatttacggactagaactttagaagcattcaaagagtcctttgataaggccgttgaaaaggagggatttgctgttgctgctcgcgattctacccagattttcttggagaagtttgataaaggatctgaagatgctaccattcaacaagtgaactgggatccctcgaaagttaaggataagcttaagcgtgacattgaggctcatgtggtgtcagttcgtgctacaaagctttctgaactttgtgccacatatgagggcaaactta

SEQ ID NO: 4180 - DNA, 303 bp, Triticum aestivum
  Clone ID: LIB3281-009-P1-K1-D8
cttatgttggctgatgatatggcttgtaatcctcggaacaattatcctgcccaagtgttcaacaatgagaaccaccagcttaatctttatggtgacaatgttgaggttgattaccgaggttatgaggttacagttgaaaactttttgcgagttttgactggaagacatgagagcgctgtaccaagatcaaagcgtctcttaagtgatgaaggaagccatattcttttgtacatgactggacatggtggggatgaatttttgaagttccaagataacgaaagaacttcagagccatgatttagc

SEQ ID NO: 4181 - DNA, 262 bp, Triticum aestivum
  Clone ID: LIB3281-009-P1-K1-D9
cccacgcgtccgcggacgcgtgggcctagccgccgtcgccccaggtaagggagagagcctaccccccgccgccgccatgaagcgcaacccccgcgtcacgagctcccgccggaagtgccgcaaggcgcacttcacggcgccgtcctccgtccgccgcgtgctcatgtccgcggccctctcctccgagctcaggcacaaatacaatgtgcgctcgatccccatccgcaaggatgacgaggtgcatgtcgtgcgcggcacctac

SEQ ID NO: 4182 - DNA, 352 bp, Triticum aestivum
  Clone ID: LIB3281-009-P1-K1-E1
cccacgcgtccgcccacgcgtccgcccgttcttctgctcccttgcagaaccttgcggcgacgattctccaaagggggttgggcgtcggcgccgcagacctcgccgtagtggtggcccctcgcacctgctcccaaccggcgtgcccccgatgtggcggctgcccgggctgctctcccaggccgccgcggccgggagggcggcggcgaggaccagcagcagccacgtcagcggttccaagggcttctccagcggagggggcgggtccccgctgccccgagggtggctgcggaggctgtggatcgaggagctgaaaagggagaaggaagctgcgaggagactggggggaggcgtc

SEQ ID NO: 4183 - DNA, 390 bp, Triticum aestivum
  Clone ID: LIB3281-009-P1-K1-E10
cccacgcgtccgatccccgccaccgtccccatggcgccagggctcaaacgcttcaccgacgtcgcggcagacggcacgccccgcctcgacgacgccgccggcgaggagctcgtgtgcgtggagcgcgccgcctcggtcgccctcggcagccgcgcgccggagcccccgggaaccctcttcatcaccaccaggagggtgatttggctcagcggggcggagaagggcaaaggatacgcggtgggcttcctggacatcacgctccacgcagtgtcgcgcgacccggaggcgtacccctcgccgtgcctctacactcagattgaagccgaagctgactctgatgaagaggatggtgattttgactctgaagcaggtggtgactcacagctacca

SEQ ID NO: 4184 - DNA, 364 bp, Triticum aestivum
  Clone ID: LIB3281-009-P1-K1-E12
cccacgcgtccgcccacgcgtccgctggagttactttgtcggaggagcagcttaaatacgcccagggaaaagcaagagaagctggcttagaggaccacataacttttctgctgtgtgactaccgtcacataccaccttacaagtatgacgcaatcataagcatctgtatgattgaacatgttggccatgaatgcatggacgaattttttgcctgctgcgagtcttacttggctgaagatggcataatggccctgcagttcatctcagctccagaggaacggtacgagcaatacagaaaaaggccagacttcttaacagaatatatatttcctggtggttgccttccttctttggcccgtgtagt

SEQ ID NO: 4185 - DNA, 373 bp, Triticum aestivum
  unsure (1)...(373): unsure at all n locations
  Clone ID: LIB3281-009-P1-K1-E2
ctcacacaactcttcttctcccatcaaacacatagctagaaactagaaagtcgtcactacgccttcatctgtccatccaaaactcatacttcgattccttttgagatctctcccaaaatggcgtcgaccaccaccaggctcgtgtgtgcacccctgttcctgctcttgctctccatgtccaatgccaactcagtccaagagaccggcagctccctcaaaagctccactcagaagaatgtgttcgtcctcgacaactacggcgcccgtggcgacgggaagcacgacgacacgcaggccctggccaaggcgtggaacgcggcgtgttcctcgtnccggccggccgtgctggtcgtcccaagggcaaaacctatct

SEQ ID NO: 4186 - DNA, 243 bp, Triticum aestivum
  Clone ID: LIB3281-009-P1-K1-E3
cccacgcgtccgtcgtttccgcctcctccaccaccacagcactcctctgctccgcccctcccgcctcccgcggcgggctcgtggtggcgtgggcggccccggcccggcgcgcgctcgcggctcctctgcgcgcggcagcggcgcaggggtcggccaactccgcgccggtcatgatggagagcaaggtcaagaagaggaacaagaagggcgccggcgccgggggccttcccgccgtcatcgacg

SEQ ID NO: 4187 - DNA, 396 bp, Triticum aestivum
  Clone ID: LIB3281-009-P1-K1-E4
cccacgcgtccgtcgtttccgcctcctccaccaccacagcactcctctgctccgcccctcccgcctcccgcggcgggctcgtggtggcgtgggcggccccggcccggcgcgcgctcgcggctcctctgcgcgcggcagcggcgcaggggtcggccaactccgcgccggtcatgatggagagcaaggtcaagaagaggaacaagaagggcgccggcgccgggggcctccccgccgccatcgacgtcgagatccgggaggccgagcagtacctcgccaccgacgggcaggaacctactccagaagacttcccctttgaaatggttgatgaagatgggatgagcgtggttattctgaaaagggactacaaggatgagaagattgaggtcattgtcagct

SEQ ID NO: 4188 - DNA, 283 bp, Triticum aestivum
  Clone ID: LIB3281-009-P1-K1-E5
cccacgcgtccgcccacgcgtccgcccacgcgtccggcttgtgataacacaggtctgaagaccttcttttttccatgtggaacgttctcaagaattgcttcaatcgcaaagaacaagcccatgtcttcgggagaagcctgcaatgatattatggcgtactccctcatactgtcttgttgctgttacacttgctgtgtaaggagaaagcttcgtcaaaggctaaatattgcggtacatattcctggacatctaaatttattggtatcagttggtttataccccc

SEQ ID NO: 4189 - DNA, 386 bp, Triticum aestivum
  Clone ID: LIB3281-009-P1-K1-E6
cggacgcgtgggcgagccaaaccctagcgccgcccccctccccctcctgccgccggccgccgaccgaggtgaaggcagaggtgggaacacaaccaagatggcggacggtcatgataacgacaagaacattgagatctggaaagttaagaagctgattaaagggcttgatgctgcccgtggaaatgggacaagcatgatatcgctgatcatgccacctcgtgatcaggtctcaagagtaaccaagatgttgggtgatgaatatggaactgcctcaaacatcaagagcagggtcaacaggcagtctgtcttggctgctattacctctgctcagcaaaggttgaagctgtacaatcgagttccacccaatggattagtactttatactg

SEQ ID NO: 4190 - DNA, 379 bp, Triticum aestivum
  Clone ID: LIB3281-009-P1-K1-E7
cgccctgcccgtctctgtcctccccgctcccttcgccgccgggtccaaaccgaaggagccgcgcccgtggaaacctagggtttcgccgtccccgccctccaaaggtttttggagaagagctgtttgttcagcgacatgaggccaattttctgcgggaaccttgactatgatgcccgccagtctgaaatcgagcgtcttttcggcaaatatggaagagtggagcgagttgacatgaagacaggatttgcgttcgtctacatggaagatgaacgtgatgctgaagatgctatccatagacttgacagaactgactttggtagaaaagcgaggagactgagagtcgaatggacaaaagaggatcgcaggtgttgtccgaaag

SEQ ID NO: 4191 - DNA, 380 bp, Triticum aestivum
  Clone ID: LIB3281-009-P1-K1-E8
ccggcacggggtgtcctacgtggggcccggcacccggttctcgccgctggtgcccggcgccaccagcttcccgcagcccatcctcaccgccgcgtcgttcaacgcctccctcttccgcgccatcggcgaggtggtgtcgacggaggcgcgggcgatgcacaacgtggggctggcggggctcaccttctggagccccaacatcaacatcttccgggacccgcggtggggccgcggccaggagacgcccggcgaggacccgctgctggccagcaagtacgccgtcggatacgtcaaggggctccaggacgccggcgcggcgggcgtcaccgacggcgcgctcaaggtcgccgcctgctgcaagcactacaccgtctacgacg

SEQ ID NO: 4192 - DNA, 385 bp, Triticum aestivum
  Clone ID: LIB3281-009-P1-K1-E9
cccacgcgtccgcggacgcgtgggtgaacatagactgatcgatgatatggtggcttatgccctaaagagtgaaggtggctatgtttgggcttgcaagaattatgatggagatgtgcagagcgatctagttgctcaaggtttcggatcgttaggtctcatgacatcggttctggtgtgccctgacggtagaacagttgaagctgaagctgcacacggtacagtcacacgacattacagagtccaccaaaaaggaggcgaaactagcacaaacagcattgcgttaatctttgcgtggtctactggattagcacataaggcaaggctcgatgacaacaaaagactgttggatttcacacaaaaacttgaagcttgttgtgtgggaaca

SEQ ID NO: 4193 - DNA, 389 bp, Triticum aestivum
  unsure (1)...(389): unsure at all n locations
  Clone ID: LIB3281-009-P1-K1-F1
cggacgcgtgggtgaacgaggagctctggaacgaagcacggacatatggagacatccaattgatgccatttgttgattattacagcttgattctttggaagacgattgccatttgcatatatgggacaaatgtactttcagccaagtatgttatgaaaaccgatgatgacgcttttgttcgtgtagatgagatactttcgtccctacatcaagtaaatatcagccatggactgctgtatggtcgtgtcaattctgattctcagcctcaccgagatctgtatagcaagtggtacataacttcagaggaatggcctgaagagagttatcccccatgggcacatggnaccaggtacattgtatctgaggacatagcanaagaagtttacagg

SEQ ID NO: 4194 - DNA, 364 bp, Triticum aestivum
  Clone ID: LIB3281-009-P1-K1-F10
cggacgcgtgggcggacgcgtggggctggaggcgccaagaagttctctgctgcatactcgaactgcgcgaagaagccatcctgatatcgtttttggcatccccttctcgtagtttaggatttttatgcaattttattctgactcttttctcccaccaatctctctggcttgctgcttcacgataatcgaccagttctctagtctttctccctctgttcctctctgctctgctctctgactcgaactgcaacaatggctgccccgacctctgcgatcgggtttgagggctacgagaagcgcctcgagatcaccttctccgaggcatcaatctttgccgaccctcatggtcgtggcctgcgcgccc

SEQ ID NO: 4195 - DNA, 384 bp, Triticum aestivum
  Clone ID: LIB3281-009-P1-K1-F11
ccacggcgccgccgcctcctccccttctgccctgctctccaccgcgctgccgcctcctcccttatgctccccaccgcgccgcctcttcctccccttcactgttctctccagcggcggcaaagatctggcggcaaagggagacgacgagggcgctcgatccgatctgctgaagacaaggaaggagaggagggagaaagagagaggaaagaggagagggaggtgtggtggcggatgagagagggtcaccggaaggagcgtgacgacctgcaggcaaagggcggcggcggcgccgctcgatttgatctgcgggagagagaagatgagagggggaggaagagggagagagagaaggaaggagaggagcggcgagagaaagagagagga

SEQ ID NO: 4196 - DNA, 376 bp, Triticum aestivum
  unsure (1)...(376): unsure at all n locations
  Clone ID: LIB3281-009-P1-K1-F12
cccacgcgtccgcaaagccagagcgcccgtctctcccccctcccacgccgccgtacaccgaaccctagcgccccagcgagcgagcgagcgacagccatgccggcggacgcgaagatccggtggggggagctcgaggaggacgacgggggcgacctcgacttcctgctgccgacgcgggtggtcatcgggcccgacgagaacggcttcaagaagacgatcgagtaccgcttcgacgacgacggcaacaaggtcaaggtcaccaccaccacccgcgtgcgcaagctcgcgcgcgcgcgcctnttcaaggccgtcgtcgagcgtcgcaactggtccaagttcggcgacgccgtcagcggcgacgacgccttcgtgcgcc

SEQ ID NO: 4197 - DNA, 324 bp, Triticum aestivum
  Clone ID: LIB3281-009-P1-K1-F2
cccacgcgtccgaatcccctccaatcccaccttcggagcagctagcatcgccagccatgtcgggccgcggcaagggaggcaagggcctgggaaagggcggggcgaagcggcacaggaaggtgctgcgcgacaacatccaggggatcacgaagccggcgatccggcggctggcgcggcggggcggcgtgaaacgcatctccgggctgatctacgaggagacccgcggcgtgctcaagatcttgctagagaacgtcattcgtgacgccgtcacctacacggagcacgcccgccgcaagagcgtcaccgacatggacgtcgtctacg

SEQ ID NO: 4198 - DNA, 224 bp, Triticum aestivum
  Clone ID: LIB3281-009-P1-K1-F3
ggggccagcagtggaggcgcaccagccctttctcccgctctttgctcctcttctcgcagtaatcggggagggtggtggtggtggtggtggtaccggcgccatctaaatttctacggagctcgtcatgaaaagcatcgacggcagaaacaactcctccatccaccagatggccagccccaatcatatgtactacatcttcgtcctgatgtacgaggacacccacg

SEQ ID NO: 4199 - DNA, 339 bp, Triticum aestivum
  Clone ID: LIB3281-009-P1-K1-F4
ggggccagcagtggaggcgcaccagccctttctcccgctctttgctcctcttctcgcagtaatcggggagggtggtggtggtggtggtggtgccggtgccatctgaatttctgcggagctcgccatgaagcggcccggcggcagaaacccctcctccctccaccagatggccagccccaatcatatggactacagcttggttaggatgtatgcgtacggtcacgcatagtatgatatcttagcgcccgcgctcccccggcccgtcccacgctccgatacgtcggaatccgtctaaaaagcggcgcctttacagcatcttcttcgatgtaataaatcttt

SEQ ID NO: 4200 - DNA, 380 bp, Triticum aestivum
  Clone ID: LIB3281-009-P1-K1-F5
cggacgcgtgggcgcgcagccaagggggaaagaaagaaagaaaaggaaaaccaaccagaagaaaagctcgggcgtttcttagcgtgggaggagaataggggagcgtgggggagggagcatggcggagcacaaggaggagccggtggcggagtccatgatggacaagatctccgacaagttccacggcggcggggactcctcgtcgtcatcctcggactcggacgacgagaagaaggggtcggcggcgggcgtcaaggccaagatctaccgcctcttcggccgcgagaagcccgtccacgccgtcctcggcggcggcaagcctgctgatcttgttctatggaggaacaagaagatctcaggaggggtgcttgctggcgcta

SEQ ID NO: 4201 - DNA, 390 bp, Triticum aestivum
  Clone ID: LIB3281-009-P1-K1-F6
atttgttttgcattgtttacctctgtttttaaggttcacgaagctactgaccctgaaagagtggtgatgcgagtgagattctgagagatttctctcggatcaaaaggagctcgacgttatgcttcacagatctcttcctgctcggactggattcattgcttcataggtatcttgcagctcgcattggtacgaacacactcactgctgaatttagttagttacacttgatgagcatatgcaccttctatttatttcagtgcatattacatagtaaaataccatataaatttcttcctcttgattattctattctatttatttgttcaaacatattggctgcaatctacttcaaggcatcctggtaggcatttagtcttacgtagtaatgag

SEQ ID NO: 4202 - DNA, 338 bp, Triticum aestivum
  Clone ID: LIB3281-009-P1-K1-F7
cggacgcgtgggcaccggcgggggccgtcggcggcggcttccgcaaggggcttcttgaatgggcaatgggaggaggcgaaccacccaggggccggacagcccccacggaccacgccgagccaagcaccgcagccgacatgtacatcgactccggcagagaccatgcgggcggggatccgggtgccaaaaggaggcgcggcggcggcagcggcgatgatgcgcacgtcgtggtccagaggccggagaagcgccggatcctcgcgtggagggtgcgccagtaccggtccctggtggccgaagccacggcggcggcaaggagggcaagaatcccggcggtg

SEQ ID NO: 4203 - DNA, 233 bp, Triticum aestivum
  Clone ID: LIB3281-009-P1-K1-F8
accgcgacaagggctacatcgacctctccaagcgccgcgtctccgaggaggaggccgccacctgcgaggaccgctacaacaagtgcaagctcgtccactccatcatgcgccacgccggcgacaccctcggcgtcgacctcgagcccctctaccagcgcatcggctggccgctctaccgcaggtacggccacgcattcgaggcctttaagctcatcgacaccgaccccgacgcc

SEQ ID NO: 4204 - DNA, 291 bp, Triticum aestivum
  Clone ID: LIB3281-009-P1-K1-F9
cccacgcgtccggccaaaggatgaccggcttcttcatcacgcgccactgtaaaaaaaacatcttacattatgggaccgagggagtagataggaaagcgccgacaaccccccccccctccccccggccacacatgggaaccctgccctgctttgggctgcgagtgccccgcgtgatgcacaagatctctcttaataccccctccgtccagaattacttgtcgcgaaaatggatcaaaatggatgtatttagaattaaaatacgtctagatacatccatttctccgacaagta

SEQ ID NO: 4205 - DNA, 346 bp, Triticum aestivum
  Clone ID: LIB3281-009-P1-K1-G1
cggacgcgtgggcggacgcgtgggctgttgctgagaaatttaagaagagtccatacagttttgtctgggcaggtgccggcaagcaagctgatctggagaagcaggtcggagtcggtggttatgggtatccagccatggttgctctcaacgtgaagaaaggcgcatacgctccacttcgtagcgccttcgagctcgccgaaatcaccgagtttgtgaaggaggcggggcgcggcggaaagggcaaccttcctctggaaggcgccccgacggtcgtagagtcagaaccatgggacggcaaggacggagaggtcatcgaggaggacgagttctcgctcgaggagctcat

SEQ ID NO: 4206 - DNA, 253 bp, Triticum aestivum
  Clone ID: LIB3281-009-P1-K1-G2
cccacgcgtgcgcggacactaaagctagggcatagagtacatttaacaagagaggatacagcatgcgtatgcgcaggtgccgcaaagcaatgctaatgtggataagcaactaccagtcggtcgttatgggtatccagccatggttgctctcaacgtcaagaaaggcgcatacgctgcacttattaacgccttcgagctcgccgaaattaccgagtttgtgaaggtggcggttcgcggcggaaagggcatcctt

SEQ ID NO: 4207 - DNA, 208 bp, Triticum aestivum
  Clone ID: LIB3281-009-P1-K1-G7
cccacgcgtccgatccctgttaccgttcccatggcgccagggctcaggcgcttcaccgacgtcgtggcagacggcacgccccgtcttgacgacgccgtcggcttggagctcgagtgcgtggagcgcgccgtcttggtcgtccttgttagcctctcgccggtgcttcgtgtaaccctttttaatcaccaccaggagggtgatttggttt

SEQ ID NO: 4208 - DNA, 174 bp, Triticum aestivum
  Clone ID: LIB3281-009-P1-K1-H1
gctggtttcttcttctgaaatcccatgtattactagcagagtttgtttgttttggtctacagaaagttcatatagtttttcatgtgcgtaatatctatatggacaagatgagtttactgttttttgccttttctatgttacaagatactggtaatatggtattgtttcttctgt

SEQ ID NO: 4209 - DNA, 394 bp, Triticum aestivum
  Clone ID: LIB3281-009-P1-K1-H10
gcgactccaaatctctcgtggtagacagcttccatctcatctccggcgatgtctgggcgtggcaagggcggcaaggggctcggcaagggcggcgccaagcgccaccggaaggtgctccgggacaacatccagggcatcaccaagccggcgatccggaggctggccaggaggggcggtgtgaagcgcatctcggggctcatctacgaggagacccacggcgtcctcaagatcttcctcgagaacgtcatccgcgacgccgtcacctacaccgagcacgcccgccgcaagaccgtcaccgtcatggacgtcgtgtacgcccttaagcgccagggccgcaccctctacggctttggcggctgagcgccatcagcgcgctgccgcttgctgacactgt

SEQ ID NO: 4210 - DNA, 363 bp, Triticum aestivum
  Clone ID: LIB3281-009-P1-K1-H11
cggacgcgtgggcggacgcgtgggaaagaatggcgggggacggcgagcttcttccccggatcgcggtggtcggcgcgggcatcttcgcgcgcactcagtacatccccaggctccgcgagatctcccacctcgtcgtcctcaaggccatctggagccgcacccaggaatccgcagaggctgccgcggagctcgcccgcgattttgcgcctggcatcgagtgtaaatggggcgacgcggggctggaggagatcatgggagacccttccatcctgggcgtagcccgtgtttttgcaagccaaagtcaggttgagcttttcttttgagatgctcaaggcaggaaagcatgtgttccaagagaaacct

SEQ ID NO: 4211 - DNA, 332 bp, Triticum aestivum
  Clone ID: LIB3281-009-P1-K1-H12
aacgccggctcgctctcgctccgtctccctccctcctcccccgctccgcgccctccgccgccagatcccgtcgagccccccgcgcccccgcgtcgaagatgagggagtgcatctcgatccacatcgggcaggccggcatccaggtcggcaacgcgtgctgggaactttactgcctcgagcacggcatccagcctgatggccagacgaacggcgacaagaccatcggaggtggtgatgacgccttcaacacctttttcagcgagaccggagccggcaagtacgtgccccgggcggtcttcgtcgatcttgagcccaccgtgattgacgaggtc

SEQ ID NO: 4212 - DNA, 398 bp, Triticum aestivum
  unsure (1)...(398): unsure at all n locations
  Clone ID: LIB3281-009-P1-K1-H3
ccggcacggggtgtcctacgtggggcccggcacccggttctcgccgctggtgcccggcgccaccagcttcccgcagcccatcctcaccgccgcgtcgttcaacgcctccctcttccgcgccatcggcgaggtggtgtcgacggaggcgcgggcgatgcacaacgtggggctggcggggctcaccttctggagccccaacatcaacatcttccgggacccgcggtggggccgcggccaggagacgcccggcgaggacccgctgctggccagcaagtacgccgtcggatacgtcaaggggctccaggacgccggcgcggcgggcgtcaccgacggcgcgctcaaggtcgccgcctgctgcaagcactacaccgnctacgacgtcgacaactggaagggcg

SEQ ID NO: 4213 - DNA, 389 bp, Triticum aestivum
  unsure (1)...(389): unsure at all n locations
  Clone ID: LIB3281-009-P1-K1-H4
ccggcacggggtgtcctacgtggggcccggcacccggttctcgccgctggtgcccggcgccaccagcttcccgcagcccatcctcaccgccgcgtcgttcaacgcctccctcttccgcgccatcggcgaggtggtgtcgacggaggcgcgggcgatgcacaacgtggggctggcggggctcaccttctggagccccaacatcaacatcttccgggacccgcggtggggccgcggccaggagacgcccggcgaggacccgctgctggccagcaagtacgccgtcggatacgtcaaggggctccaggacgccggcgcggcgggcgtcaccgacggcgcgctcaaggtcgccgcctgctgcaagcactacaccgnctacgacgtcgacaact

SEQ ID NO: 4214 - DNA, 397 bp, Triticum aestivum
  Clone ID: LIB3281-009-P1-K1-H5
cggacgcgtgggcggacgcgtgggccggaaagcctgcatctgcacctcaactccctcaaggtgctggcgtattatctccccagtacctgccagtatctcagaacttttgtttcttgtttcagacttgatcttggtttgaaaccttcccagcaccaccagtaactgatcaaaagccctggttaggtagtcatctgggcattgcactggttctttgtctgacattatagtttcttgtgttcctgaagtgacaaaaggaataggcgaaggtaagcgccgttttttgcctcttttaccatctttcatatgtgatttcctatccagattttctggagggagattatcagggctgtctacatctgaaagccatttgcgagatttatatcctttcccaaagctt

SEQ ID NO: 4215 - DNA, 368 bp, Triticum aestivum
  Clone ID: LIB3281-009-P1-K1-H7
cggacgcgtgggcgcggagcaaggaaggaggagcccgtcgggctactaatctcgggggttccccctctgatccgggcggtttcggccgttagctgctgggggaggagccgcgccggttcgtggcgccggcgtcggtggccgggggtcgtcggtccttccttggttctctcgtcatcggaaaaataaatcggtcgatctgcctctggtgagcgatttctcagattgcctcgcgcggttgggcttctccggtggggcaaaggcaggattttgagccactttgcccctaaaattaaatctgatttaatgggcgaccaatccaaaatgtgcctgtagcatcatcggttgtgccgtttcttgggtcgggcttt

SEQ ID NO: 4216 - DNA, 331 bp, Triticum aestivum
  Clone ID: LIB3281-009-P1-K1-H8
tctggtattccccccgacgcgacgccgcggatctaattacagccgccggcgtggccgtgccataccttagcctcaatccaacctctcgggggcgcgggccgccttcgccccagtccggcctccatcatcactgccgccatcgccgttccccttcttcctcagccgccgggacatccagctgccccgtccagtgtttggccgttgggtctccttccatacttccttcctctgaggtcggacatacatctagatctgccgcccctgtatttgtatgtattaccatggagactgtacatagtacatgaatcatggcggtggcacgacggctact

SEQ ID NO: 4217 - DNA, 366 bp, Triticum aestivum
  Clone ID: LIB3281-009-P1-K1-H9
cggacgcgtgggcaagcattcacatgcacgcgtaggtcccgggcttcgcctgctcccatcccaaccaccaccatgcctcccccgctgctcgtcttcgtttgcctcgtcctgttcgtccttcttggcgcgccatggccgtccgaggcgggggcgaggccgcagcttttcgcgctgcgggcgcgccagatgccggccagggcgctgccgcggcagcccagcaagctgcggttccaccacaacgtcagcctcaccgtctcgctcgccgtcggcacgccgccgcagaacgtcaccatggtgctcgacaccggcagcgagctgtcctggctgctctgcgcgccggccggcggcaggaacaggtacaacgcg

SEQ ID NO: 4218 - DNA, 296 bp, Triticum aestivum
  Clone ID: LIB3281-010-P1-K1-A1
cggacgcgtgggcggacgcgtgggcggacgcgtgggggatgatgagtacaagaagaagcccagtggtggtgggaggtatgaagaggatgacgagtacaggaagaagcctactagcggtggtggcggctacggaggtggaaggtatgagggagaagatgagtacaagaagaagcctaccagtggtggctatggtggggggaggtatgagcaagaagatgactacaagaggccccctagtggtggctatggtgggggaaggtacgaagaagactgatgtgtacaagaagaagcctagt

SEQ ID NO: 4219 - DNA, 438 bp, Triticum aestivum
  Clone ID: LIB3281-010-P1-K1-A10
cggacgcgtgggttgtgtgcctgaaggtgagaccgctgatcatgctccaattgttccatgtggccttgttgcttggagtttgttcaacgacacatatacagtccgggtcaatggagtggttactcaagtgaataaaaaggacatagcttggaagagtgacaagaacaataaattcggcaagaatatctatcccagtaactttcaaaagggaaggcttataggtggtgctacgcttaatgagagcataccattaagtgagcaagaagatctcattgtttggatgagaactgctgccctcccaactttcaagaagctgtatggcagaattgagaaagatatcaatgcaaatgataatgtaacagtggttatacagaacaactataacacatatagttttggaggatcaaaagcgttggtcctttctactgcatcttggat

SEQ ID NO: 4220 - DNA, 97 bp, Triticum aestivum
  Clone ID: LIB3281-010-P1-K1-A11
cggacgcgtgggctgactcgttgacggacgcatgggcggacacgttggcatacgcatgggcgcgcttgctgatcaccaatcagtgaattacacatat

SEQ ID NO: 4221 - DNA, 398 bp, Triticum aestivum
  Clone ID: LIB3281-010-P1-K1-A12
gaaacagacccgagacccaccgcaagtccgcaacccccggcgggatcgatttgcgctgggacctaccaacccgacccaacccagccgcggccggccgagcagacccatcccctccctccccgcttcctcctcccctccacctccacccacaccaccaccggctgctccctccccataactatcccagcccactcgctgtcactgggagcagatcgatccgggtggccggctcagattggcgttcttcaatctcgctctaccgccgcctcgctgcgctccaatccgtgccgccgccgcgtttcttggttcggcggctgcttggctgggacggggggaggcaggggatgaaggggctgggcggcgggccgtaggtgctgctggtgcacttcttgttcaac

SEQ ID NO: 4222 - DNA, 300 bp, Triticum aestivum
  Clone ID: LIB3281-010-P1-K1-A2
ggaatggcggacgtcgagtaccgctgcttcgtcggcggcctcgcctgggccaccgacgaccagtgcctccagaacgccttctccaagtacggcgacgtcatcgactccaagatcatcactgacagggagacgggccgatcccgcgggttcgggttcgtcaccttcgcgtcggacgaggcgatgcgccaggcgatcgaggccatgaacggccaggacctggacggccgcaacatcaccgtcaacgaggcgcagtcccgtcgctccggcggaggaggcagcagcggcttcttgggcggcggt

SEQ ID NO: 4223 - DNA, 275 bp, Triticum aestivum
  Clone ID: LIB3281-010-P1-K1-A3
ggggaaaaatttaatttttcctaaaaattgttttttttttgcttaccctgaatttgattttttaaaaaaaaattgggggtcccaccccaaccccataccggattaaagtatcattattaataacccgttattggccaatcccctttaaaagtttgttacttttttttgaaaaaaaaaaaaccctttttttgcccttgtttgtatttacttttcaaaaaacacaccaaataaaggggggcccccaaagggggttaaaaacaaaaaaaacccatttt

SEQ ID NO: 4224 - DNA, 384 bp, Triticum aestivum
  Clone ID: LIB3281-010-P1-K1-A4
cggacgcgtgggcggacgcgtgggcccacccgtccgtccgcgccctcgagcccaaccgacgcggcggtccagatccagatccggcgtcggcggcggccatgaacccgtcgcggtccgccccggcgtcgttccgggaccgcaccaacgagttccgctccgccgtcgagagcgcacgccgtcacgttgtacccttcccggccgtcgtgttggccagcggcagcgccgggccccttgacgactcgcgcttcgccgcgttggcgcacttcgagtttaaccggcgcgcctataagatcgggcttgggatccaccagaccttccagaagctttgccggcttgccaaattggcaaagaagacatttgtttttggtgaccctaccttagaga

SEQ ID NO: 4225 - DNA, 384 bp, Triticum aestivum
  Clone ID: LIB3281-010-P1-K1-A5
cccacgcgtccgcgcagccgccgccatgtcgaagcgagggaggggaggctccgcggggaacaagttccggatgtcgctggggctgcctgtggcggcgacggtgaactgcgccgacaacacgggcgccaagaacctctacatcatctccgtgaagggcatcaagggccgcctcaatcgcctcccgtccgcctgcgtcggcgacatggtcatggccaccgtcaagaagggcaagcccgacctccgcaagaaggtcatgcccgccgtcatcatccgccagcgcaagccgtggcgccgcaaggacggcgtcttcatgtacttcgaagacaatgctggagtgatcgtaaatcccaagggtgagatgaaaggatctgctatcactggacc

SEQ ID NO: 4226 - DNA, 393 bp, Triticum aestivum
  Clone ID: LIB3281-010-P1-K1-A6
cggacgcgtgggcatggcgtccgatggcaagagcaagatccttgtgatcggcgcgacggggtacatcggcaggcacgtcgtcgcggccagcgcgcggctcggccaccccaccctggcgctcgtccgggacgccgccccctccgacccggccaaggcgcagctgctcaagaccttccaggactcgggcgtcacgctcctcacgggcgacctctacgaccacggcagcctggtgagcgccgtcaaggcggccgacgtcgtcatctccacgctgggctcgatgcagatcgccgaccagaccaagctcatcgccgccatcaaggaggccggcaacgtgaagaggttcttcccgtcggagttcgggctggacgtggaccgcaccggcgccgtggagcc

SEQ ID NO: 4227 - DNA, 374 bp, Triticum aestivum
  Clone ID: LIB3281-010-P1-K1-A7
actccgtccactccaccgctgtgtgctcctgatcgccaccaccagtccaccagcactatgcagcccggcagcgccaacggtcccgctgcctccgtcgccgcctcgttgcaaatggcgcctgcggacgcgtcggcgtcggcgtcggagtgggacaacgactggggccgcccggccttcctcaacgtgtttctgcccaccagcgtcccagttccggcgacggcggtccgcgcgaccaccccagagcgggagcgtcggacgacccgcccggccttcatcaacgtgttcatgcccccggctccccctctcccgaagatgaccatggccgacctgcagcgacgcttgcaggacccctcggtcgagatcatcacgcaccc

SEQ ID NO: 4228 - DNA, 443 bp, Triticum aestivum
  Clone ID: LIB3281-010-P1-K1-A8
ctttggattggtctgaaggccacaattggacagtggagaaagatttgcctgccaacaggctgattgagttcaagttcttgctgcaagattccctggggaagttccactggcagaatggacctaacagaaccctacagacaggtgaaaccacaaagacattggtggtctacgaggattggggtaatgcgaagaatcagaaagtagcagaggaggggccgccggagcgccgctggttttctttcttctcgcccaagccgccgccgacacaccaaaccggcagctgcttggtcgccggggccgaccctagaataaattacgaagcagcgccacggtctccaggtagtagcagctcccctcgagccacatctctcccgcgtgctgttggttcggtggattggatcggcatggagaaggaagcgacgacgccgcggccggtgtgcgcg

SEQ ID NO: 4229 - DNA, 437 bp, Triticum aestivum
  Clone ID: LIB3281-010-P1-K1-A9
agcaaagataaggccctgctggtcagggcggatgccctccttgtccttgatcttggccttgacattgtcaatggtgtcagaactctcaacccgagtgacgtatgcatgcatgcatgcatgtgtgtaccatgctgcggccgaaatcagtgttttgaccctttttggaaaagctcagcacaaaatgaaccatgttggaataagagacgagtggatgccggaggctcctcagcgatcgcggttctcagccgttggatcgggccgcttgatgcgttttcgtccgttggatcaacatctggaggaatctgcgccgtcggatcaaaatcggatcgaaaaaatctattgctggcgcctccccccgctcgtttttacttcgtttttaccgttctaaagtcgctgatgtgtgggtccgttcgcgggtgggccttcgttgtcagcga

SEQ ID NO: 4230 - DNA, 385 bp, Triticum aestivum
  Clone ID: LIB3281-010-P1-K1-B10
gtttttatgcttgtttgtagattgctgtcgagttcatcaatttaggggttagactattgaaatgatctatatccagaaggcatatatgtgtgtgtgtgatgttgtgggtctgattgcacatggattaaatcttacatatgtgcaaactgcaaaggacttgtatatgtgtttattttgcagatatgacaccactcaattacctatctgttcggtttcatttccgaggtgaattgcatcatgatgaaagtgaatggaagtatttgaatggaaggtcaggaatgtccacaattgagtgtgacaaaatgtgtctacaatagttgaagaaacaccttgcagatcatgtttcctattctgatgaagtactaaatgtgacaactttgtactg

SEQ ID NO: 4231 - DNA, 431 bp, Triticum aestivum
  Clone ID: LIB3281-010-P1-K1-B11
ggacagcacatctgaactgaacaacagagagcgcccctgttgagagtcgagcgagagaagcacgtcccggcccgatccccaatcttccccggcggcgatgccggctggaggagagaagggagaggagcacggaggagctatgtatatattaagtctaagttgagtcttacccctgtggcgtctggcgctatgccgaggtggagcgtaccgccgccgcgttcgagcagcggccggtggttagcggtggctgcagtcctggctgcgctggtgtgccagatgcttgtcaggagtgggttgccggtgactccacgaataagctcgtttggtccgctgatctggaggaggtccttattttcctctgctttcaaggttaccatggtggtgaaggaggaagagaggaaagattgaaatccagttcgggttcgagctca

SEQ ID NO: 4232 - DNA, 449 bp, Triticum aestivum
  Clone ID: LIB3281-010-P1-K1-B3
ggcttgtctggtaacaaagttgagaaagtatgtgatctgagcagcattacactcaacaaaaatgccgtctttggtgacagcagtgcactggcacctggtggtgtgcgaattggtacacctgccatgacctcgagaggtttggtcgagaaggactttgtgaagattgctgagtaccttcatcaggctgtagtcatctgcttgaatgtccagaagcagcgaggtaagcgttacaatgatttcatcgttgacttggagaagaacgaggacatcgcggagctcagggcagaggtcgagaagtttgccattgcatttgagatgcctggcttccgggtgtcagacatgaaatacaaggattaggctgtggtaccatgcagatcgttttcttgtagcaacaaattggtgcccttaaggggctgattgctgtgctctattcgtgatgtatgattatg

SEQ ID NO: 4233 - DNA, 396 bp, Triticum aestivum
  Clone ID: LIB3281-010-P1-K1-B4
cggacgcgtgggcggacgcgtgggcggacgcgtgggcgagtctcctgaaagttgcaacctctccctctcggcgaatttggggtttctgaggcgcgcgaggtaaaccaaggttttgctcatggctcgtactaagcagaccgctcgtaagtccactggaggaaaggctccaaggaagcagctagccaccaaggctgcccgtaagtctgctcccactactggaggagtgaagaagcctcaccgttaccgccctggaactgttgctcttcgtgagatccgcaagtaccagaagagcacggagctgctcatcaggaagcttccattccagaggcttgttagggagattgcccaggacttcaagactgacctccgcttccagagccatgcggtgctggccct

SEQ ID NO: 4234 - DNA, 449 bp, Triticum aestivum
  unsure (1)...(449): unsure at all n locations
  Clone ID: LIB3281-010-P1-K1-B5
atcccgcagagcacgctccctccgtccctcgtttccccacccaccagcctagggttccggcgagatgaagcagcaggatggagctagcccggccaagatgttcatcggcgggctctccaggcagacaagcatgggtacgttcaaagagtacttctggaagtacggggagataatcgatgcggtaataatgaaggaccgccatacccaaaagcctagaggctttggatttattacctattcagatcctgctattgttgacagagtgattgaagataaccatgtcattgatggcaagcaggtacactccgtggttcctattactgctggaattatatcagttcacatgggagtgcatcgcttttccttgcattttttagtacacaagtcacatgttatgaagtntaagatccttgactatgccacagcaaaaaaaaagcagttctatcttt

SEQ ID NO: 4235 - DNA, 398 bp, Triticum aestivum
  Clone ID: LIB3281-010-P1-K1-B6
gtgccgcaactggctcaggacttggttcattgtttctgaagcgcctatcggtcgactatggagggaaatccaagctcgggttcaccatctatccttaaccacagattttgacggtcgatgtggagccatacaacagcgtgctctggacccactcggtgatcgagcacaccgaccgggtggtgcttctggacaacccggccatctacgacatctgcacgaggttcctggacatctagcgcccaacctacaccaacctgaaccgtgtgatataccaggtgatatcgtgcctgaccacgtctcttcggttcgacggcgacatcaacgtggaccttatcgggtttcagaccaacctggtgcccttccccaggattcacttcatgctcttctcctacgcgccc

SEQ ID NO: 4236 - DNA, 316 bp, Triticum aestivum
  Clone ID: LIB3281-010-P1-K1-B7
cggacgcgggggcgaaactagattttccctaatttagtcttgtacaaacatgctcgcatggcatttgcctggcttaagatcgaattagcgtgaccgtgcgtatgagtggacaaactctaactgggggaaatgtagggacagaagtgcgatgtgatctcattgataagtgcagaatgcatggttgatgttccaaaaagcaaaaagacgctggctgatattgagtgtgcaggcttacctacgcatgcatgcgggctcatatcttttctatagcgtgaactcgattgagtctactggctcggggtcaacaccagcttga

SEQ ID NO: 4237 - DNA, 356 bp, Triticum aestivum
  Clone ID: LIB3281-010-P1-K1-B8
cgtccggccttggctggtgacagagctgacataagggtttcatgcttacgtactcgtacttgcggcggatgagctcttttatggcggcacctaactgcaacctactggccggcgttttacaacacctggcctgacaaaaccagggctgtaccaaactgactctcctaggattgcattgtactttcatcaggttgtgttcatgtgaatgggtgtgcaccggccgcgcggtcagccatacgctcattctatatgtcacttggaacgcaccctggacctgcgcattatgcgcgcagaggttgggaggtacgcgctgggattccagtacactggctagcgccttagcgacctgtaattca

SEQ ID NO: 4238 - DNA, 354 bp, Triticum aestivum
  Clone ID: LIB3281-010-P1-K1-B9
cggacgcgtggggcctcctcctcctcctcccaccagtgagagtgagacttagaccagccggtggcctcgcccgttctccatggtgatcctgcgctctcacagggacacggagccggcggagatggctcagggcagcccggacctggctggtttccagttctacaagctcatggctgccggaatgtcctgggagaagctggtgctgcctgacaagttcgtgagcgagctcagcggccttgagctccggggcgtgaagctgcgggtcgacggcggaggggcgcgcgcgtcggacgtggaggtcgtcgccaacgagcacggcgacatgcacctcggcaggggctggaaggagttcgt

SEQ ID NO: 4239 - DNA, 265 bp, Triticum aestivum
  Clone ID: LIB3281-010-P1-K1-C1
gtcggcagcagcagcaccggcagcgcaaggattagagatctcttgctttgtgagggaagaggggggagggtggctgaaaagagggaggtagattggagtatcaccaccaccactcaagaaatggcggccgagactatcttcttcacctttgagtttgtgaacgagggccaccctgtcatgctctgtgactaggattaagtcactgtgcttgacgcgatgcctctctcaagtttctgtctgttaggctgcctttatgacaatcacc

SEQ ID NO: 4240 - DNA, 71 bp, Triticum aestivum
  Clone ID: LIB3281-010-P1-K1-C10
tggacgtcagggcaccgtaagacctgaaggagcctatccaacgagccagaaagagccgggcggccattcta

SEQ ID NO: 4241 - DNA, 186 bp, Triticum aestivum
  unsure (1)...(186): unsure at all n locations
  Clone ID: LIB3281-010-P1-K1-C2
ccggnnccggaaacccggggcgacccacgcgaccgggcaagaaaaagagcaacgaggaggaggacaagaagaaacgcgaagccgacgccaacggggagggcgagaacaacaaaaaggagaacgaaacgggaaggaagggcaacagagcacccaaccaggaaaacaagaaaagaggaaaaaaaagca

SEQ ID NO: 4242 - DNA, 442 bp, Triticum aestivum
  unsure (1)...(442): unsure at all n locations
  Clone ID: LIB3281-010-P1-K1-C5
aaaaaaaaaacgnaaaaaaaaaacaaacaaaaaaaaagaaaacaaaaaaacaaaaaaaaaaaaaaacaaacacaaaaaaaaaagaaaaaaaaaagaacaaaaaaaaaaaaaaaaaaaaaaaaaaaagaaaaaaaaaaaaaaaaaaaaaaaagaaaaaaaaaaaaaaaaaaaaaaaaaaaaaaaaaaaaaaaaaacacaaaaaaaaaaaaaaaaacaaacaaaaaaaaaaaagcaaaaacaaaaaaaaaaacaaaaaaaaaaaaaaaacaccaaaacaaaaaaaaaacaaaaaaaaaaaaaaagaaaaaaaaaaaaaaacagaaaaaaaaaagagaaaaaaaaaaaccaaaaaaaaaaaaaaaaaaccaaaaaaaaaaaacaacaaaagaaaaaaaaaaaaaaaaaaaaaaacacaaacacaaaaaaaaaaaaaaaaacaaaa

SEQ ID NO: 4243 - DNA, 255 bp, Triticum aestivum
  Clone ID: LIB3281-010-P1-K1-C6
ggtagagccatccagccgagcagagcagaggagagcagatccagccagctgcaaggagatctcttgtactggtaccggcgctggcacttgactggagccagtagagtagtacagtacagtacgctcttccccttctccctccctccttagtccgtccagttacagagagagcagagcagatcggagcggagcagagctgttgctcaccagtagcagagatcccaagcaagcaaggtaaggcagaggatgaaggag

SEQ ID NO: 4244 - DNA, 209 bp, Triticum aestivum
  Clone ID: LIB3281-010-P1-K1-C7
agcgcgcgtgctcgcataaaactaaggctgccatctactaagggagccaaggggctatggacatgcattcggacactgctattaccatctccaggcacagggactatggactaaaccatttctgtttcaaatgagcttattaacgaattattaggcggagctactttgtcgcatgtgatgcatgtcggtgataatgctacacttagatc

SEQ ID NO: 4245 - DNA, 452 bp, Triticum aestivum
  Clone ID: LIB3281-010-P1-K1-D10
cggacgcgtgggtccgtttacagccaagatgcagtgagaaaattgatgcagaatcgggggagccatcatatactacacgtttgttggtgtcgacatcacggatagggtgcctgatcggcaaaggtggttcaatcattacggagatacgaagaacatcgagagcaaccatacgaatcatttcgaaggaggatgttccaaaagtagcatcggacgacgaagagatggtccagatcagcggagatcttgatgttgcaaggcatgctcttgtgcaaataactacaaggctgaaagccaacttctttgaaagagaaggtgctttatcaggttttccacctgtgatcccatatcaccctttgcctgctagtgtgtccgatgagccaaagtatctaagcagagacaataagtctgctgggcacgattatccatattctagtggatatcatgcattaaac

SEQ ID NO: 4246 - DNA, 426 bp, Triticum aestivum
  Clone ID: LIB3281-010-P1-K1-D11
ggagcatcgcaggaagtatgacaggctgaggaaagagagggcggagaagaaagctgagcgtgacaggcttcgtcgccgtgctgaggcacaggctgcttatgagaaggccaagaggaaggagcaatcatcaagccgctcttcaggaggcatgcctggtggaatgcccggtggcttcccattcccaggaggcatgggtggaatgcctggtggcttccctggagggatgcctggtggtttccctggaggtatgggtggtatgcctggaggaatggggggtggcttccctggaagaatgggtggaggtatgcccgcaggaatggggggcggtatgcccgcaggaatgggaggcggtatgcctggaatggggggtggtagaggaatgggaggtggtatgcctggagctgggggtgctcccggtatgttgtt

SEQ ID NO: 4247 - DNA, 244 bp, Triticum aestivum
  Clone ID: LIB3281-010-P1-K1-D12
cgcgccccgccggcaaaccctaacagtcctgaagcagacggagagctggaatgcggtgggagacatgctatgcgtacccgctcaggtacaccctgtttattagaaggccaaggggaaggagcaagtgttcaagctcgggttcgggaggcatgcctgttggaatgcccggtggcttctccattcccatgaggcatgtatggaaatgcctggttgtttatctggagggatgcctgttggttaccct

SEQ ID NO: 4248 - DNA, 397 bp, Triticum aestivum
  Clone ID: LIB3281-010-P1-K1-D2
gtgattttcatttgtccagttaatttatttctggttgcaagaggtatgttacttagttccagcgcacattagatacgagttggaagaattgttataaaataatataaccatggcttgcatatgtccatctttgcgtaagtgtcaagcaagggaaaaagtagtgcctaaactcccaagtcaattgcttccttactgtaacaggatctgggacaaaattttggagaacgttctttttttgcacctgcttctcgcctcctatgtttgccatagatttgtgcattttttgtcaataacaatgatgctaagccctaagcaaatgtttctttcatttgtgttggttcttgttgcacgattatcattttctcctgcttctgaaacagcctcggtgcccgatgcg

SEQ ID NO: 4249 - DNA, 434 bp, Triticum aestivum
  unsure (1)...(434): unsure at all n locations
  Clone ID: LIB3281-010-P1-K1-D3
cggacgcgtgggcgacacctccagcgcgtcgctgcctcctgccacgccccaccctgcctcaccgcgcgccgctggccgccgccgcccacctcgctggcgcgcctacccctaccccgagtgcccccacacccgcagccttccactgccggcgacccgtggcctgccaccgccgacgacgaggaactgtcggatctcgatgaatccggtgaggacggcgcgtaggcagcgaatctggaaggaaggcggccggggcttgaagcacgacggctggacggcacaccatggcattggggggaggggggcgtncgatgctccgcccgtttgggtccgggcgaggagctcacccccaaagaactcctcgggcgtcctgcgggcccaggccggaggcggcagttcccagcgcgggggccgacaggaaggtgccgattcggatc

SEQ ID NO: 4250 - DNA, 444 bp, Triticum aestivum
  unsure (1)...(444): unsure at all n locations
  Clone ID: LIB3281-010-P1-K1-D5
cccacgcgtccgcggacgcgtgggctggagaaggcggcggcggccgagaaggagagggtggtcaaggccgcggccgagaaggagaagcgggagagctcggtggtgacggaggggcgggttgcagggagctcggcggagaaggatgccagcacggaggtggagaagaaggagggcaaggcgaacaaaccaaatgctggcaatggtcttgatatggagaagtattcctggactcagcagttaccagaggttaatgtcaatgtccctgttcctgaaggaacaaagtcaaggtttgttgtctgtgagattaagaaggatcatctgaaggttgggttgaagggccagcctccgatcattgatggtgagcttcacaaaccagntaaagttgatgactgcttctggagcatagaggatgggaaagcactgtctatactactgacaaagcac

SEQ ID NO: 4251 - DNA, 413 bp, Triticum aestivum
  Clone ID: LIB3281-010-P1-K1-D6
accagctctgctcgtcttttctttcttctccggctcaccttttggcctttctcttttctttttcaagtttagccatcttaccagggccgctagctgctgtgcatctcgatctgttttagtcgatccagatctgcatccgagcaagcaagcttctccatttttctttggcttttgatacacacatacatacattctacatctctccgcctgtttttgttgggtggagcttgatttcctttgcattctagtttagttcttcagctctcgacgtttactcgaaataaccagccgactccgctcagatcagccgcttgtttcggcgccagatttgcaaagactgactcacagatggagtgtggtttgaaatccctgagcagcagctcctcccccgcagcatcgccttctctgatgat

SEQ ID NO: 4252 - DNA, 420 bp, Triticum aestivum
  Clone ID: LIB3281-010-P1-K1-D7
cccacgcgtccgagcaactccctcggcggcggcggcagggacgacgccgccaaggggaggaccaggccgccgctgctgcccaagtcgccatccacgtcctcggccggtgcgggcgcgtccgggcggacggccaaggcgagcgcgtccgggtcccggaggcttctccgtacgccgtcgctcccggcgccccgcatcgggatggacccctcgtcgcccaaggacaacgagctgatagtggaggaggacgctggcggcggcgatcagcaggaggccgaggtggaggacgacgacatgaactggagcaagatttacgagggcgtcctgcgcaccaggatcgccgaggaaggccgcggctcgtcggcgctcaaccgggcgccgtccatgccggtcacgttgtccgcaaccatgggtgacggcaac

SEQ ID NO: 4253 - DNA, 415 bp, Triticum aestivum
  Clone ID: LIB3281-010-P1-K1-D8
gttctccggagcgagagagatggcggcgaagggcgatgggccggcgatcggcatcgacctcggcacgacgtactcgtgcgtcggcgtgtggcagcacgacagggtcgaaatcattgccaatgaccagggcaaccgcaccacgccgtcgtacgtggccttcaccgactccgagcgcctcatcggcgacgctgccaagaaccaggtggcgatgaaccccatcaacaccgtcttcgatgccaagcgtctcattggccggagatttaccgattcaactgtccagagtgacattaagctgtggcccttcaaggttgttgctggacctggtgacaagcctatgattaatgtccagtacaagggtgaggagaaagcagttgcagctgaggagatatcctctatggtcctcatcaagatgcgt

SEQ ID NO: 4254 - DNA, 425 bp, Triticum aestivum
  Clone ID: LIB3281-010-P1-K1-D9
ctttgggctgaggcaatggcggcgctcgctccgacgaagatgctcggcacccggctcaacttcgccggatcctccaggtatgccacagcggcaccaactgctggcgcacagaagatcgtctccctctttgatcgcttcaagaagaagcccgccccgaagccgaagcccgcacccgttgccacctcgagcgtaggcatcgacgacgagctcgccaagtggtacggccctgacaggaggatctacttgcccaacggtctccttgaccggtcggaggtgccggagtacctcaacggagaggttcccggagactacggctatgatccttttggtctgggcaagaagccagaggacttcgccaagtaccaggcctttgagctcatccatgccaggtgggccatgctcggcgccgccggattcatcatccc

SEQ ID NO: 4255 - DNA, 202 bp, Triticum aestivum
  Clone ID: LIB3281-010-P1-K1-E1
cgacccacgcgtaccctacacttgatctgaagcaatcgcttctcttgacccaaacatacatactcgcacacgggtggggttatctttcctattgcgtaacctaaattcatatacatccctcgaccttctacaacttcccgactgttaatacctattccttaccgaacttaataaactcttaaaacatcttcctttccccatt

SEQ ID NO: 4256 - DNA, 199 bp, Triticum aestivum
  Clone ID: LIB3281-010-P1-K1-E10
cccacgcgtgcgcgcactcacagacaatctgcacagacaaaacagaatcctaggagggggaaccttcatatactagacgtcacccaccaatgaaaggacgaagtgggggtgtggccgcaaaaggtggtgcaaatactactgcaagaccagaaacatctggagcaaccacacgaagtatctcgaaggagggggtaccaaa

SEQ ID NO: 4257 - DNA, 413 bp, Triticum aestivum
  unsure (1)...(413): unsure at all n locations
  Clone ID: LIB3281-010-P1-K1-E11
cccacgcgtccgtgtccttccccgtcccattccctccgcttcccagtccgcagcagttgcgcaccgacaccctcaccctccccaaagccctaaccgctcgcccgctccgccgccatgaggtccaaggccaacggagacaccgcgttcaaggcctccggcaagaacaagacggccaccggcggcgtcgccaagccgaagcgcgcccccacccccttcttcgccttcctggctgagttcaggccacagtacatggagaagcaccccgaggcaaagggcgtcgcggccgtcaccaaggcggctggggagaagtggcgcancatgtcggatgaggagaaggcaaagtatggcggcaagaaggcagatgccccagcaagcaaggcggtgaacacgaaggagagcaccagctccaagaa

SEQ ID NO: 4258 - DNA, 244 bp, Triticum aestivum
  Clone ID: LIB3281-010-P1-K1-E12
gaagaagcgtgtcgaggccatgatcgaggaccttgagccgtttgaggggcaggccttgctggacgccaagtgcttcaagtaagcgaacagtgcctggtatcgtgatggcggtggcaaagaaactatctaggacttgaaattcagtgtcggaacagctggtctttttttggaagagtttgcttgttacttaatggctatttgacctggtgaactaagacaaggtcggcaaggagatacaaggaag

SEQ ID NO: 4259 - DNA, 416 bp, Triticum aestivum
  unsure (1)...(416): unsure at all n locations
  Clone ID: LIB3281-010-P1-K1-E2
cgcggctcccccggccccgccaggaaggacctccgtgtcgccatgaagcaggtgctcgacctcttccaggacaactacccggagctcgtcgccaggaacatcctgatcaacgtgccgttctcctactacgccttcaccaccgtcttcttcccgttcctgacgcagcggaccaagagcaagctggtggtggcccgcccgtccaaggtcaccgagacgctgctcaagtacatccccatcgaggccatcccggtgaagtacggcgggctgaagcgcgacggcgacgccgagttcaccggcgagcacgacgccgagatcgccgaggtggtcgtcaaggcgggcgccaccgaggccatcgagatcgaggccgncgagggcgacacgacgcttacgtgggacgtgacggtgcttgggtggga

SEQ ID NO: 4260 - DNA, 106 bp, Triticum aestivum
  Clone ID: LIB3281-010-P1-K1-E3
ctaacgcctgggtgctgaagccgctgaaactatcctaaggcgctagattcagtgtggggcatctgggttctaagagagcgactggattgttcctgagtgactgtcc

SEQ ID NO: 4261 - DNA, 432 bp, Triticum aestivum
  unsure (1)...(432): unsure at all n locations
  Clone ID: LIB3281-010-P1-K1-E4
ccgcatctccggcgaccaccgaccacccccggccaccgctactccttccctctcctgtgatggcgcctcgcgccggcggtcagacctacggcttcccgatctactgcgcctcctggctcccactcgcacacatcatcaagccctccccatccgccgacgacgtcgtggatgcggacgcgtccccggccccgtcctccccacctccgccccccatggtggttcttggtggaggcggaggcgagggccggagcggcgtgcccaacgcgctggtcgtcgccgccctcgaccccgccgctgcaggggcgcctccagcgctctcccccgagcccgtgtttaggctggggacagaggagcaggtaccatacaggatggccgtacacccccgcggcgatggcgtnctctgcgccttccccaacggcttgaggttggtgc

SEQ ID NO: 4262 - DNA, 428 bp, Triticum aestivum
  Clone ID: LIB3281-010-P1-K1-E5
cggacgcgtgggcgagtagccgtcccaatcctcgatctgttctcaacctcccctccgtgcgtcgcagctccagatttccttccccatggctccgatcaagatcggcatcaatggtttcggccggatcggcaggcttgtggccagggttgcgctccagagccccgatgtcgagctcgtcgccgtcaacgaccccttcatcaccaccgactacatgacctacatgttcaagtatgacactgtccatggacagtggaagcaccatgaagttaaggtgaaggactccaagacccttctcttcggccagaaggaggtagctgtgtttggctgcaggaaccctgaggagatcccatgggctgctgctggggctgagtacgttgttgagtccaccggtgttttcactgaccagggacaggctgcagcttacatta

SEQ ID NO: 4263 - DNA, 406 bp, Triticum aestivum
  Clone ID: LIB3281-010-P1-K1-E7
cggacgcgtgggccgtgccctccaccatcccgccgccgccgccgcccccaaccatcccaccgccgctgtcgcacccgccatcccgtcgccgcggacagccctccaccccgaccattgccgcagtcgcccctaactacccaacagcagcactggcagcaccccactaacccggaccaccactgtcgccgagccactcaaccggcgactaccctcctcgaatgccttccctcgccaccactctacttcgcgagattcctcccccgagcaggcttcctccctaagacgatggagccagtagttcttcggatgagatgggtgctgatttaatccttctgaaccccaatgaggctgatagcctaaataaatctttgctccagaaagctttacgaagtgaattcattactac

SEQ ID NO: 4264 - DNA, 250 bp, Triticum aestivum
  Clone ID: LIB3281-010-P1-K1-E8
cccacgcgttcgcggacgcgtgggcggacgcgtgggggagaacatcaacaacgggctggagctgttgatgaagagcggcatgtacacgctcggctacaagaccgtccttaagactctgcgcagttgcaagggtaagctgatcattctcgttaacaactgctctttccttaggaagacagatattgagtactaagctatgttggcgaaaattagcgtgcactacttttacggatacaatgtttattttgga

SEQ ID NO: 4265 - DNA, 411 bp, Triticum aestivum
  Clone ID: LIB3281-010-P1-K1-E9
cccacgcgtccgcggacgcgtgggcagcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcaactgcaactgagccggcgcccaagaggccggccggcaaaggcgagcaccaggatgaggaggacaagcaagcaagcacca

SEQ ID NO: 4266 - DNA, 454 bp, Triticum aestivum
  unsure (1)...(454): unsure at all n locations
  Clone ID: LIB3281-010-P1-K1-F10
atcccgcagagcacgctccctccgcccctcgtttccccacccaccagcctagggttccggcgagatgaagcagcaggatggagctagcccggccaagatgttcatcggcgggctctccaggcagacaagcatgggtacgttcaaagagtacttcgggaagtacggggagataatcgatgcggtaataatgaaggaccgccatacccaaaagcctagaggctttggatttattacctattcagatcctgctattgttgacagagtgattgaagataaccatgtcattgatggcaagcaggtacactccgtggttcctattactgctggaattatatcagttcacatgggagttcatcgcttttccttgcattttttagtacacangtcacatgttatgaagtttaagatccttgactatgccacagcaaaaaaaaagcagttctatctttaatgg

SEQ ID NO: 4267 - DNA, 239 bp, Triticum aestivum
  Clone ID: LIB3281-010-P1-K1-F11
atccaggagagcacgctctctcctctcttcgtttacccaaccactacactaaggttcgggcgatatgaacaaggaggaaggatactagcctgtccaagatgtttatatgtgggatttccactcagaccagaatggccacgctcaaagagaactttggaacgtgcgctgagatatttgctgccgtaataatgaaataccgccataccaaaaagacctaaggctcaagattcattacctat

SEQ ID NO: 4268 - DNA, 348 bp, Triticum aestivum
  unsure (1)...(348): unsure at all n locations
  Clone ID: LIB3281-010-P1-K1-F12
aatcaatcccacctactccacctctcgccggagccccagcaaggagcaagcaaggaagatggacgccggcaagctgaagaaggtggccgggaagaagttcggcgggccgaggaagaagtcggtgaccaggtccgtcaaggccgggctccagttccccgtcggccgcatcggtcgcttcctcaagaagggccgctacgcccagcgcgtcggctccggcgcccccgtctacctcgccgncgtcctcgagtacctcgcagccgaggtgctggagctgggccggaacgccgccaaggacaacatgaagagccgcatcgtgcccaggcacctgctgctggccattcgcaacga

SEQ ID NO: 4269 - DNA, 439 bp, Triticum aestivum
  Clone ID: LIB3281-010-P1-K1-F2
ggaaagttcatggttcatcggccagttattaggaaagccatcaacaacaccttctaccagttcatctatgaaactgaaaagcacaatggaattgcagagctgttggagatcttagggagcatcatcaacgggtttgcgttgccacttaaggaagaacacaaattgttccttatccgggccttgattccacttcacaagccaaagtgcattgcaatgtatcatcaacagttgtcttactgcattacccagtttgtcgaaaaagattgcaaactctcagacacagttatcaggggcctactgaaatattggcccatcacaaacagcaccaaagaggtgatgtttttgggagagttagaagagatactagaagctacacagcccgcggagtttcagaaatgcatggttcctcttttccgccagattgcacgttgtctgaaca

SEQ ID NO: 4270 - DNA, 417 bp, Triticum aestivum
  unsure (1)...(417): unsure at all n locations
  Clone ID: LIB3281-010-P1-K1-F3
ctcacatacgatctttacacctcatataacgacccatatggaaggtcaacttcagaacaacgcggaggaaattattcagatggtcgtgcaaggggctagccatggagctcgtcaagtgcctcagcgagaccgactgcgtcaaggtgcagaagaggccgtacaaggagtgcgccggggagaaggcgcccaacatcaccagcgagtgcgtcggcctgcgggagacctacttcaactgcaaaaggggccaggttgacatgcgagcccggatacgtgggaacaaggggtattgatggtgtgcatgtgaactcccttatccagctgaaacttgttagccgaattgtcactacaagacatcttgcgttctatatatgctnttgatctccaatagaatcatatgtattttttttcctcgcgata

SEQ ID NO: 4271 - DNA, 55 bp, Triticum aestivum
  Clone ID: LIB3281-010-P1-K1-F4
caaacgtacgagctttacagctcataaaataacccatatggtaactgaaccttat

SEQ ID NO: 4272 - DNA, 407 bp, Triticum aestivum
  Clone ID: LIB3281-010-P1-K1-F5
cccacgcgtccggccaccaagaatttcaccaaatacaatgctgcacttagctacactaaccaggatcttattgcatccctgaacctgaacaacaagggagacagcctgaccgcatcctattaccacattgtggagaaatccggcacagctgtcggggcagagctgacccacagcttctcgagcaacgagaacagcctcaccttcggcacccagcataccctggacccgctcacccttgtgaaggcccgcatcaacaactctggcaaggccagcgcgctgatccagcacgagttcaggccaaagtcgctgtgcaccatctcggcggaggtggacaccaaggccatcgagaagagctcgaaggtcggaatcgcgattgctctcaagccttaatggcgaagtcaagcccc

SEQ ID NO: 4273 - DNA, 389 bp, Triticum aestivum
  unsure (1)...(389): unsure at all n locations
  Clone ID: LIB3281-010-P1-K1-F6
gagagatatattctagtaaggaagacaaaagtgggtggcgcggttaagaaactgacgaaaatgatggccattgcgccttgcgctcagttacacgagcaagatttgctgcggccggactaattgtacaggtccggttagcgtctcctccggcgcggaagcaactaggactaccactccttctgtgagtgggatactcccggcagggctgaggacaactgtcgggacctcagtactcgagccgtgatgatggggatttcactgatgccgatgagagacgcccactcggatgatgtggagcaccagctgctttcagcacaagctgcgcancatgatcgcacactggtcctgcgttttataagagcccctccgccgcgcagcagctgtatata

SEQ ID NO: 4274 - DNA, 324 bp, Triticum aestivum
  Clone ID: LIB3281-010-P1-K1-F7
cactccccaaccccacgctcccctgccctaaaatccctaaagagctccacttttcccccttcccccggatccccccccagcgatggcggcgaaagtagccggcggcgccgcatctctcccggcggcgcaagaggcgagcctcgcgaggcattacaccgcgatggatatcagcggtggcgagatgggggaggaggcggaggtctcatccttcaccacgcgcttcgcgtcgctgcgcgttcgggaggaccggctggccaagatcgctgctagcctgcgcctgatcaaggagaagcgcggctcccggccccccacctacatcgagct

SEQ ID NO: 4275 - DNA, 351 bp, Triticum aestivum
  unsure (1)...(351): unsure at all n locations
  Clone ID: LIB3281-010-P1-K1-F8
cggacgcgtgggcggacgcgtgggtttttttttttttttttttttttttttttttttttttttttnaaaaaacggggcagggaacggctgaacgcaaggggtacaagatacacttttcacttttgagcagcagtacgcaggaagccaagagcattctgtaaataccgaacatcaacaggtacaggacaattttcaaacaaaactgaaaactattttctttctgacatgatactgaagactatttaccggctctacacaggttttggcgggggcagaggccaccatcctgtttacccactggcaacaaatctatggattttgtggctgactttggggtcattagaccttacc

SEQ ID NO: 4276 - DNA, 401 bp, Triticum aestivum
  Clone ID: LIB3281-010-P1-K1-F9
ggaaaggcgtcttcgtactcgcctctctccgcgcaaccgagccttccgcccacctcctccccatttcgccagcggcgcacccaccaaccacccccacccgccgccatgagggagtgcatctcgatccacatcggccaggccggcatccaggtcgggaacgcgtgctgggagctgtactgcctcgagcatggcattcagcctgatggccagatgcccggtgacaagaccgttgggggaggtgatgatgctttcaacaccttcttcagcgagactggggctgggaagcacgtcccccgtgctgtcttcgtagatctcgagcccactgtgattgatgaggtgaggactggcgcttaccgccagctcttccaccctgagcagcttatcagtggcaaggaggatgc

SEQ ID NO: 4277 - DNA, 143 bp, Triticum aestivum
  Clone ID: LIB3281-010-P1-K1-G12
gtcttttttaacggcggaggcgaacggctaaccctagactaacgcagtacggctaggccgaaactgcgttgaagcatagagctctgtcgttcatggcttggaggcactgtgtctatatgatatacctaacgcctctagaagag

SEQ ID NO: 4278 - DNA, 419 bp, Triticum aestivum
  unsure (1)...(419): unsure at all n locations
  Clone ID: LIB3281-010-P1-K1-G3
aaaaaaaaaaaaaagaagaaaagaaacaagagaaaaaaaaaaaaacaaaaagaaagagagaagaaaagagaaaaaaaaaaaaaaaaagaaaaaaacaacaaaaaaaaaaaagaaaaaaaaaaaaaaaaaaaaaaaaaaaaaaagaaaagaaaaaacgaaaaaaagaaaaagaacaagaaaaacaaaaagaaaaaaaaaaaaaaaaaagaagaaaaagaaaacaaaaaaagaaaaaaaaaaagcaacacaaaagaagagaagaaaaaaaaaaaagaaaaaacaagaaagaaagaaaaaaaaaaaaaaaaaaaaaaaaagagagaaagaaaaagacgaaaaagaaaaaaaaaaaaaaaagacaaaaaaaaaganaaaaagagaaagaaaaaaaacgaacaaaaaaaaaaaacgaaaaaaga

SEQ ID NO: 4279 - DNA, 386 bp, Triticum aestivum
  unsure (1)...(386): unsure at all n locations
  Clone ID: LIB3281-010-P1-K1-G6
aaaacaaacaaaaaaaaaacaaaaaaaaaaaaaaaaaacacaaaacaaaaaagaaaaaagaaaaagaaaaaaaaaaacaaaacgaaaaancaaaaaaagaaagaagagaaaggaaaaaaaaaaaaaaaaagaaaaaaaaaaaagaaaaaaaaaaaaaaaaaaaaaaaaaagaaaaaaagaaaaaaaaaaaaaaaaggaaaaaaaaagaaaaaagaaaaaaaaacaaaaaaaaaaaaaaagaaaaaaaaaaaaaaaaaaaaaagaaaaaaagaaacaaaaaagaaaaaaaagaaaaaaaaagaaaaaaagaaaaaaaaaaaaaaaaaaaaaaaaaaaaaaacaaaaagaaaaaaaaaaaaaagaagaaaaaaaaagaaaacaaaaaa

SEQ ID NO: 4280 - DNA, 115 bp, Triticum aestivum
  Clone ID: LIB3281-010-P1-K1-G7
ggttagactaggcgttcactaacaggaggttaactagaaactaaatggcgcacgttgaagcttttaaattatataaaactcttaaatatccaaggtaataatttgtttttgtttc

SEQ ID NO: 4281 - DNA, 378 bp, Triticum aestivum
  Clone ID: LIB3281-010-P1-K1-H1
cgtcgagccatgaagagagaatatgaagagttcaaagttcgtgttaatagccttgtagccaaggccgagaaagttcctgaggaaggatggatcatgcaagatggcacaccttggcctgggaacaataccagggaccatcctggaatgcttcaggttttccttggtcatagtggaggccttgatagtgacggcaatgagcttccccgtttggtttatgtgtctcgtgagaaacgtgctggattccagcaccacaagaaagctggtgccatgaatgcacttgttcgtgtatcagctgtccttactaatgggcagtacatgttgaatcttgattgtgatcactacatcaacaatagcagcgctctaagagaggctatgtgc

SEQ ID NO: 4282 - DNA, 350 bp, Triticum aestivum
  unsure (1)...(350): unsure at all n locations
  Clone ID: LIB3281-010-P1-K1-H10
cccacgcgtccggcgatcatggcggcgcgcgggcagggtctggagcaagatttcgatttcttcgtggtggtcgacttcgaggcgacgtgcgtcaaagacgggcggatctttccgcaggaaatcatcgagttccccgcggtgctcgtcgacggcgccaccggccgcatcgtgtccgcgtttcgcaggtacgttcgtcctaagcatcaccctgtgctgacccaattttgcagggagctcaccggcatccggcaggaggacgtcgacggcggcggtgaactcggcgacgcgctctggctgcacgattcttggctgaaggcngcgacngcgggagcagggacaagagaggcgtc

SEQ ID NO: 4283 - DNA, 153 bp, Triticum aestivum
  Clone ID: LIB3281-010-P1-K1-H11
gccgcaccaactgcgcagcaacacgcccgccgatgctcccctcccccccgctccgacttgttttctaaaccaaaaatctcgcctttctgtaaaactagatttccccttgctaattcgggtattataccggcggctaatcacactccacccggt

SEQ ID NO: 4284 - DNA, 449 bp, Triticum aestivum
  unsure (1)...(449): unsure at all n locations
  Clone ID: LIB3281-010-P1-K1-H12
gtctttcttctcggcggaggcgaacgacgaaccctagccgcgcgaggaacgccaagatccccaaggccggcgacgatggcggcggttcggtgcgcggcgaggaggctcggcggctctctgctccagcgaacgcaggcggcggtcgcggaggagggacgcctgctcgtgccaagcaggctcatgcgctcccgccagctctacaccaaggtctccggcgagcgatcgcaggtggcggagcgacacctcctcgagccaggcagcctcatgcgctcccgccagctctncggcgagcatgctcgcaacatccagaagaaagaggatgactgctgggcggtgttcaatgagacgctaaagaggttggacgagcttcaaaaaaagaagaaaccaagtgtttttcagcagcgcatgatatccatcgaccgtgcgttggagagtttggtctatggatc

SEQ ID NO: 4285 - DNA, 436 bp, Triticum aestivum
  unsure (1)...(436): unsure at all n locations
  Clone ID: LIB3281-010-P1-K1-H3
gtcgaatccagcgagcagatcaaagcgagcgatagcccccggagaattccccatcgggagaggccgagtcccaatcttccgcggcaatgtccaaggcgcagctgaaccagctgtgccagcagcggcggtggccggcgccggactacacccaccggagcgaggggccggcccactcgctgaggttccgcgccaccgtcaccgtcaacggcgaagtgtaccactcgccggacgacggcgacgggttcagcacggccaaggaggcgcagaacctcgccgccaaggccgccttcgagcgcctntnncgcctnccgcccccttccccggcggagtccgaaacccaacttccctacaagtctcagttgcaagtttatgctcagaagagacataaagatttgccttcatatgacaccattcgaagtggtccacttcatgcacc

SEQ ID NO: 4286 - DNA, 448 bp, Triticum aestivum
  Clone ID: LIB3281-010-P1-K1-H4
cggacgcgtgggttctaacagttggtctgaaatgatattatttgactaatccagtagaactagcccgatgctgccttcaagcatagcgcctgcgcgttgatgtcttgatgtgattgtgtccacatgagagcctcagagcctctagaagaggaaagagcttcatcatttcacattttgtttgacgccataaatttgatttttctctcagcagggagaaagccccttaggaaggtttgagtacgaggacagttttctacagcatttgttgcctccatggtcacaaaaggactacatggacagacagaggtgatgctccgaaacatcttgcaaaccaggcagtgcaatagctatggcatcaagggacacataaggaacaatttttaccaagcccatagaatttagatggtcagcggaaactaaaatgagtgcaaattatgagacccttttt

SEQ ID NO: 4287 - DNA, 339 bp, Triticum aestivum
  Clone ID: LIB3281-010-P1-K1-H5
cccacgcgtacgcccacgcgtccgcggactcgtggggtgcccgccgcggccctatcctagatgctacctgcccgtacgtatcttggtccacggccgaatatcgcaggtcgtacgtacactcactcgccatggtggccgggcgtgtcaaggcggccatgggcttccacagcagccccagggcgcccaaatcgtcggcgccggcggcgacggccccagccgaggggtatgcatacacgccggcccggggttccttgttagaaacgttatcgcccgccccgtgcggctcggactccaaggcgttggagatagtgcgggtctaggggcgcttactttccgggc

SEQ ID NO: 4288 - DNA, 241 bp, Triticum aestivum
  Clone ID: LIB3281-010-P1-K1-H6
acgcccacgcgttcgcccacgcgtgcgcggacgcgtggggtgcccgccgcggccctatcctagatccgacctgcccgaacgtatcttgttccacggccgaatatcgcaggtcgtacgtacactcactcgccatggtggccgggcgtgtcaaggcggacatgggctttcacagcagccccagggcgcccaattcgtcggccccggcgtgtactgccccagccgaggggtttgcatacacgcc

SEQ ID NO: 4289 - DNA, 209 bp, Triticum aestivum
  Clone ID: LIB3281-010-P1-K1-H7
gcctcccctccattccgttcccccctcgccttaatccacagccccgtccccgaccccgggtgtggcgccgatggggtacgtgctgtccgcggtggcgagggtgctggagcatccgacggcgtggggcgcggcctgcgagatggcgctgttcgcggggtcgatcttgacggcggccctcggcggcctgctgctcggatgggcctggaccc

SEQ ID NO: 4290 - DNA, 331 bp, Triticum aestivum
  Clone ID: LIB3281-010-P1-K1-H9
gcgcctccagtcgctcccagttcccctccgtccgcggcgcgccgctcccgacaggctgggtcgctgacgccgtcttcggctccgactaccgccagccgacgacgcccttcgacccatgacggcgtcgtcgtcgtcatcaaccgtttatttggccacgctcctaccaaatcggctatcagttgagcaatccaagtgaagcatatggttacatgagaaccgttacaggtaagctgtgagctggaacctatataagccctggatccttcttgcagtttcagggtgtgtagctgctataaaattcaagagcctgtgtcgtgtcttctccgagtgg

SEQ ID NO: 4291 - DNA, 400 bp, Triticum aestivum
  unsure (1)...(400): unsure at all n locations
  Clone ID: LIB3281-011-P1-K1-A11
gntccgcggccccgacccagcgctcccctcccccctctcgccccggcttgccgccggcgacgagctccagctcaggttgccctttcccacggccggcggaggaggacgcgggcggcagaggacatggagcccatgagcgtggaccagcagcggctgcggcggcctggacgcgcagatcgagcagctcttgcagtgccgcccgctcgccgagcaagaggttaaagcactatgtgagaaggctaaggagatattgatggaggaaagcaatgttcagccagtgaaaagcccagggacaatctgtggtgatattcacggacaattccatgattttgttgagcttttccggattggcgggaagtgtcctgatactaattatttgtttatgggggattatgtggat

SEQ ID NO: 4292 - DNA, 310 bp, Triticum aestivum
  Clone ID: LIB3281-011-P1-K1-A12
ctctgccagcagagtcctttcctagtccctaccacgccgtgcctgtagctctcggccatgtcgccgtccatggccgcggccgtgtcgtcgctccgcgccctcccactccacatactcgtgccactcgtggcctcggcgctcgccttcatcgtcgccgtcttccgacgcattcttcggcggcagcggccggtgtacctgctgaactacagctgccaccttccggacgcggaccggcagtgcaacctggaggtgtgcgagtacttcggcctccgctccaagcgctacaccgacgagaccgccgacttcatgc

SEQ ID NO: 4293 - DNA, 314 bp, Triticum aestivum
  Clone ID: LIB3281-011-P1-K1-A4
agaagacgccagagtcgcaagccgctgcagatctcctccgtcctccgcgctcagccctcccctttgtcctccatggagtgcgtccgctccggggctcttgatctggggcgctccgggaaattcttggggaagagcggctccacgacgtcatgtggtaaagtcagatgttctacaaaccttgctgggtctaccaaatgcgagcaaaacttgcatgggaaggttaaacccttgctgttgtcagcaagtggaaaagccaggggaacctctggtttggttcacagaagtccggtacctaaacatcagcaccatctttc

SEQ ID NO: 4294 - DNA, 368 bp, Triticum aestivum
  Clone ID: LIB3281-011-P1-K1-A5
cccacgcgtccgcggacgcgtggggccgcattccctccaactcatgttgttatactgagcaaaccaaacttattcgtctcgaaatctgcaccagatcgagctcagcaacgcgagccgagccggaggcgttcgtctgcccggggtggcgccatgcggatccgcctcttcctctgaaccgggcaagcgcgagccgccttcctcctcgtgctcgacggcggcgacgagcgtcggtggccgcatagcaaagtccagcaacgagcagggtttcatgtaggggagggcaacctgttcccagccctcgatttccaccggagcgtgcgaagtccagtcggcagcaacggcgacgccggtggaggcagccgcgggca

SEQ ID NO: 4295 - DNA, 349 bp, Triticum aestivum
  Clone ID: LIB3281-011-P1-K1-A6
gatccacttcatgctttcctcctatgccccagtgatctcagctgagaaggcttaccatgagcagctgtccgttgctgagatcaccaacagcgcctttgagccttcgtccatgatggccaagtgcgacccccgccacggcaagtacatggcctgctgtctcatgtaccgtggtgatgttgtgccaaaggacgtcaacgctgctgtggccaccatcaagaccaagcgcactattcagtttgttgactggtgccccactggcttcaagtgtggtatcaactaccagccaccaggtgtcgtcccaggcggtgaccttgccaaggtccagagggctgtgtgcatgatctccaac

SEQ ID NO: 4296 - DNA, 395 bp, Triticum aestivum
  Clone ID: LIB3281-011-P1-K1-A7
cccacgcgtccggctttacgccggtatcctcagcagcgtggtccgtcgatatcaatttcgaccatgcgaagacttaccaagaagtttccccaggacttgcagagcaacgtggatgaaagtaatcgatctccagtgaatacagctgcggctgttgctcctcctacaccttcatccggaacttctccctgcaagcagctagggaagaagtcatcacgggaaacgattgcaagtggacttttgctaattggaagcatcgtttgtctgtcgaaaggccgatctaacctcggcgcacagcttgccatggcattcttcctgaagaaggcctttaagcaggacaaagaaccaggctcttcgccaaggggaagaactgatgcgaggtgcccatgcagtagtag

SEQ ID NO: 4297 - DNA, 297 bp, Triticum aestivum
  Clone ID: LIB3281-011-P1-K1-A8
agctaatcaagctctcagctccttccgagctccacggtttccagcaagcaagccgaagcactagatcctcgatggctcgcgtggcactggtcgccgtgttcgccgtgctcgcggcactggcggtggcggacatggcgtccggggcggtgacctgcggcgacgtgacgtccgccgtcgcgccgtgcattttctacgcgtcggggaaggcgtcggcaccctcgggtgcgtgctgcagcggggtgaggaccctgaacgccaaggcgtccaccccggccgaccggaaggcggcgtgcaact

SEQ ID NO: 4298 - DNA, 387 bp, Triticum aestivum
  Clone ID: LIB3281-011-P1-K1-A9
aagaagacgtagagcaggaccaataagttcggagcaatgcaaaaggtggaggtgctgttcagaaaggaaaaaagcagaaaggtgtgagacaagcaagtgctcttgacaaagctttgagtatagaatctgctgaaggtttaagagataagacacccaagcaagcttctgctgtgcgagataaaaagagtggcaagaaggcattgtcaggagcatcagtggccaaaaaggaaggatcctcaaagcgatcgggccgtaccaatctgaaagaatattcagatgcggcggaggacagcacatcacaactccatgatacaagcgcgagtaaaaatgcagcttgagcaagagacatggcattaaggaatcgaagtcagcacaaaaactgtttcg

SEQ ID NO: 4299 - DNA, 177 bp, Triticum aestivum
  unsure (1)...(177): unsure at all n locations
  Clone ID: LIB3281-011-P1-K1-B10
gcgagggcacccccgaccccgcgacgaggaacagaacagagcgggaggcggcggcaggaaagccccccccccccccccaaaaccangggaaagagggcaccacgccgaccggccgggcggcccgacacacaacggccgccggcgccgggcagggaaaacaaacgacggacggacggg

SEQ ID NO: 4300 - DNA, 179 bp, Triticum aestivum
  Clone ID: LIB3281-011-P1-K1-B11
ggaaagccgggaagacaaaagcgcacgggcaaaccaagcacagacgtttcttaactcacctccctcccgcggggcaaaccaagccaaaggacacaagagaagaagccgcacccaaacgctccaccgacagccactaatggggagcaaacaccccaccaacaaaaccacaggcggaacgc

SEQ ID NO: 4301 - DNA, 258 bp, Triticum aestivum
  Clone ID: LIB3281-011-P1-K1-B12
cccacgcgcccgcggacgcgcgggagcgcattatttgaacaaaacggaacgtagaggaggggcaagccctacttgctggaagagagttggttcttcctcctaatgaagacagagatacctggataaaatttgctaaactttgctggaagagggggcggaggactcaaggaagaactacgcaagggcaaccgggaccgcgtgcggcggaagcgagcggagaggggggccagaacaacagacaccctgaagtagccgggg

SEQ ID NO: 4302 - DNA, 331 bp, Triticum aestivum
  Clone ID: LIB3281-011-P1-K1-B2
gccgcccagcgaattggacaagcccccgagctcgccggatccgatggccgtcacgttctttgacctccacaccgccgacgggcttaagggcctcgaggcgcacctcggcgggaagacctacatttccggcgatgggatcaccaaggacgacgtcaaggtgttcgcggcggtgctcgtgaagcccagcgccgagtttctgaacgctgcccgctggtacgacgccgtcgtcggggccgtttttttaaggtttcctggccaggcctatggggtgagtgcattcttgggttctggtggaggttgttctgttgtttttaaggatgaagatgatgac

SEQ ID NO: 4303 - DNA, 281 bp, Triticum aestivum
  Clone ID: LIB3281-011-P1-K1-B3
agaacatacccggggagagaaacacaaagtaaatcgtgctcaagcaaggcaatgtgcaattgggaagaaaaaggacatcacaaccgagggtccagctagctgtggagatcacaatgggaaagaacagataggtgcaacaagcagagagcatgcttcttcgaaacaaaaaagggcacaggaggctgcagatatccaagacgaaggtcgtgaaaagaaacagaaagcaaatgatggtcttataagcgactccataattggtcaatgcatggatggtagtacag

SEQ ID NO: 4304 - DNA, 408 bp, Triticum aestivum
  Clone ID: LIB3281-011-P1-K1-B6
cggccggaatcgcgggcgaccagcaccgcgacgcgacggcggtgcatatttttatactgacaccgcccgcgcggcgagggctgctgggggagcgcccggctgcgctgctaagaagacagaaacccgcaaaaattgctaaactttgctggaagagtggacgatagtcaggcaaatctacttagtcaaacttttacagttgacctgaacttctcctgagttgacactgtacatggacatcctcaagtagtcctggcttacctgaagtaccagtatgctgttggagatgagcttaaacgaaaggacgcattttctaggctacaggaactgtcagtgcagaatgcaacagccacaaataagtactctggaatgctagcaagccatggtgctataacaagtgctggagtacca

SEQ ID NO: 4305 - DNA, 180 bp, Triticum aestivum
  Clone ID: LIB3281-011-P1-K1-B8
gcgtcgaaaacacgcgcgttttttgtgccttatccccgccgctcaacccgcgcgcgcattactccaccaccatcctctccttttccccagatccaattgaaccgcgccgcgcgaggggccatcaggagcaggaaacgccggcagctggcgacggagacagcactatcacgctacaggacc

SEQ ID NO: 4306 - DNA, 209 bp, Triticum aestivum
  Clone ID: LIB3281-011-P1-K1-B9
ccacggtcgaaaaaaaaaaagagcttttttccctatctgtcttccggcggactattggtgtgggactcttatccccacgaaccccttcctcgcgcgcaccacccacagggcggtccggcgagctcggcgggcgcaacacgaccccagctccctaggtcggccaccttccctccgccagaatcgcgctcccgtctacacgaccccgggta

SEQ ID NO: 4307 - DNA, 408 bp, Triticum aestivum
  Clone ID: LIB3281-011-P1-K1-C11
cggacgcgtgggcggacgcgtgggggcaagtaactggaggttgcctgagtcttgcagcacgagaattgagccagcttgtaggctagggtatgggtttgtccatattatgctaccggtgttgtcagtgagggagagctgtggaccaatgctgaacacagacaacttcgtggccattacggtggagcctgaacccaggttcttggcataccacaccaccttctcctgtgcagggtcgggcgcctgggtgaggttgaagttgaaccagacagcaaggaggaactggctggggtcagagtcgagggcccggaagccgaaggcaaatccccccgacggggaggtgatgtagccaggggggctgagtgtcgatccggttgtgagcctctgcgctgcaagcagatgaggctggtg

SEQ ID NO: 4308 - DNA, 370 bp, Triticum aestivum
  Clone ID: LIB3281-011-P1-K1-C12
cgaggaggagttcgagaagtccggcaaggtccccgacccggagtccaccgacaaccccgagttcaagatcgtcctcaccatcatccgcgacgggctcaagaccgacgccagcaagtaccgcaagatgaaggagaggctcgtcggtgtctccgaggagaccaccaccggcgtcaagaggctctaccagatgcaggagtccggcaccctcctcttccccgccatcaacgtcaacgactccgtcaccaagagcaagtttgacaacctttacggttgccgtcactcgctccccgatggtctcatgagggccactgatgttatgatcgccggcaaggtcgccgtggtctgcggttatggtgatgttggcaagggc

SEQ ID NO: 4309 - DNA, 405 bp, Triticum aestivum
  Clone ID: LIB3281-011-P1-K1-C2
cggacgcgtgggcgcggatctctcctcacctgccgcgaatccacgaggcggagcgacccgccgcccgattatggagttcctgcaggggcagagcacggagaccacggtggccgtcgcggtcgccgtcgtcgccgtggccgccggcgccggattccttcttctccgcagcaagaaacccaagggctgcttggatgctgagaatttcaaagagtttaaactcgtgcagaagagacagatcagtcataatgtggccaagttcaaatttgctctcccgacacctacttcagtgttgggccttccgattggccaacatataagctgcagagggcaggatgctactggcgaggaagtaatcaagccttatactccgactacactggattctgatattggatactttgagct

SEQ ID NO: 4310 - DNA, 284 bp, Triticum aestivum
  Clone ID: LIB3281-011-P1-K1-C3
ggtaggcgagggccagctattcaatggaattaatgggggagacaggttagtctttcatggggcaaacaaatactttagattgggagggatgctaacaaatggcattgcagggtcatggttaaatggagcaaatagtgtactgaaaatgatattcaggaataccacccttgcctacattgtgttgccaaataattgcaggatgtgaggaggcactcatcacagtgctcattacctctcacatctatagcagcaacaccagtagtcaaacaagttgcttgatctgt

SEQ ID NO: 4311 - DNA, 277 bp, Triticum aestivum
  Clone ID: LIB3281-011-P1-K1-C4
cccacgcgttcgcggacgcgtggtcgcggtgcgacgccagagggacctgtcggacgcggctcgctcgctacaagtgcaacgcgggggccgtgcaccaacctcggcagcggccgcactagctctcgcgggtttcttcgctcttgcgggcggcgctccgaggagggacggagcatgggcgagcgggggcacgtgcggcggaggcgagcggaccgtgaggcgagatcaccaagctcgatgctgtagctggcgcgaccagtaaatgagcttgcacagcagt

SEQ ID NO: 4312 - DNA, 86 bp, Triticum aestivum
  Clone ID: LIB3281-011-P1-K1-C5
cccacgcgttcttggactcgttttttttgtgatattacagaaggaccgggggggctcggctcactcgctacaagttcaattctatg

SEQ ID NO: 4313 - DNA, 379 bp, Triticum aestivum
  Clone ID: LIB3281-011-P1-K1-C6
cggacgcgtgggaggagtgaagaagcctcaccgttaccgccctggaactgttgctcttcgtgagatccgcaagtaccaaaagagcacggagctgctcatcaggaagcttccattccagaggcttgttagggagattgcccaggacttcaagactgacctccgcttccagagccatgcggtgctggcccttcaggaggctgcagaggcctacctggtcggtctcttcgaggacaccaacctgtgcgccatccatgccaagcgggtgaccatcatgcccaaggacattcagctggctaggaggatccgtggcgagagggcttaaggtgctgtgcttgccttgcctgtgggaatcgctctggtgggcatctgagtctgcttt

SEQ ID NO: 4314 - DNA, 358 bp, Triticum aestivum
  Clone ID: LIB3281-011-P1-K1-C7
gccgcgcccaggtctagggttccccctttcttcttctccacgcgaatcagctagatactagcaccagcatcgatggcggcggcagcgccggcggacgcgaaggcggaggccgccaagatggacctcctcgaggacgacgacgagttcgaggagttcgagatcgaccaagaatgggatgacaaggaagatggcaacgaagctgtccagcaatgggaggatgactgggatgatgacgacgtgaacgatgatttctcactgcagctgaggaaagagctggagggaggcaacactcagaagagctgaactatttccccatccatatcaaagctgtagtaaactttatcttcgatcaggcact

SEQ ID NO: 4315 - DNA, 270 bp, Triticum aestivum
  Clone ID: LIB3281-011-P1-K1-C8
cccacgcgtccgacaggagtcttttttccgtccccgtacgccgcggtgcgcgttccccgattggttcggcgccgccgcccccgtccccgtcaacctcctcgattccggccgccgtctctcggcaccacccgagctgcccatggacattgactccgaaccacccgccgagagcaagcccacccagatggacctttaggaccaggcggacgccgactggaagggggaggactaggagctccctgactttatctggagcctattcattggccc

SEQ ID NO: 4316 - DNA, 366 bp, Triticum aestivum
  Clone ID: LIB3281-011-P1-K1-C9
cccacgcgtccgctccttttattatcctgagagtttcttctttggggtgatttttctttcttggtaggagtaacaatagttttggctctcctcatccagaggcgaagcttcagggtttgtaaattttccggatctaatcaactaaccaaaaaaacccaaaaaaaggaaccatgagccacttcgccgccatgaagagccccgtcccggtcgccgccgccgccgccaccgacgcgaagagcccgctcttctgccccaagccgcgccgccccgtcgcgcccctccggtgccaccagagtagccactccgacgcgggcgccggcatggatctgctcgaccttctcctgtcaaagggcgatgagagcaatc

SEQ ID NO: 4317 - DNA, 370 bp, Triticum aestivum
  Clone ID: LIB3281-011-P1-K1-D1
cccacgcgtccgcccacgcgttcgcccacgcgttcgggttggccccaaaaccgtccatgttccatcaggggagaagcttgctgtttttgatgctgctatgaaatacaagaatgaagggcatgacactatcatcctggctggtgctgagtatggcagtggaagctcaagggattgggctgcaaagggtccaatgcttcagggagtgaaggccgtgatagccaagagttttgagaggattcaccgtagcaatcttgctggaatgggcatcgtccctctatgcttcaaggctggggaggatgccgacagtcttggcttaactggccatgagcgttacaccatccagctttcgactgatgtgaatgaaatcaag

SEQ ID NO: 4318 - DNA, 409 bp, Triticum aestivum
  Clone ID: LIB3281-011-P1-K1-D10
cggacgcgtgggttgcctgcagagctctttcacagaggaacagtgacccaacaaaagcttcccggccctgggatatggaccgtgatggttttgttatgggagaaggggcaggtgtgctagtattggaagaacttgagcatgctaagcaaagaggtgcaacaatatatgctgaatttcttggtggaagcttcacatgcgatgcttaccatatgactgagccgcatcctgaaggaacggggatcactctctgcattgagaaggcactggctgattcaggggtagcaagggaagagattaactatgtgaatgcgcatgcaacatctacacaatcaggcgatttgaaggagtatgaagcgatcgttcgttgcttcggccagaaccctcagctaagggtgaactcaacaaaatc

SEQ ID NO: 4319 - DNA, 371 bp, Triticum aestivum
  Clone ID: LIB3281-011-P1-K1-D11
cggacgcgtggggcggccttgggcatgaactccggcgacgtgacgaggggaacggcgagtccccagatggaggaggacggggccaactggatctggccggagtagaacggaggcggcggggcgagctcgacggaggcgaagccacagacgcaggggccgtgcgtgtagagcagaggcgggtagcaggagcggcaggaggatggccggcagcgaccggacacgacggcggggcttggtggagctcggcggcctggttccacggacgcggacaaggacggcggcgggcggccgtgagggacctcctgtccaaggcgcagcagtgggagctctggcctgggtagtcgaggacgaagccaaggcccgggagggag

SEQ ID NO: 4320 - DNA, 325 bp, Triticum aestivum
  Clone ID: LIB3281-011-P1-K1-D12
cgaggaggagttcgagaagtccgtctaggctcccgacccggagtgcagcgacaaccccgagttcaagatcgtcctaaccatcatccgcgacgggctcaagaccgacgccagcaagtaccgcaagatgaaggagaggctcgtcggtgtctcccaggagaccaccacctgcgtcaagaggctctaccagatgcaggagtgcggtacccttctcttacccgccattaacgtcaacgactcctggaccaagagcaagtgtgaccacctttacggttgacgtcactcgctccccgatggtctcatgagggccactgatgttatgatcgcc

SEQ ID NO: 4321 - DNA, 408 bp, Triticum aestivum
  Clone ID: LIB3281-011-P1-K1-D2
cggacgcgtgggcgggacctgaaaaagattgtggatgtacgggtccgtgcatctaatactcgacttggtggagatgcgaaggctcaacccgtggaagtaaacgtggttagccatccaattcaaagatatgcggtttggtttggcggatcggtgcttgcttctacagcagaattctacgaggcgtgccacacaaaagcagagtatgaagagtacggtgcaagcatctgccgatcaaatcctgttttcaaagggatgtattgaaattttcgtatgaagactaggaggcatcacagatagcatctccatgcaatcagcctgagcctagctagcagtagcaggctggcagcatggtaaatggtaaaactgacaccggaggcaagctctcttgtagcgttgtttgtacacaac

SEQ ID NO: 4322 - DNA, 406 bp, Triticum aestivum
  Clone ID: LIB3281-011-P1-K1-D3
gagaaggcggccatcctcctcatggccctctcctccggcgtcatctacggctgatccaggccggcccagccccacctagctagctagcagcaagcggagagaggagaagagaagagaagagagatgagaggagatccagagtgtgagtgatttgctcgcttgctgcttgtctagcaagcaagcatgcaggcagagatgttgcggcgtctctgcctgctcccccttgttctttcctggtagtttttccggctgattagttcttcaataatgaatgaatgaacgatgatgcagctgcagcagctgctgctgttcttcgtgccagcttagcggctttgttctttcttgttgcctagtagcagctgtgatgttacccaagtagtagtagtagcggttatcctagtagtag

SEQ ID NO: 4323 - DNA, 393 bp, Triticum aestivum
  Clone ID: LIB3281-011-P1-K1-D4
aggactgccaaacccacacccatacaagaggcaggcaaggggcaccctcctcaagcctcaagcaaccaacgcagttcttccaccgatatttccttccctcgccggcaccgccgacgatctgcagccatggcaatggcttacaagatggcgacggaggggatgaacatcaaggaggagtgcaagcggtggttcacggagatgaagtggaagaaggtgcaccgcttcgtggtctacaagatcgacgagcggacgcgcgccgtgctggtggacaaggtgggcggccccggggaggggtacgacgagctcgtcgccgcgctgcccggcgacgactgccgctacgccgtcttcgacttcgacttcgtctccgtcgacaactgccagaagagcaagatc

SEQ ID NO: 4324 - DNA, 139 bp, Triticum aestivum
  Clone ID: LIB3281-011-P1-K1-D5
agactgcaaaccacaccttttatttatcaggcaaggggcacccggctgggcctcaagcagccaacgcaaactttacaccgatatttcctttctctcccggcaccgccgacaatcttcaatcatggcaattgcttacaaa

SEQ ID NO: 4325 - DNA, 368 bp, Triticum aestivum
  Clone ID: LIB3281-011-P1-K1-D6
tgacttcggtctctccgtcttcttcaaacacggggagcagtttaaggatctcgttggaagtgcgtattatgttgctcctgaggttctgaagcggcactatggagcagaagctgacatatggagtgcggggattattctgtacatccttctgtctggtgttcctcctttttgggcagacaatgaggatggcatatttgaggctgtcttgcttggtcacatagatttctcatctgacccctggccttcaatatctaatggtgcaaaagatttggtgaagaagatgttgcggcaagaccccaaagagcgcttgactgctgcagaaattttgaatcacccatggattagggaagatggagaggctccagata

SEQ ID NO: 4326 - DNA, 390 bp, Triticum aestivum
  Clone ID: LIB3281-011-P1-K1-D7
cgacttagtcgtaaagatatgttggactattcatttggtgatgccacttgtcctgaagaaggaaagctcttggaccaccagcctttgaggctaaaccaagatgactatgaccgtgtccagcagattccgataaagaagggagcgaatttccgtgacttgccaggagtcaaggtcggagcgaataacattgtggagtgggatccagaagttgagcgtgtctacctcaagtccggcaaacctttggttcctgactatgcaatgtccttcatcaagggcagatcaccaaagccgtttggtcggttgtggtgggatgagacagtttccacggtcgtgaccagagcagagccgcataaccagatcatactgcacccgaatcaaggacgcgttttg

SEQ ID NO: 4327 - DNA, 313 bp, Triticum aestivum
  Clone ID: LIB3281-011-P1-K1-D8
gcctcgcctccctcctctcctctcccgggcgcctccaccccccgcccagcggcgcgaagcgaccatgacgttcaagcggaggaacggcgggcgcaacaagcatggccgcggccacgtcaagtacatccgctgctccaactgcgccaagtgctgccccaaggacaaggctatcaagcgtttcttggtgaggaacatcgtggagcaggctgctgtgagagatgtgcaggaggcttgtgtccatgatggatatgtccttcccaagctgtacgccaaggtgcaccactgtgtttcttgtgccatccatgctcacatt

SEQ ID NO: 4328 - DNA, 406 bp, Triticum aestivum
  Clone ID: LIB3281-011-P1-K1-D9
cccacgcgtccgcggacgcgtggggacggattccaaaagggagcaggttatcaagatcatggacccaaggctgtcaacagtgcccgtgcatgaggtaatgcacgtcttctatgttgcgttgctttgtgtggaggaacagagcgtgcagcgacccacaatgcgggaggtggtgcaaatcctcagtgagctacccaagccgagtacgaagcatggagaggagcagcttactggtagtggtgatggtgatgaatctggtcctgtaggacctcctgaaactgtggagcctgcaaccgatgaagcaaaggagcagcaccaacagcagcaaccgagctcgccgtcttcactgcctcccaatctcatcagcatctgaagaactgtcaagctgaattattgccatttattttgt

SEQ ID NO: 4329 - DNA, 382 bp, Triticum aestivum
  unsure (1)...(382): unsure at all n locations
  Clone ID: LIB3281-011-P1-K1-E10
aagaaaaggggggaaactgcacgcggcggcggcatccaccgccgaatgcacccccaaaaccaaatccctccaccaaaaccccaatccccatctccatccccatccccatggcgaccgggtcgcgtgcgccgcgacgccgccgcccccgctcgccgctgacgctgatcgacgacctcgtgcgcgagatcttcctgcgcgtacccgtggacgaccccgtgaccctcgtccgcggcgccgccggctgcaggagctggcgcagcatgctgtccgcccccaacttcgcccgcgactaccgcaaggcccgcagtgcggcgcccgtgctgggcttnctccacaacaccaccagcgaaccggaggatcgcttcgcctcctcacacttcgt

SEQ ID NO: 4330 - DNA, 346 bp, Triticum aestivum
  Clone ID: LIB3281-011-P1-K1-E11
aagacacggggggaaactttactcttcgaccgcatacaccggcggatgcacacacgaaaagtaaatccctgtatcaagacccgaatacctatatctatccccatccccacggcggaccggctcgcgtgcgccacaacacctgcgcccccgctcgccagctccgctcatacacacctattgcgctagatcttgctgagcgtaccagtgcaccaccccacgtcccttattcgtggcgccggctggtgcaggagctggcgcaccatgctgtccgaccggaacttcgcccgccactaccgaaaggcccgcagtgcggcgcccaggctgggctttcttcacaacaccacca

SEQ ID NO: 4331 - DNA, 413 bp, Triticum aestivum
  Clone ID: LIB3281-011-P1-K1-E12
gcgctccccacctcttgtccacctcgcgcctcgtagtcgtactaccaaccaaccccggccgacgcaactccagtcactcccggcctcccgcgatggtcgccacggcgaagatcccgcagcggcagctcttcatcgacggcgactggcgctgctgaaccatcccacgagggagctccagcaaggccgctcgggtggtgcgctggacggtcgccgacctcgcgtaaccccggcgccgcacggctccgagcacccggcgacctcggcgtaccgcaggagcggacccgacccacaggcgaagggtgatcgaggagaggggagaggcctgggcgagtggaccggtccgatcggtcagggtggcgaccaaggagctgaggatgtcgaggagggcggtgaaccccggcggtcatggaaag

SEQ ID NO: 4332 - DNA, 407 bp, Triticum aestivum
  Clone ID: LIB3281-011-P1-K1-E2
gcaagatccccgataaggagatcctcaagattgtgaaggagaactttgacttcaggcctgggatgatcagcatcaaccttgacttgaagaagggtggcaacaggttcatcaagacggccgcttatggccactttggccgtgaggatgctgacttcacctgggaggttgtgaagcccctcaagtttgacaaggcctctgcttgagaggtgggtatgaaggagtctaatcattcctgctgctgccgctggtggttgtatcttggataattgaattccttctctttagaaggaagcagggtttcaacatcgccgtggacacgctgaattggcatctagtgattggtattttggtatggaatacaaaaatatgtgctgagttaatactagtcgggtcttttgatgtcttct

SEQ ID NO: 4333 - DNA, 351 bp, Triticum aestivum
  Clone ID: LIB3281-011-P1-K1-E4
cggacgcgtggggctgcgccacccgtcccggctaaatctagatggacctacacgcgttggacgacgctggtgctgtctagttacaggagcaggttgacaagttcgttcaagagaggatgtcggcgaatccgccgccccaagaactccaccaagacgaccctgaggcgatgaacgaagaggaggacgaagaagttgacatctgtagcggtgtctgcctcttggtgatcgagccgcaacctatgatgcaagaacgtcaccaagacggccctgaggtgatggccgaagaggaagaggaggaagaagttgacatctgcggtggctgctacatattaccgagcgtgccggcaactc

SEQ ID NO: 4334 - DNA, 404 bp, Triticum aestivum
  Clone ID: LIB3281-011-P1-K1-E7
ccctctcctccgccgacagatccggccgtcccaggctgactcccgccggatcccgtcctcggcgcggccggtcgcgcggggtgagaggagctgcgacaccatggcttagaggagctaggcccgacgcccgagagaccatcccgagccaggagaagcaccaggacgaccgctcttcttccccgtcccgagcaagataaacatacaatcttaatggggcatgatcatatcactcatatagagaagctcacggcggatggttccgttgctgacaggaaatgttgccaggaacctggctgcgatgagatcgtcagtggaagggtaatgtactgcaatagtcacactagagggcattcatcccaacagcttggttaccttcagagttcacagaaaacctcagatttata

SEQ ID NO: 4335 - DNA, 358 bp, Triticum aestivum
  Clone ID: LIB3281-011-P1-K1-E8
ccgaagcctacctcctcgcgccgcgccaccttccgccgcgaattcgtcatcacgcgccggcaccagagatgaccgcggtgcgaggggccgcagtggagggagcgtggtctaatccggcgctgatggagccgccggccgccgctgccgatgggcctcaggtgtctgaggtggactcgttccggcgccaggtcgacgacctcctctccaagaccgacgtgctcgagaagagggtgaacgaggtggtagggttctacaattccaagaagcacagcaatggagggcgcaaggctggcggcaggtacgcggcaaacggtgccagggacagccacggcaatgggatgcccgacctcatgcgcca

SEQ ID NO: 4336 - DNA, 353 bp, Triticum aestivum
  Clone ID: LIB3281-011-P1-K1-E9
gaatttcagtttcagaaatatttcagccatagccaaaatgactgaatttcactgaaatttagtggttcagttttggaattcagcgattttggttttcatttcggtcaaagggccaaagtttccacttgaattagattggaatctaactaaatatttcaaaaagttcaaatgtaatttgagaattattcaaatttgtgcatactaccgtagttgctatgagtgaagcaaggggttgggcgtatgagaacctctaccagcgtttaaacatgaaggaaggcgaaagggacatctataagatggccaagatctgagagaagaagacgagggatgtcaaccaagtcaaatgcatcaag

SEQ ID NO: 4337 - DNA, 357 bp, Triticum aestivum
  Clone ID: LIB3281-011-P1-K1-F1
cggacgcgtgggaaagaatctatcataatctaccactgaagataatctgagagaattgtttggtaattttggacctataactagtgttattgtagtgcgaggcgatgatggtaaatccagatgctttggattcgtgaactttgaaaatccggatgatgctgcatgtgctgttgaggatttgaatggcaagaaatttgatgataaggaattgtatgttggtagagcccaaaagaagtctgaaagggagatgcaattgaggaaaatttgagaaagcaataagagacagtgcaggaccaagcactactgattgaaaattgatgtaggtgtacatagagtaagactttgtgattgacttac

SEQ ID NO: 4338 - DNA, 213 bp, Triticum aestivum
  Clone ID: LIB3281-011-P1-K1-F11
gcagcatgggccgcgagttcatggccatggcggatgcggggggcgcgccagccgacccttgccccggggactccggcgccgggaacaacgacctgcagctggcgcggatcggggagcacgagcccgtgccggagacggagacgaacccgctggccatcgtggcggacaccggcggcgcgctaccaccggcgccaacgtcgtcgtcttcgtgcg

SEQ ID NO: 4339 - DNA, 398 bp, Triticum aestivum
  Clone ID: LIB3281-011-P1-K1-F12
gccagacgaagagaggagggagagggagaaggcgagcccatggagaagtgccaccgcaagtagatcttgccgtcggcggcaagaaggccacgccccccctccacctggtgcgttcacccagcagtggaagcaatgccctttttcccctgttgagagatcaaatcaaattgcatcggtacgccatgccgtcaccaatttgatcatgcaaacctgatgaagataatgtattatgtgcgctggttcgccggccactatcttggatacgaatgatctcaatgataccaaaatcttagcatcaatgtaacgctgcaattttctgtgttatctgaatttagctgcaggaattgttgcacctttgcctttcttccttcatattctactagatgggtgctactcac

SEQ ID NO: 4340 - DNA, 395 bp, Triticum aestivum
  Clone ID: LIB3281-011-P1-K1-F3
gcatcccgaaaaagtgccgtcagacttcaagagatcggaccaagaatgaccatgcgcttagttaaggttgaatctgggctatgctcgggcgacatattgtacccacaatctgttggaaaagaagatgtgaacgtggggcacgaggaagaagagatagaagatgctggggatatgatggagctggatgatgggacggaggaggacgactgggttgacgaagagtagcctacataagctcgagaggtgctgagcagcaccctatgatgattgctaaaaatgtgaagcaactggtgtattgcgactaacattatgagtttgagtgatccttgagaaagcatattctgagaaagcatatccttaacagaagtcactcttggaaaagagagggataaatc

SEQ ID NO: 4341 - DNA, 407 bp, Triticum aestivum
  Clone ID: LIB3281-011-P1-K1-F4
cggacgcgtggggaatctggccaccaaccaaggctgtcttgcgatgctcctcggttctcatatgacgggagggaatcggcatcaaaacgtagggagatgccaagattgtcgctggacatcaaggaaggccctcttaggatccgtgaaatggactcgcggccgaagccgaacatgaatgacacagaaaggagtatcagttttggttctgataaagaatccaatgcagagatccagaaagaacaaccagcagcctctaagcgtcttccaagtgtcgttgcaaaactcatgggtttggaagagttgcctgagcccaacgacacaaaggtgatatcaccacaggcacccaaatcagttcaagagaggaagcaagaacatatactgctccctttgagcctctcctcgcataa

SEQ ID NO: 4342 - DNA, 304 bp, Triticum aestivum
  unsure (1)...(304): unsure at all n locations
  Clone ID: LIB3281-011-P1-K1-F5
ctagcgctcgcgccgccgccgccgccgccgcaccaccgctccccagctcgcgccccgcgagcttgcgccgcaacttcaccatgaagttgaacatcgggaaccccaccacggggtgccagaagaaggtggagatcgatgacgacatgaagctgcggaacctttatgacaagaggatctctcaggaggtagttggtgatcttctgggtgaggaatttgagggctatattttcaagatcttgggtggctgcgataagcagggcttnccaatgaagcaaggagtgctaactcctgggcgtgttcgcct

SEQ ID NO: 4343 - DNA, 420 bp, Triticum aestivum
  Clone ID: LIB3281-011-P1-K1-F6
gagcattcttttgtgaaggaatattacactaaaaaagttgtcatcagtatatatctcaagatgaattgtgtcacgggagccgatacggcggcagacacaagcagagcaaagcgaagccggcgcgacggccgggccctccaagcacacaaccactgcctcctcgccaaaatacgctagcctgcatctacaaggaaaaaaaggaacttgcccgtatggtgttcactaaaaagaagaatctgctaaaaggttggatgtgggctgtacgtggacatgaacttgttcctgggattcagaagggagcacgtgccatggaacttcaagaagacggagaaccatgtgtacctccatgtcgtgctttggcagaagctggatgccgacgagtcagaacctgctgaagaagccactctgctcaccattggt

SEQ ID NO: 4344 - DNA, 381 bp, Triticum aestivum
  unsure (1)...(381): unsure at all n locations
  Clone ID: LIB3281-011-P1-K1-F8
cccacgcgtccgtgatgctcttttagccgcaactttgctgattgatagcaagcccagcaagggtctgcgcaagttcctgcagaagcactgtgatggtgaaacattggctgttgctgattccaaacttgggaatgccatcaaagaaaagctgcaaattgattgccttcacaactctgctgttatggaactgatgagagggctgaggaaccagctcactgaacttatgtctggactagctgagcatgatctaagtccaatgagcctaggattgtcccacagcttgtctaggtataaactcaagttcagccctgaaaaggttgatactatgatcattcangccattggcttgttggatgatcttgacaaggagcttaacactta

SEQ ID NO: 4345 - DNA, 296 bp, Triticum aestivum
  Clone ID: LIB3281-011-P1-K1-F9
cggacgcgtggggtgttggaatcattgtctaccggggtctgtacttgggactgtatgattatatgaagcccgttctcctgactggcactttccaggacagcttctttgccagctttgctcttggttggctgatcaccaacggtgccggtcttgcatcataccccattgacaccgaacgcaaaaggattatgatgacctccggagaggctgtcaagtacaagagctccttggatgctttgcagcacatccttgcgaaggagggcggcaagtctctctttaagggtgctgggggcaac

SEQ ID NO: 4346 - DNA, 388 bp, Triticum aestivum
  Clone ID: LIB3281-011-P1-K1-G1
cccacgcgtccgcggacgcgtggtggatctgggctggatggggccaaactactctatttccactgcatgtgcaaccagtaacttttgtatcctcaacgcagcaaaccatatcagaagaggggaagctgatgtcatgctttgtggtggttctgatgcgccactcatcccaattggattgggaggttttgttgcctgcagagctctttcacagaggaacagtgacccaacaaaagcttcccggccctgggatatggaccgtgatggttttgttatgggagaaggggcaggtgtgctagtattggaagaacttgagcatgctaagcaaagaggtgcaacaatatatgctgaatttcttggtggaagcttcacatgcgatgcttaccatatg

SEQ ID NO: 4347 - DNA, 337 bp, Triticum aestivum
  Clone ID: LIB3281-011-P1-K1-G10
cccacgcgtgcgcggacgcgtgtgctgacgcgtgtgatttaccggtgagaatgattcgaatctctatgctaccctagacatgctatatgctgggatggaaaaccagactaggttctttggtgctggtgaaaatattacatattacctggctgggatatactgactatgacgaggccatacatcaatagaactgaacaatgctacggtttcagggcccgacaatatataacttactagaacactcatgaaaacgcggcacttatattatatggacgtgatcaaggaccattaacaaactgttagacgccgctctaaccatataagtccagtgctttta

SEQ ID NO: 4348 - DNA, 291 bp, Triticum aestivum
  Clone ID: LIB3281-011-P1-K1-G11
gcgcgggacgaggtggagaagcttcggcacgcgggggcgcaggttgtttagctgaggcagattcaaggtttgttcatctataatttgtgttatcctgtcatatgtgatgtttgtttgctggtagaataagcaaataaatttgccttgccataatttgtgctatcctgtcatatgtgatgtttgcctgctatcctttcatatgtgatgtttgcttgctatcctcaaatggttcaaatgtggtgtgccaagtcagggtttattaatctctgtgatggaatgatacaatatttt

SEQ ID NO: 4349 - DNA, 76 bp, Triticum aestivum
  Clone ID: LIB3281-011-P1-K1-G12
gccacacgaagagaggatttattgggagaaggcgtgcccatggcggagtgacaccaccagtttatcgtggcgttta

SEQ ID NO: 4350 - DNA, 399 bp, Triticum aestivum
  Clone ID: LIB3281-011-P1-K1-G2
cccacgcgtccgcccacgcgttcgtagagatgaacaaaaagatttacaagatgggcaagtctggacaggagtctcacgaggcctgcactgagtttgacaggactgagaaggacatcaccccgatgggtggcttccctcactatggtgtggtgaagggtgactacctcatgatcaagggctgctgtgtgggccccaagaagagagtggtgaccctccgccagtccctgttaaagcaaacgtcgcggttggcccttgaggagatcaagctcaagttcatcgacacctcatcaaagtttgggcatggccggttccagaccaccgacgagaagcagaagttctacggcaagctcaaggcttaggccgcgacagatcttatcccataatgttaccagctttttt

SEQ ID NO: 4351 - DNA, 371 bp, Triticum aestivum
  unsure (1)...(371): unsure at all n locations
  Clone ID: LIB3281-011-P1-K1-G3
cgcaaaaggcgaggagagagagccatggaggacagagaccacggccccgctgagaaccttcctgaatctccacaccgcatcgtcgacgccgacgaggagggagacgaagacggaggcggcttcaccttccccgtcctaccgttcgcggcggacgcgctcatcgtgcccgtgtaccccatcttcggccgccccccgtccccgccgncggcggcctcggtcgacgagcaggagacggccaccgtgcgagtcccgctggggcagctcctgctggaggagcgcgacttccgcgcgaggcagagggacgaagagagcttcngggacggcgagctggagggcgtggcgccggagagctactgcctctgggcccccgg

SEQ ID NO: 4352 - DNA, 416 bp, Triticum aestivum
  Clone ID: LIB3281-011-P1-K1-G4
cggacgcgtgggtcctccaatccagcaccaccgccgccagctccacacctcgagagggacacctcgtcgccggagaagcagcaagaagaagatggccggaaggaagggcggcgacaggaagaaggcggtgacccgctccgtcaaggccgggctgcagttccccgtcggccgcatcgggcgctacctcaagaagggccgctacgcccagcgcgtcggctccggcgcccccgtctacctcgccgccgtcctcgagtacctcgccgccgaggtcctggagcttgccggcaacgcggccaaggacaacaagaagacgcgcatcatcccgcgccacctgctgctggccgtccgcaacgaccaggagctcggcaggctgctcgccggcgtcaccatcgcccacggcggcgtcatccccaaca

SEQ ID NO: 4353 - DNA, 413 bp, Triticum aestivum
  Clone ID: LIB3281-011-P1-K1-G5
gagaaggcggccatcctccttatggttttctcctccggcgtcatctacggctgatccaggccggcccagccccacctagctagctagcaacaagcggagagaggagaagagaagagaagagagatgagaggagatccacagtgtgagtgatttgctcgcttgctgcttgtctagcaagcaagcatgcaggcagagatgttgcggcgtctctgcctgctcccccttgttctttactggtagtttttccggctgattagttcttcaataatgaatgaatgaacgatgatgcagctgcagcagctgctgctgttcttcgtgccagcttagcggctttgttctttcttgttgcctagtagcagctgtgatggtacccaagtagtagtagcaagcggctatcctagtagtagtatcag

SEQ ID NO: 4354 - DNA, 417 bp, Triticum aestivum
  Clone ID: LIB3281-011-P1-K1-G6
gcccaggatctgggtgttgtcgctgttttattgtgtggccatgtttaccatgctgactgcctggatagcttaactgcagaagctgagaaatatgatcctccttgtcccgtatgcacccacggtgaacaatgtactgtgaagctattcggtaagctggaatcaaagataaagaacaagatacctacaaatgtgatactcgatggtgatctagatgggagctctaagcatcaaaagaaaagtaagagagttcccagattaggcacaaggatcagtatgaaggactcattcagtcggccatttttgaggaggcatttctcaattggctcccggccaccccggtttgtttcagagagcgagtcaacaaggaagaaggtcttctgggcgaggcactggagagaatagcatagtactcagtca

SEQ ID NO: 4355 - DNA, 364 bp, Triticum aestivum
  Clone ID: LIB3281-011-P1-K1-G8
gcagtacccctactcggggtaccaccccaacaagccgtcggcgagccggcggccgatgccggcgccgggcagcgaggagtacgccctgctggagcgcgacccggagaaggcctttatcctcaccatcaccaaccagttccaggcgctggtgggcatctcgctgatggagatcctgtccaagcactcctccgacgaggtgtacctggggcagcatgacacgccggcgtggacgtcggacgccaaggcgcaagaggcgttcaagcggttcggggcgaggctggagggcatcgagaagcaagtggtggccatgaacggggacccgcggctcaagaaccgcaccgggccggccaagttcccctacatg

SEQ ID NO: 4356 - DNA, 369 bp, Triticum aestivum
  Clone ID: LIB3281-011-P1-K1-G9
cggacgcgtgggcggacgcgtgggcaaaggtgtttgctgtattgatgagtttgataagatgtctgataatgcccgaagcatgctgcatgaggtgatggagcagcagactgtatccattgcaaaggctggaattattgcatctttgaatgctaggacatctgtactagcatgtgccaatccatctgaatcacgttacaatccaaggctttctgtgatcgacaatatccaccttcctccaacactgctgtcaaggtttgacctgatttatctgatcttggacaaggcagacgaacaaactgatagacgcctggctaagcatattgtttcattgcatttcgagaatccagaagtagttgagcaccaggtctt

SEQ ID NO: 4357 - DNA, 371 bp, Triticum aestivum
  Clone ID: LIB3281-011-P1-K1-H1
cccacgcgtacgcggacgcgtgtgtccgtttttcctttcccccctctaaacccgcaccagaagcagcgctcctagggtttgctcctgccacaaaccctaccaccagattgcccggattccggcagaggcggcggctgcgagctggtggcatggcgggttacccggaggacaaccagcacgccatgaacgggtacgaggatgaggtcgaagaagtggaggaggtcgacgaggagggccgcccggggcggaggggacggcgagatgggggcgatggtggtggctatggcgacgccggtggggatgacgggagggctgggggcggtgactcgtcggggaagattttcgtcggaggcgttgcatgggagacaact

SEQ ID NO: 4358 - DNA, 406 bp, Triticum aestivum
  unsure (1)...(406): unsure at all n locations
  Clone ID: LIB3281-011-P1-K1-H10
cccacgcgtncgcactgctctttttctctcctcagtccccactctcttcccacgcagctggggacgccctcccatttactgagccaagaggaggaggggaagaagaattgattgccgatccggcgcagaccaataaattgttcccgcctccgccgcgagatcatcatggctgctgccgccacgaggagggccgcctcctcgctcgcctcccgctgcctgctcgccaggcccgcagcgtcgcccgccgctgtcccctccgcgctccgcagggcagatggtgcacgtggattgttgccaggactccttcagaggttcggcactgcggcagcagcagaggagcccatttcgccttctgtccaagtgggcgagacacaggtccttattaacggcaaattcgtttgatgct

SEQ ID NO: 4359 - DNA, 106 bp, Triticum aestivum
  Clone ID: LIB3281-011-P1-K1-H12
cccacgcgtgcgcggacgcgtgtgtcggcggagccgccgcccgcgatgtccaaggccgacgtagccgccgccaacatggtttacctgccgacaccggcttgggagg

SEQ ID NO: 4360 - DNA, 114 bp, Triticum aestivum
  Clone ID: LIB3281-011-P1-K1-H4
tcgatctcgagcccccctcttccgttcgtccgtcccaacccgatccgatcccctcctccgtcgccatgggccgcaagttcttcgtcggcggcaactggaaatgcaatggaactg

SEQ ID NO: 4361 - DNA, 391 bp, Triticum aestivum
  Clone ID: LIB3281-011-P1-K1-H5
cggacgcgtgggcggacgcgtgggctgacgcgtgggcaggcggcggcggcggaggcggaggcgagcgacgacgcgtgccatggcgctctgccgtgtgggttctcggctcgctggagtcgcggcgaggagtcttctcaccggctcccatgctgccaagggcggcgctgacatccccatcgccggcctccgcgctcacctgcccaacacctctggtctcctgcgtcccaagggcgtcggccactactctcaggaaaggttctcccacaccaagccggcacccacactggtcatggtggtggtgcatgaagacccagatctcgcgcgtgtctatgcggagagcctgtctaaggctgccagggaccaaatccttgttctgcacaaggtgcacctt

SEQ ID NO: 4362 - DNA, 390 bp, Triticum aestivum
  Clone ID: LIB3281-011-P1-K1-H6
cccacgcgtccgctgacacaaaaaagtgacgtgtatagctttggggttgttcttttggagctcctaactggaaggaaaccagtagatcacacgatgccaaggggacagcagagtcttgttacctgggcaacaccaaggcttggtgaggacaaggtaaaacaatgtgttgatccaagattaaacggagagtaccctccaaaaggagttgccaagctcgcggcggtggcagcgctctgtgtgcaatacgagtctgagtttagacctagcatgagcattgtagtcaaagcattgtcgccccttattattaataaacctcagcagcaaccgggagctccagacacgccttcagatacttgacaacatgtgcaatgcgaggttcatgtaaagtgc

SEQ ID NO: 4363 - DNA, 253 bp, Triticum aestivum
  Clone ID: LIB3281-011-P1-K1-H7
acggcggcgactccttcaataagctcgttgtgtttcctgttaaggtggaggcccggctgctcttccctttcttttcaagccatcgtggtggtggatggaggaagaaggagaggcggcgagctggactttgcagtttgggaaggagctcatcctcaatgggtttgagacgaggcaacggcgcccgcttcggctggcggcagccggtcctcaccgtctcgccattgaatatgctggccgaagggcggccctttct

SEQ ID NO: 4364 - DNA, 296 bp, Triticum aestivum
  Clone ID: LIB3281-011-P1-K1-H8
ttcgggtacaacgctggctctgggcattacgaggacttgatggcggatggtatcattgaccccactaaggtggtgagatgtggcctgaggcatgccgtgtcgcatgccaagaccttcctgacgtccgacgtgacggtcgacgagatcaaggagcccaaggacgagcccctcgccaaccccatggataactccgggtatggatactgctgagcaacacaggccgcgtttctcctgaggacgtggcttaagtcttggtagcatgaaccaaggtttgaaagattgatggagatgatgat

SEQ ID NO: 4365 - DNA, 349 bp, Triticum aestivum
  Clone ID: LIB3281-012-P1-K1-A1
aacaattttaaaagaatttcgagttcgcgacagcgagaagcagagccgggtcgcggggccgcgggcgggcgtgcgcgttagcatggagagcgagacggcggcgcgcggtggccggagccagccgctggcggaggaggcggtggggtccagccgcaccatggagcgcgtcgcggctgcgaagaagatcatcgagaacgactaccgcgagcgcatgaagaatctccgggagcgcaacgagagacgcttgattttggaacaacagctagcttcttctcaagttcctagggaggagcagataaaattgataaaggagttgcagaggaaggagactgaatacatgagacttaaa

SEQ ID NO: 4366 - DNA, 373 bp, Triticum aestivum
  Clone ID: LIB3281-012-P1-K1-A10
caatcgccgtgatccagctagccagcttacacagaagggcgattcgaccgaggccgccgccccgccgccgccgccgccgccggagacgatcccctgtagtcagttagttaagatacaaaaatggcctcactggacaccgtcagaggggatcttggcctggttgttttgtacctaagcaaggctgaggcaagagataagatctgtagggctatacaatatggatccaagttcttgagcaacggacagccaggacctgcacagaatgtcgacaaatcaactagtctagctcggaaagttttccgcctgtttaagtttgttaatgatctccaagctctgattagtccccctgccaaaggaactccacttccactga

SEQ ID NO: 4367 - DNA, 372 bp, Triticum aestivum
  Clone ID: LIB3281-012-P1-K1-A11
cgcccgcctcgcccgccgcggccccggctgctggcctcgtcggcgctggcggggtcgggggcggcaggcccttctcgatccgcgcgcccaacgagaagatagagatgtactctcccgccttctacgccgcctgcaccgccggggggatcgccagctgcgggctcacccacatggccgtcaccccgctcgacctcgtcaagtgcaacatgcagattgacccggcgaaatacaagagcatctcatctggatttggtgttctgttaaaggagcaaggagctaggggattcttcaggggatgggtgcctaccttgcttggttacagtgctcaaggggcttgcaagtttgggttctacgagttctttaagaagacct

SEQ ID NO: 4368 - DNA, 373 bp, Triticum aestivum
  Clone ID: LIB3281-012-P1-K1-A12
cggacgcgtgggtgccgttgtagtatgaactgtcctcgctgcattagtgtcccctcctggccactcggtcgagcacatggtgggcatggcgagggcaagttctgaagcatctgagacggacacgactgccatgcaggtggaggtggagtaggatcgtgatggggacacaacgaggttggataggggcaccttgttgacatgggtggtgctggcgacggggtagaggcccaatgtcgaacaggtgacgggcgtctcaagcacctggtccgcctcgctctgcatggtggacgcaggcacgccgattggacccgtggacaccggaggagtggtgtctggtgccgcaccgttgtctcctcctgggctcgtcgagcag

SEQ ID NO: 4369 - DNA, 377 bp, Triticum aestivum
  Clone ID: LIB3281-012-P1-K1-A2
cggacgcgtgggtgcagactgaaactgtgctgcgccaagctcttggtgagaggattaggccagtccttactgtgaacaagatggacagatgcttccttgagcttcaggtggaaggtgaggaagcatatcagactttctcccgtgttatcgaaaatgccaatgtcatcatggcaacatatgaagatgtgctccttggtgatgtccaagtgtacccagagaaggggactgttgcattctctgctggtctgcatgggtgggctttcacccttacaaactttgctaagatgtatgcctccaagtttggagttgacgaggcaaagatgatggagaggctgtggggtgagaacttctttgacccagccacaaagaaatggacc

SEQ ID NO: 4370 - DNA, 379 bp, Triticum aestivum
  Clone ID: LIB3281-012-P1-K1-A3
caagctgcacctaatccaagacatgttcagacgcaagttgagtttgactataccatgtcaactggatgctatctaaccaaatcacaagatgagaaagttgtagaaatagcccgcaaaataaggtctgagattcctttgtatgtggcaatcatgaagaaacttaatgtcaacgtgaaggactgctctatcaacataccattgaggcttgtgagccatttaaaagaggaggcaggtagtgctattatcaaactagaagcccctggtggtaacatatacaatgttcgagctagcaagcacagcgaggatcaagttgtcctccaatctgattgggatgcttttgtagctgctaatcacatacagttgaacgacctcctcattt

SEQ ID NO: 4371 - DNA, 378 bp, Triticum aestivum
  unsure (1)...(378): unsure at all n locations
  Clone ID: LIB3281-012-P1-K1-A4
cggacgcgtgggcgccgcgagactctcctcggctcctcctcctcctccgagtgtccaccactaccttcccggagttgcctattcccatggcgctctcccgccgccgcctcctcctcctctccctcgttgccatgacggcggtcactggcacctccaaggtcatcgtgacaaggtgctacccgccgccgacgccccaccccaacggcaggggcgcgttccaccgcagtcttctctcgctcctcgacgacctcccctccgccgccgcaccgacgggcttcgcctccatgcggacccgcggcgcgttcgcccgtggcctctgcttcggcgaccccgcgcccggcccgtgcctncactgcctgtccgacgccggcgggaaga

SEQ ID NO: 4372 - DNA, 275 bp, Triticum aestivum
  Clone ID: LIB3281-012-P1-K1-A5
ccgtcggaattcggtgacacgctccgcctggcggcccattaacattggaaccagtgaattcaccatgctggctgcggaatggagatgtaaccaaggacaggcatatgacactctggactgcgagaagcctgctaccaagcaggggttgatgaccaggtgtctgcgacggtgtgtatgaggacatagggcgtggaggcagagacaagctagccctccggtgggcacataccattgcgactctatgtggggggtgtatttcgtgtggtcgtcgattg

SEQ ID NO: 4373 - DNA, 212 bp, Triticum aestivum
  Clone ID: LIB3281-012-P1-K1-A6
tgcgagactatttcggctctctgtctggtctctgcgacttggtagcttctcatgggctccatggtgttggatgatgtggagggaggagggttcgtgttagctaagttagtccactccctctgttcgtgttttgtaagttaattagtagtatgtgtgctactagtatatggaactttaaatcggttcaccggcgagttgtgtgctctgctttt

SEQ ID NO: 4374 - DNA, 264 bp, Triticum aestivum
  Clone ID: LIB3281-012-P1-K1-A7
aacactcgtaaaagaatactgagtttgcgattgccagaagcatagccgagaggaggagcccagggctgacttgcgccttaacatgcagagcctgacttgagctcgcggtggaaggagacagaccatatcagactatgtggcggggtatagaaaaagcaaatggcatgatggggacataaaaaaaatcattgagaacgactaccgcgagcgcatgaagaatatgcagcagcgcaacgagagactcttgattatggaacggctttt

SEQ ID NO: 4375 - DNA, 374 bp, Triticum aestivum
  Clone ID: LIB3281-012-P1-K1-A8
gagattctcaagatttgcaacgttattggttgcccagatgagcaaacatggccccagggattgtctcttgcagaggcgatgaagtatcagttcccacagatcagaggcagtcaactgtcggaggtaatgaaatcagccagtagtgaggcagttgaccttatatcctctctgtgctcatgggatccttgcaagagaccaaaagctgcggaagttctccaacatgccttctttaaggattgtacatatgttccagcttctgtccggccaaaagctgcaggccctcctaaaactcctccgggtgttggagcaagaggactttcaggacacattgctcggagatactccactggagctctctccacaagcaaacctgc

SEQ ID NO: 4376 - DNA, 355 bp, Triticum aestivum
  Clone ID: LIB3281-012-P1-K1-A9
acaagacggacagaaaacaattgcatcacaggatttgcaacaagctaaatgcggtagcacaaagagttgtaaaacagaatagcatcgtcattagcataattcataactagagaacaattcgttaactgaatcatataactcggcgaacacagtatttgcccatcaggttcagaacacggaagcaaactactaagcataggatactactagtactaagcatggaaggcacagaacccaaatcaactacagctttctctcctccttcgatttcttgaccgcgagccagggcttgtgcgccagggccagccagcgccgcggctcttcaaccgcgctcgccctctctggtttgctactc

SEQ ID NO: 4377 - DNA, 378 bp, Triticum aestivum
  Clone ID: LIB3281-012-P1-K1-B1
cggacgcgtgggcccagcctcccccctccctcgtgcgcctctactaaaccaaggagtagtcggcagggaggggcagcaggggagggagatctgactgacgagtccagggatgatggagagccagccgctgcaggccccgacggccgagccccacggcgccggagccgcggacgaccaggccggagccggggctccccccgccgtcgttcccgggaaggagttcacgcggacctgcaagggcctcgtcgtcgtgctcatcggcggctacgtgctgctccagctcctcccgtcctccctcaactacctcgccatcatccccgccaagacaattccctttgtatggaccgtcttcacagccggttacatcgagcaagtcct

SEQ ID NO: 4378 - DNA, 372 bp, Triticum aestivum
  Clone ID: LIB3281-012-P1-K1-B10
cggacgcgtgggttttttttttgaaaggtaaaaatcagaagaagttaaaaactggagcgaatttgaacaatttggatggggagagagagagagctagtgttgcatagctagctctaggctgctgtgcatgggattattctgttcttttttcactcctctttctctttactgttttcctttgcgggttggatcagcgtctcttttcactcccagcaggccttccctttctacgcgcgccgccgctagcttcccgtcattttgcatcatgctcagagcctcagacggtggccaccggggtccactcgaactggccggcgttgagaggcacgccgcgcgcgacgtcgaagttgtatttggcggcgaagcgctcgg

SEQ ID NO: 4379 - DNA, 372 bp, Triticum aestivum
  Clone ID: LIB3281-012-P1-K1-B11
cccacgcgtccgtatcgacatgcttcagctttgcacaggaatagatgagaaatctgtgggatcctccttccagcttgtctttgcaccaattgatgattttccagatgatgctccattggtttcatccggctttcgtgttataccacttgatatgaaaacagacgttgtatcctctggcaggacattagatttggcatctagtcttgaagtaggctccactgcagcccaagcctctggtgcatctccagatgattgtaatgtgcgatctgtgctgacaatcgcctttcaattcccttatgagctgcatcttcaagacagtgttgcagctatggcccgtcagtacgttcgtagcattgtttctgctgttcaaag

SEQ ID NO: 4380 - DNA, 381 bp, Triticum aestivum
  Clone ID: LIB3281-012-P1-K1-B2
cccacgcgttcgcagcgttctgcgacggcaagtgcggggtgaggtgctccaaggcggggcggcacgacgactgcctcaagtactgcgggatatgctgcgccgagtgcaactgcgtgccgtcggggaccgccggcaacaaggacgaatgcccctgctaccgcgacaagaccaccggccacggcgcgcgcaagaggcccaagtgcccatgatccacatacaccaccgccctccaggcattctccgccgcccatggcgtctacacaccatatgcctgaactggatgcatccctatctatcatgtcgtactgtctcgcggatcaccactatatattatatgcgtgtaaatcatgatctggagcgtctggtgcatgatcctactat

SEQ ID NO: 4381 - DNA, 376 bp, Triticum aestivum
  Clone ID: LIB3281-012-P1-K1-B3
cgcttttcctccgctccccgccccgtcttttgcagctcaagaacgcgcgcagccatggcgacggagaccgagaccttcgccttccaggccgagatcaaccagcttcttttggtcattataaacaccttctactcaaacagggagattttctccggggggttatttcaactcctccgatgccttggacaagatcagggtcgggagcctcacggacaagagcaagctcgatgcgcagcccgagctcttcatccacatcatccccgacaaggggaccaacacgctcacgatcgtcgacagcggcattggcatgaccaagtcggacctcgtcaacaacctcgggaccatcgccaggtcggggaccaaggagttcatggag

SEQ ID NO: 4382 - DNA, 379 bp, Triticum aestivum
  Clone ID: LIB3281-012-P1-K1-B5
ggcccgatccccaaatccctccgcatctcatggcggcgagcctgtggcgagcggtgatgggcaccggcgccccgcccgcggacgccacggacggcgtcgagttctggcgcgagccggagcgcggcgggtggctggacaagcagggcgagtacatcaagacgtggcggcggcggtggttcgtgctcaagcaggggaagctcttctggttcaaggactcgaccgtcacgcgcgcctccgtgccccgcggcgtcatcgccgtcgcctcctgcctcaccgtcaagggcgccgaggacgtgctcaaccgcaagttcgccttcgagctctccaccccgggcgagaccatgtacttcgtcgccgactccgacaaggagaaggagga

SEQ ID NO: 4383 - DNA, 381 bp, Triticum aestivum
  Clone ID: LIB3281-012-P1-K1-B6
cccgcctgcacccgtgcgactgcccccacgcagaagcccgcgcccccaaccgagccaacgcgccgacgtcgatagggtttctccccctccccccggcgacggccgcgcagagccccgaatctccctacccgcggcagtacatgagcgacggcgaggacaccctcgacctctccgccctcggcgccggcggccccaacgccgcagagctcagcgccgaggacaaggccaacctcgcggagtcgattcagaacacgctgcagggattggcggcgcggcacacggacgtgctcgcgagcctggagcccaaggacaggaagcgcgtcgaggcgctcagggagatccagagccaacatgatgaatctgaggcaaagttttctgagg

SEQ ID NO: 4384 - DNA, 362 bp, Triticum aestivum
  Clone ID: LIB3281-012-P1-K1-B7
gccgaacggcaacttagagctgggtccggccaagtcggagctggtgaacgggacggtggtgaagggcgggaaggcgatccccaagtgggagacgtcgggcttcgtggagtacatccagtccgggcacacgcagggcgacatgctgctggtggtgccggagggcgcctacgccgtcctgctcgggaacgatgcctacatcctccagcgcatccccgtcgcccggggctcctactacgccatcaccttcagcgccgcccgcacctgctcgcaggccgtgcgcctcaacgtctccgtcagctccgagtacggcgtgctcctcatgcagaccatctacggcagcaacggctgggactcctacgcct

SEQ ID NO: 4385 - DNA, 177 bp, Triticum aestivum
  Clone ID: LIB3281-012-P1-K1-B8
acgcccacgcgtacgcgcaccacccggaacccactgcaggggctagggttttacgcagatggccctcgtcgccgcagccgtcggagccatgatgctcctagcgcaactcgcgtccttctgcgacgtgtgcatatacggactaatgccccgtggtacacgcacaagacgacctaccac

SEQ ID NO: 4386 - DNA, 373 bp, Triticum aestivum
  Clone ID: LIB3281-012-P1-K1-B9
cgtgtgatcaaggatcgaccctttttcgtgtctcgaggatttgcttttattgacttccctactgtggaagctgcccgcaaaatgaaggaagctactggagacaatggccttctaattgatggtaggcagatattttccgagtacagtagtaaaccaactggtgggatgagtggtgattcttttggacaagaacatattacgaggtctacctacgggcgcaggaccatatccacacaatgtgattggatatgtactatatgtggctgtatgaattttgcccgcagaacctcctgttttcagtgcaacgagccacgtactgacgatgctccaccagctgatgcagcatcttccattcaaaccgttggcaaacggg

SEQ ID NO: 4387 - DNA, 266 bp, Triticum aestivum
  Clone ID: LIB3281-012-P1-K1-C11
cggacgcgtgggcccgaacttttctctttcaaagcaccgagaagcttgaggttattatgagcacggatgctatccaacagggactaaaatctcatgatgcacactcacgcgcacaaaacgcgaaacaacgtggcggtcgaacagcaggaggactcacaagcactatcttgaactacacagtcccaaaggcatggaaaacggccgcgagaggaaccaccatagctcatggcttggtgtgcaacacagggactccttccacaaacacc

SEQ ID NO: 4388 - DNA, 107 bp, Triticum aestivum
  Clone ID: LIB3281-012-P1-K1-C2
acgcggacgcgcgggcccgcccgcttttttaatatggctccttacaccggagcgggcggccgaccttcctcaggggtccacctccgcagccgacacacaagggccac

SEQ ID NO: 4389 - DNA, 352 bp, Triticum aestivum
  Clone ID: LIB3281-012-P1-K1-C6
gtctggtttggttgaatggaaatgccatagggaggtattggcccaggacaagtcctactgatgacaggtgcactccgagctgtgactacagaggaaaattttctccagacaagtgcagggctggatgtggaaagccaactcaaagatggtaccacgtcccaaggtcatggtttcacccatcagggaacacccttgtggtctttgaggagcagggtggagatcccacgaagattacattctcgaggagagtcgcgacaagtgtttgctcctttgtctcggagaactatccttccatagacttggagtcctgggataaaagcatctcagatggtaacccagtagcagcaaaagt

SEQ ID NO: 4390 - DNA, 360 bp, Triticum aestivum
  Clone ID: LIB3281-012-P1-K1-C7
cggacgcgtgggttacgcagcatgttgagtttgtcactcacgatgagaaaagaacctacctgatagatctcttacagaaacaatctttcacttcatctgatggcaagcctcagcagcctctaacattggtttttgtggagacaaaacgagaagctgattcattgaggtattggctatacaacaaaggtttccctgcaacagcgatccatggtgacagaacacaagaggagagggaaagcgcactgagatctttcaagtctggcttgaccccggtcatggtcgccactgatgtagtcgcgcgaggcctggatgtcccaaatgttgctcatgtcatcaactatgatcttcccaagagcatag

SEQ ID NO: 4391 - DNA, 370 bp, Triticum aestivum
  Clone ID: LIB3281-012-P1-K1-C8
cgctcgcccgcccgcgccgccgccgccgcctccttccgcaggagctccctccccgcaggcgcgatggtgtacatcaagaaccagaagacaagggcgtactccaagcgtttccaagtcaagttcaagagaaggcgccaggggaagaccgactacagggccaggctgaggctcacaaaccaggacaagaacaaatacaatacccccaagtaccgttttgttgtgcgatttaccaacaaggatgtcactgcacaaattgtgtatgctaccattgctggtgatatcgtgatggccgctgcctactcccatgagttgcctcgctatggtcttgaagttggcctgaccaactatgctgcagcctactgcactggtc

SEQ ID NO: 4392 - DNA, 353 bp, Triticum aestivum
  Clone ID: LIB3281-012-P1-K1-C9
cctaactcgtgccgtgcgttgcgttgtccccccgggtcccgattggcgagacggtccgcgctgcgcaaccgccggagatctcagtcgtcgacccgctaccgcgcgctcccagcgaacccgagcggcttaccccaaaggagacctgcccgtcggtgaagaacattgtgttgctggactccgaggggaagcgcgtctgcgcaagtactacacggatgattggcccgtgctctcagagaagctggccttcgagaagtcggtcttcgtcaagacccacaaagcaagttctggagcataggctgagattgtaatgtttgatggtcaaattgatgtatataagttcatccaagacctgc

SEQ ID NO: 4393 - DNA, 378 bp, Triticum aestivum
  Clone ID: LIB3281-012-P1-K1-D1
ctcaaagatacacaacagactttgttgagaatgtctcggacatcgacacgaactttgacagtgatggcgatatcatgggtgaagctgtctatgacgaggagtatcttagaagtcgaaaacaacccaaggcaagtacttcagagtacgatggagagtttcgatcagaagaccaagcggagtattctttgagcagtgaagatgaagaggggattcaacggtccaaaaggttgccaagccgcagccctcaagggaccaggctgaaatccatggatgtaatccaaacaggcatcaagcgaaataagcgttctgcccggccccatatgaaccatcagcgatgctctggtaaagattccggattgggaaagccaggtgaattga

SEQ ID NO: 4394 - DNA, 375 bp, Triticum aestivum
  Clone ID: LIB3281-012-P1-K1-D10
cgctgggaccccgactccccgtcgaccaagccccacctcaaggactacaaggtggacctctccgactgcggccccatggtgctcgacgcgctcctcaagatcaagaacgagcaggacccgtccctcaccttccgccggagctgccgtgagggcatctgcggcagctgcgccatgaacatcgacggcgacaacgggctggcctgcctcaccaagatctcctcggaggcggccggggcctccacgatctcgccgctcccccacatgttcgtcgtcaaggacctcgtcgtcgacatgaccaacttctacaaccagtacaagagcgtggagccgtggctcaagcgcaaggacccgccgtcggccggtgggaaggagatc

SEQ ID NO: 4395 - DNA, 367 bp, Triticum aestivum
  Clone ID: LIB3281-012-P1-K1-D11
cggacgcgtgggtcctattgtgactcactgttggattcgaggacgctgaggttacgatgattacaggatgctgtacaagagggactgaaatctgatgctgctgaacctcgcgcaccaagctggaatcaatgaggctgtcaaatagcaggatgctctaaagcataacattgaactgacaggccaaaaggcatggaaatctgacgtgagcggacccaccatagctcaggccttggggttctacagagcgacgagttgcacaaataccattgtcacgagcaggcgccgctacgggagtggacactactgcgcgaccataagcgctgccaagagcactatcgcgctactgacaatatggatgcagatgaat

SEQ ID NO: 4396 - DNA, 376 bp, Triticum aestivum
  Clone ID: LIB3281-012-P1-K1-D2
cggacgcgtgggcaagggctacgtggacatgtccactgtcgatgctgcaacttcttgcaagataagcgaggcggttaaacaaaagggcggagcttttgttgaagctccagtttcagggagcaagaagccagctgaagatggccaattggtcattcttgctgcaggcgacaaggcactatatgatgatatggtccctgcatttgatgtacttgggaagaagtcgttctttctgggggagatgggaaatggagcaaagatgaaactggtggtcaacatgatcatgggaagtatgatgaatgctttttctgagggactctgtttggctgacaaaagtgggttgagcccccagacgcttcttgatgtcctggatctcggt

SEQ ID NO: 4397 - DNA, 306 bp, Triticum aestivum
  Clone ID: LIB3281-012-P1-K1-D3
cggacgcgtgggcaagggctactcttatttttacacttgggatcctcgagctgagggcaagataagcgaggctgttaaacaaaacggcggagcttttgaggaaactgcgatatcggggggcaagaagccctctgaagatggccaatttggttattcttgctgcaggcgacacggcactatattatgatatggtccctgcatttagtgtacatggaaagaaccctgtctttctctgggagatgcttaaaggttcaaagatgtaactggtggtcatcatgatcaatgggcagtatgatgaatgctttt

SEQ ID NO: 4398 - DNA, 379 bp, Triticum aestivum
  Clone ID: LIB3281-012-P1-K1-D4
cggacgcgtgggcggacgcgtgggcagtcccattcaggcatggagagcgcattggcttcagttacctagtttcacagaagtatactggtgagaaggcacgtgtcaaagttctccggaattcgaaaattcatgaattcaacataaagctctcaatccacaaaaagctcattccagctcatataaagggcaggccaccgtcgtactacattgttgcaggctttgtttttatggttgtatctgttccatatcttcgatctgagtatggaaaagattacgaatttgatgcccccgtcaagttgttggacaagcatttacatgcaatggcgcaatcacctgatgagcagcttgtggtggtctcacaggtgcttgtggcagatat

SEQ ID NO: 4399 - DNA, 147 bp, Triticum aestivum
  Clone ID: LIB3281-012-P1-K1-D5
attgttactttccgcaaccttcaggagactggggctatattattcacgatcatccacaagtaggactaaaattttatgcattcaagctcggggtctaagcttctatatacgatggtctcaaatcagatgatagcctaaaacattaca

SEQ ID NO: 4400 - DNA, 252 bp, Triticum aestivum
  Clone ID: LIB3281-012-P1-K1-D6
gggcccccaaaccaacttttatttttattgggggcacggatcagcgaaccaaatgcatttttggatccctgggggaaaaaagagggggcagttcaagtttatatcaaaaaaggcgtttttttaaaaatccagcattcggcccctaaggagggcccccgcctttttgacttcctttacggggccaaagaagaacaccctattgggagggccctttgccccaccgatatggatttcaacattgcaagaattttt

SEQ ID NO: 4401 - DNA, 371 bp, Triticum aestivum
  Clone ID: LIB3281-012-P1-K1-D7
gggaagcttcgcgacgctcgccaactggctgacctcctttgggataacaatgacagcaaacttgctgctcagctggagtgctggaggtacctttgtgtgctacacgcttgtgagcgcgttcacgctcgtgttcatcatcctctgggtgccggagaccaagggaagaactctcgaggagatacaatggtcgttccggtgagcttggttgtttccgtcgaatgtatgtcggaattattttcaagtcgggcattgtcttctttttactagtctgattgctcgatggaggccaatcagacaacagttattgtgtgtatacaagtatattcctgtacaggattgtttcagttgactttgtatagaaaggacatgtc

SEQ ID NO: 4402 - DNA, 372 bp, Triticum aestivum
  Clone ID: LIB3281-012-P1-K1-D8
cggacgcgtgggcggcgacgcatcattaatcatcggatcagcgagcagagcccgcgtcagccttttatctaataaatgcgcccctcatcttcggagaagagagagagagagaggggcagggcggccagaggaggcacgcctgcccggatcataaccaagattcaaatttgcccgctcatcaatcatggttcttgattcattatcatcgcctcacaggaggtcgcaaaacacattctttctgtcatctcctaagaagcctcaatcatctcgtgatgatgttggtagttggtctgccctggttgagcggcatcgctttctcttgacaacgctagtggtgcttgccttcctgtgcaccatatatctttacttcgc

SEQ ID NO: 4403 - DNA, 211 bp, Triticum aestivum
  Clone ID: LIB3281-012-P1-K1-D9
cgcacgcatccgcactctcttttgtttaagcaccacctcaaggacgagagggaggacctgcccgactgcgaccccatggtgctcgaatcgctactaaagatcaagtacgagcgggacccgtccctcacctgccgaccgagctgtcgggagggcatctgaagcagttgagccatgatcatcgacggagacaactgactggaccgccttacca

SEQ ID NO: 4404 - DNA, 357 bp, Triticum aestivum
  Clone ID: LIB3281-012-P1-K1-E1
ctgacacatgcacaacggccacttttttttgtgcactggacatgctcacggggggtgacagataaggcgagctgatgaacaaaacggcctatctctaggagtatcttcaaagtcagggaccacgcaacgagcttactacagcctactggtgattgttgctacccgcgaaacgggcatatttcatgctacgccaccaaacacaaattgtgcttgcaaagaaccaaaacgttgtcagaggcgatggcctaacggagccaagctgaaactcatggatgacatcctcacgggcattatgcggaatactcgttctgcccggccctatatgagctaacggtgtggctctgagcaccccacacg

SEQ ID NO: 4405 - DNA, 378 bp, Triticum aestivum
  Clone ID: LIB3281-012-P1-K1-E10
cccacgcgtccgcccacgcgtccggggcagggcagcgcggcttctgctgcacactacgggctccagtcacagatgatggcacagccaaggcaaaaaggcatggtacaaggtgcacaatttaatactgccaacgcagctcaagcgttgcaagggatgcaatccatgggagtcatgggtactttggggatgaaccagatgagaccaaatggaactattccatatgctcaacaacgctttgcccaggcccaaatgaggccgcagcaagcgtcgcagcaagctgcactatctccgcagaagggggttgctcaaggcttgtcgagaacagcatcgatcacaggattaaactcacaactgcctggagtgtcacaaaatgggcag

SEQ ID NO: 4406 - DNA, 375 bp, Triticum aestivum
  Clone ID: LIB3281-012-P1-K1-E11
cacatttcttgatgccagatacttttagctgttggcacattattcagttgctagttgtctgtcccactggatgctgtgcgtcttttagcagcccagtactcatttgtaggaagggtggcatcactttgttggttgttcttgaaggtcagtaagaccatgtattgattgatcttgtatgctgccatggatactttgcaagtggtgattttccaaggttgttgttaccatggaggtcaacgggcgtcacaagcctacaagagagtatgtcgacagagggtgcaatggtgtaaaaccacacaataattttggcaaagttgatccctggacggcgtgggcgtacagaccgcggaccatctcgttgttgctgatgggtat

SEQ ID NO: 4407 - DNA, 379 bp, Triticum aestivum
  Clone ID: LIB3281-012-P1-K1-E12
ctcacacatctcaccaccttttcttccaatcccacccgaagcggcagccatggcccccaaggcagacaagaagcccgtcgccgagaacaaggtggagaaggcggcggagaaaacccccgccggcaagaagcccaaggccgagaagcggctgccggcgggcaagacggcgtccaaggaggccggcggcgaggccaagacgaggggccggaagaagggcagcaaggccaagaagagcgtcgagacgtacaagatctacatcttcaaggtgctgaagcaggtccaccccgacatcggcatctcctccaaggccatgtccatcatgaactccttcatcaacgacatcttcgagaagctcgccggcgagtccgccaagctcgcg

SEQ ID NO: 4408 - DNA, 377 bp, Triticum aestivum
  Clone ID: LIB3281-012-P1-K1-E2
ggggcacatccccaactaccccaacctgttgccgcagctcatctgccagctgcacgatgtcacaatgcatgctgatgtggagaccgacgaagtgtacgcgcagatgacgctgcagccgctgaatccacaagagcagaacgacgcctacctgccggcggagatggggatcatgagcaagcagccgaccaactacttctgcaagacgctgacggccagcgacaccagcacgcacggcggcttctccgtgccccgccgtgccgccgagcgcgtcttcccccctctgtgtggtttgtaggatttcacgcagcagcctcctgctcaggagctaattgcgcgggacattcatgatgtggagtggaagtttaggcacatcttcc

SEQ ID NO: 4409 - DNA, 329 bp, Triticum aestivum
  Clone ID: LIB3281-012-P1-K1-E3
cggtgctctgccagccaacgggtggcaaggccaggctcaccgagggttgctccttccgccgcaagggcgactaaacagaagtctatctttaaaagcaagccgatgttgaactctagtttttcaggggtgttggtctgaaaattttgcaatgtctggcaaattgaatccatctttggtaatttggtatctagctcgagcaatattccgtttgggctgtgagatcagactagtagtacctgccaggtaatatggtggtctgatgaattgttgttcctaatgatgctgtttgccctcgctggtatatgactcttgaatcgtttgttgcttgt

SEQ ID NO: 4410 - DNA, 379 bp, Triticum aestivum
  Clone ID: LIB3281-012-P1-K1-E5
ggggaagactcatggtctccttattgaaggagggcttacacaagaagctataaagaaatcggtggctgatgctgcaattgcttttcgagatggagtggtggagctgttcgaattcttggaggctagagatattccagtgttagtcttttcggctggacttgcagacataattgaggaggtcttccggcagaaactccaccgatcattcaaaaacatcaagattgtctccaacaggatggtctttaacgaagagggttgtcttgtagcatttaaagggaagacaatccatgttctaaacaaaaatgagcattccttggacatggcagctccggtgcatgacagtctgggggatccaaacgggtctgttgatgactattca

SEQ ID NO: 4411 - DNA, 372 bp, Triticum aestivum
  Clone ID: LIB3281-012-P1-K1-E6
cggacgcgtgggttttttttttttttttttttttttttttttttttttttttttttttttttttttttttttttttttgccaccaacgaactagaataatattttactaagacggggcatcggggcccatttaatccacgaatgttccaacccgcacggaataactgggcccactgggggcgaaacaaaaaccataacaaccttaagtttgggttaagagacgccataataataactagcagcaggctttggcgcctccaccacaaaacatgggctggttagtccacctcctaaattttggggccggggcccccggacccagatggggggttgatgaccatgccgccctccatgtcaggaccagcaccctgg

SEQ ID NO: 4412 - DNA, 328 bp, Triticum aestivum
  Clone ID: LIB3281-012-P1-K1-E7
gcagggactacagacggctatgcagttcagctcagttgttacagactggaagctacaacagttacaggcatagcacagacgcatttcaaagacaccgctgatcgctgtgacccttgaagtagagatcatccaggcgacgacaccaaaccaaatcacacgaagaaacaatacacatactgaaactgggaaatggtgacggagcagtagatctatggtgtaggcaaaccggataacatgcatattgaccaaggtgcgaagcaggttcatacaacacaacaggttgtaaaccaaacaccccacagcaaacattcaattcaaacagacagaa

SEQ ID NO: 4413 - DNA, 371 bp, Triticum aestivum
  Clone ID: LIB3281-012-P1-K1-E8
cggacgcgtgggcgaatctagagctcaggtgaagaggaggtagccggcggcgggcgagcggccaagtctctcaggtgtcttcgacgatggggttcatctcgggggtggtgatggggttggtggtcggcgtcgtgatcatggccgggtggagccgcgtgatgcagcggcgcagcaggaagcgcgtcgccaaggctgcggatatcaaggtccttgggtctcttggcagggaggacctcaagaagctctgcggcgacaatttccccgagtggatatccttcccacagtatgagcaggtgaaatggctgaacaagcatctcagcaaactttggccttttgtttcacaagctgcaactgcagttgttaaggaatct

SEQ ID NO: 4414 - DNA, 94 bp, Triticum aestivum
  Clone ID: LIB3281-012-P1-K1-E9
cgcacgcgtgcgccaacctttttctcatatgaagaggaggtatccgggggggggcaagcggccaagtctctcatgaggctacagaccatgggga

SEQ ID NO: 4415 - DNA, 141 bp, Triticum aestivum
  Clone ID: LIB3281-012-P1-K1-F1
ggggcacctggggtactaccatgcaggggggatatctaaaatctgtcttaggcaataatggtaacttctcgacaaaaatcggtcggcttgccctgaaaccagattgtgattggtgtatgagtaaaaaatggcagcattttc

SEQ ID NO: 4416 - DNA, 378 bp, Triticum aestivum
  Clone ID: LIB3281-012-P1-K1-F10
agagaggagagcgtccacactccgcagcagccatggccaaggaggtgagcgaggagccggagcacgccgcgccggcgcacaaggactactccgacccgccgccggcgccgctcttcgacatgggggagctccggatgtggtccttctaccgggcgctcatcgccgagttcgtcgccacactgctcttcctctacatcaccgtcgccaccgtcatcggctacaaggtgcagtccgcggccgacccgtgcggcggcgtcggcgtgctcggcatcgcctgggccttcggcggcatgatcttcgtcctcgtctactgcaccgccggcatctcggggggccacatcaaccccgcggtgacgttcgggctgctgctggcgcgca

SEQ ID NO: 4417 - DNA, 381 bp, Triticum aestivum
  Clone ID: LIB3281-012-P1-K1-F11
cccacgcgtccgcacaccaccgttttccccaaccccacccgaagcagcagccatggcccccaaggcagacaagaagccggcggccgagaacaaggtcgagaaggcggcggagaagacccccgcggggaagaagcccaaggccgagaagcggctgccggcgggcaagacggcgtccaaggaggccggcggcgaggccaagacccggggcaggaagaagggcagcaaggccaagaagggcgtggagacgtacaagatctacatcttcaaggtgctgaagcaggtgcaccccgacatcggcatctcctccaaggccatgtccatcatgaactccttcatcaacgacatcttcgagaagctcgccggcgagtcggccaagctcgc

SEQ ID NO: 4418 - DNA, 368 bp, Triticum aestivum
  Clone ID: LIB3281-012-P1-K1-F12
cggacgcgtgggtggtcaaccactttgtccatcctgttatcaaagtcctcaccaccaaggtgagtgtcaccagcagtggacttgacctaaaagatgccctcttcaatggtgagaagagagacatcaaaggtgccgccaccaaggtctcctgatggttggatggggctggacatttgcccacattcagttaaaacatttaatggtgccctggacacaacacaaacaattatttggaacggaccaatgggtgttcttgaatttgacaagtttgcagtaggaactgagtctattgcaaagaagttggccgagcttagcaaaaagggtgtgacaactatcattggaggcggagactccgttgcggctgttga

SEQ ID NO: 4419 - DNA, 371 bp, Triticum aestivum
  Clone ID: LIB3281-012-P1-K1-F2
atctatgtctgtatggtcttcccaatgaaacatgggaagtgaacttgcctgcagaggaggttcccccagaacttccagagccggcactgggaattaattttgctcgggatgggatggatgagaaagattggttgtcacttgttgcggtgcacagtgatgcctggttgctagcagtagccttctactttggagcaagattcgggtttgacaaagaatccaggaagcggctttttagcatgataaacaacctccccaccatatatgaggttgtcaccggaactgcgaagaagcaggtcaaagaaaaacaccccaaaagcagcagcaagataaataaatctggcactaagccatctcgccagccagaacccaac

SEQ ID NO: 4420 - DNA, 333 bp, Triticum aestivum
  Clone ID: LIB3281-012-P1-K1-F3
cccacgcgtccgcggacgcgtgggctcgtccaagaacgcgtgggaggacgcggtgcctctgtcgcggaagacagaggcctcgcccgcggacgcgcaagcgcgacacgacgacgacgacattgacgaggacatggacggcgaaggcgacggcgcggtctattacctgagcaagtccggcgacgtgatggtgtccagcacgcagcgcagcgcggcgaggcagtactcgtccgccgtgacgtgccgcagcgacggcggcgaggccgtggcctacttcctgagccactcgggcgcggtcgtggcgtgcgacctggctcgccgcgtgttcaccgagct

SEQ ID NO: 4421 - DNA, 382 bp, Triticum aestivum
  Clone ID: LIB3281-012-P1-K1-F4
cccatgcgtccgcgaaaacagaaactcgtgtgacgtgtgccttcccgtgcgtctccgagggcgacagcgacagggaaggaaggaaggaaggggatgagctccgccgccgccgcctcctcgtcggcgtcgccggtgccgccggaggacgacgtctgctccgtctgccacgaccgcttccggatcccctgccaggccaactgctcccactggttctgcggagagtgcatcgtccgtgtttggaatcatggagctgctgtacagccttgcaagtgtcccatttgccgccgccttataaatctgctggtacctgctaatgtatcagacgatcagaatgatgatccccagcttcagcgtgttttgggagagattcagcactacaatc

SEQ ID NO: 4422 - DNA, 382 bp, Triticum aestivum
  Clone ID: LIB3281-012-P1-K1-F5
gggagctgctcatggccttccggcgcgcggtcaccgcggacccgctcggcgcgctccgcggctggagctactccgacgactccgcctgcgcctggaacggcgtcatctgcaacgggttcccgcagcagcaggcatccacggtcaacctcacctccgcctcctccgacggaaacgggaacttcagcacgctcgccggcggcagggcgaacggcacgctgctgggcctcaacgcgtccatggcggcggccacggtgtcgcgggtcatcggcctcgtcctccccggcgcgcagctctccggctcgctccccgccgagctggcccgcgtcgagcacctgcgccacctcgacctctccgggaacggcctcaacgggaccctccccgc

SEQ ID NO: 4423 - DNA, 257 bp, Triticum aestivum
  Clone ID: LIB3281-012-P1-K1-F6
cccacgcgtccgcccacgcgtccgtccctaaccctaaaccccagcccctcccccgccgtcgaccccatcgccgccgacggctcctcctgccccggagactggtacgtcgggcgcgggccctcgcaccggcaggcaaacatggccaatcagaccttcccgtcctgcaaaacaaactggaacgtgaccagactcgaagacatgaagcttgaacgtaacgatgtcgatcaacaaaaaaaccatggaggggcccacatgat

SEQ ID NO: 4424 - DNA, 299 bp, Triticum aestivum
  Clone ID: LIB3281-012-P1-K1-F7
ctggcgggtggacggtccaatcttacaggaccatccactgacatgtgtaacgacgaattttatactatgcatcagcagttatacctgctgcagggcgaggcgtgaaaggggactacgccgaatgatgtgttgctcagcaaataaaaggagccgctgatctccattgcctattggtggcctgctactggtctaatgtagcctcgcgctgttcaagaggagagactctgtcatgaataaggatgatgcagattacctacgatgcatctcatgtgttagaatgggcgccatgatcgactgca

SEQ ID NO: 4425 - DNA, 359 bp, Triticum aestivum
  Clone ID: LIB3281-012-P1-K1-F8
gctcctttgcttccgcccggccgtttctctagggtttaacgccatggacgtcgaggacgagctccagaccgcccccgcgcccgcggacggcggagagtcctcgcacgcgctggtgtccggggaccagttggacgtggaggcgtacgcggcgcagtactcggggcgcacgcgcgtggggcggctcctcttcatcgcggagaagtgcgggtcggagcagatgcggctggatgcgctccggctggcctacgactgggccctcaagggcgaggacacggccctccaccgcgacgtcttcgccaagatcgccggccgccttggcccccgctacgccgccgaccagccctggtccgacgcggtcg

SEQ ID NO: 4426 - DNA, 374 bp, Triticum aestivum
  Clone ID: LIB3281-012-P1-K1-F9
cggacgcgtgggcggacgcgtgggtacatccggaaaccaccaccagcttctgcgattgcatcggtcttccaccaacgcctcgcttcatcggaaccggaccccgatgacgtacccaccgatatggcacgcggcgctcggctgctcccgctggtgccgccgccctttgcttcttaccattgatcgccgccgaagcttcgacgcccggtgtgcgctctacggcggggataggatcttacaactcattacggtcgtactagtagttgtcgctcgacgatagctcctggtagaagatcggcttgtggatgatgcatgccaaggcggctcagtattgctgcatttctaaatacagtagagcccgggtgtatattgatgcc

SEQ ID NO: 4427 - DNA, 247 bp, Triticum aestivum
  Clone ID: LIB3281-012-P1-K1-G1
cccacgcgtccgcggacgcgtggtttttatgttctggatggagccaaactggggggttttcactggatgcgcaaccagtaacacttgtaaccttaacgtaacaaaccatatcataagaggggaagctgatcttatgcttattggtgaatattatgcactctcccatactaattgtattggaaggttttgatgccatgcatagttcttttacatatgaacagtgacccaataaaagctttccgtccat

SEQ ID NO: 4428 - DNA, 262 bp, Triticum aestivum
  Clone ID: LIB3281-012-P1-K1-G2
gaacccccggggcgagccaagcgacccatcacgcctccgaccacacgaccttttattttgatcaaaaagacacacaaggggggggggtttttgacaggagtctcacgacgcctgcactgagaatgacaggactgataaagacatcacccctatgggtggctttccttactatggagaggtgaagggtgactaccttatgatcaaagtctgctgtgagggccccaaaaaaagagtggttgaccctcacttcagtccctgttaa

SEQ ID NO: 4429 - DNA, 375 bp, Triticum aestivum
  Clone ID: LIB3281-012-P1-K1-G3
atccctcccacagaaaaatccccaattccttcgtcttcctcttcgcggacgcacacagcagagcacacagcgagaagatgtccgggcgcggcaagggcggcaaggggctgggcaagggcggggcgaagcggcacaggaaggtgctgcgggacaacatccaggggatcaccaagccggcgatccggcggctggcgcggaggggcggcgtgaagcgcatctccgggctcatctatgaggagacccgcggcgtgctcaagatcttcctcgagaacgtcatacgcgacgccgtcacctacaccgagcacgcgcgccgcaagaccgtcactgccatggacgtcgtgtacgcgctcaagcgccagggccgcaccctgtacg

SEQ ID NO: 4430 - DNA, 379 bp, Triticum aestivum
  Clone ID: LIB3281-012-P1-K1-G4
cggacgcgtgggggttggatggggctggcaacatctctccttgcaaaggcaaaggcaaagggtgtctcccttctgttgccatctgacgttatcattgctgataagtttgctcctgatgctaacagtcagaccgtccctgcatctgcaattcctgatggttggatggggctggacattggcccagattcagtcaaaacatttaatgatgccctggacacaacacagacaatcatttggaacggaccaatgggtgtctttgaatttgacaagtttgcagtaggaactgagtctattgcaaagaagttggccgagcttagcaaaaagggtgtgacaactatcattggaggcggagactccgttgcggctgttgagaaggtgg

SEQ ID NO: 4431 - DNA, 382 bp, Triticum aestivum
  Clone ID: LIB3281-012-P1-K1-G5
gcgccaagctcttggtgagaggattaggcccgtcctcaccgtgaacaagatggacagatgcttccttgagcttcagtttgaaggtgaggaagcatatcagactttctcccgtgtcatcgaaaatgccaatgtcatcatggcaacatatgaagatgtgctccttggtgatgtccaagtgtacccagaaaaggggactgttgcattctctgctggtttgcatgggtgggctttcacccttacaaactttgctaagatgtatgcctccaagtttggtgttgatgaggtgaagatgatggagaggctgtggggtgagaacttctttgacccagccacaaagaaatggaccaccaagaacactgggacagctacctgcaagagaggt

SEQ ID NO: 4432 - DNA, 385 bp, Triticum aestivum
  Clone ID: LIB3281-012-P1-K1-G6
cccacgcgtccgccaacccccaagcaccataacctcctcaacatccccgcgcatcgacgacatggcccgcaccaagcagacggcgaggaagtccaccggcggcaaggcgccgaggaagcagctggcgaccaaggccgcccgcaagtcggccccggccaccggcggcgtgaagaagccccaccgcttccgccccggcaccgtcgcgctccgtgagatccgcaagtaccagaagagcacggagctgctcatccgcaagctccccttccagcgcctcgtccgggagatcgcccaggacttcaagaccgacctccgcttccagtcctccgccgtctccgccctgcaggaggccgccgaggcctacctcgtgggcctcttcgaggacacc

SEQ ID NO: 4433 - DNA, 245 bp, Triticum aestivum
  Clone ID: LIB3281-012-P1-K1-G7
ttttattagctctagtaggttgtatgtctgctggtggtgccattggggtgggagctctgacatgggagtcgtattatctgcatgacattctctacttcacatgaatgctgtttgcaccagaactgacatgatcagtatactcaacaatagcctaagggctttggctgctagcgtgcttgtagatggtgcaggtttatattacctctcaaatcgcttgtcttagattaggatgctagctagcgcta

SEQ ID NO: 4434 - DNA, 195 bp, Triticum aestivum
  Clone ID: LIB3281-012-P1-K1-G8
aattaaagggggaaaaggttgaaaaaaaattttttttttgggggaaaaaaggaaaaaattttattttccaaaaggggaaaaatttttttgcaaaaaaaaaccaattgggtgggaattggggggggcaaacccccccccggggaaaaaaaaacccgcctttttttaacctaaggggcttgggggttcccaaagggg

SEQ ID NO: 4435 - DNA, 96 bp, Triticum aestivum
  Clone ID: LIB3281-012-P1-K1-G9
cggacgcgtgggcggacgcgtgggtacagaacgcgaaaacccacccgggaggcgaaaaaatgccagaggacccacaccgcacgcagcatgagcaga

SEQ ID NO: 4436 - DNA, 376 bp, Triticum aestivum
  Clone ID: LIB3281-012-P1-K1-H1
attccgatctcgctctatgtctcaattgaagttgtgaaggtggcacaggcacatttcattaatcaggacattcatatgtttgatgaggagactggcaatactgctcaggcccgaacttcaaacttgaatgaggagcttggccaagttcatacgattttgtcagataaaaccggcactttgacctgtaatcagatggatttcttgaagtgttcaattgctggggtttcttatggtgtgcgtgcgagtgaagttgaaagggctgctgcaaagcagatggcatcaggcgctgctgaccatgataatcctgtggaagatgtatgggagagtaatgaggatgaaatccagttagtggaaggagttaccttcagcgtgggaa

SEQ ID NO: 4437 - DNA, 361 bp, Triticum aestivum
  Clone ID: LIB3281-012-P1-K1-H10
ccgcattgcattggtgccactcggaccctgctcgtgtctggacgtgtgcgtgtctgggtcgtcgtgggtaccgcgaacgactgggtcgtgtcgcagctcgatttccattctgctttgccgatcgccatgggcaaaactcccaaaatgattcgattcaccaacccgggtttgaccaaaatgtagcttgacctgccaggtttgggggagaactcgcagcctgatttcgtcaattctgaatccatatcattgatcggacattgtgagaacttgagtcatgtggtgtttgtaagtgatcgatgctagcgcgctctaatggcattgttgtgtggtgtttgtaaggggctgatgctagggatttcta

SEQ ID NO: 4438 - DNA, 379 bp, Triticum aestivum
  Clone ID: LIB3281-012-P1-K1-H12
cggacgcgtgggtttttttttaaatcatgaatcatcttatcttaagaggcaggtaggagctgagagcatacatgcatacatacatacatacaaaaaggagagaccagaccagaccagaccagaccatgtatatatgctcggctgctttcctttgcccatcatcctcatcctcctcctaacattacattatattggtttagttagttattcaaaagaccagacagactcaatctgaatcatcatcttcatcatcatcatcatcttctggagttagagcagacacacagaaacagcacatgtacatacacaacacatacatggctgggagcagcagcacacaacaagacattttgactttcatttacacccaccaggtagg

SEQ ID NO: 4439 - DNA, 266 bp, Triticum aestivum
  Clone ID: LIB3281-012-P1-K1-H2
attacgctgtggatcaaagggatttttttttttgggggtcaggcaccaccgcatcacattgatcatgacatggatatgtttgcttcaaggaataggaatgcggttccagcacatgacttgaactcaattaaggaggaaggatggcagatcatattgtgtgagagtgcactgacgatataccatgacatacagtggatatattgcagggattaatagagaggctcgattatgctgtgactacgactgaggttattaaaaattgttaa

SEQ ID NO: 4440 - DNA, 379 bp, Triticum aestivum
  Clone ID: LIB3281-012-P1-K1-H3
cttctactgtggaccggagggatcaatcctcccggaggtcagggcacacggaagcacagggagcgtgatgaggggagggatgcgtcaagggataggaaggtggagccaaaagatgataggagtgccttcacaggtagaagactggacgatgatgatgatggaaggggtcactcaagagatagaagaactgacagggatgataggtcaggtgcttcgagagaggcacgatcaggccgggacgacgacagacatgattcaaaagggaaaaggtcagacccggaccgaaaaggtggttccagggagcaaaggacagaccaaagtcccagaagggattccgtgggagatagaatggcagaccgggatgagagcaatggtggat

SEQ ID NO: 4441 - DNA, 342 bp, Triticum aestivum
  Clone ID: LIB3281-012-P1-K1-H4
cggacgcgtgggtttcaagcaacttaacatctttaggttcagttcccatctctattaatttgatggatgggtgcacccatacacccatagaggccttctgtcattacttcacaatatgacacttgaattcagtcaggttggtggacagtacaatttcatatagcagcagcagaacaggaacaaagatacattaggtgtaacaagcggagatagctccaacatcatcctacacctaggctcacaaggtcagcccattgcatacttctgggttcagctgctcgctgcggactcatactttgcacgatcactgttggacatgtgtgcaatctcctgaaccaacgg

SEQ ID NO: 4442 - DNA, 369 bp, Triticum aestivum
  Clone ID: LIB3281-012-P1-K1-H5
cggacgcgtgggaagaggttcctccaacttgactgccgtttcgtcaaggatctcactgtccctgatggaacacgaatggcgccatcaactccatttcgtaagatttggtgcatgcttaacaatggaaatatcgtatggccttatggaacccaccttgcctgggttggtggagatcaatttgctcgccaaagcttagtgaaattagcgattccagaggctggtttccccttgaatggagaaatcgatgtttgtgttgactttgtttcacctgcgaaacctggtaggtacatatcgtactggagactaacatcgccagacctacaaaaatttggtcagcaagtttgggttcttattgaggtggaagagcct

SEQ ID NO: 4443 - DNA, 254 bp, Triticum aestivum
  unsure (1)...(254): unsure at all n locations
  Clone ID: LIB3281-012-P1-K1-H6
tgcgcgtgccggtaccggtccgccgtgtcgacctcaggcgtacgcccacgcgtccgcggacgcgtgggtgttgtcgccgccgccggcggggatgcccttgcggtggagggtgtatgccctctgccgctggcgcccctgcttgtacctagatggttactctttccgtccattgtcaccggctaacattgtgataatatcagtctgggtaatgttaaaaaaaaaaaaaaaaacaaaaaaaaaaaaaagaagtntat

SEQ ID NO: 4444 - DNA, 361 bp, Triticum aestivum
  Clone ID: LIB3281-012-P1-K1-H7
cggacgcgtgggctctattgtatccagaaattgtggttcaaatatttcatttcatacagcttatgctagttttatgtaccattattattcttttgctattgttttcttgttctaacttgatctaattcatttgtctttttcctaggctttgaactttgcattcaaggattacttcaagaggatgttcaacttcaagaaggacaaggatggttactggaagtggttcggtggcaaccttgcttctggtggtgcagctggtgcttcctcgctgttcttcgtgtactcccttgactatgctaggacaaggctggccaatgacgcaaaggcatcccaggggtgaggtgagaggcagttcaatggc

SEQ ID NO: 4445 - DNA, 375 bp, Triticum aestivum
  Clone ID: LIB3281-012-P1-K1-H8
ccaataactcacaaacgtctcattgagaaagagcttgagggatttggcatccggttgaacaagacacctcccaatatgacattcaggagaaaggaaaagggtggcatcaattttacatcaacagtagcgaacacacacttggaccttgacacagtaaaagcaatctgtagtgagtacaggattcataatgctgatgtctccctgagatttgatgcaacagcagatgaccttatagatgtcattgagggaagtagaatctacatgccttgcatctatgtcgtcaacaaaatcgaccagatcacagttgaagagctggatatcttggacaaacttccccattactgcccaattagtgcacatctggaatggaacctt

SEQ ID NO: 4446 - DNA, 258 bp, Triticum aestivum
  Clone ID: LIB3281-012-P1-K1-H9
gccagcggtgagttccacatcagctagctgatgggggtgcttcactggcgtgagaaggccacagaccggggataaaatttgtcatatagtttgtagtgtgtggttttgttctcgagtttttctcttcattattgtctcgattctgcaacagtgtaaattaccaaagtggttccgtcgctgtctttacaatgactgattaagctagcattgcggaaacataatgtatggaataaatcatcttattgagcatgttcttgc

SEQ ID NO: 4447 - DNA, 317 bp, Triticum aestivum
  Clone ID: LIB3281-013-P1-K1-A1
acgcccacgcgtgcgctgtcgcacgctctattggctatggacagaatagaatgggagcttagctgtttgaactttctgtaatggtgtcgctttccctattaccctcagcgccattattgggtggagcgggtgggtctcctgcttcttgacccgggggaccaagattgagggctcacagactgctttcatgaggggcgctgtctgcacatttgctcttgaaccatgcatacggggcgcggtagtgacgtattggtgccacttatgacattgccataaactgaatcacatcaactcctattgccttacttacaaagcct

SEQ ID NO: 4448 - DNA, 432 bp, Triticum aestivum
  Clone ID: LIB3281-013-P1-K1-A10
ctcttttctcccaccaatctctctggcttgctgcttcacgataatcgaccagttctctagtctttctccctctgttcctctctgctctgctctctgactcgaactgcaacaatggctgccccgacctctgcgatcgggtttgagggctacgagaagcgcctcgagatcaccttctccgaggcatcaatctttgccgaccctcatggttgtggcctgcgcgccctctccagggcccagattgactctgttcttgatcttgcacggtgcaccattgtgtccgagctctccaacaaggacttcgactcctatgtgctatctgagtcgagcctgttcatctactctcagaagattgtgatcaagacctgtgggactaccatgctcctgctcaccattcctaggattcttgagcttgctgaagagctgtgcatgccg

SEQ ID NO: 4449 - DNA, 432 bp, Triticum aestivum
  Clone ID: LIB3281-013-P1-K1-A11
cacctctacagaagcagcaaatggagctgcaatattatggaaattgtgccattaactctcttcatctgcactgattggtggcaaggaaggggagagcaacaggttcatggtttgataaattcttggaggcttccattatgtgcataaactgtgaggaccactgctggggcttcctaagctcacttctatctgattggtcgaagtttgggaatagcatcacagaactgaaggaatatcgggatcagggtggctttagactgcaattttctttcaatgttatgcccatcttacaagggcactggtgctttggaaatgttaatagcctgttgattcctcctggttcgaatgggaagtattatctctatgctcattgctgggtgctccaagtttgccaagatagttcacatggactgatcaagaagtccagtgcat

SEQ ID NO: 4450 - DNA, 152 bp, Triticum aestivum
  Clone ID: LIB3281-013-P1-K1-A12
cggacgcgtgggcggacgcgtgggcggacgcgtgggcggacgcgtggggttgatccatgtatctactttgtcggactctgttgaataattaataaagatggctgtatgcatcgcttgatgcagaggccgggggtaagcctccttttcgaagt

SEQ ID NO: 4451 - DNA, 440 bp, Triticum aestivum
  Clone ID: LIB3281-013-P1-K1-A2
cccacgcgtccgggcggtttcagcatgggagctgccactgcgctccactctgccgcatgttatggtcatggaaggttctcaaatggggtcgcttaccctatcaccctcagcgccatcattgggttgagcggctggcttccctgctccaggaccctgaggaccaagattgagagctcacagactgctttcaggagggctgctgccttgccgataatgcttggccatggaagaggggacgaggtagtcacgtataggaacggcgagaggtcggccgagtttctgcggaactcgggcttttcttaccttaatttcaaagcctacaacggactgggccatcacaccatccctgaggaaatggacgatgtcttcaagtggctcatggcaaggctcgggcttgatcgctcttgcggctaagtggagaagcttgtgccttggtggct

SEQ ID NO: 4452 - DNA, 443 bp, Triticum aestivum
  Clone ID: LIB3281-013-P1-K1-A3
cccatctcccgaatccctagcagaaatccttcccacctcgaggccagcgccgccgccgccgccgaattccgaagatgcctgccgccctctccatggtgcccgcctgcgacgcggaggagccgctcctggcggagtcgtcggaccgcttctccatgttccccatccggttcccgcagatctgggagttctacaagaaggcggtggcgtccttctggaccgccgaggaggtggacctctcctccgacgcgcgccactgggacaccaccctctccaacgacgagcgccacttcatctcccacgtgctcgccttcttcgccgcctccgacggcatcgtgctggagaacctcgcctccaggttcatgtccgacgtgcaggtcgccgaggccagggccttctacggcttccagatcgccatcgagaacatccactccgagatgtactcc

SEQ ID NO: 4453 - DNA, 401 bp, Triticum aestivum
  Clone ID: LIB3281-013-P1-K1-A4
aaggcgtcttggaactctactatatacgcgcaaccgatcctgtgcgaccacctcctccccatttggacagcggagcacccaccaaccatctccatgcggcgccatgagggagtgcatgtggatccacatcgggcaggccggcatccatgtctggcaacgcgtgctgcgagctgtactgacttgagcatggcattcagcctgatggccagatgcccggagacaagaccgttgggggaggtgatgatgctttcaacaccttgttcagcgagactggggctgcgaagcacgttccccgtgctgtcttcgtagatctcgagcccactgtgattgatgaggtgaggactggcgcttaccgacagctatgtcaccctgggcagtttatcagtggcaaggaggatgct

SEQ ID NO: 4454 - DNA, 411 bp, Triticum aestivum
  Clone ID: LIB3281-013-P1-K1-A5
actaggtctagtcacccagctatctatgcgcatccgtttctttcgatcacctccttcctatgtgagcagcgtagctccctccaaccatccccactctgcgccattggggtgcgcatgtggatccacatgggccatgccgtgcatctaggtcgactacgcgtgctgcgagctgaactgacttgagcatgttatatagactgatggccagattcccggtgacatgaccgtagtgacaggttatgatgctctcaacaccttttttaccgagtctgtggctactaagctcgcctcatgtcctaggttcttagcttttgtgcccacttcgactgtatagttttggacatgcctctcactgacagttatttcaccctgaccagttttttattcccataggtttattcttatatcatt

SEQ ID NO: 4455 - DNA, 217 bp, Triticum aestivum
  Clone ID: LIB3281-013-P1-K1-A6
aaagagcccacaatgaaggaatgctgcgtgcatttgcatgctggatagttttgtggggaaagaaagcctgtgggttaattttagtggggaaaatgatacttttggatggcgttttactggcttagggcctagtttggctgtcctttgggctttgtatactagaaattgctgtatttgcaggtccagttttgttgtgagccatgaggcacatgtgaag

SEQ ID NO: 4456 - DNA, 405 bp, Triticum aestivum
  Clone ID: LIB3281-013-P1-K1-A7
cggacgcgtgggcacgaccaccagctgctattattggtgtggacagaatagaatcggatggtaccgatttgaactttatgtactatcagggaattatcaagaactctgagcgcaattattgtgtgcagaggctggcgtccctgcttcaggaccgtgaggaccaagatggagggctcacagacatgctttcatgaggggcgctgtcttgccaataattcttggcccttgaagacggggcgcggtggtcacatatattaacaccgcgaggggtcccccgattttctgcggaactcgggcttttcttaccttaatttcaaagcctacaacggactgggccatcacaccatccctgaggaaatggacgatgtcttcaaagggctcaaggcaaggctcgggcttgatcgc

SEQ ID NO: 4457 - DNA, 408 bp, Triticum aestivum
  Clone ID: LIB3281-013-P1-K1-B1
cccacgcgtccggccggcggagctcttccgctcgttcccgatcgtggaggccatcttcgtcaacaacaaccagttctccggcaagatcccgagcaacctcggcgactcgcccgtgaactacctcgcgctcgccaacaaccagttcacggggcccatcccgtcgtccatcggccgcgccgccaacacgctgctggaggtgctcttcctcaacaacaagctcagcggctgcctcccctacgagctcggcctgctcgccaaggccaccgtcatcgacgccggcacgaaccagctcacgggcaccattccggcctcgtacgcgtgcctgcggaaggtggagcagctcaacctggcggacaatctcctctacggcgaggtgcccgacgcgctctgccggctcgcgtacccgtc

SEQ ID NO: 4458 - DNA, 332 bp, Triticum aestivum
  Clone ID: LIB3281-013-P1-K1-B10
ggagatattggacatgctgcctctcctggaggccaagagaaaggtggagaaacgggagaagctagagacggcgttgctaatgacgacattaattgggaagaactgaagaatgaaagccgggaagcaccaccaatgacaactcaagaacaaatggatactgataatcaatttgcatgaaatcttgatcattatgcaatggcatagagctggacgttgaattgatgaagatcacatagattcgatgtggcatcgaaggtgccaacaaattacatgggagagcaagttgcatcagggggagagtccgatacaattgatgaagatcacatgttaag

SEQ ID NO: 4459 - DNA, 428 bp, Triticum aestivum
  Clone ID: LIB3281-013-P1-K1-B11
ctggaggatgtctttcctactattgcaagtcgtatgtctgtgatattgtcacaagatgccttttctactggtcctgcaggcaataccgaggaaatgcgtgaactgcaagagctgcagaggacattatacacattcctccatgggatggttacacatgatttgtctgcagttctccttgctcctacctgtaggcagtatttggaaaccataatgcagctacttttgtttacttcatgcagtcataaagatatactgctccggaaggcgtgtgtgcagatttttgtcaaacttataaaagactggtgcactacatccaaagctgatgataagcttcctggcttccgagtattcatgattgagaagtttgctactggttgctgtttatacagtgtccttgaaaaatcatttgatttacgtgatgcaaatac

SEQ ID NO: 4460 - DNA, 423 bp, Triticum aestivum
  Clone ID: LIB3281-013-P1-K1-B12
ctggaggatgtctttcctactattgcaagtcgtatgtctgtgatattgtcacaagatgcgtgttctactggtcctgcaggcaataccaatgaaatgcgtgaactgcaagagctgcagaggacattatacacattcctccatgggatggttacacatgatttgtctgcagttcttcttgctcctacctgtaggcagtattctgaaaccataatgcagctacttttgtttactttatgcagtcataaagatatactgctccagaaggcgtgtgtgcagatttttgtcaaacttataaaagactggtgcactacatccaaagctgatgataagcttcctggctttcgagtattcatgattgaaaagtatgctactggttgctgtttaaacagtgtccttgaaaaaacatttgatttacgtgattgc

SEQ ID NO: 4461 - DNA, 431 bp, Triticum aestivum
  Clone ID: LIB3281-013-P1-K1-B2
gccgccgccagcagctgcgcaaaggctccacaaaccctaaccctaacttcaaacttaagtttcaattttttggatctagctagagccatggccccaaccaagggcgaggggccggccatgggaatggacctgggcaccacctactcgtgcgtgggcgtgtggcagcacgaccgggtcgagatcatcgccaacgaccagggcaaccgcaccacgccctggtacgtggccttcaccgactcggagcgcctcatcggcgatgccgccaagaaccaggtcgccatgaaccccatcaacaccgtcttcgatgcgaagcgtcttatcggcagaaggtttgctgatgctcctgtccagagtgatattaagatgtggccgtacaaggttattcctggcccagcagacaagcctatgattgtagtgcagtacaagggtga

SEQ ID NO: 4462 - DNA, 439 bp, Triticum aestivum
  Clone ID: LIB3281-013-P1-K1-B4
catcaggataaccatcaaagtgcacccaataatttctcacctgcttatcttgaagggataaagtttggtgattttcgctttcctaaagttccttcacgggaaaagaattctagttctgatttttgtggtgtggacctgccacagaagactgaaaacaatcgcagggagaaaccgaatggactgcgctctccgggagcacatgcattaaccagcagcaatatggacttcactaagccagcattgaaaatgaacggagttgggaaatatgctcagaatacaaaactttcaactaatcctcttatccaaaggtctaagagcagtactagccaaccacataagaaatacatccaaggtgctgttcataatggtgatgatagtgcatctagtcgacaaaatggtacaacagctccaagatggagcagttctggcaaagtagctg

SEQ ID NO: 4463 - DNA, 404 bp, Triticum aestivum
  Clone ID: LIB3281-013-P1-K1-B5
ggctattcgatttcgtatttattgagccaacgctcttcatgtacggtgtacatacagtactgtactgttcgtttgcttctggttgctaacccagctaaatcactatgatacaaggctcttgtcccataaatatacaccaaggaaggataatgatggtaacatcatcaaaatgtaaagaggttggaagaattgacaatatcgatgcggtccaaaaatataagaggaaaacagctctatatgcagctcgagcaaacaaaaatgaaacggttacaaaccaccggcttcacctacgccgctgcctcgatcttctcaatggtttctaacctcgttttccttttccatcctttcatggtggccaccaggttaaccagcccgacaacctggctcttgctgtattctggatg

SEQ ID NO: 4464 - DNA, 462 bp, Triticum aestivum
  Clone ID: LIB3281-013-P1-K1-B6
atctcatttcctttggcttcaggataggcctaataagaaaacaaataattccaattcatatatgaacatttttgcctccttatttcttgaaaatgtggaattggaattcctttcctttggcttcaggataggcctaataagaaaacaaataattccaattcatatatgaacattcttgcctccttatttcttgaaaatgtggaattggaattccccgaggaattccgatctcatttcctttggcttcaggataggcctaataagaaaacaaatgattccaattcatatatgaacatttttgcctccttatttcttgaaaatgtggaattggaattccccgaggaattccgatctcatttcctttggcttcaggataggcctaataagaaaacatatgattccaattcatatatgaacatttttgcctccttatttcttgaaaatgtggaattggaattcccc

SEQ ID NO: 4465 - DNA, 402 bp, Triticum aestivum
  unsure (1)...(402): unsure at all n locations
  Clone ID: LIB3281-013-P1-K1-B7
cccacgcgtccgcccacgcgtccgcggacgcgtggggtccgagtaaagtagccctcgctgctcctcttgtccttccattccccttcgcctttccccctccctcctcccctccctcccaaaaaccctaaaccctacctcgacgggatcggccgatcggcgccgcgtnctcgccgggttttacttagaacggcatgatctttgccttcccattgggagggtgagaagcaaccaagtatggcttcaagggcgatcattaggaagaggaagcgtctttttgataatgttaacacacatatcctgtcatgctctttctccaccttccagcatggggcatttggtttcaaggctcagcccagaatagcgcagcaatttctcgagcaaagcttangggactcaaaatct

SEQ ID NO: 4466 - DNA, 419 bp, Triticum aestivum
  Clone ID: LIB3281-013-P1-K1-B8
cccacgcgtgccggcactccttcaccgacgcgtaaggtacaagtaaagtaaccctggctggctgcatggtaggtacaggcctgttcaaggtgcggcgccaagtgctaccgtaagtgccaaaaacactaaaccataccttgacgggatcggccgttcggcgcctggcgcgtggcgggttttactaacaactgtatgatcttagccacgccatggcgcgggtgagaagcaacctcttatggcttaacgggcgatcattaggagaacgaagcgtctttcagctcatgctaacacacatatccgtgaatgctgtttctacacctatcagcatggagcattcggcctcaaggctcatccaagaatagcgcaccaatttcttgagcaaagcttaggggactcaaaatctgacaaggagaaagagc

SEQ ID NO: 4467 - DNA, 272 bp, Triticum aestivum
  Clone ID: LIB3281-013-P1-K1-C1
caaacgcaaactccgttcgttccccaccaccatctcgtccaaaacctagaaattcggagtgagattgtgttcgtccgtttgctttcgttttttgagatccgtgaggagggggagagacagatccgtcgcttgctcccagctcgaggtttgtgacgagcggattcgacgcgcgccttcgaagttcttcctggaactaatttgatgtgctatggaatccaagggtggtaaaaagtccagcagtagtcgttccttcctcatgtacgaagcttccc

SEQ ID NO: 4468 - DNA, 423 bp, Triticum aestivum
  Clone ID: LIB3281-013-P1-K1-C10
cccgactcggcgaaaggactgtctcgccgccgccgccgccgccggccgacgaggaggaggaggagaggccgagatgttcttccacatcgtgctggagcggaacatgcagctgcacccgcggcacttcggcccgcacctccgcgacaagctcgtcgccaagctcatgaaggacgtcgagggcacctgcagcgggccgcacggcttcgtggtggcgatcacgggggtggaggacatcggcaaggggctcatccgggagggcacgggcttcgtcacgttccccgtcaagtaccagtgcgtcgtcttccgccccttcaagggcgagatcctcgaggccgtcgtcaccatggtcaacaagatggggttcttcgctgaggctgggcctgtgcaaacctttgtgtcaaaccattcgattcctgacgatat

SEQ ID NO: 4469 - DNA, 419 bp, Triticum aestivum
  Clone ID: LIB3281-013-P1-K1-C11
cggacgcgtgggtccgcccctcgctgccgctgcatctcgtctccaccaccccacttgccgccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacac

SEQ ID NO: 4470 - DNA, 409 bp, Triticum aestivum
  Clone ID: LIB3281-013-P1-K1-C12
ggcatgcaagggtatccatggcgcatgccaacagtggaaggaatagattcgtagataggggctcattccattggatcgctgagacacagcgggttatgatggagcagttggctttctatcaacaatcaagacaagcagctgctgacccccacagggacttgagactgaacattgatgagatgagttacgaggaactgttggccttggaggagtccataggtactgtgaacaccggccttgccgacgaaaagatttcagcttgtgtgaaagaagtggtctgttgcagttccgatgaggcacaagacgacgaacatgatgggcgctgtctagtctgcctggaggagtacaaaaacaatgatctcctgggaattctgaagtgcaggcacgacttccacactgactgcatcaa

SEQ ID NO: 4471 - DNA, 411 bp, Triticum aestivum
  Clone ID: LIB3281-013-P1-K1-C2
cccacgcgtccggttaaatatgcggctaaattcaggaactgatgttttgcaaagtcagcaaattagcagccctgcacagtccaagagtgggtcttctgttcgtgaagatggtggcaattacagtaacaaaccagtaaaagatgagatgttggatgtgaaactaaagctaaagcaggtggaactagacatgctcaagcttcggtccaagcaggcgcagataaacaatgggaagcaaggagcccttccatcagggccccattcgaatttagaggaggatgccgatgccagaactgttcttgtgacaaatgtgcattttgcggcaaccaaggaagcattatcaacacattttatgaagtgtgggacagtgcttaagctcaatatgttgacagatgcaattactggccacccaaa

SEQ ID NO: 4472 - DNA, 396 bp, Triticum aestivum
  Clone ID: LIB3281-013-P1-K1-C3
atgtattattttcatggatgagattgatgccattggtggccgaagattcagtgagggcactagtgcagatcgtgaaatacaacggacattgatggagctcctaaatcagttggatggattcgatgagctcggaaaggtgaagatgatcatggcgacgaaccggcctgatgtcttggaccctgcgctcctttgtactggacgcctagaccggaagatagagattccgctgccgaatgagcaatccaagacggaggtcctgaaaatccatgcagctggtatcgccatggcgaaattgattacgaggctgtggttaagctggccgagggcttcaatggcgctgatcttcgcaatgtctgcactgaggctggcatggccgtcattcgagcagagcgtgac

SEQ ID NO: 4473 - DNA, 414 bp, Triticum aestivum
  Clone ID: LIB3281-013-P1-K1-C4
gcgccgtcgagctcgttggcggcaaggagagcgcgctcgtccaggaggtgcgcaccgtgcccgggtgggcataccgcctctccttcgccgtcggcgactctgccgacagctgcaagggctccatggtgggcgagggctacaccgcgcgctccaccctcaaggtgccgtacgagtacaatggcgccggcggctacaagcgcgccgtgctggacttcttcgccgtcagggaccgcacccgggtggtctttcagagcgccttctaccacatgaaggccgacggcaccctctgcgggcccgtcatcgacgacgccaagctcgtcggcctgcgcaagaagccatccgcacgttgcctcatgctctaattaagctagccccgctgccacgttttactacaaacaatatatgcaagcacac

SEQ ID NO: 4474 - DNA, 438 bp, Triticum aestivum
  unsure (1)...(438): unsure at all n locations
  Clone ID: LIB3281-013-P1-K1-C5
cccacgcgtccgtccacgcgtgcggtcgacgccaagctcgcgtacatcgtgccggtgctcacgcgggtgcacgcggaggaagaagccagaagagccaaggcggcctacgccgcggactgcgcctaggaggaagcctgtaagaacagggcctccgaggaggcctccgacacggcgcccatgaggccgtacttgtcggacgcgtgggaggacgaggagacggaggtgaggcacttgctgatcaacttcaggatccccggcgccgacgacagggctgacctcaaggagaacctgcggatctgggcgcacaccgtggcctgcgtcgtncggtgactgatttgaccaagagcccacctttttttccattatgccgagcagtgagcggaatgattaactggaaatattctttgccatgtgcatgcgcatttttataagatattc

SEQ ID NO: 4475 - DNA, 433 bp, Triticum aestivum
  Clone ID: LIB3281-013-P1-K1-C6
cccacgcgtccgggctgactgtgctgtgctcatcattgactccaccactggtggttttgaggctggtatctccaaggatggccagacccgtgagcatgccctccttgctttcactcttggagtgaagcagatgatctgctgctgtaacaagatggacgccaccactcccaagtactcaaaggcccgttacgaggaaattgtcaaggaagtctcttcgtacctgaagaaggtcggctacaaccctgacaaggttccctttgttcccatctctgggtttgagggtgacaacatgattgagaggtccaccaaccttgactggtacaagggccctacccttcttgaggctcttgaccagatcaacgagcccaagaggccctcagacaagcccctgcgtcttccccttcaggacgtttacaagattggtggcattgga

SEQ ID NO: 4476 - DNA, 434 bp, Triticum aestivum
  unsure (1)...(434): unsure at all n locations
  Clone ID: LIB3281-013-P1-K1-C7
cattggcgcatctcgcccccgttcggcggcggcggcggcgtagatccggcgtggcgttgcgcccccgttcctcgcccctcgtcgctccgcagcgcccgcgctccccaaggccgcagcacgcgagcggcgcggccttcgttggttattgaagaaacaacactccgccgttctgaagaaatgagtgcgtgtaagaaggccagggcggaagctacatatgttgtgagttcagacagacttagcagtctacctccagagttaaagggcgacatcctttcccgtctgaatgtcgaagaagcggttaagactagcaccttatcaagtacttggagggatgcatggactaatatgccaaaaatatttctgcgcgatggaaattttgcaagaaccaagttcgtcacattangtgatatggtgctatcactccacaacggaac

SEQ ID NO: 4477 - DNA, 291 bp, Triticum aestivum
  Clone ID: LIB3281-013-P1-K1-C8
catcgattgagttcctccgccgtcctcttaaacgaatgattgaccacgtgagcgagaacagggattttgtgcaaaggatgagggagtgtggtctttttctcaccaaatgatgcgtcgtcagccgagagcttcctccaggaggaggagatgaatggcgacacttccttcacgcagatctacgcattagtggcaaaaagtcctcaatcgagagggagaaaattggtgttgagggcgactctagggtgtgactgctgttgattgggtagaggatttttacatggtcaacgtact

SEQ ID NO: 4478 - DNA, 402 bp, Triticum aestivum
  unsure (1)...(402): unsure at all n locations
  Clone ID: LIB3281-013-P1-K1-C9
ccacagctcagtatcccacaaacaaaactgtagatcgattccatcctccatgagttcaacttcaacttcaatctcggtcttatcccaaggcagcggcgtcgccgcctccggcggcggcgacatgaccgacctagagagcataacccacatgctgcagtgggtggtgccggtcgcctcgccgccggcggtagagcagctggggcgcgcgctgtgggggctgggctccctcacccttgtgctgggcctcaccaccgtgctccaccagccggccgtcggacctgtcttcgcccactacaaggccgcatactataccgtccttgccttcgtnctcttcgtcgccgtgccggtggagctggggatcgccttctgcctgccccgctgcagccacgggcgccggatcca

SEQ ID NO: 4479 - DNA, 402 bp, Triticum aestivum
  Clone ID: LIB3281-013-P1-K1-D1
ctccaaggatggccagacccgtgagcacgccctccttgctttcacccttggagtgaagcagatgatctgctgctgcaacaagatggacgccaccactcccaagtactcaaaggcccgttatgaggaaattgtcaaggaagtctcttcgtacctgaagaaggtcggctacaaccctgacaaggttcccttcgttcccatctttgggtttgagggtgacaacatgattgagaggtccaccaaccttgactggtacaagggccctacccttcttgaggctcttgaccagatcaatgagcccaagaggccctcagacaagcccctgcgtcttccccttcaggatgtttacaagattggtggcattggaactgtgcctgttggccgtgttgagactggtgtcatcaa

SEQ ID NO: 4480 - DNA, 244 bp, Triticum aestivum
  Clone ID: LIB3281-013-P1-K1-D10
aacacgcgtgggcaaacatatagtaagcattcttatatactttctcctgcaaaggcaggggcatttcatggggtggagtgaaatcaactcacatgccttccatgtccaacctaatgaacataattgccctcacaaagaacaatcttcaaaatcttaaagcacatataccttttgccaacaattccaagtgttataattcccccacctaaaactttacctaatacacttacaacttcaataaaaa

SEQ ID NO: 4481 - DNA, 412 bp, Triticum aestivum
  unsure (1)...(412): unsure at all n locations
  Clone ID: LIB3281-013-P1-K1-D12
cccacgcgtccgcccacgcgtccgcggacgcgtggggacaagccgccagccagcccagggcaaaccaccggaccggagcagcagccgacgcctcacaaccgccgccgcgcaggcagacgagccagcgggagggagccatggatcggtaccagagggtggagaagccgcgggaggaggtgcccatcaaggagaacgagatccgcatcaccacccagggcaggatgcgcaactacatcacctacgccaccaccctcttncaggataagggttgcgatgaagttgtattcaaggcgatgggaagggccataaacaaaactgtgatgattgcagaattgatcaagaggagaattgtgggtctccatcaaaacactgccactgaatccactgatattactgacacatgggagccact

SEQ ID NO: 4482 - DNA, 253 bp, Triticum aestivum
  Clone ID: LIB3281-013-P1-K1-D2
cggacgcgtgggggataattgaattccttctctttagaaggaagcagggtttcaacatcgccgtggacacgctgaattggcatctagtgattggtattttggtatggaatacaaaaatatgtgctgagttaatactagtcgggtcttttgatgtcttctgtgctttctttttgctttttgagtctactgaaaccgcagtacttgtgcggtttcctctatcggtcgtccagctattttttagtactgcatctgt

SEQ ID NO: 4483 - DNA, 440 bp, Triticum aestivum
  unsure (1)...(440): unsure at all n locations
  Clone ID: LIB3281-013-P1-K1-D3
cggacgcgtggcggacgcgtgggcagggccgcaagctttaacatcattcccagcagcactggtgctgccaaggctgttggtaaggttcttcctgagctgaatggcaagcttacgggtatgtctttccgggttcccactgtggatgtgtcagttgttgatctcactgttagaaccgagaaggctgcatcatatgatgacatcaagaaggctatcaaggctgcatccgagggaaaactcaaggggatcatgggttacgtcgaggaggatttggtctccactgattttgtcggtgacagcaggtcgagcatctttgatgccaaggctggaattgctctgaacgaccacttcgtcaagcttgtctcgtggtatgacaacgagtggggttacagcaaccgcgttgtcgacctgatccgncacatggccaaagactcagtagagcg

SEQ ID NO: 4484 - DNA, 316 bp, Triticum aestivum
  unsure (1)...(316): unsure at all n locations
  Clone ID: LIB3281-013-P1-K1-D5
cggacgcgtgggcgctcacactcactcactgttgtgtcgtgtcccatcccactgctgccacccaagctaattgtggagccagtgataatgccgtccgctggcgccgtcgacccccagagcggctactgcgccgtcacgaggacctttcacagacttcgcgcgcccattccggtggcggccccatacccggcggtcttctttccggccttcggcttnttccttcttcccttcccggttcccggccacgccgtctttcttgatgccggcaccggcgaggccgtcccctttccggccttcctcgggcaggttcgggccc

SEQ ID NO: 4485 - DNA, 359 bp, Triticum aestivum
  unsure (1)...(359): unsure at all n locations
  Clone ID: LIB3281-013-P1-K1-D6
tcacactcactcactgttgtttcttaccccatcccacttctnacacccgatctaattttaaatccaattataattcactccactgcccccgtctaccccaagagcttttactgcacccccacgagtacctttcacataactacgctcgcccattcctcttcctcccccatccccgccaatcttctttccgtccttttccttcttccttcttccatccctgttaccctcccacgccatctttctttattccttcaccggctaattcatcccctttccttcctttctttttcaattactgacctcttacatggcccttccttcccatcttcacatattcctctgttacattacctttattc

SEQ ID NO: 4486 - DNA, 439 bp, Triticum aestivum
  Clone ID: LIB3281-013-P1-K1-D7
cctgcgagctctacacagcatcacaccgcatttctcattcttcctccccacgtcgccgtagcagctagctagccgggagggaggcgccgccgccgccgagtgagggagccggtggaggcgggttggaggcagggcggaaatggggcgcgggccggtgcagctgcagcggatcgagaacaagataaaccggcaggtgaccttctccaagcgccgcagcgggctgctcaagaaagcacacgagatctccgtgctctgcgacgccgaggtcgcgctcatcgtcttctccaccaaggggaagctatacgagtactccagccaggacagtagcatggatgtgattcttgaacgttaccaacgttactcatttgaagaaagagctgtactggatccaagtattggaaaccaggcaaacttgggagatgaatatggaagtttgaag

SEQ ID NO: 4487 - DNA, 430 bp, Triticum aestivum
  Clone ID: LIB3281-013-P1-K1-D8
cggacgcgtgggtatgtatgctgatagcgtttagagataccttctaatcaaaaaataagatctgatcgtgcgctatatgttgattctcttacatatgtattatgacaaaattaaggcacatatgttgatattggactgataaccttagtacatgaaaaggtgttggaaaggacccaatccttcaaagatatgtagtactcccgtcccaaaataagtgtcttaaccttagtactttagtacaaagttgtgacacttattttgagacggggatatgttataggatcctagctttatttcgacccatctgttgtaaggagagtatcttgtgcacttattattcttattatttgtgcttttcgcattaatcgcgagctgatgttatttgcatatgagtccaagaacaacaattgctctttgttgtggcattact

SEQ ID NO: 4488 - DNA, 416 bp, Triticum aestivum
  Clone ID: LIB3281-013-P1-K1-D9
cggacgcgtgggcgaacgcgtgggcagcccccacctaccctgcctacagcaaactcacaggccccaccaccgaagctgccaaccccacccgaagcggcagccatggcccccaaggcagacaagaagccggccggggagaacaaggtcgagaaggcgacggagaagacccccgcgggcaagaagcccaaggccgagaagcggctgccggcgggcaagacggcgtccaaggaggccggcggcgagggcaagacccggtgccggatgaagggcagcaaggcgaagaagggcgtggagacgtacaagatctacatcgtcaaggtgctgaagcaggtgcaccctgacatcggcatgtcctgcaaggccatgtacatcatgaactccttcatcaacgacatcttcgagaagctcgccgggga

SEQ ID NO: 4489 - DNA, 436 bp, Triticum aestivum
  unsure (1)...(436): unsure at all n locations
  Clone ID: LIB3281-013-P1-K1-E1
gccgtgcgtttcgtttgccaaaaatggggcctaagccaacgctcgccgccaccgccgcgtccttgctcgccgtcctggccgccgtccaccttgccgtcgcggcgaccgcggtggacgacgccccgctgccgaggctcccgcagcacgacatcccggccgtgttcgcgttcggcgactccacgctcgacacgggcaacaacaacgtcctgcccaccatggtccgcgccgaccacgcgccctacggccgcgagttccccgggggcgcgcccacgggccgcttctccgacgggaagctcctcaccgactacctcgtggaggtgctcggcatcaaggagctcctcccggcgtaccgctccggcgccgccaacctcacgggcgcggacctagccacgggcgtctgcttcgcgtncgccggctccggcctcgacgacgccac

SEQ ID NO: 4490 - DNA, 425 bp, Triticum aestivum
  unsure (1)...(425): unsure at all n locations
  Clone ID: LIB3281-013-P1-K1-E10
aacaaacagttgttgtactatactttgaagtttgaagtgtgatcctgcaattatcttggaaggctccaggttaatgctgttttccgacaaagatcctgatactgttatacttgctccttgtaccttcagttacgcctctgctcccgtttctcagaaagaaaatcaaccggatattgttgtgctgtactaagtctggttgcccatgaaagtgtctgtgaggcacgggatcaatactgtaaatctgttattctttggtgacgccttcgaatagcaactaacatcacttagcaatggccaacatcattgtcttccctgcttagattgtcgctatctcatttctcaagtatgttggagcacagttgctgcccttacattatgtactgtatgttggaacactggttgctcataatntatgttgtgatatt

SEQ ID NO: 4491 - DNA, 258 bp, Triticum aestivum
  Clone ID: LIB3281-013-P1-K1-E11
tggagttctactttttactaggtgtggagtgggagtgctatgcgcggggtcgcgtggcgcgggctaaataaaagtgttgtcggggccagtcgacgcccagtgtcggtcagcggcagcgagcgagcgagcgacgcagtgcggtgccactctcgccggcccccgtggctggctgcgtctgcttagctgcagctttgtagtggtgtgtgtcacagtgtcagttccacctatgatcgatcggtatcctatccggtttgtgtt

SEQ ID NO: 4492 - DNA, 320 bp, Triticum aestivum
  Clone ID: LIB3281-013-P1-K1-E12
ccgcaggcactcctttttcctcgcccgcatccggccatcccgcatcccgcacggcacgggacggccgccggccctcccgcccacctccagtccagcgccggcgccggtggtcaccgctccatggctccatggccgccccgcgcctccgtggcctcctcctccgccgcatcccgcacggtcgccggctctgccgcaggcatcccgcacggcacggcacggccgccggccagctccatgtccgccccgcgcctacgtggccttctccgccgccgcatccctcacggccgccggctctcccgcaggatcggatcccacccacc

SEQ ID NO: 4493 - DNA, 415 bp, Triticum aestivum
  Clone ID: LIB3281-013-P1-K1-E2
cggacgcgtgggctgcaagcgacgcgcgggcggtcggcgctagcagggcgcgggcgagctgggccgtgcgtctgcgcggcgagcatggccgggcgctggtgcagaggatggctgtgcggtggcgcggctaggcgagcagggcaaggcggcggcatggatccccggccagtagaaggacggccgacggtcaagtccctgttcctgcagtggagaaggacgaaggacttgattgtttttacttttactttctagggtcctttgtgtaaattttcaggacaactgtgtaacttctctataactccacctacaagtgtaacttctctgtaactccaccagtccacctacaatgaatgaaaggtagcacggccgtgtcgaaaccaaatctaacgtgagctgaacctgctctattgatttg

SEQ ID NO: 4494 - DNA, 440 bp, Triticum aestivum
  Clone ID: LIB3281-013-P1-K1-E3
ccctcgcaacggccgccctgcttgcggtgttccagcggtggggtctccgatacggcctgacggtgaacccggggcgcccgtgcgggacgcgggactggatctactccttcgcgcagaacgcatccgtcgactgcagctgcgacggctcgcccgtgtgtcgcatcacacacctgttcatgccccgtcttcccggctcatccgaggcctctgggttttcggctttcccggtgcctttgcttgtgtattgacggctgggatctggatcatgcaggaacatcaccggattctggaatctgaccgagatcccgctggagctcttcaacttaacggagctggtctctctgtgagtcatggcattggtttctattgttgtgcaaactgcttacactaggaaatgcgagaattaaccagcctactagaagcaggacaatgagatcaag

SEQ ID NO: 4495 - DNA, 404 bp, Triticum aestivum
  Clone ID: LIB3281-013-P1-K1-E4
acatctcctgctagtagtacgttccaggatcgccggagccccgtaggaataccaaaccgtaggggaggagggagagagaaggagagattaggttcacggcgttcgcgtgggagagcgccttccgtcccttcatcaacctgcccaccttcaccggtctggtggatgtcctagccgtaagtagtggaggaggcctcgtctcatatgcggactctcagccggaccatccccaaggatttaataagaacaaagcagtggttcttggaactggctgggctgccaccacattccttaggattcttgatagcaaactgtacgactatcaagccatttcacctcggaactactttgcattcacacccttgctcccagtgttacctgcggaacagacactccaatgagcgttg

SEQ ID NO: 4496 - DNA, 366 bp, Triticum aestivum
  Clone ID: LIB3281-013-P1-K1-E5
cggacgcgtggtcggacgcgtgggcggacgcgtgggcggacgcgtgggaagccgctcgccggggagaagctctccaagaaaacataaccaacacttaccttcatgctccatgggtaaaactatgagagatagagaaagagatatataaagctgtctttctgaatgcaaatcattcattgcgatgatctttctgccagttttatgcactcttttatacggcccatccccatgtatttaataggaataaagctgcggttcttggaactgactaggcacacacacacgttcccgtggaatcttgttagcacactgtgcgactttcatgccatttcacctcggttctactttgaattcacacctttgctc

SEQ ID NO: 4497 - DNA, 437 bp, Triticum aestivum
  Clone ID: LIB3281-013-P1-K1-E6
cggacgcgtgggcgagaccgaccgaaacgcaccggcgtcggagcggctaggcgaaggcggggcgcaacgccggcgagcggcggcagcgtgctcgccgccatggacgagcaggagttccggcgcatgctcgacctcttccccgtcgtccgatcccgcgactactgcaaggatgaagtggaatcatcaagcgaaggcaccacacagcaaacacgagctcaggagataaaaggaaccaaaaagaatgctgcagaagctctattcctgcggaaattgaagatggctgctgagaaaaaggttggagcaacaaaggcagaactattctgcaagacattcgaagaagctcacgagaaacttgtttacaaagaactggatctggatgctgctcaaaggttcctgaatgcctacaagagctgatgatgaagctgtgctagatgcct

SEQ ID NO: 4498 - DNA, 360 bp, Triticum aestivum
  Clone ID: LIB3281-013-P1-K1-E7
cccacgccgtccggtggttgtgggctgcttcccgaaggactaccattcggctgtcacattaacgctcgccttttcgatgcgcaaaatgatgagggataaagctctggtcaggagactttctgcatgcgagacaatgggttctgcaacaacaatttgcagggacaagactggaacattaactttaaatcagatgactgctgctgaggcatactttggtggcgagaagatggatcctccagataacactcagaagctatctgctgctgtatcaacaatgattattgaaggaattgctcaaaatacatctggaagcatatttgagccggagggtgatcaagctccagaagtgactggatcacc

SEQ ID NO: 4499 - DNA, 425 bp, Triticum aestivum
  Clone ID: LIB3281-013-P1-K1-E8
ccaaatcagactcgactcgacgagggtttagggggaagaggcggagaaccctagccgccgccgccgccgcgatggggatcttcgacctgctcgacctggccgacggcgcctcgggggacgaggccgtcacgcgcgtcgtcaagaaggtcgtcccgcccgacgaccccgacaagcccttcaaggccgtcaggaagaccgccgtcgtcgtcgacaaggacgccgccggccccaaggacggcgttcaggacgaccagcaccaccactacacccaagagggtgggcattaccaaagggagggcaactttggtggaggccggtgcagaggccaaggctactattgtggtggtggcagatgacgccgtggaagggggcgtggcgccagatccagtcgtgtctttgatgatgccaacggtcgtttctataat

SEQ ID NO: 4500 - DNA, 211 bp, Triticum aestivum
  Clone ID: LIB3281-013-P1-K1-E9
gccgtacgcgttcgccaaagcctacccgcttgcctgcgtttcctggtggcggacgccgtccccacctggggcgagcccagcccccatgacgggcgaagatgaagaccatcctggcgtcggagacgatggagatcccggacggggtgtccgtcaaggtgtccgcgaatatgatctcagacacggtcacgccctgtacgctcgctcgatactg

SEQ ID NO: 4501 - DNA, 392 bp, Triticum aestivum
  Clone ID: LIB3281-013-P1-K1-F1
cggacgcgtggggcaacagagagatggcggcggtggcgacgacgacggcggtccacgggagccaggcggccggcgcgcagaggctgctgcttctcctcgctctcgtgattgaagctgtaaacaatggagcagatatcttcactgaagaccagcaagaaattatcaagcaatttggcagaatcaaatccgagactgttcctgagaacaaggatgcagggtctgatgacgatgatgacgatgatgaagatgaggatgatgaaactggtgatgctgatgatgatgatgccgatgctggagaggacttctcgggtgaagaaggcgaggacgatgacgaggatgatgaccctgaggcgaacggcgatgatgctggcgcggggagcgatgatgatgat

SEQ ID NO: 4502 - DNA, 427 bp, Triticum aestivum
  Clone ID: LIB3281-013-P1-K1-F10
cggacgcgtgggcgcgcttccttctcctccgcctcctcgacccgatcccactcgcgggatcctccgccgccgcggagcgatggcagcccgctccccttacttcgcccccgaggaaggcgcccggtgcatccgcccaggggagtcacctgccgcggcgctccgccggatcctggcgacgccaggcgcccaccaggcgccctgctgcttcgacgcgctcggcgcccgccttgtcgagcgcgcggggttcccgatctgcttcatgggcggtttctgtgtttctgcctcacgacttggattgccagatgttggattaatctcctatggagaaatggttgatcaagggcgtctaatcaccgaagcagtttcggttcccgtgattggtgatggagacaatggttacggaaattctatgaacatcaagagaact

SEQ ID NO: 4503 - DNA, 222 bp, Triticum aestivum
  Clone ID: LIB3281-013-P1-K1-F11
cgttcctgcgcaaacgcgtgggccggctcctcttcacctgccataccgcgttcccggtggcggcatggcctgttgaggaggcgacgcccctccatggtgtgaagcagcacaccaggatctggatgaggaaaaagggatcccggctccccaacggtggatcgatcgatgcgagggggcaacgagcttctcccgacgtgggggagcaactaggcccggaaatcc

SEQ ID NO: 4504 - DNA, 380 bp, Triticum aestivum
  Clone ID: LIB3281-013-P1-K1-F12
cggacgcgtgggcggacgcgtgggattctggtcacatggtacccatggatcaaccgaaggccgccttggagatgctcaagaggtggatgtcaggaaacctttcagacgcctcctcgagctctcagaggttcgacttcgccatataatccatccttgcgctggctactagtgtaatgtatctggtgtgcacgcacatgccttgggatgatcttaggtgatgggaagctcgtcggcgaccgtgcatatgctatttcccttgtacggtgctcgaggttgatgagcgtgtaataaaaggctttcagaggattgctggggcaatgcgaatgccgaatgtatcacgaagattatcgccaatgagtgacatgtggactactttatgc

SEQ ID NO: 4505 - DNA, 379 bp, Triticum aestivum
  Clone ID: LIB3281-013-P1-K1-F2
attcagcctgatggccagatgcccggtgacaagaccgttgggggaggtgatgatgctttcaacaccttcttcagcgagactggtgctgggaagcacgtcccccgtgctgtcttcgtagatctcgagcccactgtgattgatgaggtgaggactggcgcttaccgccagctctttcaccctgagcagcttatcagtggcaaggaggatgcagccaacaacttcgcccgtggtcattacaccattggcaaggagattgttgatctctgcctagatcgtatcaagaagctttcagacaactgcactggtctgcagggattccttgtcttcaacgcttgtggaggtggaactggctctggccttggttcgcttctcctggagc

SEQ ID NO: 4506 - DNA, 110 bp, Triticum aestivum
  Clone ID: LIB3281-013-P1-K1-F3
taatcatattttcacattatttacttaagaaatattcaaatacccccattatgctacatttacaacactcctccatattttgcagaaaagggcgaaaaggcccaaaattc

SEQ ID NO: 4507 - DNA, 428 bp, Triticum aestivum
  unsure (1)...(428): unsure at all n locations
  Clone ID: LIB3281-013-P1-K1-F4
agctccagaaagaaagggaaagggccgaaaagaagaaagagaaaaggaatgacaagaaagcttgccatcagggtggtggtgagacaaaacattcaaaacgtagccataagaagagaaagcatgaagataccagcatagccggcctggagtccaaaactgcacccaaagaactatttgatcagttggagaagagtggactctcagaagagtatggggccccttctttcattcagacagtacatggatcaccagagagctctcaggacagcagtaagcgaagaaaggtggtgctcccaggccctagtcaaaataagaatgggacggtacttcgcattaagataaaaagagatcaggattcaccgtcagccatgttggatggttctagggttcttncgcaacaacctgtccaacaaatggctacaccttca

SEQ ID NO: 4508 - DNA, 394 bp, Triticum aestivum
  Clone ID: LIB3281-013-P1-K1-F5
gccttttgtgccttgctgcattggaggctccgagggttcttaatctcaataattctgaatacttctctggaccatatggagaaaatgttgtcttcgttgcaaatgactggcacactgcagttttgccatgctatttgaagagcatgtataagcaaaatggaatttatgagaatgccaaggttgctttctgcattcacaatatcgcctatcagggcagatttcccagagcggacttcgaacttcttaatttacctgaaagtttcatgccgtcatttgattttgttgatgggcatgttaagccagtagtagggagaaagattaactggatgaaagcagggatcactgagtgtgacgtggtccttacagttagtccacattatgtcaaagaactcac

SEQ ID NO: 4509 - DNA, 326 bp, Triticum aestivum
  Clone ID: LIB3281-013-P1-K1-F9
atgcgttcacgatctactgacaatgttaaatcgatatgttgctctttacgagcatgcggagaacgatcagacagatattatgcatacacttgtacgagtttaaaccctgacatgtatttcatcagatcaaacatgtgcttaaatttttacttgtggcggcccgtatattcatagctcggtggatactaagctcaactggcgtactggccgtacccatgtgatcattggcgccgcatgtattagagattccatacctaatgcagtggagggcaccaacacttagtgcctgtcaatacactcgcatgagctcaccctatttggtctcc

SEQ ID NO: 4510 - DNA, 439 bp, Triticum aestivum
  Clone ID: LIB3281-013-P1-K1-G1
ccctctccctctctcacgcggcagcgaccccggaggcgacgtcggcggccacagcaggcttctcgccgaaatggcatcatcttcggacccatggatgaaagagtacactgaagcatctaagcttgttgatgatataagttccatgattgccgatagaagttcacttccacattcaggccccgaaattatgcgccacacatcagccatccggagaaaaataaccattcttgggactagactggatagctgggtgacattgttgtccaggattccgccaaagtcactcactgacaaggagatgcataagcgccaagatgcactttccaacttgaaatctaaagcaaaacagatggggacaagtttcaacgtgtcaaactttgccaacagggaggatttgcttggtcagagtaagaaagctgctgatgatatgagcagagtt

SEQ ID NO: 4511 - DNA, 420 bp, Triticum aestivum
  Clone ID: LIB3281-013-P1-K1-G10
agcccatctagctcgctcggattacggccgtcgttccagaggtgagcggcatggcgggggcgggggcggaggaggcggtggtgggcgagagcttcgagttcgcctttgacaaggaggccttctccgacaagaagctgcgggtcgaggtcgtcggcagcgacgacgccgccagccgcaagcgccgccgcgaggacgacaaaagcgatgaaggagaatgtgtcgattcttcttctatagtgatggctgcaccaattttacgagtcactaccatgcatatcaattcggcgattcttgctgcaaaaagtcctttctttttcaagcttttctcaaacggcatgaaagagtctgacaagggacaggcaacacttcgaatcgctgattcagaggaaaatgccttcatggagcttttgtactttatgt

SEQ ID NO: 4512 - DNA, 372 bp, Triticum aestivum
  Clone ID: LIB3281-013-P1-K1-G11
tcggggacgaccagctcggggaggcgctggagggcgccgacctggtcatcatccccgccggggtgccccgcaagcccggcatgaccagggacgacctcttcaagatcaacgccgggatcgtcaagggcctctgcaccgccatcgccaggcactgccccaacgctctcgtcaatatgatcagcaaccctgtcaactcgactgtcccaattgcagctgaggtgttcaagaaggctggtacctatgatgagaagaagctgtttggtgtgaccactcttgatgttgttcgtgctaaaacattctatgctggaaaggcaaacgtgccagttactggggtgaatgttcctgttgttggtggccatgctggaatcacta

SEQ ID NO: 4513 - DNA, 383 bp, Triticum aestivum
  Clone ID: LIB3281-013-P1-K1-G12
cggacgcgtgggccaatgagtgctccttacctgtttcaccaactaaagatggaaaccatggtgctgttgattctgtggacgctgcaccgaaggaaagtggaaatcttgtccaagaatgccatgttgcatctgatgttcatcctggtagaccctttgccatttttttttagttttgatgaaattctgctcagtttgctataaccatgtttgaattaatgtaattgttgaactacatgaataattgagtatcctggtctaatgtattcttgaatggtttttgtggtgcagatgaagtaccacaggggaatgcagatgaggtgccacatgggaatcctgtgcctctcacaagtgcaatggaagaggctgtcgaccacagtggagat

SEQ ID NO: 4514 - DNA, 325 bp, Triticum aestivum
  Clone ID: LIB3281-013-P1-K1-G2
ccctctccatgtataacgcggtaaagaccccggaggcaacgtactcggccacagcagggttgtggccgaaatggcatcattttcggacccatggatgaaagagtacactgaagcatctaagcttgttgatgatataagttccatgtttgccgattgaaggagaataaggtgccctaccagattaattttgcgccacacataagccattcggagaaaaataaccattcttgggactagactggatagcttggtgacattgttgtccaagattccggcatagttactcacttgcaaggagattcataagcgccaagattgcactttc

SEQ ID NO: 4515 - DNA, 436 bp, Triticum aestivum
  Clone ID: LIB3281-013-P1-K1-G3
ccacgcgtccgcccacgcgtccgatcaattccaagggttgttccaagcaggaacttgcaagtgtggtcgataagttccagtacatgctgaacgactacttcagcaacaagaaatcgcggctgaagattggttttgtgaaggaggctgtccgcaggaacccctgggtaggacgggagcttttcggctttgctctacagaagatcggcagcaccaaggctgaataccgaagagttcaaactttggagctggtggactgcatattgaaatcctgggtcggcgacgatgtctcgagcgcatcaaaggttttgaagaagcatatggctctgctgtgcgagctgatgcaggaaatcctcacaaagatgcccgaaaacaagtcgcgtcgccaggaggtgcgtagattctgcacgcgggctctgcaaaccgtgacgaggctcaa

SEQ ID NO: 4516 - DNA, 296 bp, Triticum aestivum
  Clone ID: LIB3281-013-P1-K1-G4
ccacgcgtccgcccacgcgtccgatcaatttcaagggttgttccaagcaggaacttgcaaggtgggtcgataagttccagtacatgctgaacgactacttcagcaacaagaaatcgcggctgaagattggttttgtgaaggaggctgtccgcaggaacccctgggtaggacgggagcttttcggctttgctctacagaagatcggcagcaccaaggctgaataccgaagagttcaaactttggagcttgtggactgcatattgaaatccttggtcggctactatttctttagcgca

SEQ ID NO: 4517 - DNA, 442 bp, Triticum aestivum
  Clone ID: LIB3281-013-P1-K1-G5
cccacgcgtccgattctctagtcgatcacacacgctctcctcgccgccaagatgttcgggttcgggcaccaccacaaggaccaggcgccggcggcgtcgggccccaaccagatcttcaagatctactgccgggcctcggaggactactgcctcgccgtccgcgacggcgaggtggtgctcgcccccgtcaaccccaaggacgagacccagcactggctcaaggacatgcgcttcagcaccaccgtcaaggacgaggagggcatgccggccttcgcgctcgtcaacaaggccaccggcctcgccgtcaagcactccatcggccagtcccaccccgtgaagctggtgccgttcaacccggcgtacgaggacgcgtcggtgctgtggacggagagcaaggacgtgggcaagggttttcgctgcattcgcatggtcaacaacaccc

SEQ ID NO: 4518 - DNA, 315 bp, Triticum aestivum
  Clone ID: LIB3281-013-P1-K1-G6
caccaccacaaggaccaggctccttcttcgtctgaccccaaccagatcttcaagatctactgccgttcctcgtaggactactgcctcgccgtccgctacatctatgtggtgctcgcccccgtcaaccccaaggacgagacccatcactggctcaaggacatgcgcttcatcaccaccatcaatgacgaggtgggcatgccttccttcgtgctcgtcaacaaggccaccgtcctcgccttcaagcactccatcttccaatcccaccccgtgaagcttgtgcctttcaaccctgcattctatgacacttctgtgctt

SEQ ID NO: 4519 - DNA, 416 bp, Triticum aestivum
  Clone ID: LIB3281-013-P1-K1-G7
cggacgcgtggggtttgctactgctggtgctcatcggactccccgacgccgccgtcgccgccaacatgaccgaggtctgcgtcaaggccgccgtcggccaccccgacacgctcggcgactgtcccttctcccagagggtgctgctcacgctggaggagaagaaggtgccctaccagatgaagctcatcgacgtcagcaacaagcccgactggttcctgaagatcaatccggagggcaaggtgcctgtgtataacggtggtgatggcaaatggattgctgattctgatgtgatcactcaagtcattgaggagaagtacccaactccatcacttgtgacccctcctgagtatgcatcagtgggatcaaagatcttctccaccttcgtcacgttcttgaagagcaaggatgccagcgat

SEQ ID NO: 4520 - DNA, 431 bp, Triticum aestivum
  Clone ID: LIB3281-013-P1-K1-G8
gccaagagcatcatcgccagcggtctcgcacgccgctgcattgtgcagatttcatatgccattggtgtgcctgagcccctgtctgtgttcgtcgactcctacggcaccggcaagatccccgaccgggagatcctcaagctcgtgaaggagaactttgacttcaggccagggatgatcagcatcaacctggacttgaagaaaggtggaaacaggttcatcaagaccgctgcttacggtcactttggccgcgatgatgccgacttcacctgggaagtggtgaagcccctcaagttcgacaaggcatctgcctaagaacaagacatcgccacattggggttattcttggtctgctgcctctcaagttcaacaaaaggcgggatccttttgctcctgggaagtaagaagaagcattcgacatcaccgcgacgtgc

SEQ ID NO: 4521 - DNA, 287 bp, Triticum aestivum
  unsure (1)...(287): unsure at all n locations
  Clone ID: LIB3281-013-P1-K1-G9
gtgcatgcagagatggggacgacgacgaccaagctggcggaggcgcgggactgcctgtcgcagagtcacaacttcaagggcgcctgcctcagcagcagcaactgcgccggcgtctgccacaccgagagcttccccggcggcgagtgccacacgcagcacttcgagcgcaagtgcttctgcaagagggtctgctagcccgcctgctcgccccggccgccctgccggccagcgccgagacgtccgatcatncgtgccgtgcctncacgttcgtnagtagtagtatttct

SEQ ID NO: 4522 - DNA, 406 bp, Triticum aestivum
  Clone ID: LIB3281-013-P1-K1-H1
gagagtctgctggcaacagagcgtgaagcttgcgctgaagccaataagagagccgaggccgtgtcactgcagctgcagtcaacccaaggcaagctggacatgctccagcaggagctcacctctgttcggctcaacgaaactgcacttgacagcaaggtgaaggcctcctactctaggcgcacgaggggcgaaaccaccaagtccgctcattacatggacgtggacaacgacgacaccgggaggcgaaggaaaaggtcgaagagcacaaccagcccgttcaagaacaatcacacggaggatggcggatccgtgttcttcggagaggacacgaacaacaggagccagcagttgtgggggacggagaccgagaccgaggacttcaccaagttcacggtgctgaaagctg

SEQ ID NO: 4523 - DNA, 245 bp, Triticum aestivum
  Clone ID: LIB3281-013-P1-K1-H10
ggactgttagtgtgaccatctgtttctactatctaatattcagggcttcttctcaaaaaaaaaatctaatattcagggctatattaaccaacagtctatgcattatccagtttcaaacttattaagctccaagcgttgaacatgttattcctgtgctttctgttggatcttgttggttgtgggcacccatgggtatcttaccattgaatcgttacttgagttatatgcattgaacttccacattt

SEQ ID NO: 4524 - DNA, 381 bp, Triticum aestivum
  Clone ID: LIB3281-013-P1-K1-H11
cagtgatggtaaccttgtggccactctacttgcccataaattgggagttacccagtgcgaccattgcccatgccttggagaaaaccaagtaccccaactcagacatctacttggacaaattcgacagccagtatcacttttcatgccagttcacagctgacctgattgccatgaaccacactgatttcatcattaccagcacattccaggaaattgctggaagcaaggatagcgtgggccaatatgagtctcacattgctttcacccttcctgatctgtaccgggttgtccatgggattgacgtgtttgatcctaagttcaacatcgtctcccctggagcagacatgactgtctacttcccgtacactgagactgacaaga

SEQ ID NO: 4525 - DNA, 409 bp, Triticum aestivum
  unsure (1)...(409): unsure at all n locations
  Clone ID: LIB3281-013-P1-K1-H12
cggtgacaagaccgttgggggaggtgatgatgctttcaacaccttcttcagcgagactggggctgggaagcacgtcccccgtgctgtcttcgtagatctcgagcccactgtgattgatgaggtgaggactggcgcttaccgccagctcttccaccctgagcagcttatcagtggcaaggaggatgctgccaacaacttcgcccgtggtcattacaccattggcaaggagattgttgatctgtgccttgaccgtatcaggaagctttcagacaactgcactggtctccagggattccttgtcttcaacgctgttggaggtggaactggctctggccttggttctcttctgctggagcgcctctctgttgactatggaaaagagtncaagcttgggttcacagtgtaccca

SEQ ID NO: 4526 - DNA, 420 bp, Triticum aestivum
  Clone ID: LIB3281-013-P1-K1-H3
acagaaaaaacgaagaaccctcttccctccccactcctgctgctccgtggccatggcgaaggcgaggccgcactcggggcgatccggtcaccgccgccgcaacctcctcctcgcagctgctctcctgtcggcggctctgctccttccggcggcgatggcctccgcggcggtggcggcggcggcggagggggacggtgagaacaggtcgcggtgggcggcgacgcagtgggcgacggggaaggacgagggggagctggccgcggagcgggaggccgctggcggtggctcggtggtggaggacgacttcgcgggcggcttcggctccctcgacagcatgctgcagtgggccatcggaaattcagatccaggaaggctgaaagaagaggcggcggttgtgcagaaagtatcttgaggatgagc

SEQ ID NO: 4527 - DNA, 415 bp, Triticum aestivum
  unsure (1)...(415): unsure at all n locations
  Clone ID: LIB3281-013-P1-K1-H4
cggacgcgtgggtctccatccgcgagtcgctcctgttcggcgagaggaccgccgccgacatcagctgcgagtacctntcccgcctgcgccgcaccgagacgagcctgcgcagcttcattcacgtggccgacgccgccgccgagcgggaggccgaggagctcgaccggaggatcgcctccggcgggcgggatgcggtggggccgctcgccggggtgctcgtgggcgtcaaggacaacctctgcaccgccagcatgccctccaccggcgggtcgcggatactggacgggttccagcccgcgtacgacgccacggccgtgcggcggctgcgcgaggccggcgccattgtggtggggaagactaacctcgatgagttcggcatggggagcaccaccgagggctctgggttttaggtgac

SEQ ID NO: 4528 - DNA, 460 bp, Triticum aestivum
  Clone ID: LIB3281-013-P1-K1-H6
gagtttcgacccaggcgtacggacctccttcagagagccccgcctgctcatcctcaccgacccaaggactgaccaccagcccatgaaggagtctgctctggggaacatccctaccattgccttctgtgacactgactctcccatgcgatacgtcgatatcggcatcccagcaaacaacaaggggaggaacagcattggctgcctgtactggctcttggccaggatggttctgcagatgaggggtactatcctgcctgggcacaagtgggatgtcatggttgatctgttcttctacagggaccctgaggaagccaaggagcaggaggatgaagctgctggagccccagagtatgctgccatcactgattacggagctgcagctggtcaatggggtggtgaccagtggacctctgatgcacctgctcccccgcctgttactggtggcgagtggccgatggct

SEQ ID NO: 4529 - DNA, 414 bp, Triticum aestivum
  unsure (1)...(414): unsure at all n locations
  Clone ID: LIB3281-013-P1-K1-H7
cggacgcgtgggcgctcactaaatatatacatgtatgctgcatagacatggtcacatggatgattaacatctttttagcaaaggcatgctaattcaatgaaaaattctactacacgtatgactatgaacgtagatgtccactattgatttttgaggactactttaggatgtgatcattggtgttgcttcacaccttctagacaacataacatttgattgttactaatgtgaaaatcaacttaccatttttttatcacagtgtgttcagccactatcagactttggtggtatgctctggctgcaaaactatgctcttccaacctaccggtggaaaggggaggctcaccaagggatgccttattatggaaaaaatgaagcccttcttaagatngtttactactacttatcctcgat

SEQ ID NO: 4530 - DNA, 430 bp, Triticum aestivum
  Clone ID: LIB3281-013-P1-K1-H9
ctcgccccttggaggagggactggctgaggccattgatgacgggcgcattggcccgcgtgacgatcctaaggtgcgttccaagatcctgtctgaggagtttggctgggacaaggatcttgccaagaagatttggtgctttggacctgagacgactggacccaacatggtcgttgacatgtgtaagggagtgcagtatctcaatgaaatcaaggactctgttgtggctgggttccagtgggcgtcaaaggaaggcgcgttggctgaggagaacatgcgtggcatttgctttgaggtctgtgatgttgttctccacactgatgctattcacaggggtggtggtcaggtcattcccacggccaggagggtcatttatgcttcccagctcactgccaagccaaggctgctggagcctgtgtacctggttgagat

SEQ ID NO: 4531 - DNA, 394 bp, Triticum aestivum
  Clone ID: LIB3281-014-P1-K1-A1
ctacgcggacgcgtgggcggacgcgtggggcaaaaatcaacaaacactctattttatgcgataagcaacgaacgcccttattgattcatggagcccacggcaaagctttaagctcaagccaaaggctgcaaatggggggaacagagagggaaaccttaactggatgtgcgctgagactccttggcaaagcggcaaagccatggacggagacggagagataacatggtcctttcatttctgctgccacaagattagccacatttcaattacaacattatgatctataataatcgcttgctaaaaacagttaacacatctatctactgtgcggaagcaccccacttattggtcctaacaaaccgactactaagcatggatttctaggctcttgatt

SEQ ID NO: 4532 - DNA, 389 bp, Triticum aestivum
  Clone ID: LIB3281-014-P1-K1-A10
cggacgcgtgggtctcatcccccctgcctgtctcctcctccgctccggtcggggcctccgcagatccgcgccagcgaggacccggggagacgaattcccccgccgatggcggtgaacgggtcggccaacgggtcgtcgggggccaacgggtcggcggggccgaccaggaccgtgctggtgaccggcggggcgggctacatcggcagccacgccgtgctgcagctgctcgccgcgggcttccgcgccgtcgtcgtcgacagcctcgagaactcctccgagctcgccgtccgccgcgtcgccgtgctcgccggggaccacgcgcggaacctttcctttcacaaggttgatatccgtgacgaggatgcactggacgctgtttttgctttcac

SEQ ID NO: 4533 - DNA, 84 bp, Triticum aestivum
  Clone ID: LIB3281-014-P1-K1-A11
tcattctgtcacacgtggtctttaatatgcaaacttacacactcaaacattcaggggcggagccctaatataatcaaacataaa

SEQ ID NO: 4534 - DNA, 241 bp, Triticum aestivum
  Clone ID: LIB3281-014-P1-K1-A2
attcggtgattcgaatgatgggcagccccgttaccaaaccatactatgcgggggtgttagcgcccacaggttggcattggccttgagagcgttgcaattcttctccaagctagtgagctggctggggaatctacggagaggggggctaacccactggtgcttcagttgattgcgaagctattatcagaaaactcccatcttatccaaggaacagtatatgccctcatatgacgccacgtta

SEQ ID NO: 4535 - DNA, 304 bp, Triticum aestivum
  Clone ID: LIB3281-014-P1-K1-A3
gacactcgggttagtatttctattgcggatgattattttgagggaccaacggtctttccaactatcagagaattgtgtcgtacagatgatactcatactttccatgcaagaaatcttgggcatcccattattcgaagtgattccttaggctacggttcatttgtaccaaatcacaattacatgcgtgggccaaacatataccagtactaattgctcttactgtgatcaaataatgggcggtataaacaactcctcaatgcgctcaagttttgtgtgacacattcatatatggtcacagggaatg

SEQ ID NO: 4536 - DNA, 334 bp, Triticum aestivum
  Clone ID: LIB3281-014-P1-K1-A5
cccacgcgtccgcccacgcgtccggcaaagaggaggagcgaaacagcatccctgccttgctccacgcccgtagggtttccggatcggaggagcccaagccgccgcagccatggttcgcggatcgctcgggaggttggcgtcgcgcaccctctccgtcgccggcaaatggcagcaccagcagctccgccgcctcaacattcacgagtaccagggcgcggagttgatggggaagttcgggatcaacgtgcccaagggcgccgtggtggggtcagtgcaagaggtcaaggaagttttgaagaacgtcttccccaatgagaaagagatagttgtgaaa

SEQ ID NO: 4537 - DNA, 327 bp, Triticum aestivum
  Clone ID: LIB3281-014-P1-K1-A6
cggacgcgtgggtggaaacgcaacgctgtctcacaggaacaggctccatataggacatgacatcgctggacggaacaatgtgtgcttcgtccggcatataagaagtcatctatccgtgccgcgccatgctctggctgataacaacatccagaacgcacagagacacagatcgggagcgagcgcgcacccgtttatcgcttgatgtatgtgcattccacctagagagcctttctcgtccactaacacgaccaacagtggccgcccgtgaggatgagacgctgagggcgcacgaagaggaggaccacgccatgatgaatgagccggtcg

SEQ ID NO: 4538 - DNA, 352 bp, Triticum aestivum
  Clone ID: LIB3281-014-P1-K1-A7
attcggtaatcgtttgatggccagcgccggtaccaaaccattctatccgataattttagcgcctacaggttggcggcagtcttgagggcgttgcccttctcctccaagctcgtgagcaggctgtcgaagctccccttgaaggagctcaccccctcgtgctccagctgcttgccaacctctttccagtcgatgcccagcttctccagggcactgtatatgccctcagcttctgacacgttagcgtggattgtcctagcaactgtgccgtggtcgatgaacgcgtccagagcttggtcgggcatcgtatagacggtgtcaggtcccatgagaggatcgacctaaagagtggcca

SEQ ID NO: 4539 - DNA, 391 bp, Triticum aestivum
  Clone ID: LIB3281-014-P1-K1-A8
cccacgcgtccgcccacgcgtccggcaaagaggaggagcgaaacagcatgcgtgccttcctccacgcccgtagggtttccggatcggaggagcccaagccgccgcagccatggttcgcggatcgctcgggaggttggcgtcgcgcaccctctccgtcgccggcaaatggcagcaccagcatctccgccgactcaacatccacgagtaccagggcgcggagtttatggggaagttcgggatcaacgtgcccaaaggcgcccagatggggtgagtgcacgaagtcaaggaagtttttaagaacctcttccccagtgagaaagagatagttgtgaaaagccaaatactttccggtggccgtggattgggaactttcaaaagtggactaaagggt

SEQ ID NO: 4540 - DNA, 392 bp, Triticum aestivum
  Clone ID: LIB3281-014-P1-K1-A9
acggatgttttggttagtctttctattgcgggtgattatttcgagggaccaacaggctgtccaactatcagagaattgtgtggtccagatgatactcctactttccatgcaagaaatcttgggcatcccattattcgaagtgattccttaggcaagggttcatttgtaccaaataacattaacatgggtgggccaggaaatgccacctttattgttcttactggtccaaatatgggtggtaaatcaactctcctgcgtcaagtttgtcttaccataatattggcacagattggagcagatgttccggccgaaaaccttgagctttctcttgttgaccgtatctttgttcgcatgggagcaagggatcatattatgggtggaaaaagtacatt

SEQ ID NO: 4541 - DNA, 308 bp, Triticum aestivum
  Clone ID: LIB3281-014-P1-K1-B10
cccacgcgtccgccttaacagtgcaaagctatgcatataaagttgtcgtgcttgtataagtgggcagtacataaagctgctgttgtgaccttaaccatccaaaactaatgaaaaaatttgagatgtgctagtgtgtatactatattggaacataatgcatagttcctgtatgtgcagcatttcaattgccctgtgaagtaatagttgatgccatgctggtaagggggccggtttcattaccttaacagtgcaaagctatgcacgtataattaacattttattttgaatttcccttcagcaattacttg

SEQ ID NO: 4542 - DNA, 391 bp, Triticum aestivum
  Clone ID: LIB3281-014-P1-K1-B11
tcattcgcggacgcgtggttttaaatctgcagcgtctcaccctcattctttttaggtcggagaccacatatggtgcatcattactaaaataaccaagcagttgaaacactcccttgccactgcaagtaccaaaccaaaccaactatatcacacatgtactcaggtcctcataaacactgcccattaaacagacacgatgtcttactgcatcatcctctccttaaataggcaatgctcagaatattatgaactccgcagttcatgcacggcttcatgccatatgatgcgtttaaaacgcgcatccattccattcaaattctgagctctttgaatcgcggaacttgtggtataatccgtacttgtggatggacagctgtcactccaagatgga

SEQ ID NO: 4543 - DNA, 400 bp, Triticum aestivum
  Clone ID: LIB3281-014-P1-K1-B4
cccacgcgtccgcccacgcgtccgagccaattgactgggaatactacaaaaagggaatcggatcgaaagttgtggatatgtacaaggaggcttatgatagcattgagatcccaaagtatgttgacactgtcactcctgagtacaagccaaagtttgatgctctgttaatcgaaatgaaggaagcagagaagacatctctgaaggaatcagagaggatagagaaggagattgctgaattgaaagagatgaagaaaaagatcagcacaatgacagcagacgagtacttcgcgaagcaccctgaactcaagaagaagtttgatgatgagatccgtaatgattactggggatactagataacggcgaaagtccaagttcttttactagaacatgcaataatact

SEQ ID NO: 4544 - DNA, 394 bp, Triticum aestivum
  Clone ID: LIB3281-014-P1-K1-B5
cttcccctcttctttctttctcccctcgccgtcgcctcctcctcctcctcgcacccaaaccctaatcccctctccccccccgcgaaccgaggccgcgggcgcgcaggcgggcaggcgcggggcaaaatggcgggcaaggaggacagccggatcttcgtgggcggcctctcgttccacaccgacgagcgcaagctcgaggacgccttccgccgcttcggcaaggtcgtcgacacccaggtaccggaccgtcgccgcgccgctccgcgtatgctttcgcttgttgttttttatttattgtttcgtgggtatgtatgtgtatatagctgctagatctgcggaattagatggtgttgagggtaggaaggcgaatgtgatgcacatggccaaggtctag

SEQ ID NO: 4545 - DNA, 399 bp, Triticum aestivum
  Clone ID: LIB3281-014-P1-K1-B6
cggacgcgtgggcagcaaacaaatggcgatagaagggttcaaggcgcaaagcgagatggtcatcgacagcctggacagattaattacatcctgggaagagcagaagcaatctgttattgttgaaggagttcatttgagcctcaattttgtgatggggctaatgaagaaacatccttccataataccatttatggtctacattgcaaatgaggagaagcacatggaacggtttgctgtacgcgcaaagtacatgacactggacccagcaaagaacagatatatcaagtacatccggaacatcagggctatccaggagtacctttgcaaccgagcagacaagcatctggtacccaaaattaacaacactaacgttgaccagagcgtggcagcgatacatgc

SEQ ID NO: 4546 - DNA, 87 bp, Triticum aestivum
  Clone ID: LIB3281-014-P1-K1-B7
aggtaccgattcccaattccagggcacgacctcacgcctacccaaaactgcaacctctagggcatctggcaaagtaaacagaaaacg

SEQ ID NO: 4547 - DNA, 390 bp, Triticum aestivum
  unsure (1)...(390): unsure at all n locations
  Clone ID: LIB3281-014-P1-K1-B8
cttcccctcttnctttctttctcccctcgccgtcgcctcctcctcctgctcggcccaaaccctaatcccctctccccccccgcgaaccgaggccgcgggcgcgcaggcgggcaggcgcggggcaaaatggcgggcaaggaggacagccggatcttcgtgggcggcctctcgttccacaccgacgagcgcaagctcgaggacgccttccgccgcttcggcaaggtcgtcgacacccaggtaccggaccgtcgccgcgccgctccgcgtatgctttcgcttgttgttttttatttattgtttcgcgggtatgtatgtgtatatagctgctagatctgcggaattagatggtgttgagggtaggaaggcgaatgtgatgcacatggccaaggt

SEQ ID NO: 4548 - DNA, 388 bp, Triticum aestivum
  Clone ID: LIB3281-014-P1-K1-B9
cggacgcgtgggatcgccttcggtcgcttcgatgactccttcagcttggcctctttcagggcctacatcgccgagttcatctccaccctcatcttcgtcttcgccggcgtcggctctgtcatcgcctacaccaaggtgagcggcggcgcgccgcttgacccatccgggctgatcgccgtggcgatttgccacgggtttgggctgttcgtcgcggtcgccatcggcgccaacatctccggcggccatgtgaaccctgccgtcaccttcggcctcgccctcggcggccagatcaccatcctcaccggcatcttctactgggttgcccagctcctcggcgccatcgtcggcgccttcctcgtccagttttgcaccggcgtggccaccccta

SEQ ID NO: 4549 - DNA, 312 bp, Triticum aestivum
  Clone ID: LIB3281-014-P1-K1-C1
acgctcacttgaaaacacccgagcaaacctctccgatctcccatcccggcgcccggcgctggtcccgcgatggcccgtacgaagcaaacggcgcgcaagtccaccggcggcatggccccggggcagcagctggctaccaaggcggcgcgcaagtcggcccctgcgaccggcggcgagaagaagccgcaccgtttacggccgggcacctttgtgctgtgcgagatccgcacgtaccaaaagagcacggcgatgctcatgcggaagctcccctttcagcgcctgaggcgagagatcgcgcaggacttcaagacc

SEQ ID NO: 4550 - DNA, 398 bp, Triticum aestivum
  Clone ID: LIB3281-014-P1-K1-C10
cccacgcgtccggagccaaacacctcgtccctcactcccacttccaccttcgaagctccagcggcagccatggcccccaaggcagacaagaagccggccgccgagaacaaggtcgagaaagcggcggagaagacccccgcgggcaagaagcccaaggccgagaagcggctgccggcaggcaagacggcgtccaaggaggccggcggcgaggccaagacgaggggccggaagaagggcagcaaggcgaagaagggcgtggagacgtacaagatctacatcttcaaggtgctgaagcaggtgcacccggacatcggcatctcctccaaggccatgtccatcatgaactccttcatcaacgacatcttcgagaagctcgccggcgagtccgccaagctcgc

SEQ ID NO: 4551 - DNA, 343 bp, Triticum aestivum
  Clone ID: LIB3281-014-P1-K1-C11
gtgttggagaccacaaatggttcatgattactaatcgaaccaagcagttgcaacattcccttgccatggcatagtcgaaaccaaaccaactagatcacacaagttctccggcactcataaacactggccattaaactgacacgatgtcttactgcagcagtttctccttaaataggcaatggacagaatattatgaactctggagttcatgcaaggctccatgccatatgatgcgtgtaaaaggtggatccattccatacaaagtctgagcgctttgaatcgtggaacttgaggttgaagcgggacttggggatggacagctttgactccaggatggaagcaa

SEQ ID NO: 4552 - DNA, 341 bp, Triticum aestivum
  Clone ID: LIB3281-014-P1-K1-C12
ggacaccacaaagggttcatgattacgaatcgaaccaagcagttgcaacattcccttgccatggcaagtccgaaaccaaaccaactagatcacacaagtactccggcactcataaacactggccattaaactgacacgatgtcttactgcagcagtttctccttaaataggcaatggacagaatattaggaactctggagttcatgcaaggctccatgccatatgatgcgtctaaaaggtggatccattccatccaaagtctgagcgctttgaatcgtggaacttgaggtagaagcgggacttggggatggacagctttgactccaggatggaagcaatgc

SEQ ID NO: 4553 - DNA, 360 bp, Triticum aestivum
  Clone ID: LIB3281-014-P1-K1-C2
ctctcgccttgtttgctttgttcttcacaaggaaagtcaccatggcaagcaggggcagcatcccagccaccaccgtccgtgagatccgtgttgcgcagcgtgcggacggtccggcggcggcgctggccattggcacggcgaacccgccccactgcgtgccccagggcgactaccccgactactactttcgcgttaccaacagcgaccacctcaccgaccttaagcccaccttcgccaagctatgcgggatgacaggcatcggcaggcgtttcttccaccacacagacgaactgctcgctgcgcacccgggcatgttcctcgacgcccggctggacgtcgtggctaccgccgccccggagc

SEQ ID NO: 4554 - DNA, 392 bp, Triticum aestivum
  Clone ID: LIB3281-014-P1-K1-C3
cctaatgctcctactagctttctgacgttggcaaatgatctgactcctctcacttggcctaggaggaacaccactgatgatgagagcagatcctttcccttaatagattagcatcattccattcttactttgtagtagaattggtagtgatagagtgggtgaatctatgtgatgtagagatacactaagatcatgcaaaaatatatattagttctgctaatgcttaccagtgaattcaagtctgcttatttgaaggtccaacgcttgtgcatactgatttgtgtcctctgtgatttggggagaggaaatagtaatgttgccaattgatgtagtggtttgcgattcggatcaactaaagtgaaagtgagatattgagatgtggatcacactag

SEQ ID NO: 4555 - DNA, 399 bp, Triticum aestivum
  Clone ID: LIB3281-014-P1-K1-C4
gagaatttgaaagtgaattatatgagcgttttggctctttggttaagatgcctctcctgaagccagagagagctccattgcctggtgatgtcaaaactatcttagatgagggaatgagcttattcagactgcatcaaagcaggcatgggagagtggagccatcaaaaggttcatatgcccaagaatgggctcagtgggagaaaagactacgtgtggtcttgtcaaggaatgctaattatcttacatccattcaggttccatttgatgttgcggtgaaagaagtactggaacagttgaaggctgttgcaaaaggtgatgtcaaaactcctgatactgcaaagcgaaggtttgggaatatcatttttgctgcggttacggtaccccaggcagatatattga

SEQ ID NO: 4556 - DNA, 398 bp, Triticum aestivum
  Clone ID: LIB3281-014-P1-K1-C5
gttgacatgccctggtatacgcggtaggcttccaagtcttgggcttgggccgccccatggtggttgggccgactcttccttccattgctataccctgggggcttaacatcgtccatagcccttgagtcccaccctgcgccttagtaacgggaaaaaccgagaaaaaatatatgcctaaaccatcggaacggagggagtacaattcccgtatattaagcatgctttgtgagattaagtctagagtctagacctttataatatgggctcaccacataatctgacagatcatattttttagtttatatggaagaacagggtgtggctcatttgcctcttgttttaataacatatactccctccgtcccctaatgtaggacgttttttgacactaatgtagt

SEQ ID NO: 4557 - DNA, 406 bp, Triticum aestivum
  unsure (1)...(406): unsure at all n locations
  Clone ID: LIB3281-014-P1-K1-C6
cgtgacgcgtggngatcgnccttcggntcgcttcgatgacctccttcagcttggccctgtttcagggncctacantcgccgagttcatctccaccctcatcttcgtcttcgccggcgtcggctctgtcatcgcctacaccaaggtgagcggcggcgcgccgcttgacccatccgggctgatcgccgtggcgatttgccacgggtttgggctgttcgtcgcggtcgccatcggcgccaacatctccggcggccatgtgaaccctgccgtcaccttcggcctcgccctcggcggccagatcaccatcctcaccggcatcttctactgggttgcccagctcctcggcgccatcgtcggcgccttcctcgtccagttttgcaccggcgtggccacccctacacacgggct

SEQ ID NO: 4558 - DNA, 389 bp, Triticum aestivum
  Clone ID: LIB3281-014-P1-K1-C7
aggacttccgcgacccgaccaccgggtggtacgacgagtccgacgggacgtggcgcaccatcatcggctccaagaacgactcggaccactccggcatcgtcttctcgtacaagaccaaggacttcatcagctacgagctgatgccggggtacatgtaccgcggccccaagggcaccggcgagtacgagtgcatcgacctctatgccgtcggcggggggcgcaaggccagcgacatgtacaactcgacggccgaggacgtgctctacgtgctcaaggagagcagcgacgacgaccggcacgactggtactcgctgggccggttcgacgccgccgccaacaagtggacgccgatcgacacggagctcgagctcggcgtcgggctgcggtac

SEQ ID NO: 4559 - DNA, 390 bp, Triticum aestivum
  Clone ID: LIB3281-014-P1-K1-C8
gttgacatgccctggtatacgcggtaggcttccaagtcttgggcttgggccgccccatggtggttgggccgactcttccttccattgctataccctgggggcttaacatcgtccatagcccttgagtcccaccctgcgccttagtaacgggaaaaaccgagaaaaaatatatgcctaaaccatcggaacggagggagtacaattcccgtatattaagcatgctttgtgagattaagtctagagtctagacctttataatatgggctcaccacataatctgacagatcatattttttagtttatatggaagaacagggtgtggctcatttgcctcttgttttaataacatatactccctccgtcccctaatgtaggacgttttttgacact

SEQ ID NO: 4560 - DNA, 354 bp, Triticum aestivum
  Clone ID: LIB3281-014-P1-K1-C9
gaggaggctagggcttgctgtgtggcgacttttgatgttcctcgcccgccgcatgtttgttcaccttgccggccgcttcaatcaagcagagccgatcccttaatagattagcctcatttcattcttactctggcgtccaatagatggggtctcgtatggtgtgcctatcagacgagtcgttacagctaagtgacactgatttcgatgactatgctgagaaggcgtacacagaccttaaggtttgcaagcttgtggggaggatcggctgcccacagcggtatatgcccgttctgcctccgggggaagaaacatgactaccggtccaatgagctggttgagcacgcatttggtgtg

SEQ ID NO: 4561 - DNA, 393 bp, Triticum aestivum
  Clone ID: LIB3281-014-P1-K1-D1
gaggaggagagggtttttggagaggagactcttgccattcctcgccggccggatctttgctcacctcgccggccgcttcaatcaatcagtgttgattaatcggcgtcggatccgtcgatctaggagatccatgccaccaagagatggggtctcgtatggagtgcagttcagacgagtcgtcagagctaagtgacactgatatcgatgactatgctgagaaggcgtacacagacctcaagtctggcaagcttgtggcgaggttcggcgccgacaggtttagatgcccgttctgccccgggaagaagaagcaggactaccgctacaatgagctgcttcagcacgcaattggtgtgggcgcatccaaccgtgctgccaaagtgaaggcaaaccatc

SEQ ID NO: 4562 - DNA, 394 bp, Triticum aestivum
  Clone ID: LIB3281-014-P1-K1-D10
aattccccaaacttcgtgtcaaggatgctgatgctacggctctgaatgtcttcaagattctccgggacagtccagtcgatggtcataaaaatgtaacccttcgtgaagtgcgcatgactctgaggaccttggctgagattcaggaagaagaatgaagatggcgctactaggaagcaatatcgtctcttgctctaatatgaactagctttgcagtattgtagtatttgaatctttcctatgttgtcgctctgtgtctcgatcttcaaaactgctggatggatgtgatgttttgctattttcttgcttcgcaaggttgaatcatccttcgatcttgacatgcccaccagattcgagcgtaagcttttgggctagcgataggggcggcatgtacttg

SEQ ID NO: 4563 - DNA, 388 bp, Triticum aestivum
  Clone ID: LIB3281-014-P1-K1-D11
caagttcacgtccaagtcgctgcagcggcaggcgcgcaagtgcgagaaggaggagaaggagcagaagctcaaggtgaagaaggccatcgagaagggcaacgtggacggcgcgcggatctacgccgagaacgccatccgcaagcgcaccgagcacatgaactacctccgcctcgcctcccgtctcgacgccgtcgtcgcccgcctcgacacgcaggccaagatgcaggccatcggcaagtccatgggcaacatcgtcaagtcgctcgactcctccctcgccacgggcaacctccagaagatgtccgagaccatggacagcttctagcgccagttcgtcaacatggaggtccaggccgagttcatggagggcgccatggccggctccacc

SEQ ID NO: 4564 - DNA, 185 bp, Triticum aestivum
  Clone ID: LIB3281-014-P1-K1-D12
gcagcccccaaatcggcgacccctctctctccgatctccaatcccgaggtgggagacgcgcaccaaccgggctcgatgcgggcgatctcgtaggcggagggagggatgctgcggtcgctgttgagcgcgtcggttcgctttcgctgtttgcactttaactgctttggcctgttgttctttctttt

SEQ ID NO: 4565 - DNA, 396 bp, Triticum aestivum
  Clone ID: LIB3281-014-P1-K1-D2
gaccgcctactgcctttgcgagttgcaaccctcaggcgccgccgtcgcaacgacccaccagaccctctctccgccgcctccaacctagtgctccggcgagcttgccggcggaggagcgatgggtgagcggaaggtgctgaacaagtactacccgccggatttcgacccggcgaagatcccgcggcggaagcagcccaagaacaagcagatcaccgtgcgcatgatgcttcccatgagcatccgctgtggcacttgcgggacctacatctacaagggcaccaagttcaactcgcgcaaggaggactgcatcggcgagacatacttgggcatacaactatttaggttttacttcaagtgtactaggtgctcagctgagatgaccttcaaaacagaccc

SEQ ID NO: 4566 - DNA, 217 bp, Triticum aestivum
  Clone ID: LIB3281-014-P1-K1-D3
gcttcagccatggcgtccaaggcctgcatcctgatcctgctcctcgttgcagctcttctccatacaggtcatgctagtggcgacgccgggccgtgccaactggaggacatccgcgtctcgtcggtgttgacggggcggcgggtcctgaatgtgccggagtacagcgtgacggtggagaacacgtgctcgtgcgcgcaggcgggcgtggtgatgtact

SEQ ID NO: 4567 - DNA, 400 bp, Triticum aestivum
  Clone ID: LIB3281-014-P1-K1-D5
cgccccactctcctctcacctcacctggtccggtgccagctgctgccgtgctgctttgcgttgttgctcggttcaagaacacgggcgcacggagggttgaaaaaggggggagccacccagcaacgacggcataaaccaaatcaatcagtcagccggactcgcctggagattggaggagccaaaaagagagtggggagagcttctctcggtcagcaaccaaagcgcgtccccaccccctctgcattgagggaggagggcatttggtgcgggcgggagatggggacgaggaggaggggtggcggaatgccgggcgcggcgtcgctgctgctcctggcctgctgctgctccgtctggccccgggcgcaaatcttggtcgccgccaccaccgacgccactgacc

SEQ ID NO: 4568 - DNA, 402 bp, Triticum aestivum
  Clone ID: LIB3281-014-P1-K1-D6
cccacgcgtccggtcctctctcgcacgccatggacgccacggccaccggcgccaaggggaagaagggtgcggccgggcgcaaggccggcggccccaggaagaagtcggtgacgcggtccgtgaaggccgggctccagttccctgtcggccgcatcgggcgctacctcaagaagggccgctacgcccagcgcgtcggcaccggtgcccccgtctacctcgccgccgtcctcgagtacctcgccgccgagctgctggagctcgccgggaacgccgcgaaggacaacaagaagagccgcatcatcccccgccacctgctgctcgccgtcaggaacgacgaggagctcggcaagctgctggccggcgtcaccatcgcgcacggcggcgtgatccccaatatcaacc

SEQ ID NO: 4569 - DNA, 367 bp, Triticum aestivum
  Clone ID: LIB3281-014-P1-K1-D7
tcggcggcggcggcccataggggccggccagatatagccggatcccttggacggtggtgacgagatcgttgaggaccccggtgatctccgtcggggagtagacggcacggtgaagggcggcgactggccggtggaggcgcccctcggtggaaccgtgcagcgctgcggggagagcgagcggcacggtggagaggtcgggagaggtcggacggtgcggcagatagggttggtgatgcggcggttgtggacagcaacagaggtgtggacaatggcggggtagggccggggcgcacacatgatcagacccaagctaccttttaccaaattggtaagagctaggaccccacccggtttagggccaatgttg

SEQ ID NO: 4570 - DNA, 386 bp, Triticum aestivum
  Clone ID: LIB3281-014-P1-K1-D8
cgccccactctcctatgacctcacctggtccggtgccagctgctggcgtgctgctttccgttgttgctcggttcaagaacacgggcgcacggagggttgaaaaaggggggagccacccagcaacgacggcataaaccaaatcaatcagtcagccggactcgcctggagattggaggagccaaaaagagagtggggagagcttctctcggtcagcaaccaaagcgcgtccccaccccctctgcattgagggaggagggcatttggtgcgggcgggagatggggacgaggaggaggggtggcggaatgccgggcgcggcgtcgctgatgctcctggcctgctgctgctccgtctggccccgggcgcaaattttggtcgcctccaccac

SEQ ID NO: 4571 - DNA, 201 bp, Triticum aestivum
  Clone ID: LIB3281-014-P1-K1-D9
gaagagagagccgcccttcgctccccccagaggccagagacggacacgatggcggcgcccacctcctgcgcgggatccaccctcgcccccttctcccaccccaaaaccctagccggcgccaccgccgccggaggctcatcctctgtcgccttctcttcggccgccttccaccccgcatgcgccctatcagtctcgggcgcc

SEQ ID NO: 4572 - DNA, 252 bp, Triticum aestivum
  Clone ID: LIB3281-014-P1-K1-E10
gccgtacaccatgcgccggctctttacgggggagctgggcccggagcgcggcgacctgtacatctacagccgtcacttcaacccgacggtgctggcgctggggcggcagatggccgcgctggaggggaccgaggccgcctactgcacggtgtacggcatgtcggccatctcctgcgtgctgatgcagctggtgggcgccgggggccacgcggtggggtcttgctgactgttccgcggcccccacgcgctgtg

SEQ ID NO: 4573 - DNA, 140 bp, Triticum aestivum
  Clone ID: LIB3281-014-P1-K1-E12
gatatagatcgcccccggtcaccataaagggtacatgcttacgagggggggggtgctaatggccagcgcttatttagactaacctacatttactgctctacatgctgtttaaccacaacatcccatgggacaagcgccgt

SEQ ID NO: 4574 - DNA, 360 bp, Triticum aestivum
  Clone ID: LIB3281-014-P1-K1-E3
cccacgcgtccgggcggtggaggttgtcgagccggccatcgtcacggtcgaggagactacggtggcagcggtggcgattgtcgagccggccgtcgacacagttgaggtggcaacggctgaggctgtggagccggccgttgtcgccgccgaggaggccgcgaaggaggaagctgttgcaccggccgtgaccgagctggcgaaagaaccggaggcagctccagcggagaccaaggaggccgagacagaggccaaagagaccgagcccgaggctgtccaaccggcggcagccgccgaggaggcgcctgctgtgccggcagtgactgagaccaaagagccggaagctgcccctgccgagggaac

SEQ ID NO: 4575 - DNA, 398 bp, Triticum aestivum
  Clone ID: LIB3281-014-P1-K1-E4
cccacgcgtccgcggacgcgtgggcgatgaccacgacaacggggacgtcttgatgtacaccgggagcggcggccgtccgcgcaacggcggtgaccacctctccgaccaggagttccagcgtggcaacctcgccctcgcctacagctgcaactacgacgtcgaggtgcgcgtcatccgctgccacgactgcgacgccagccccagcggcaagctctacgtctacgatggcctgtacagggtcgagtcctccgcctacggccctggcaagtccggccgcgaggtctgccagttcaagcttgtgcgcctgccaggccaggacgcgctcggcagcaacacctggcgctccgtcagagacctcaccgacgcgctcgtcgccaagatccgcccccccggctacc

SEQ ID NO: 4576 - DNA, 399 bp, Triticum aestivum
  Clone ID: LIB3281-014-P1-K1-E5
cggacgcgtgggctcagctccagctccccaatcaagctcgccaaaagccctagcccgcgagctccggcggccaccgctccctccctcccctcccccgcacgaccggcgcggcctccgtccgtcccctcaatcggggccgagcaatgccccggcggcggccgagggccggggagaagcggatggacgccgcgatcgaccacttcgccgagatgggataccgcaaagccgacgtccgccgcgtcgtcaacaagctcctcaaggatgtgtatgggaaggatgggtggccgttgctggaggacagttgttactccgtagtgcaagaagctgctcttgagttggaggagcaggagaagttgcagcagcagcagaatgaggatgatgatggtgacgatgaggggg

SEQ ID NO: 4577 - DNA, 401 bp, Triticum aestivum
  Clone ID: LIB3281-014-P1-K1-E6
atcgggacgaggcaatggcgtctccgagattcaagcccgtggaggagtgcagctccgaggggaggtcggggcagacggtggccgcagacttcgacggcacgctgctccgctcctccaacgccttcccctactacctcctggtggcgctggaggccggcagcgtcctccgcgccgtggcgctgctcctgtcggtgcccttcgtgtacgtgacctacatcttcttctccgagtcgctggccatcagcaccctggtgtacatctccgtggccgggctcaaggtgcggagcatcgagatggcggcgcggtcggtgctgcccaagttctacgcgcaggacgtgcacccagagagctggcgggtgttccggtccttcggcaagcggtacatcatcacggccagcccc

SEQ ID NO: 4578 - DNA, 371 bp, Triticum aestivum
  Clone ID: LIB3281-014-P1-K1-E7
acgcccacgcgtccgcccacgcgtccggccacggaggaggcaggatcgaaggtgcgcgaccgagcgggagctggccgtaccggagatccgagcctccggagctcaaaatcccccccgtcgccgccgccgtcgctctcgcgccgcggcaggagggtgatgagatcttcgcgggcgggcctcgctcggtcataagatgctagccggcggcgttggcagcaacagaggcggcagttcccatctctcctccccctcctcccagagggacctacgcggaggccggagcttcctcttcgggaacacctggtttatgctctccgactacccggcgcgcctgctgcacaccgcggaccgtcgggcgcccgctgacgtct

SEQ ID NO: 4579 - DNA, 282 bp, Triticum aestivum
  Clone ID: LIB3281-014-P1-K1-E8
cggacgcgtgggctcagctccagctccccaatcaagctcgccaaaagccctagcccgcgagctccggcggccaccgttccttccttcccttccccggaacgaccggcgcggcctccgtccgtcccttaaatcggggccgagcaatgccccggcggcggccaagggccgggaagaagcgtatggaccccgcgatcgaccacttcgccgagatgggataccgaaaagccgacttccgccgcgtcgtaaacaagctcctaaaggatgtatatggaaaggatgggt

SEQ ID NO: 4580 - DNA, 83 bp, Triticum aestivum
  Clone ID: LIB3281-014-P1-K1-E9
gtccgtcgtgcacggcccggtccggtacacctgggccgagacctaccggcggtgccgccgcctcgcctctgcgctggcgcgcc

SEQ ID NO: 4581 - DNA, 387 bp, Triticum aestivum
  Clone ID: LIB3281-014-P1-K1-F1
ggagcttgcaggcaacgctgccaaggacaacaagaagacgcgcatcatcccgcgccacctgctgctcgccgtccgcaacgaccaggagctcggcaggctgctcgctggcgtgaccatcgcccacggtggcgtgatccccaacatcaactctgtgctgctccccaagaagtccgccgcagccgagaaggaggccaagtcgcccaagaagaaggccgccaccaagtcccccaagaagaaggccgccgccaccaaggagtaggcgccccatagcctagttccataatcagcgagaagatgacgagcctttttttttttgcgggattggatcgtgtatgtaattgcctagtctgtagtggctcgttcattaccttgatgagcaagccatta

SEQ ID NO: 4582 - DNA, 239 bp, Triticum aestivum
  Clone ID: LIB3281-014-P1-K1-F12
ctcaaggaacagatgacccctctatctgatttcgaggacaagctctaaactgttgcttctgttacatggtctagtttgcttttgctgctaagagagctgcactattatctgtctattgagtcgtcgtcgctgtattgctattggaatgtactcctatctgtcgtgatactggcactttgttttgatgtctgtcgatgttaaaacttagattatatatctgtcgcgatacttttgatgtc

SEQ ID NO: 4583 - DNA, 397 bp, Triticum aestivum
  Clone ID: LIB3281-014-P1-K1-F2
gtcggcgatagccgagaggatatcagtgatactgcagaacataacgtccctgatgacatctttcatcgtcggttttgtcattgagtggagagtggcgatccttattctggccactttccctcttcttgtgcttgccaactttgcccagcaactttcgatgaagggctttgctggtgacacagcaaaggcacacgccaagagcagcatggttgccggtgaaggcgtgagcaacatccgcacagtggcggccttcaacgctcaaaacaaggtcatgtctctcttcagccacgagctgcgcataccagaggagcagatcctgcgacgcagccagaccgcgggccttctgtacggcctctcgcagctctgcctctactgctcggaagcgctcattctctgg

SEQ ID NO: 4584 - DNA, 395 bp, Triticum aestivum
  Clone ID: LIB3281-014-P1-K1-F3
cggacgcgtgggaaaggcgtcttcgtactcgcctctctccgcgcaaccgagccttccgcccacctcctccccatttcgccagcggcgcacccaccaaccacccccacccgccgccatgagggagtgcatctcgatccacatcggccaggccggcatccaggtcgggaacgcgtgctgggagctgtactgcctcgagcatggcattcagcctgatggccagatgcccggtgacaagaccgttgggggaggtgatgatgctttcaacaccttcttcagcgagactggggctgggaagcacgtcccccgtgctgtcttcgtagatctcgagcccactgtgattgatgaggtgaggactggcgcttaccgccagctcttccaccctgagcagcttatca

SEQ ID NO: 4585 - DNA, 400 bp, Triticum aestivum
  Clone ID: LIB3281-014-P1-K1-F4
gagggctgtgtgcatgatctccaactccaccagtgtcgtctaggtcttcttccgcattgaccacaagtttgacctcatgtacgccaagcgtgccttcttccactggtacgtgggtgagggcatggaggagggagagttctctgcggcccgtgaggatcttgctgccctggagatggactatgaagaagttggtgctgagttcgacgagggtgaggactgtgacaagggcgacaagtactagagcctgcctacaggtgctttcccaaggcgtgctgctgctatcccatgatctgaccgagtggcttcatctgttatctgactgttcgaatctttgctctgtggcgttagatgtataacctgttgtgttgcaagacccttgtatctttgaacctgctatgca

SEQ ID NO: 4586 - DNA, 403 bp, Triticum aestivum
  Clone ID: LIB3281-014-P1-K1-F5
ggacggcatggtgagcgtcatcgcgcacgagctggccgagatggcgtccaacccgctggccaacgcgtggtacgccggcggggacccctccttccccaccgagatcgccgacctctgcgagggcatctacggcaccggcggcggcggcgcctacaccggccagctgctcaccgacggcaggtccggcgcctcctacaacctcaacggcgtcggcgggcgcaggttcctggtgcagtgggtctgggacccctaccgcagctactgctccggccccaacgcgctcgaccagcactagcactagcgtctctttcgtctcaccgccgccgcaccctcgccgcatctagcgtagcgctagcggtagtagtgttcctccttcctccggcattggattccttcctcggga

SEQ ID NO: 4587 - DNA, 404 bp, Triticum aestivum
  Clone ID: LIB3281-014-P1-K1-F6
cgcttctcctccgctccccgccccgcctcgagcagctcaggaacgcgcgcagccatggcgacggagaccgagaccttcgccttccaggccgagatcaaccagctcctctcgctcatcatcaacaccttctactccaacaaggagatcttcctccgcgagctcatctccaactcctccgatgccttggacaagatcaggttcgagagcctcacggacaagagcaagctcgatgcgcagcccgagctcttcatccacatcatccccgacaaggcgaccaacacgctcacgatcgtcgacagcggcattggcatgaccaagtcggacctcgtcaacaacctcgggaccatcgccaggtcggtgaccaaggagttcatggaggccctcgccgccggcgccgacgtgtc

SEQ ID NO: 4588 - DNA, 392 bp, Triticum aestivum
  Clone ID: LIB3281-014-P1-K1-F7
cggacgcgtgggaacccgcactgcgcccactccgatctccccaatcccctccaaatccctcgccggaaccctagccccgcgccgccaccatgcctccgcgccgctctaagggagggggcgggggcaaacccgaccccgaagccaccgacgccgagcctgtggagaccgcggtcgacgccatgtccgaagacgaggccgacgacgacaactccaaggaggagtccgctgagagcggagctgaggatacggacggcgaggactccaaggaggaagccgccgagaccaaggccgaggagatggatacggagcatcaagaggaagccgccgagaccaaggccgaggagacagtcgccgaacctgaagccaatggtgcagatgcggagaccaaagtc

SEQ ID NO: 4589 - DNA, 391 bp, Triticum aestivum
  Clone ID: LIB3281-014-P1-K1-F8
ggacggcatggtgagcgtcatcgcgcacgagctggccgagatggcgtccaacccgctggccaacgcgtggtacgccggcggggacccctccttccccaccgagatcgccgacctctgcgagggcatctacggcaccggcggcggcggcgcctacaccggccagctgctcaccgacggcaggtccggcgcctcctacaacctcaacggcgtcggcgggcgcaggttcctggtgcagtgggtctgggacccctaccgcagctactgctccggccccaacgcgctcgaccagcactagcactagcgtctctttcgtctcaccgccgccgcaccctcgccgcatctagcgtagcgctagcggtagtagtgttcctccttcctccggcattggatt

SEQ ID NO: 4590 - DNA, 389 bp, Triticum aestivum
  Clone ID: LIB3281-014-P1-K1-F9
agaacccgcacgacgacctatctccacctcgagcgcatctccacgatggcagtgcgccgccgcggccggcccccgcccctctgccgcgcgtcaccaccgccggccacctcccctccgccgtgcgctgcccccctccaccgccatcatcggccaccgcccctccgtcgtgctccgccccaccccttcggcttcagtggatccgcaccgccgccgcccttcctctccaccgtcacccgtgcctgcccgcgctcatccatcgccgcgttaaggcttcagtgaccacggcgcctcggctgcgacccaggcctgcttggccgccggatggatggataccggccgagctcgtccttggcgccccggctgcgacccatggttgattggccgccggc

SEQ ID NO: 4591 - DNA, 391 bp, Triticum aestivum
  Clone ID: LIB3281-014-P1-K1-G1
cggacgcgtggggccgctttccccgtctccccctcaccgcgcggcgacgccgagcgacccagcggcgagcccggcatgcatcacgaccccaaccccttcgacgagggcaccgccggcgacgagaaccccttctcgaatggaggaggccgtggcgggaagcagcagcacggcttccggcccaccgagcccgtcggcttcggcggcggcggcagcaggggcgacgccaccgtcgacgtgccgctcggcaacatgggcgactcgaatggcaaggcgagggagctctcgtcgtgggaatcagatctgaggcgccgtgaggcggatatcaaaaggagggaggaatcactgaagaatgctggagtgcccatggaggagaagaattggccgccttttt

SEQ ID NO: 4592 - DNA, 400 bp, Triticum aestivum
  Clone ID: LIB3281-014-P1-K1-G11
cggacgcgtgggagcgaaccaaacgtgccggaaaagaagctcccctcgaacccgagcagactcgagccaaccccagagcggcggagcagacgagggggaatcccgatggcggcggtggcgatggacatcgcgaagccctcggcgctgccggcgagcgtcgacgacccgtcggcggcgtcggccaagggcagggccggcggcggggaggggctgcgccagtactacctgcagcacatccacgacctgcagctccagatccggaccaagacgcacaacctcaaccgcctcgaggcccagcgcaacgacctcaactctcgagttagaatgcttcgggaagagttgcagcttcttcaagaaccgggctcatatgttggcgaggttgtgaaggttatgggcaagt

SEQ ID NO: 4593 - DNA, 396 bp, Triticum aestivum
  Clone ID: LIB3281-014-P1-K1-G12
ccgcattgcattggtgccactcggaccctgctcgtgtctggacgtgtgcgtgtctgggtcgtcgtgggtaccgcgaacgactgggtcgtgtcgcagctcgatttccattctgctttgccgatcgccatgggcaaaactcccaaaatgattcgattcaccaacccgggtttgaccaaaatgtagcttgacctgccaggtttgggggagaactcgcagcctgatttcgtcaattctgaatccatatcattgatcggacattgtgagaacttgagtcatgtggtgtttgtaagtgatcgatgctagcgcgctctaatggcattgttgtgtggtgtttgtaaggggctgatgctagggatttctacagtgcgttgcaatggcactaattaacatgcgcat

SEQ ID NO: 4594 - DNA, 341 bp, Triticum aestivum
  Clone ID: LIB3281-014-P1-K1-G2
gatggctgccgccttttcctcatgtagcatcagcttcactttcctagttaagttctcctccaaaacaccatctgccttctcttgctccgatgggtcacacttgaaacgccaccaaaattcttccactattttggaagctgctgttcttacttctggaccaggggaccacttgtagtcctcccaacacaataccggtttctgatcaatttttggaccaattggcggtggatacatctggcgcactaaggcacctagcactgttgatggatcacgagcgctgtatgggtgcctttcccatgccatgccaacgggaactataagcggtctgtcaatttcctcta

SEQ ID NO: 4595 - DNA, 297 bp, Triticum aestivum
  unsure (1)...(297): unsure at all n locations
  Clone ID: LIB3281-014-P1-K1-G3
nctttagatgagaaggcagatcataatagccacccatttaacattttatttaggagtttacacacatgccttcacagaccggaaagggaatttaatttcaaccgccccgacaactattgttctgcattacctgatctaaactaatccaaacactacggtatggtgactatctataatgttgcacctccagatgtctacaaaatagccatgcttaacaactgcatttaccatgctgacatatggaccgctccaaaactgccacttgtagataatgactgcatgagcgttattaaaata

SEQ ID NO: 4596 - DNA, 402 bp, Triticum aestivum
  Clone ID: LIB3281-014-P1-K1-G4
cccacgcgtccgcccacgcgtccggccacagaaatgattctgaggcatcacactatgtaaagaaacatttcaagatacccagttcagctcccccgagcacctgatttacggggaaaatctggaaacgcctcgaaggtacatataacggatggacggtgctcggccttgtgcaacctaggaagcgtattttgtaatgattgtgcattattagcagtagaagctagggaaccatacgctagttctgattcatgggcattggattgattggttgcttctgcccaggaaagatttagatgtcttacccttgtttctgtggggagtttttagctggattttgatgacatttctgactgatgggaatgttggtctgtttgtgtggtttcagaactgatgcctacaatt

SEQ ID NO: 4597 - DNA, 401 bp, Triticum aestivum
  Clone ID: LIB3281-014-P1-K1-G6
cggacgcgtgggcgcgctcggcgtcttcccggcgctcgcgggacggctcgtcacgctccccgacgaccgcatcgtcatccggtgcgacgacggcgctgccgttgagttctaccatgcggtggcgcccgctctgtcgctcgccgacttcctcgtgcgcgacgccgacgtgcccaccaggctgacgaaagatctgttcccgatggaccgcaccgtcagctacgaaggccaccgccgcccgctcacgtcgtttcaggtcaccgtgctcggcgacggcgctgtctttgtcggcctcgtcgccaaccacgccgtcgtggacggcacctcattctggcactttttcaacacgtgggctgggctgtgccgcggcgagccagtccagccgccggacttcagccgcaact

SEQ ID NO: 4598 - DNA, 378 bp, Triticum aestivum
  Clone ID: LIB3281-014-P1-K1-G7
cccacgcgttcggaagaacaaatgaacagcgagaaacatatttctgagctgaatcaagaccttgccaatcttacaagcaagcttgaactgatattatcagagaaagacacagttgataacaagctggccactctactaactgacatcacagcacgtgatgaaaagatgaaacagatggatggccaccttagtcagcttcaacttgagcatgccaagatatcagcagagtccgctattgtgcatgagtccctgtcggagctgcgtgctcgggtttctgagctcgaggaacttgtggagaagcagaacctcgcgatctctgagggcgccgaggggaagcgtgaggcgattaggcagctgtgcttcacccttgagcattac

SEQ ID NO: 4599 - DNA, 390 bp, Triticum aestivum
  Clone ID: LIB3281-014-P1-K1-G9
aaggccagcactcaccctcccatccctcctctccggccgcaacccccggcgccgccgccatggtgaagtactcgagggatccgtccaacccgaccaagtcggccaaggcctgtggcaaggatctcagggtccacttcaagaacacacgcgagacagcgtttgctcttcgcaggatgcctttgggcaaggctaagaggtaccttgaggatgttctcgctcacaagcaagcgattcccttccggagatactgcagaggtgtgggtcgtaccgcgcaagtaaagaaccaccagccaaatgggcagggtcgctggcctgcaaagtcggcccagttcgtgttggatttgctgaagaatgctgagagtaacgctgaggttaaaggcttggacgtcg

SEQ ID NO: 4600 - DNA, 383 bp, Triticum aestivum
  Clone ID: LIB3281-014-P1-K1-H1
ggacgagaacttggggcgatcagatcagccagattgggtcactgttgaagctacaatttcacacatcaaaactgagaaattttcttatccagcttgcacaagggaggttaatggtaagcgctgcaacagaaaggtaacaaataatggtgatgggatgtggcattgtcccaaatgccagcagagctctcaaaattgtgagtaccgacacttgtttcagtgtaagatccaggatcacactgggactaccaatgctactgcattccaagaagctggccaggaaataattggcatctcagcggaagagcttttcatgattaaaaatgtagatctagatgacgcacgatttgcaaaaataatacatggtgcctgttatcagcaatttc

SEQ ID NO: 4601 - DNA, 391 bp, Triticum aestivum
  Clone ID: LIB3281-014-P1-K1-H10
tgttgtcagactaatacagaagaacaaaaaactaactgttgatgctttgtctgtccagctagccggcaagtcagataaaagtgtcatctgatacgagaaagtactactgtttacatttataaaagatacataagtgttaatttggcaagtctgttagttgataaccttacctgatgttaagagggtgagtggttagtgtaaaataactttgagatcatcttcttttgcagttctgaccaattttttcttcacatcattttgaaattcttagtttgttttttgagttattcatattgtacccatgtcatgctgaatgaacgtgcatgctgtgagagagatagatggaaactgtaattctttagtgtcattgtacattatgtagagttatatt

SEQ ID NO: 4602 - DNA, 176 bp, Triticum aestivum
  unsure (1)...(176): unsure at all n locations
  Clone ID: LIB3281-014-P1-K1-H12
aagatcgccgaggccaagcgccgcctcctcgaagagctccccgactcgtggaagggccccccggaggaccgcaccgtgcaccctgactgcatcaacgcctccaacccctatcatggctgctccgagtactgctttaagaagattgccgacgccaacgcagccnnnnngcgcgggga

SEQ ID NO: 4603 - DNA, 361 bp, Triticum aestivum
  Clone ID: LIB3281-014-P1-K1-H2
cccacgcgttcggcttgcagaacaaacagataagctaggtagcaagctgctccaaggctccaggacaccatggccacaaaccccggcctcttcagcgagtggccatggaagatgctcggcagcttcaagtacgtggtgctggcgccatgggtggcgcacggcatccaacaggtggcgaccaaggtgtggcgcgaggccgatctggggtacctggtgatcctcccgtcgatgattctccgggggctccacaaccaggccttgatcacggtgtccccgccttcagaacgcgcgcggcaagcggcagatcgtcgaccgcgcatcaagtcgagcagatcgaccggagcgcacttggacgacagat

SEQ ID NO: 4604 - DNA, 327 bp, Triticum aestivum
  Clone ID: LIB3281-014-P1-K1-H3
cggacgcgtgggcggacgcgtgggcggacgcgtgggcaaaaggcagcctcccccctttgccttcccacacatggtggtccggctctagggccctttcgcctcgtgcttggcggcggtgatggagccgtcgtcgtccatcacggtcgcctcctcgtcgtcctacctgtccaacggctctagcccctgctccggcgctctggcgccgctgcccgcggcggacgggtggggcggggctgggggagggggagggagcagcagcagcgtcgaggctgtgagtttgagttgcctcagcagcaacctcgagcgccttcttcttgtttttgaact

SEQ ID NO: 4605 - DNA, 360 bp, Triticum aestivum
  Clone ID: LIB3281-014-P1-K1-H5
cggacgcgtggggcatggccctgttggcctccaccggcgacagccatgcaagtttagctcgcctgtgtcagcgcatgcatggctgcatgctaccggccgatgctggtgtggccgtccgtcgatgggtcgatggtgcatgaaggcatgcttgtagacctgaactgcgcaacacggagcaggatggctaccgtctacgtgtgagatatactaatattgttccttccattgcatgatttgtctctcgtccgaaccgctggcttcagtacttgcgtgtcctccatcgatcgttcgttcgtcatcgtcactggatgtaatgtatgtaaaatgccgtgacgttcggaatataatataatatttttc

SEQ ID NO: 4606 - DNA, 267 bp, Triticum aestivum
  Clone ID: LIB3281-014-P1-K1-H6
cccacgcgttcggtcaactccttttgttcttctacctaggcggggagccaaactccattcataatcgccaagctgcacgcaatgggcgccgtccctgctctgatactagccggtctactcgccgtgctcacgtacgtgctttgcgcgctccactccatcgagtgggtgccgcaccgcctggagcgccagctgctctgtcagggcatccggaggcctctctgcagactgctgtccggatacgcggccgaatacatagccatgaccaaa

SEQ ID NO: 4607 - DNA, 202 bp, Triticum aestivum
  Clone ID: LIB3281-014-P1-K1-H7
cggacgcgtgggattgttcgcacaaattggcaaggtcgatgacgttcgcctggctacccatgaagatcgccatcccatgcgatgtcgtgatggctagtacgctacgggtggacatgctcacaaagcgctcgattcactgtatggtggtgatctaacgctcccggcagagagacttgacatgggtgatgaaagaggtgcagct

SEQ ID NO: 4608 - DNA, 360 bp, Triticum aestivum; identical to SEQ ID NO: 4605
  Clone ID: LIB3281-014-P1-K1-H8

SEQ ID NO: 4609 - DNA, 142 bp, Triticum aestivum
  unsure (1)...(142): unsure at all n locations
  Clone ID: LIB3281-014-P1-K1-H9
ggaagggcgggggcgacccacgcgnccgccnnnagaagagaaggcagaacacaanagccgagcaanaacaacaagggggggggccaancaaacaagcaccnacngaaaccccacaacccaaagcacggagcaagcacaacca

SEQ ID NO: 4610 - DNA, 305 bp, Triticum aestivum
  unsure (1)...(305): unsure at all n locations
  Clone ID: LIB3281-015-P1-K1-A1
cggacgcgtggggcacgcccgaactttactactgctacgggcacgcaccactagcacaccccgcatcgtcgccggatcggaagagcaggggggagagccgaggaggaagaaggccgaggatgttccgcaaccagtacgacaccgatgtcaccacctggagcccgcaggggcggctgttccaggtggagtacgccatggaggcggtgaagcagggctcggcctgcgtnggccttcgntccgacacccacgccgttctttgcggcggcaacaagttcggcaacgagcttttcttccaccagcgcaag

SEQ ID NO: 4611 - DNA, 113 bp, Triticum aestivum
  Clone ID: LIB3281-015-P1-K1-A10
gtttgagcaattgacagtaattagtaaagtactttgtactgagagtagcacaatctatcgcccccgtgttcggatgatattttggaagatccttatcgctgtcatctgttttg

SEQ ID NO: 4612 - DNA, 404 bp, Triticum aestivum
  Clone ID: LIB3281-015-P1-K1-A11
cggacgcgtgggcacaaacgccggctcgctctcgctccgtctccctccctcctcccccgctccgcgccctccgccgccagatcccgtcgagccccccgcgcccccgcgtcgaagatgagggagtgcatctcgatccacatcgggcaggccggcatccaggtcggcaacgcgtgctgggaactttactgcctcgagcacggcatccagcctgatggccagacgaacggcgacaagaccatcggaggtggtgatgacgccttcaacaccttcttcagcgagaccggagccggcaagtacgtgccccgtgcggtctttgtcgatcttgagcccaccgtgattgacgaggtccgcaccagcgcctaccgacagctctttcaccctgagcagctcattagtggcaagga

SEQ ID NO: 4613 - DNA, 409 bp, Triticum aestivum
  Clone ID: LIB3281-015-P1-K1-A12
ccacgcgttcgccttggaggagaattataacagggccgcgctcctttctctccctctctcggtctctcatcgcaggtttgggacaacttacttttgaccatggcagggaccttagtcctgccggttgctcttgagataacttttgcaggccgtacaggcggtcggcactgcaagtctcatggaaccaggaggactccctcaatgttggcaatgtcattgaaccgtcctgtaaggatggcagcatttgtcggtctgagatcggaacatagcttctcagccatgcgctcgtccaacttcaggtcaacagttgcatcttacagattctctagacagggaaggcgtgcttcttttgtaaccagagcaatgttcgagaggtttactgagaaagctataaaggtcataatgcttg

SEQ ID NO: 4614 - DNA, 350 bp, Triticum aestivum
  Clone ID: LIB3281-015-P1-K1-A2
cggacgcgtgggttttttttttcaagaaaagtatccctgattccgagggacttaaaaaaatacacaatagcatctcctctgttttgttgaatacaaggtacatgtatcaagatatcccagcctaacgggttgagggaaaaatggtgatttcgagaccacctcaacttgggggggaaatgtcagcagttcatatatatttacacagtaaaaacacgagcgatggtacaactttccaaagaataatacacactacctacattctttctttcctttaagaaaaatatgaacaatgcctatttactcacccctagaagaaatagctggtcaacagcaaacaaagaggattttac

SEQ ID NO: 4615 - DNA, 346 bp, Triticum aestivum
  Clone ID: LIB3281-015-P1-K1-A3
aagccacggggaagtcgaccaagaaggtggcggggcacgtcctcgcccggccggccgcggagaccagcgccgaggcgaggaacatcaagacgacggacgcggcagccgccagcaaggacgcggtcctgcagccgacgaccttcccgcccttcgaccgcctcggcggcctccccggcggaagcagcatgccgggattcagcctccccggcagcagcggcgccaccccgggcatcagcggcatcggcagcatgcccttcctcggcggcagctcccccggcctcggcggctccaccggtctcggcggcttcggcggcatgccggggtcccccgctgcagctgcccgcga

SEQ ID NO: 4616 - DNA, 328 bp, Triticum aestivum
  Clone ID: LIB3281-015-P1-K1-A6
gttcgggtttttttctttgagagaggccgagtagctagcctagtctagggtttcggtagagaggaagggagatccatggcggagacggagtaccgctgcttcgtgggcggcctcgcctgggccaccgacgacaacaacctccagcaggccttcagccagtacggtgagatccttgacgccaagatcattaacgaccgcgagacggggaggtcccgtgggttcggcttcgtcacgttcggcagcgaggagtctatgcgccaggccatcgaggagatgaacggcaaggagcttgactggcgcaacatcaccgtcaacgaggcccattccc

SEQ ID NO: 4617 - DNA, 404 bp, Triticum aestivum
  Clone ID: LIB3281-015-P1-K1-A7
cggacgcgtgggcgcagttgcatgttcgtgtccattggcgatgtgagccatttcttggacgatgccgccattggagaggatgtcccactcgctgcgagaggtctcatcgcggaggaagtcgaagacgcgcttgggtgggacagggagccagaaggaggtggcggcgttgaggacgatgccgggcggcctcccggggtcgtagacactctttctggtcatgaccctgacgtcctccgcgccgctccccgacagagtggtccactggtgcgcaacggaggctgttacgccaccacagaagcttgccaccattctctccactagcttgaggatgctctttctctcctccgagctagtggtcacttcgatgtcgcttgtggggatgttggtggccatggcccttgcta

SEQ ID NO: 4618 - DNA, 272 bp, Triticum aestivum
  Clone ID: LIB3281-015-P1-K1-A8
acgcgtacggtggctactctgggcaattctcctactctcgagcggggcaagagtgccaaggtcatggcaggttgtttcaagcacaagcggagcgatattggggggtgctaattttacctcaccatgtttatctagtgccgccgagctgggaggagcatcaatacaactgtcgcggcggctgtcttatgtggagcgcggctctattggtcacaacctgcattcattgatgatgatgatgagctctatcctccaagagaattatcggcaatatt

SEQ ID NO: 4619 - DNA, 403 bp, Triticum aestivum
  Clone ID: LIB3281-015-P1-K1-A9
ctgagcagtggcctttatttttcttgtcgacctgagcaacctaaggagaaggcctcgacctttggatccaatgtgatgccatacactggtggtgacaccaagaaatctggagagcttgggaagatgtttgagctccatgctgaaagatctagaaaatctggtcctctaggcaatgcgccttctagaaatcctttatttggcggcgctgccttcaactatggacctgtgtctaatgctggcggacggacaaactactccggttctttttcatctttagtacctggcgcttggaggatcatcatgagcaaaatctaattccggaccactcaatttgcatggttaaccagtaaagcggtcattttgtccccagtctggaggtgtgaccccaatggttcgtcagaat

SEQ ID NO: 4620 - DNA, 390 bp, Triticum aestivum
  Clone ID: LIB3281-015-P1-K1-B1
cttctccactccggccaagcattccccgcctgcccgagcccgacaccccactcccgccgcagatccctcccagccgcccgctcctcgccaccgagcgaactcgctcagcctcagcccgccaccgccatgccgtcctagcgcgcctccctccccgccgcccgatttagccccccgcccccccttcttttatggagtccccgcgcggccggcgcactcgcaatgccgccgtcccctccgcctgcttcctactcctcctccccctccttctactcgtcccaaccctcttcccctccgccgtccccatccttcgtcacgtcgtgcaaagggcggccctctcgtcccccttctttgccgtcaggccgcggggggactgccaggagctgcaggccc

SEQ ID NO: 4621 - DNA, 408 bp, Triticum aestivum
  Clone ID: LIB3281-015-P1-K1-B10
cggacgcgtgggcgagatacagagatggggcgtcgggtcgccggcggcggacctcaccgtgtgctgccttatgacctcgtcgtgttccgaaatccagcagatagcacgccccatccccgggccgccgttctccacctcggcttcaacaccttaccacacccgccggctaccttcgccattcatcgacgggtagatccgccatccgtggatgcctagctccgctattcaccgagaccggagaagggaactccagccttcagacttcagcagtgatggttcggatgaagatttcaggaactttcttggcgacggtgacaatgcctactcaagaggacgaagcgacacccaggcaccatattttggttcccaataacgaatgtttatagcagcaatgatatgtatgaagat

SEQ ID NO: 4622 - DNA, 320 bp, Triticum aestivum
  Clone ID: LIB3281-015-P1-K1-B11
gtcgaaaatgcatcatttcatggacatacatgaaaaatagcacaaggttcctacagaaagctgtagatgagcattttctaaactaactatagcatggtagataacactatcacacaaaatatttacagggaactacattttctcatactgccccccaggaattacattctactgcagaggtagccaaacccggagatgatacagaatgcagcactgagtgcatccaatcttctcatcacatcaaaaagtgacatgtatatatataccacctaactggaccatacatgcaccagcccctgactgttgccagtgtagatctc

SEQ ID NO: 4623 - DNA, 395 bp, Triticum aestivum
  unsure (1)...(395): unsure at all n locations
  Clone ID: LIB3281-015-P1-K1-B12
caagcgccccgtcccctgccacagccacgacatcacggtcgtgcgccacccaccttcggatccctccacccgctcgcgcccttgctccctctccgcctgcggggccgcacccctcgcgctgctcctcgacgacgcggggctcgtccaagtggcgagcgaccggtggcggcggcaccagcgttgtcgtgaaggggccgcgagtggcgggcgacccgcacctcttccatctttccaccaaacgccgccgacctcctctcctctcccaccatcgacctcctctccccagccaaccccaccgacgaattacgcggtcttcccatccccgggggcctcctccctcgaccccgtcgncggcggcccctaacctctcctcctctccctggcgactggcgagg

SEQ ID NO: 4624 - DNA, 381 bp, Triticum aestivum
  Clone ID: LIB3281-015-P1-K1-B2
aacaccaacaccaacacggtgggttgttccccagcgggggaaggaatcttgagcccccttctcccccggcgccgggcggggcctcgacgggtaaatcgcgacggcgccctaaaacccccgagcagccgggcgatggaggaccgcggcggcggcggcgggggcgggggcgcgcggcgggtgggggactacgtgctgctgcgcccgatcgggtcgggggcctactcgcaggtctggctggggaagcacgtcgtgcggggcaccgaggtggccgtcaaggagatcgccatggaccgtctcagcgcgaagcttcgcgacagccttctctccgaggtcgacaatctccgccggattacgcattccaacattatcgcgcttcacgac

SEQ ID NO: 4625 - DNA, 330 bp, Triticum aestivum
  Clone ID: LIB3281-015-P1-K1-B3
accggaactcccaaagcgaaagcctttcttatcggcgacgacgcgcaccagcaccgatggcccgctacgaccgagcgatcaccgtcttctcccccgacggccacctcttccaggttgagtacgccctcgaggccgtccgcaagggcaacgccgccgtcggcgtccgaggcgtcgacaccgtcgtcctcggtgtcgagaagaagtccacccccaagctccaggactccaggtccgtgcgcaagatcgcgagcctggacacccacatcgcgctggcctgcgcgggtctcaaggcggacgcgcgcgtgctgatcaaccgggcgcgcgttgagt

SEQ ID NO: 4626 - DNA, 414 bp, Triticum aestivum
  Clone ID: LIB3281-015-P1-K1-B5
ggctctttcaaacatggtagtcgtggttcattcagatgtcgattcttgggaaagccacatacaatgcaatgggaggtcaatcttatgggatctgaggaaaccagttaaggcggctattgctgcatctgctgaatatgtatctggtttacttccttcgcatttggcttatagctcagctcatgaaactgcatcagaggactggacatggtctgtgggctgtaatcccttatctattagttctaaaggttggcaactttcagaatttcagcaagatgtgatcgcacggaactatattattactggagtggaggaatccatacgagtagtcaattcagcaattcaacgattggtaacagagaggacatccgaacaaggctttaaaattttcaagaccaaagagagcgtgatggttga

SEQ ID NO: 4627 - DNA, 369 bp, Triticum aestivum
  Clone ID: LIB3281-015-P1-K1-B7
tcgctctacacctcacaaagactggtctacctcaccgaggagaagaagggagaagcgagaagatgtcgggccgcggcaagggaggaaaggggctcggcaagggcggcgccaagcgccaccggaaggttctccgcgacaacatccagggcatcaccaagccggcgatccgtcgtctggctcgcaggggcggcgtgaagcgcatctcggggctcatctacgaggagacccgcggcgtgctcaagatcttgctcgagaacgtcatccgcgacgccgtcacctacacggagcacgcccgccgcaagaccgtcaccgacatggacgtcgtctacgccctcaagcgccagggacgcaccctctacggattcggcg

SEQ ID NO: 4628 - DNA, 405 bp, Triticum aestivum
  Clone ID: LIB3281-015-P1-K1-B8
gttcaaattatcggtaatctgaagttaggcctgaacccaatctccgtcacaaacctccagttcacgccgccgtacatgatgctcgccctcaagaccggcctcatcaccggcgtcatcgccctcgccgaagggatcgccgtcggccggagcttcgccatgttcaagaactaccacatcgacggcaacaaggagatgatcgccatcgggacgatgaacatcctggggtccttcacctcctgctacctcaccacggggcccttctcccggtccgccgtgaactacaacgccgggtgcaagacggccatgtccaacgtggtcatgtcgctggcggtgatggtgacgctcctcttcctcacgccgctcttccactacacgccgctggtggtgctgtcggcgatcatcatg

SEQ ID NO: 4629 - DNA, 403 bp, Triticum aestivum
  Clone ID: LIB3281-015-P1-K1-B9
cacggctaataacgtcactgcatgctatggataccttccgtgggcgtgtttgtgagtgccctattgtcaaaggtgtaaaattcgtgggggatggatataccaactgtgaagcttccggtgttggtaggtgtgagatcaacaatggaggatgctggaaagaaactaagaatgggaagacaatatctgcctgctcgcatgaagaatctgaaggttgcaaatgtccacaaggtttcaagggcgatggtgtaaaaagctgtgaagatattgatgaatgcaaagcgaaatctgcctgtcagtgcaatggctgcagttgcgagaatacatggggaagctatgaatgcagcttgggtggtaacaacatgttatacatgagagagcaagacacgtgcatcagcaaacaagc

SEQ ID NO: 4630 - DNA, 359 bp, Triticum aestivum
  unsure (1)...(359): unsure at all n locations
  Clone ID: LIB3281-015-P1-K1-C1
cggacgcgtgggccgctcgcgcgcagaacatcgtcgctgccgctcagcagcagaacagagctttaggtggtggtggtggcggngnccccnccatgggcaagcagcaaaaggcggccatggccggcaggcccgatcccaagaacacccgccgcgccctgggcgacatcggcaactttgaggccaacaaccggcgcgccccactgggcgacaacgccaacgtcgtcaatccccgcgcggccgaagggaaaccacaaccccaagagccggtgaaccgccccgtcacgaggaactttggcgcccagcttctaaaaacgcccaagagaaagccaaaaaccccgctgcaaggcccgctgtgagga

SEQ ID NO: 4631 - DNA, 365 bp, Triticum aestivum
  Clone ID: LIB3281-015-P1-K1-C10
ccaagtcgtccgcagtggtctctgtatttcgatctgtgtaacaaatgttcaatgcaatgaacagagggaaccatatggggcacgctatcgtttactatgatgcttcatatgatgctacgaaggaccggatgcatgaccgaaaccctgatcggaccgctaatcaaacggtatatgagctggtcattgagcgcatcatagagcgcgtagaccaacgcgccaacctgctgatcaaactcattattaacaagatcaactgcaagctgctttggggactgattgttgacaatcatggtgagacctatcgttgaacctacgcattgattgactttaagaacgaatgcaacgtcggctgtgctttgatctat

SEQ ID NO: 4632 - DNA, 408 bp, Triticum aestivum
  Clone ID: LIB3281-015-P1-K1-C11
cccacgcgtccgacgacaggaccaagcgcatggtcatccccgacgcgctcaaggttctgaggctgcagcctgggcacaggtactgcctcctcggccagctctccaaggaggtcggatggaactacgccgacaccatcagggagctggaggaaaagaggaaggagaaggccaaggtctcctacgacaggagaaagcaactggccaagctccgcgtcaaggccgagaaggcagccgaggagaagttgggaactcagctggagatcctggctccgatcaaatactaagagatatcagagctttcgtgcgccatcagttttgggaaacctctgtcgtattttaagtagtttggtaactctgatagtacaatctggttggtaaacctttgttatgcatgcagttctgctaccc

SEQ ID NO: 4633 - DNA, 242 bp, Triticum aestivum
  Clone ID: LIB3281-015-P1-K1-C12
cggactctgcttcattgcccaagatgagaggagttgtggtggtggccatgctggccgcggccttcgccgtgtctgcgcacgccgagcaatgcggctcgcaagccggcggggcgacgtgccccaactgcctctgctgcagcaagttcggtttctggggcaccaccttcgactactggggcaccggctggcagaggcagtgcaacggctgcaggggcggcaccccggtaccggtaccgaccccc

SEQ ID NO: 4634 - DNA, 396 bp, Triticum aestivum
  Clone ID: LIB3281-015-P1-K1-C2
cccacgcgttcgatagattcatctttcctgtttgcgttagggttccactcccgttcctacttcggccgccacctccgcatcgaccttctcggttgccatggtgatggatgacaacaaactccgggtgctccagatccctccggctatccaccccgacgatccggattctactctcccggagaccatgctcatcgactcgttcggctacctcagcgaccgcaccaacggcaccaccgtcaggggccgcaggagcaggaccaagaagaagggcaagcgcatcctggtcaccttctggccgggtgccccgccgtgcgttttctgcttcactgatcactgaccagatctgaagcccgatgcattcgctgaaatccacaagatctactatacggaggacga

SEQ ID NO: 4635 - DNA, 417 bp, Triticum aestivum
  Clone ID: LIB3281-015-P1-K1-C3
cggacgcgtgggggcgtggcaccgcagccgtagagcagccgtcgcccgcagttaccaggcaccaccccgcggcgccgtgcacctcgcggcggcggagcacatacgagagcacgcagtcgatcgggaggcgccgccgatggacccgtccgacgtcgagatggagcccgcggagcatccgctccagccccagccccagcagcctccgccgccgccgcaggcagcggcggccggagatgggtggagcatgctgtcccgcgcccgcgggctgctccaggagggccagccgtccctcgcgctgcaggcggtactcttggccataagatctcaaggtggtgaacaggctctcatccagactctgaaccgtgcacgtgacctctacaggcagagatcgcagtctgctccaaacattgatgagct

SEQ ID NO: 4636 - DNA, 204 bp, Triticum aestivum
  Clone ID: LIB3281-015-P1-K1-C4
cccacgcgttcgcggacgcgtggggcgtggtggccgcagtggagcggcgccattgtttatatcctcgttccgcgcagcttgagcgagggtggtgtggtggatatagacatacaaccgtctcggaaggttctgctctccgaccacgacggcgcgaacatgtagcccgtgtcgcatccgttcaagtcttaatacgagcaatttaag

SEQ ID NO: 4637 - DNA, 416 bp, Triticum aestivum
  Clone ID: LIB3281-015-P1-K1-C5
gtttgatgactcgcttggagaatgtacggtagacgtaaatgaactgagaggtggacaaagacatgacaaatggatatcgctgaagaatgtcaagaaaggaaggatccacctggctataacgattgaagatgtatcagaggagacggaggcaacaacgagtttggaagaatcaccggcgaaaactgatgtgaaactgccactgcccacctttgttgatagcaagtcggatgctgctaagctgcttgaagaaaggaaagtcataatggatgaagttgagcacattgactttgatggacaagaacaacctggaggtgtatatgtacatcgccctggaactggtgttccccagacatgggaatcccggaaagggcgggcgcgcaatccagacacggagatcctccaagaggttgacatat

SEQ ID NO: 4638 - DNA, 106 bp, Triticum aestivum
  Clone ID: LIB3281-015-P1-K1-C6
tggaaatttgtaaacttggtcaaactatgggcctgggacgtcaaaataattattcattacaacaaggattctaaatgcattacttaagcccattggggcctttcca

SEQ ID NO: 4639 - DNA, 407 bp, Triticum aestivum
  Clone ID: LIB3281-015-P1-K1-C7
cccacgcgtccgcccacgcgtccgttgacacgtggggcagcaaggagcagccagcatcgagggagcaacaatggcgatggcgtcgtcgagcgggctgaggagctgcagcgccgtgggcgtgccgagcctgctggcgccttcgtccaggtccggccgctccgggctgccgttctgcgcctacgccaccacctccggccgcgtcaccatgtccgccgagtggttccccggccagccccgccccgcccacctcgacggctcctcgccaggagacttcgggttcgaccccctgggcctcgccaccgtgccggagaactttgagcggttcaaggagtccgagatctaccactgccgctgggccatgctctgcgtgcctggggtgctggtgccggaggcgctgggactgggca

SEQ ID NO: 4640 - DNA, 241 bp, Triticum aestivum
  Clone ID: LIB3281-015-P1-K1-C9
cccacgcgtgggcgcacatttgctgtattctgaaaaagcacgaggccgataggcgctactcctgcggggagatcgttgcaaaaggggagccggaaacaaataaaaactgtttatatctaatgtagaaccacctggctgcaaaacaacattgtgctcgcagtgaattgcttccaatgactgccaacactcgagaatggaatcaagataacagttttgatatgcttgcccagacgctgaagaa

SEQ ID NO: 4641 - DNA, 360 bp, Triticum aestivum
  Clone ID: LIB3281-015-P1-K1-D1
ttcgagcgaaacacctctccctcactctcacctccgagaagctccagcggcagccatggccccaaaggcagacaagaagccggcggccgagaacaaggtggagaaggcggcggagaagacccccgcggggaagaagcccaaggccgagaagcggctgccggcaggcaagacggcgtccaaggaggccggcggcgaggggaagacccggggcaggaagaagggcagcaaggcgaagaagggcgtggagacgtacaagatctacatcttcaaggtgctgaagcaggtgcacccggacatcggcatcttctccaaggccatgttcatcatgaactccttcatcaacgacatctttgagaagct

SEQ ID NO: 4642 - DNA, 390 bp, Triticum aestivum
  Clone ID: LIB3281-015-P1-K1-D10
atttctcttcccctcgcctcgccttttcgcagcggcggctgtacgacattcaccgaatcctccccgacggacacgtccccatgccacaccacgctggaggagttcatctctcgtagcgggaggagttggactggcgcggagtggagatccattcgggctttggattgatccctttcgttgatcccttttcctgttttgggaagctatggcaagaactgcaagacaccgtgacttatcaagccggcgacttaggtcatctcctcttgatgcaccttcccactaccagaaagcaacaagggcagccaaggaaaataaattgaagttaaccttggagaaaaaggattggaaacatgccactttgccaatatgcttggagcgtccacatgatgc

SEQ ID NO: 4643 - DNA, 368 bp, Triticum aestivum
  Clone ID: LIB3281-015-P1-K1-D11
cccacgcgttcgacgacttttccttgtgcatggtcatccccgacgcgctcaagggtatgaggctgcggcctgggcacaggtactgcctcctcggtcaggtatttaaggaggtcggatggaactacgccgacaccatcagggagctggaggaaaagaggaaggagaaggtcaacgtcttcgtacccaggataaagcaactggccaagctcctttgtaaggcccggaaggcagtcgaagagaagctgggaactcagctggagatcctgggttcgatcaaacactaatagaaatgaaagactgtctagccccatcaaattatgggaaacctctgctcgattctaagggattaggaaactctcaatgggcaa

SEQ ID NO: 4644 - DNA, 389 bp, Triticum aestivum
  Clone ID: LIB3281-015-P1-K1-D12
aaaccccaatttcctcccaccagagcacaaggaaagaaatgaatcaattcgcccctcagcaatcatcgctcgccatggactcaggggagagctccgccgcctccaacgccgcccacgcggcaatggccgtcgactacgcccccgaggtcgcctgctgcgtatcatccatggtcgacctcggcggcgccgccggcgtggagagccagcgcctgttcctggcgcgccgcacggcgctggagatgctgcgggaccgcgggtacagcgttccggaggacgagctcgcccgcaccctcccggagttccgcgcgtggtggtccgagacgcccgagatcgagcgccttttcttttccacaaccctcgccttcgacgagtccaacaaggtgcgaatt

SEQ ID NO: 4645 - DNA, 393 bp, Triticum aestivum
  Clone ID: LIB3281-015-P1-K1-D2
cggacgcgtgggcggacgcgtgggcggacgcgtgggttgtggaggaaatgagtacatttaccagactcttgctttgcttgaagctagagcagagcgctttgaacaagcacggactttattccagctagctactcaatgcaatccaaaaagttgtgcaagttggctatcttgggctcaggtagaaatgcgtgcagaaaacaatgtcattgcgaggaagctctttgagaaagctgtccaggctagtcccaagaacagattttcgtggcatgtttgggcactctttgaggccaatcaaggtaacactgacaaagcaaggaagttacttaagattggccatgctgtgaaccctagggaccctgtaattctacagtcacttgcactgctggaatacaa

SEQ ID NO: 4646 - DNA, 147 bp, Triticum aestivum
  Clone ID: LIB3281-015-P1-K1-D3
cggacgcgtgggcggacgcgagggttgtctcttgggatgtgtgcagaaaaagtgcagggaccagactgttgctctgctggaagcacgaggccatcgctctgaacaaacacggactttattgcaggggggtactcaatgcaagccaaa

SEQ ID NO: 4647 - DNA, 411 bp, Triticum aestivum
  Clone ID: LIB3281-015-P1-K1-D4
gatgatctgcagactcagcgtgtcattgattaccaagcacttacatgtatcttgaacctgtcgactaccaaccacaagaaaagcatcaagaaagaagcatgctggacaatctcaaacattacagctggtaaccggtaccagattcaggctgttatccaggcaaacattattggtgctattgttcatctcctgcagggtgctgaatctgacattaagaaggaggcggcttgggcaatttcaaatgccacttgtggtggaacacatgatcagattaacttccttgttgcccagggttgcatcaagccgctctgagatctgctcatttgcccggatcccagaattgcaacaagttgcttggaaggacttgagaacatactgaaggtttgggaggcagaaaacaacctatgtgca

SEQ ID NO: 4648 - DNA, 175 bp, Triticum aestivum
  Clone ID: LIB3281-015-P1-K1-D5
cggacgcgtgggcgagatcgagctttgcctgtcgacttttcctacccgtcgcgcccggacgtgatggtcttcaaggagttcagcctgaggatccgagctggccagagtcaggcgcttttgggagcgagcgggtctgtgaagagcactgtcattgcactcatagagcgtttgtact

SEQ ID NO: 4649 - DNA, 412 bp, Triticum aestivum
  Clone ID: LIB3281-015-P1-K1-D6
cccacgcgtccgcgctccccctttcttctgctccttctcaattccaagcacttcacgagccttaagccaagatgaacagcgcggccgagacggacgccggcggctacaacggcagcccggccgccccggtgctggtggtggagcgcgtggtgacggtggagtaccttgagcagtccatgtcgcggggcctcctcggcaagttccccgactcctccgcctacgacttcgactactgccagagcggcatctggtccccggtcaacaagatcccgagcgagtcgccggcctccggctccagagacttcctcatcgccaagctgaagcgccgggcgagggccgggagcaggctcaaggacgctgccggcggaggcggcagcaggtcgaggtggcggcgcccgcggctgcggcggga

SEQ ID NO: 4650 - DNA, 195 bp, Triticum aestivum
  Clone ID: LIB3281-015-P1-K1-D7
cggacgcgtgggcggacgcgtgggtgcaagtcagcagagtgaatagtgaaggatcctgctcacacatttgctgtattcacccccacctcgtgtgcccctgttttctgggttaaccaccccctgttcttgtagcactgtcaatcctgtatagatacactctattaccttctggtctacatgtagatttgttgtctc

SEQ ID NO: 4651 - DNA, 349 bp, Triticum aestivum
  Clone ID: LIB3281-015-P1-K1-D8
gtcttcttcttcctccctgctccgaccgagatccgctccagtggactcgattagggttagggtttgcctctccgatcgtgaggcgggttgctacatctgccttgttcgtcggattccggtagaatcaaccactcgatcgacttaatttcccccgccggtgctgcctctgttttgccgaagatgctgggcggactttacggcgacctcccgccgcccacctcggcgggcggcgacgacgacaagccgacggtcttcgtctggtcgagcgccaccaagatggcgccgtccacccttcggaagcccttcgcgaccttttccccttccacgttccttcttaggaaccagaacc

SEQ ID NO: 4652 - DNA, 360 bp, Triticum aestivum
  Clone ID: LIB3281-015-P1-K1-D9
cccacgcgtccgaaaactccacccgctccctccctccaacaaagaaggaaggaacgaaggaggatccactgcgcctgcgcctgcgcctgcgccacacacacccttcgacaccaaaggtttgatcggatcgtcgtgcgctccatggggcttcttgaccagctgtgggacgacacggtggccgggccgcggccggaccacggcctcggcaggctccgcaagtacgcctccttctccccgtcctcctcggcggccggcacgaccgctgccgtgccgtcggccgacgtggcggcgccggcggtgacgcggagcatcaccatcctccgcccgccggctctgtccgtgacgtcgccgcgcggcgag

SEQ ID NO: 4653 - DNA, 416 bp, Triticum aestivum
  Clone ID: LIB3281-015-P1-K1-E1
cccacgcgtccgcccacgcgtccggcgtcctgccgctgccggcgaacgacctgctctgggagctcgcgctaccgctgggcaccgaccgggaccacgagtactgcaacccggaggccatgctggccggcgtcggagcggagcggctgcggaggctgccgccgtgcctggtgctgggccgtaagaaggacccgccgagggaccggcagagggtgctggtgcatgcgctgcggaaggccggggtggccgtggaggcgcagatggacggcgccgggtaccacgcgatggagctgttcaagactaactgcgccgaggagttcaacgcgcaggtgacggacttcgtccgccggcacgccggcgacggcgacggcgtcgacgtatacgctgcgaggagcaggctgtgaacggtggatccaaaa

SEQ ID NO: 4654 - DNA, 280 bp, Triticum aestivum
  Clone ID: LIB3281-015-P1-K1-E10
cggacgcgtgggctggaaaggggaaggctcattagttgatgagctccttcagtcaattgaacatcatgttgacgaagatgtacttaccgatctcaaggacaaaattcggcttcgtgatccatctgattctgaagacatcgagggagacatccgaaattctttgttatggttgcgtgatgagttgcgaactctttcatgcacatacaagtgccggcatgacgctgctgctgatttgattcacatgtatgcttacacaaagtgtttttttagagcccgagac

SEQ ID NO: 4655 - DNA, 407 bp, Triticum aestivum
  Clone ID: LIB3281-015-P1-K1-E11
cccacgcgtccgctacgccgccgtcttcgccgccatgggtatcgacctcgtcgccggcggccgtaacaagaggaccaagcgcaccgcgccaaagtcggacgatgtctacctcaagcttctggtgaagctctaccgcttcctggcgaggaggaccaagagccagttcaatgccgtgatcctgaagcgcctcttcatgagcaagaccaaccgcccgccgctctcgctttgtcgcctcgtcaagttcatggatggcaaggataaccaaatcgctgtggtcgtgggcaccataaccgacgacaagagagtttacgaggtgccggcgatcaaggtggcagctctcaggttcactgagacggcaagggcccgcattgtgaatgccggtggagaatgcctcacctttgaccagc

SEQ ID NO: 4656 - DNA, 342 bp, Triticum aestivum
  Clone ID: LIB3281-015-P1-K1-E12
tcgcccacgcgtccgctacgtttccgttttcgccgacatgggtatcgacctcgtcgccggcggccttaacaagaggaccaagcgcaccgcgccaaagtcggacgatgtctacctcaagcttctggtgaagctttaccgctttctggcgaggaggaccaagagccagatcaatgccgggatcctgaagcgcctcttcatgagcaagaccaaccgcccgccggtctcgctttgtggccttggtaagtgtatggatggcaaggataaccaaatcccttgggtagtgtggaccatatcctacaacaagagagtttcgaggtgccggcgatcaatgtggcagctttt

SEQ ID NO: 4657 - DNA, 53 bp, Triticum aestivum
  Clone ID: LIB3281-015-P1-K1-E2
aaaaaaaaaaaaacaattaaaaaaaaaaaaaaaaaaaaaggaagagcacgaac

SEQ ID NO: 4658 - DNA, 417 bp, Triticum aestivum
  Clone ID: LIB3281-015-P1-K1-E3
cggcgtacgcgttcaacacgcggcctctggcgcgcacgccgtgccacaagcccgccgtgtactacctgtcgtcggcgcgcagcgcggaggccgcccgcggcggggagacaacggtgacgcggtacgagcggtggcgccccgcgaacgagacgcggcccgcgtgccgttggaacatcaccgacccggacgcgcatctcgaccacatcgtcgtgctcaagaggcccgaccccgggatatgggaccggtcgccgaggaggaactgctgtagagtgctgtcgtcgccgaaggtggggaaggaggggaagaagacgatgaccatcgacgtgggcgtgtgcagggacggcgagttcagccaagtagtctaggtctagcctagcctgttaggagaacactgtaggacgattcaatttttatttt

SEQ ID NO: 4659 - DNA, 404 bp, Triticum aestivum
  Clone ID: LIB3281-015-P1-K1-E4
cggacgcgtgggcggacgcgtgggaaaggtattccaatccgcacagaaatccccatctgaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggaggcgagtccatctacggcgagaagttcgccgacgagaagttcgttcacaagcacaccaagcccgg

SEQ ID NO: 4660 - DNA, 409 bp, Triticum aestivum
  Clone ID: LIB3281-015-P1-K1-E5
gctgcggttaatgtggcagagatatctctgtacgacagagtggtgtgtgggcgctgtggtgacttggatcctgagatcaaggacaaggtttgtccatcaagatatccatggactgctgaggagaggacacaagcaactgaggatttgggtttgccttcgcgtgctgcggttcacttccggtcctaattgaaatatgatttgcatgatattcttatgttatttactttgcaaatcatctgtcctatatcttttagtttgaaggaattactgaacttcataattctgtagctaccaagcctgtactctttctttcccttcaattcaagctttgaactattgcccaatgcttgatgcgttggagtatatttgatgtgtccccttcaaaaaaacaataaaaaatttttttttt

SEQ ID NO: 4661 - DNA, 411 bp, Triticum aestivum
  Clone ID: LIB3281-015-P1-K1-E6
cggacgcgtgggcggacgcgtgggctgacgcgtgggctcggctgcagatcgccggccggcgactcccaccatttttctaatcgctacgtcggagcgcacgcccgcacgccaggcccccagatcccgaattgattattgcggtgatgggccgccacattctcgtctccacggcgaggaggatggtgtaggcgcagtcgtaggaggaggataagagcggcggcaggcgcaggggggaggcggaggaggaggagggatggatgggcaaaagcacaatcggaggaaacagggtgggacgtcgaccaaggcgggctccggcggcgaccaggccagtccgccgggcgccaaggcgggcgccggcggagaccaggcctgtcaactagggggcaccaaggcgggcgccggcggggactt

SEQ ID NO: 4662 - DNA, 411 bp, Triticum aestivum
  Clone ID: LIB3281-015-P1-K1-E7
acccacctccgcatcgcgcgagcagtttcacgctagggagggaggggtcgcgattccccacctggttccacttccgctcctcggccgcagccacagaagagagaccaccgcctccgcagccatggccgccgccgccgccgccgccgagcccaagaccaagtacgatcgccagctcaggatatggggtgatcaaggacaggctgcactggagaaggctagcatatgcttgcttaactgtggccctaccggaactgaagcgctgaagaaccttgtgcttggaggaatagggagtgttactgttgttgatggctccaaagtcgaacaatcggacctgggaaacaattttctgttggatgaagggtgcttgggtcaatcaagagcaaagtctatatgttcattcctacaagagct

SEQ ID NO: 4663 - DNA, 360 bp, Triticum aestivum
  Clone ID: LIB3281-015-P1-K1-E8
acccacctacgtatcgctttttctttttcacgctagggagggaggggtcgcgattccccacctgggtccacttccgctcctcggccgcagccacagaagagagacctccgtctccgcagccatggccgacgccgacgccgccgtcgagcccaagaccatgtacgatcgtcagcttcaggatatggggtgaacaaggacagtctgtactggataaggctagcatatgcttgcttatttgcggccctactcggtactgaagcgctgaagaaccttgtgcttgtatgtattaggagtgttactgttgttgatggctacaaagtcctacaaactgtccttggttacaattatatgttgaatgaa

SEQ ID NO: 4664 - DNA, 412 bp, Triticum aestivum
  Clone ID: LIB3281-015-P1-K1-E9
cccacgcgtccgcccacgcgtccgttctcttctatttaactgtctatggttgattgtgatagtgaagtcgatattttgatttctaatagaatatacatcttagttttcctctatctatgtagagggctcaagaaagagacaagaacttgtgcttcaagcagcgaagatagccagcctaaatgaatcgaaacaagaacaagaatcgggaaattacagatcaggaagtgcagctggtacggtcactccctttttgccaaaactgcttggcaatcatcttcttgccaatttataattgaattcctactatgattcgcttcctaaaagaaatagcaatcatcttgaaacaagtaatttatctagctacaaatgcttattctatactggttatgttgcctccaattgcggacaatgg

SEQ ID NO: 4665 - DNA, 414 bp, Triticum aestivum
  Clone ID: LIB3281-015-P1-K1-F1
gtgaaaattctcaaaatctggtaactgaagtctactcaaaagagagtaaaggcgccgtatcagctgttgcgtcacttcaaggtcatctgctgatagctgctggtccaaagatcacattgagcaaatggactggttctgaattgaccgctgttgcattctatgatgctcctttgcatgttgtgagcttgaacattgtcaaaaattttgttttgtttggcgatatccataaaagcgtatattttcttagctggaaggagcaaggttctcaattgactctgcttgcaaaagattttggatctctagattgctttgcaactgagttcttaattgatggaagcacactgaaccttgcagtttctgactctgataaaaatttgcagatcttctactatgctcccaaaatggtggagagct

SEQ ID NO: 4666 - DNA, 169 bp, Triticum aestivum
  unsure (1)...(169): unsure at all n locations
  Clone ID: LIB3281-015-P1-K1-F10
aaacgaaaggccggcgacgacccacgcgnccgcccacgcgaacgagcgacataagatttcacaccaccgccccacaggggggaagggaacctacgcgcgggcgcaacgtcatagcactggtatagagccacccaaacgcaagccactgggcgagggaaaacaacgagca

SEQ ID NO: 4667 - DNA, 120 bp, Triticum aestivum
  Clone ID: LIB3281-015-P1-K1-F11
tcggtttttgcctggagtacactttgagttggattgtttcacaggggcagacgctgactagttggcaacatgtggaatactggtagtactttgctgcctagtatggtccattttccagac

SEQ ID NO: 4668 - DNA, 252 bp, Triticum aestivum
  Clone ID: LIB3281-015-P1-K1-F12
cggacgcgtgggcacccgctccgttatccatggcgccaagcggaagagggacgtctcggccttcgagatgctgtcgtcgggggagtcccgcccgtcgggagggggccggttttggttgggcgaacgggcctacagcggccggaaggaacttcccgaggaagggcccttgtgcgttgaaaaacatgattggcggggccttttttcggaaattctcaaacaccgcttcatttttcgttgccgggtttggggaaa

SEQ ID NO: 4669 - DNA, 244 bp, Triticum aestivum
  Clone ID: LIB3281-015-P1-K1-F2
gttgcagcaggggtgcccgctgacgtggagtttggccaaatgacacgcgcgcgcccgtctgaggtggtaggcgacttaaaggggacctgctgatacctggtggtggaaaggatacattcagcataatggactggttttgaattgaccgaagttgcataatatgatgcccctttgcatgttgtgagctagaacaattgcaaaaaattttgttgtgtttggtgatatccataaaagcgtgtatttt

SEQ ID NO: 4670 - DNA, 272 bp, Triticum aestivum
  Clone ID: LIB3281-015-P1-K1-F4
gcagccccgggcgcgatccgggccgccccgcctccgctgaacctcagcaccctgggtttcagttgaggcatctgccgtcgacatggcccccaaccccgcctcaatcgccctactggccgccctcgacggcaaactgcgtctcctcaagaaaatgtccaaaaagatggatttgcgggtaacaaaggaccccaaagggctcaacgcacttcattgcgctgcaaataaggggtccctgagagatctgcaagatcccggtggatgacgtgggggtc

SEQ ID NO: 4671 - DNA, 269 bp, Triticum aestivum
  Clone ID: LIB3281-015-P1-K1-F5
acgcgtacgcatagacatgacactgcgcgagcttccacaccgctctcaaccagataagggacaccatcgggagcagccaccttggctactgggtcgaggcgcgcatcttctacaacggcatcggcagcagcgactatctgaagatgtacgtgatgacgcactacaagatcttcatcaagtgcaactgcgaccaggactccacccttctgagacagcagtacagcgagcagctcaccagccttgacaacctgaacatccgtaggtgcgac

SEQ ID NO: 4672 - DNA, 406 bp, Triticum aestivum
  Clone ID: LIB3281-015-P1-K1-F7
cccacgcgtccgcggacgcgtgggaaccgctcctcgacctcctccatccgcgcgcagctcgagccaagaagagatcgtcagccatgtccggccgcggcaagggaggcaaggggctcggcaagggcggcgctaagcgccacaggaaggtgctgcgcgacaacatccagggcatcaccaagcccgccatccgccgcctggctcggaggggcggcgtgaagcgcatctcggggctcatctacgaggagacccgtggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggctctttctcg

SEQ ID NO: 4673 - DNA, 409 bp, Triticum aestivum
  Clone ID: LIB3281-015-P1-K1-F8
cgttgcacaagaattcctcctaccctcaccgtctcgccgccgccaccaccggcgcagctagataagaagaaaaaaagagagagatgaactcgtcgggagggctcgagatctgtgtcgggagagagggaatttttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagcacccctcggttacagcattgaagacgttcgacctgctggaggcgccaagaagttctctgctgcatactctaactgcgcgaagaaaccatcctgatatcgtttttgcatccccttctcgtagtttaggatttttatg

SEQ ID NO: 4674 - DNA, 413 bp, Triticum aestivum
  Clone ID: LIB3281-015-P1-K1-G1
cccacgcgtccgcccacgcgtccgtttctcatgaactttgaggccactctacgtcctgatgaaggatactatgtaggtgggacatttactttcaccttccaagtatctccttcctaccctcacgaggctccgaaggtcaagtgcaagactaaggtttaccatcctaatattgacctagaaggaaatgtctgcctgaacattctgcgtgaagactggaagcctgtcttgaacatcaacaccataatatatggtttaaaccttcttttctcacaacccaatgacgaggaccccttgaatcatgaagctgcggccgtcctccgagacaacccacagaagttccagagaaatgttcaaacggcgatgtcgggaggctatgttgataatacccatttcccaaggtgcaagtaaggtct

SEQ ID NO: 4675 - DNA, 398 bp, Triticum aestivum
  Clone ID: LIB3281-015-P1-K1-G10
cccacgcgtccgagccactgctccttctcggttcctccgccgtaggcagaaacgtgctgccctgcgcgccgtgccgcacggccaccgcatcacactccactccagtcgtcgagaagggagggccatggaagtggtcgcgtcggcgccggggaaggtgctcgtggcgggagggtacctggtgctggagcgccccaaccccggcctcgtcctcagcaccagcgcccgcttctacgccatcgtccgcccgatccacgacgagctcagccccgactcctgggcatgggcgtgggcggatgtgaaggtgacctcccctcagctctcccgggaggccgcctacaagctatccatcaagaattcgacgctccaattgacgtccgcaagggagtctacaaaccctt

SEQ ID NO: 4676 - DNA, 411 bp, Triticum aestivum
  Clone ID: LIB3281-015-P1-K1-G11
acgagcaggttgatgaggcactactctttttgcagtaatgccgctcaaggtggaggcaacaacaacttcagcttgatgaggtacgactccatgagcagcaatgcctaccacgacagaagcaacgtgtatgcgaggtttgactcgatgaagagcaccgactcccacgaccggggctactccttcgacgacgacgacgaccctttcggcaccgggcccttcaagccgtccaagccgtcgacggagacctccagcccgacgagacatgggaccgacaagtggagcgcgttttgacaggcacctgtactatatagaagaggtgatgatgtgtgtgttcgtgcaccttactgcatatatatatacacgtacaaggaagggcaagacatttttgcttgggaggggagggagcttgct

SEQ ID NO: 4677 - DNA, 256 bp, Triticum aestivum
  Clone ID: LIB3281-015-P1-K1-G12
tcgcgagcttctgtcccttggcaccggcaagaggaaataacaggaagggagggggacaagggaacccgaacccgaacccgagaaccaaccatgggacaagggaaccaccccctttgcgactttttaaatgacaggataccaccaccaccctatttgttaacagcccggctggagcattccataattttcattgtgctttcaacctgttggttgtatcaccaccaccattattgtttgatagatagcaataatttgc

SEQ ID NO: 4678 - DNA, 256 bp, Triticum aestivum
  unsure (1)...(256): unsure at all n locations
  Clone ID: LIB3281-015-P1-K1-G2
ggggcgacccacgcgaccgcccacacgnccgcccacgcggacgttgattatgaacatagaggccacacaacggccggaggaaggagaccacgcaggcgggacactaactaacaccaaccaagaaaaaagaaacccaccctgacgaggcaccgaaggacaagcgcaagacaaaggaacaccagccgaacaaagaccgagaaggaaagggcggcccgaacacacaaagagaagacaggaagccggccacgaacaacaa

SEQ ID NO: 4679 - DNA, 414 bp, Triticum aestivum
  Clone ID: LIB3281-015-P1-K1-G3
cggacgcgtgggcggacgcgtgggttcatttcaatccaataaagaaagagaaacttttccttttgtgctcgggcgattagggatttggtggcggaggcggcaggaggctcaggcggcgcgggtcaatcgctgctggggcaggcggacgcgccgcgtcagatccaccggagagcctatgacctattctccttcagcgacacaactcgttgaaggactcactggggtgttcactcgcaatgacaagtgacaagggaaggacttcaaagaaggccgctgagggttcaccctctgctttggctgtgcctgatggaagagccagcagtggaccacagaaggggcggttgtccaatgggaggacaacgggtccagcaaggcgctcgaccaaaggaaattggaccctggaagaggacgata

SEQ ID NO: 4680 - DNA, 275 bp, Triticum aestivum
  unsure (1)...(275): unsure at all n locations
  Clone ID: LIB3281-015-P1-K1-G4
cggacgcgngagcggacgcgaggttttattttaanccaacaaagaaagagaaacgaaggcgccggcgcccgggcgaggagggaacgggcggcggaggcagcaagaggcacacgcggagaggggcaagcgccgcaggggcaggcggacgcgccggcgaagaagcaccggagggccgaagacccaggccagaacagccacacaacgcgccgaaggacacaacgaggggcccacncgcaacgacaagcgacacgggcaggacaaaaaagaaggccgcc

SEQ ID NO: 4681 - DNA, 365 bp, Triticum aestivum
  Clone ID: LIB3281-015-P1-K1-G5
cggacgcgtgggtggaaagatccgtttctcttgcccagcagtgtcccagcagtagaagtttggtggccttagggatggatactatatccatggtcagtgtgcgattatcatgtttgatgtcacttcaaggctgacctacaagaatgttcctacgtggcacagggacttgtgcagggtttgtgagaacatccccattgtgctgtgtggcaacaaggttgatgtgaagaacaggcaggttaaggccaagcaggtgacattccacaggaagaagaacctccagtactatgaaatctctgccaagagcaactacaactttgagaagcccttcctttaccttgctaggaagctggctggtgatcccaaca

SEQ ID NO: 4682 - DNA, 411 bp, Triticum aestivum
  Clone ID: LIB3281-015-P1-K1-G7
gtcctggagcaaattcttgctgtacttatacagtttgttaaagacaagaagttagaacaccagcaccaatatgatgatgtgaagaagacctggcttattaaaagatgccgtactatgaatgctaaactaagctacctggagcaccatctcttgcgtgacacctacacgaaggaaacagtacctgcattgcatagaatcaggaaatatcttgtggaggcaacgaaagaagcatccaattcctataatgaagcggtctcacggcttcgcgagtaccaaggcgtagacccgcactttgacgtgatcgcgaggcagtaccatgagatcgtgaagaaactggagggcatgcagtggacgatccaccaggtggagatggatctgaagccggcctcctcatgatctcccaggtgcgcg

SEQ ID NO: 4683 - DNA, 334 bp, Triticum aestivum
  Clone ID: LIB3281-015-P1-K1-G8
gtcctggagcaaatacttgttttttttatacagtttgaaaaagacaagaagtttgaacacctgctccaatatgatgatgtgaagaagacctggcttattaaaagatgccgtactatgaatgctaaactaagctacctggagcaccatttcttgcgtgacacctacacgaaggaaacaggacctgcattgcatagaatcaggaaatatctggcggaggcaacgaaagaagcattcaatttctataatgaagcgtactcacggttatgcgagtaccaaggcgtaaacccgcactttgacgtgatcgcgaggcataaccatgagatcgtgaagaaac

SEQ ID NO: 4684 - DNA, 101 bp, Triticum aestivum
  Clone ID: LIB3281-015-P1-K1-H10
cggcgcgtggggagatttcctaatgatgagggagagagacacgcccagggggacaatcatggtccggcactcgaaagaagattcaaatgaagatcaagttc

SEQ ID NO: 4685 - DNA, 407 bp, Triticum aestivum
  Clone ID: LIB3281-015-P1-K1-H3
gagagccatggccaaggaggtgagtgaggagccggagcacgccgcgccggcgcacaaggactactccgacccgccgccggcgccgctgttcgacatgggggagctccggatgtggtccttctaccgggccctcatcgccgagttcgtcgccacgctgctctttctctacatcaccgtcgccaccgtcatcggctacaaggtgcagtcggcggccgacccgtgcggcggcgtcggcgtgctcggcatcgcctgggccttcggcggcatgatcttcgttctcgtctactgcaccgacggcatcttggggggccacattaaccctgccgtcaccttcgggctgctgctggcgcggaaggtgtcgctgctgcgcgcggtgatgtacatcgtggcgcagtgcgcgggcggca

SEQ ID NO: 4686 - DNA, 67 bp, Triticum aestivum
  unsure (1)...(67): unsure at all n locations
  Clone ID: LIB3281-015-P1-K1-H5
cccacgcgttcgtggagacgaactttatactggcttcggtaaaaanccgagtcagatgaggaggttt

SEQ ID NO: 4687 - DNA, 411 bp, Triticum aestivum
  Clone ID: LIB3281-015-P1-K1-H6
ctcgccttcttcagggccttcaggttctgtgttgggttgtgcctgatagtgttcatgctcatgtcgctttgagctttcagtttcatgcccatgcccgccttgaacttgatagcaatacgactcataacttttgtgttgttcatactggttagagccataatgcttcccatattcagccatgctcctgtcatgctttggctcaccgttgtattcagcatccctatccttcaagtgagcgcggtcacgctcgtaacttgcacgctcatgatctctctcgcgatccctgcctctctcacggtgacgatcatgagagaggccacgatccttctccctatcatgatccctaccacgggccctattcctatctctgtcccgacgatcacggtcacggtcacgcccatggtctttttt

SEQ ID NO: 4688 - DNA, 199 bp, Triticum aestivum
  Clone ID: LIB3281-015-P1-K1-H7
cggacgcgtgggcggagggttatttttacctggaggcaagctgcccttcggtcctgactgagcttctcaagtctgtccatgggagaaagtgctgaaaggtagccatattgctagactttcaggatctgacaatgcgtgtagtctttgtttgtgcttgttgagaaaagttttattgcattctataaactttttgtttttt

SEQ ID NO: 4689 - DNA, 399 bp, Triticum aestivum
  Clone ID: LIB3281-015-P1-K1-H8
gaggaggtatctgacccaaaggcactcctagaggatcgtacgaaggctaagtgtgtctaccagtggtatgaatatcagaaatgcgttaagagaattgaaggtgacgagaccgggcagaagcactgtactggccagtacttcgattactggaaatgcattgacaagcatgttgctgagaagctctttgatagcttaaaatgacaaggaaattgttctctctagctacttttcactcaacagtggtaataaatagcatcacttgcacgccttattgacaattcaggtctttatcatcatatatgtaaaagaaggttttgcctgtcgggtaacacgacagtttttctgcggccactttacattttgtttgtcagaggcgttgctggctcacgatattttttt

SEQ ID NO: 4690 - DNA, 380 bp, Triticum aestivum
  Clone ID: LIB3281-015-P1-K1-H9
cttgcgcgtcttatcgattttctaatggaagggggagagaggggcggccagagggacaatcttggtctggaatttgaactaagattcaaaagaagatccgcgtcttggccggatattcagccggatcttgagacgatggctgggaataaggttcgtcattacctccctcttttcgtgcttgtcttctcgcttgtcgtctccttcgctgagagacaccgtgatagtcacggctatattgatggcttattggaccgctcattggagcgttacctggaggatcaggccgaggaccaggccatttacaaaggacttgcagaagtttctgcctttgttggtgttttactaggtgctatactaactgctatgttttctgcacagtt

SEQ ID NO: 4691 - DNA, 268 bp, Triticum aestivum
  Clone ID: LIB3281-016-P1-K1-A1
gtcacagaaagccgaagaaagtatttatttttgcgccatcccaaaaaccgggtggggagatcaacgaacttccggccgcccacttcttagtgggggtcaataccactaaacaatgtggagatttcaaaacgcacgagatgtaatgcatcggtactctcggcgagcgatcctgaagcatggtgagggtggagttcatgatggactttgagttccactggcgtattctaactttcaatcgattttattagcaccggttctgctgaggaaa

SEQ ID NO: 4692 - DNA, 413 bp, Triticum aestivum
  Clone ID: LIB3281-016-P1-K1-A11
gatcccgaaccagggaggatccctttgcgaggagggcaaaggaagagaagaggagaccaccgagcccagcgcgcgcacacgacagcaggcgccgcgatctagcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtg

SEQ ID NO: 4693 - DNA, 376 bp, Triticum aestivum
  Clone ID: LIB3281-016-P1-K1-A12
gatcccgaaccagggaggattccatctctcggagggcaaaggaagagaaggggtgactacggagcccagcgcgcgcacacgacagcaggcgccgcgatctagcgcaggcacgaagaggggtctcacgctcacgaagctgctcaggcggctcttcgccaagaaggagatgaggatcctcatggtcggagtcgaggcggctggtaagaccaccatgctctacaagcttacgctcggggagatcggcaccaccgttcccacaatcgggcgtaaaggcggaactgtaccccacaagaacattaaggttaccggttgggatgtcgggggtcaggacaaggacaggcccctgtggaggcacttcttccagaacacccagggg

SEQ ID NO: 4694 - DNA, 425 bp, Triticum aestivum
  Clone ID: LIB3281-016-P1-K1-A2
cggacgcgtgggttctgcggttgttgtgatctcaccccaggcgcctgctactggcgacctccgcgcctcgccgcccaccctgccgctgctggccgctccccgggttgctatcccccacccctgcacctaggccagggaggctttcggtcttaatctggagcctgtcgccccgccggcgttgggggaggagcctgagggctcggatctggcggggtgcgggcaggtgcatccggccctgctgccatccagtagcaggaggctggttgaacccctcgacgcagcccgcgcatcaggcgggcgtacgacggcgtccggatgggctccgtcgagcgagcttccagaggaaggcggcgacgtccgattctggctctggctcgggtggtggcgccactcgccgatccagcttttcgactgctcgtcgcaag

SEQ ID NO: 4695 - DNA, 431 bp, Triticum aestivum
  Clone ID: LIB3281-016-P1-K1-A5
cccacgcgtccggtgaattctgattttcttatagccaaagcagccggctgctagcaatgcgttatctgctgactctgggatgtcaaatccagcagtaaaagaagatgattccagtctttgtattcctgtgaggcaagctatttcctattctggctttactggtgagagcattcctgaagaataccaggattgtggtgtatcaccaatgctccttatgggcgagcctccatggcttcctcctggtcctgatggctcatttgctggaattagagacagtgctatcacacggtacaaggagaagaagaaaagaagaaagtttgaccacaagatcaggtatgaatctcgcaaggctagggcggatgtgagaaagagagtcaagggacggtttgttaaggccggtgaagcgtatgactatgatccgctcgacacaa

SEQ ID NO: 4696 - DNA, 431 bp, Triticum aestivum
  Clone ID: LIB3281-016-P1-K1-A6
cccacgcgtccgcagggaacattgttaatatacctctggttctcattgcagcactatgtcgggacccatccaatccttttggtgactctgaaaaatgcagccaggatggaaacgcgtatatctcattcggtcaatgggttggtgcgattattgtttacacatatgtgttcaagatgctttctccaccacctggagagacctttgatggtgaagaggagaagcttccggttctggcatctgaagaaaacgcgatgcctgaacttggtaaatatccaacaggcactcacactagtactgtacccgaggatgagcctttgttagctctcgaggggaatcaaaaaggctctacttctctaggatcaaagatattaagctgtgctagatgtgtggtgaaattcctaaaagacaagcaacttcttcagccaccaatt

SEQ ID NO: 4697 - DNA, 381 bp, Triticum aestivum
  Clone ID: LIB3281-016-P1-K1-A7
gttctagatcctgagcttattacttccattgatttcaccgaaccgcaccccccacttcctttcccgccgccgaagacacatgcttggctcctctctgagatatttcttagcatagtgtctgggaaaagtcagattgaatcttgaattgaggttagacttgcgcatcacagcagcaaagatggggatctctgagtctatggaatggaccttatgcttcacaacttccttctgagctggagttagtttggtcttgttcacggtaatgtaaccatccttcaactgctccttctgaattgaagatagcctgaccttcttcttcctgacggtgaaattggaaccaggcacttcacgtactccatattcttcttcatcttcacgtac

SEQ ID NO: 4698 - DNA, 377 bp, Triticum aestivum
  Clone ID: LIB3281-016-P1-K1-A8
gtcaccggcgtcacccgctttcttttcttcggccccgcgctctcctcccgcggctgcgccgtcgccgccttcgccgtctcctggctgacgttcctcgtcgcggaggcctgcctcgtcggaggatccgcgaagaacgcgtaccacaccaagtacctcggctactacacgaagcacgacctggtgagctgcgccgcgctccgcaagggggtgtttgcagcagccgccgccatgatgctcatcaacctggcggcctccctggtgtactactggagctactcgaaggcggcggacggcgggttcatcaagcaccagaacgaggccggcgtgggcatgaccgactacggcctcgacaggggcggcggcccttggctctgagt

SEQ ID NO: 4699 - DNA, 321 bp, Triticum aestivum
  unsure (1)...(321): unsure at all n locations
  Clone ID: LIB3281-016-P1-K1-A9
cggacgcgtgggcggacgcttgggtantccgggaggtggggaggggagaggagaggagaggaggcgtgagcgctaggaaaagggggagagagggttggatttcttcttcaggttgcgggatcgccaccccaattcgattccaccgcctagcgcccgatcgatcccagctgggttgatcactttccccctcgatagctttctactgttggggaatttttttgctgttgcgtcaattttatccgacggtttcccttctgatcggatcagttcgatattggaggagatgcgaatcgaggatcttcccgcacattctcgatggcc

SEQ ID NO: 4700 - DNA, 437 bp, Triticum aestivum
  Clone ID: LIB3281-016-P1-K1-B1
cgtcagcttaaaatggaacgaatattaggttattgtccacggcacatgagctatgctagaatccgccggaatagtcataccagcgctcctaacgaagagcggcctcatccacactgcgggatggtacaccgcgggcgagcaggccattcttagggccaagaccacgatttccgaaggtatgctcattgggccagaccgtgccaagggcactgggaccatccttgaacaacacaccgtgttacttaagcggagacttccccatagactacgactgtgtcatccgtgcactcttctatgacccggagacatttgatcagaaccgggagcgtggagacacccagaggaacatgggctaatgtggatgctctgggatgcaacatacccataaaatactgtccaataacggttaaaaaactcgtagaaagcgtataacacaa

SEQ ID NO: 4701 - DNA, 419 bp, Triticum aestivum
  Clone ID: LIB3281-016-P1-K1-B10
gtttgagaagttggccgatctcgatgctgccccagcagcactggccagactcttctcaatagattggtacagagagaggatcaatggcaagcaggaggtcatgattgggtattcagactcaggcaaggatgcaggccgtctctcagcagcttggcagatgtacaaggctcaggaggacctcgtcaaggtcgctaagcaatttggagtgaaattgacgatgttccatggacgaggtgggactgttggaaggggtggtggccccactcatcttgctatcttgtctcagccaccggacacgatcaatggatcactccgggtcactgttcagggtgaagttatcgagcagagctttggggaagaacacttgtgcttcaagacgctccagcgtttcacagctgctactcttgagcatgggatgc

SEQ ID NO: 4702 - DNA, 420 bp, Triticum aestivum
  Clone ID: LIB3281-016-P1-K1-B11
cccacgcgtccggttattttttcttgtgcagcagtttctggtctggtccaaggcgagagagtgttcttgcttgagttggtgttgatccaatgggcgagatgaaccaccagcccggggcgccgccgccggtgggcgtgccaccgcccatggggatgcagcccatgatgaacgcaccggtcggcgcgggcgccatgcaccagccctacgagcagttcaaccaactcaactactgcgtccactccaatccttcttgggttcaggtagcagggcttgcattcctccactacctagtgatgttgggctctactgtcatgcttgtgtcaattattgttcctgcaatgggtggtggtcctggtgagaaggcttgtgttattcaagcgttcctgtttgtgagtggcattaatactctgctccaaacac

SEQ ID NO: 4703 - DNA, 299 bp, Triticum aestivum
  Clone ID: LIB3281-016-P1-K1-B12
gttcgggtccgagagtagcctgcctagtctagggtttccgtagttcggagaggagagaaagggagagatccatggcggagacggagtaccgctgcttcgtgggcggcctcgcctgggccaccgacgaccacaacctccagcaggccttcagccagtacggcgagatcctcgacgccaagatcatcaacgaccgcgagacgggcaggtcccgtggcttcggcttcgtcacgttcggcagcgaggagtccatgcgccaggccatcgaggagatgaacggcaaggagctcgacgggcgcaac

SEQ ID NO: 4704 - DNA, 423 bp, Triticum aestivum
  Clone ID: LIB3281-016-P1-K1-B2
ccaaaaggccaaaaccctaaaccatggcttcgctcaccccctccgccggcgcccgcctcctccgccgcctcctctccaccgccgccgaggtggcacgggaggcgccggcccccgccgcgaagaacacgaagaaggcggcggcacgccccgtcaggaagcgggcggcgcgcgccgtcgccccccaggacgcgaaggaggcggcagaggcggcgccggatgcggagggcgcgaagaaggcggcagaggcggcgccggatgcggagggcgcgaagaaggcggcggcggcggggaccaaggactcgcgcccgctgtaccggcgactgtcggcgctggggaacgccggggaggggagcgtctccgcggtgatgaacaagtggctgcgggagggccgggagacgcgctccgtggatctcgagcgctacg

SEQ ID NO: 4705 - DNA, 428 bp, Triticum aestivum
  Clone ID: LIB3281-016-P1-K1-B3
attagtgacaatgctggtggaatttttgttatggctggcatgagccacagaatccgtgagaggactgatgctcttgatgctgctggcaacacaaccgctgctattggaaagggttttgccattggatcagctgctcttgtgtccctggcactttttggtgcttttgtcagcagagctggtgtgaaggtcgtcgatgtcctatctcccaaggtgttcattggtctgattgtcggagccatgcttccgtactggttctctgccatgaccatgaagagtgttggaagtgccgctctcaagatggttgaggaggtccgcaggcagttcaacaccatccctggactgatggagggaactgccaagcccgactatgccacctgtgtaaagatctccactgatgcttccatcaaggagatgatccctccgggtgc

SEQ ID NO: 4706 - DNA, 388 bp, Triticum aestivum
  unsure (1)...(388): unsure at all n locations
  Clone ID: LIB3281-016-P1-K1-B4
ggaaaagaagcccaacccacctgtttctattatcccgtcccctatccttcgaacagcatgacgccgcaaccaccgcctccctccctggctcgcgccgccgccgggccccggccacaaatcgcactgcctccctaccccgaccttcaaccgcgccgccgctgcgtcctccctcccgtgccggcaccgacaccacccttcccacctcgccaccaaccggcgccccgccgcacccccgaccccaaccggagacaccgnctcaccttcttcccggattccgcggcatcgtcccccacacgctgccgctgacgacgggagcaaccaccggtgcgggttgctccaccacctactggcctttaccgctcccctccaccagcatcggccccacccc

SEQ ID NO: 4707 - DNA, 431 bp, Triticum aestivum
  Clone ID: LIB3281-016-P1-K1-B5
aagacgcatgcgaaacataggaagctctagttttaccattgggtacatgcctattatgcttagaagttatgcttgtgttctgaatgggaaggacgaagctgaactagcaagatatggtgagtgccctcttgatcctggtggttacttcattgtgaaaggaaccgagaaggtcatcctaatacaagaacagctatcaaagaatcgtattattatcgacactgataataaaggaagggtaactgcatctgttactagcagcacacatgaagtaaaaagcaagacagtgatttgcatggacaaagagaaaatttatctacatctgaatcagttcactaagccgattcctataattgtggttatgaaagccatgggaattgaaactgaccaagaggttgtacaaatggttggaagagatccaagatatggtgacc

SEQ ID NO: 4708 - DNA, 427 bp, Triticum aestivum
  Clone ID: LIB3281-016-P1-K1-B6
cggacgcgtggggaagcatttgcgttcatctaacatatttttatggtatttttaaaaaagatcaaggttagagctatggcgctgtatgaggctatcattagtatggaagataaattaatgttaaaatattatttgagtttccttcattctgtaaaccgcaatacaagctacgtttgcgccatgattctattacaattttttttaacaactggcaattaacgacacatcaaatgttttgtattgaaatggatcattttgtcaggttgggtttagtaggtcataatggttttattctacgacagggttaattttgtttatattgtaaccagttcaagtaatacaggggaaaacaacagtttttggtttgtttggcaagaatagtccggtaatgatcttaatgaagcactgcatttatttcatacaagtc

SEQ ID NO: 4709 - DNA, 427 bp, Triticum aestivum
  Clone ID: LIB3281-016-P1-K1-B7
cggacgcgtggggtatttttttgtgtatttgcattcaccttgctatacttgataaagccaaggaaactgggagatcacaactacctgtcctggaacaggcaccccgcaggccgctaagggtgtttccgaactcgatatggcatatgattgatgcccgcctcgactacgtgaaatgtatcatcatgccctaaatgatacatgagattgccagtagctttagaccacctgtgtgtgtaaatgttaacagacggatctatgttcttttgtttgttgttgtagggcatgcatacagcagccgatccttgttgttgagtactactacggattgtattactacctctgatccaaaataagggttgcagttttgaactaaccccagtttagaactgcgacacttattttggatcggggggagtataagtttctc

SEQ ID NO: 4710 - DNA, 377 bp, Triticum aestivum
  Clone ID: LIB3281-016-P1-K1-B8
cccacgcgtgcgcggactttttggtacctgcagctcgcgcgcaaggggcggtgaaggcaggggaagttacagaccacaacgacgtggacgggaacagtacacgccgcaggctgctaaaggggtacacgaactctatatggcatatgattgatgcccgccttgactacgtgaaatgtatcatcatgccctaaaagatacatgagaatgccagtagctttagaccaccagtgtgtgtaaatgttaacagacggatctatgttcttatggatggtgttgaaaggcatgcatacaagaaccgatccttggtgatgagtactactacggattgtattactacgtctgatccaaaataaggggttgtagtgtttcaactaacc

SEQ ID NO: 4711 - DNA, 230 bp, Triticum aestivum
  Clone ID: LIB3281-016-P1-K1-B9
cggacgcgtgggggaactctagggtatttgcaccggacgcgcaagacgaggtgaggagagggaagctgaaagatcacatcgacctggacaggaataggcacccaggggttcggttacggtggaaccgaacaaaatgaggcatataatagatgccggcgtagacaacactaaatgtatcataatgccctaaacgatacatgaaaaggccagtagtaatagaccacccgggt

SEQ ID NO: 4712 - DNA, 430 bp, Triticum aestivum
  Clone ID: LIB3281-016-P1-K1-C1
gtggacagctagagccagccaccatcgttttcctggcgagaggggaggaaggggcaggtttagcctggcaggtgcttctcgggttccatggcttccagcgagggggcggcatccttgctctgcatcaagctcgtggtctgcctctgcttcctcggattatcccaaggcaggggcacggccaagccgccattcacgttgaggaatctcccacccctcgagaaggcgagcagcttccccgcgatgcgccacgacagctacgactacattgtcgtcggcgggggcaccgccggctgccccctggcggcgacattgtcgctcaagtacaaggtgctcgtgctggagaggggcgggtccccttacggcaaccgcaacatcttctacatggagaacttccacattggcctcagcaacacggcgccggactcttcgt

SEQ ID NO: 4713 - DNA, 419 bp, Triticum aestivum
  Clone ID: LIB3281-016-P1-K1-C10
cgtacccgaacgcgacgtatcctatgttcgccctacagccctcggaacgcttcacccttccattcccgttcacgagctgctcgcctgccctcccctaccctccccgctcagccgagcctccccaattcccggcaccgccgtcttctctgacccgggcgtatgtatacaggcccattcaaaatccacgccgcaaaatattaaccacaaatccatccggcgatagggcagctgccagctgaggctgctgctctgcttcactgctcttccctggtgagctccggcctcggctctcgcgtggtaggtatgggcacgggagagggcaggggccggcggcggcggaagctcgagggggacgacagcgaccaggagtatgtgttggaggaagaagaggaggaagatgatccccttcagatttagta

SEQ ID NO: 4714 - DNA, 313 bp, Triticum aestivum
  Clone ID: LIB3281-016-P1-K1-C11
ggtacacaagcgggccgtattcgatgttcacccagcagcactggccagactcttcttaatagattggtacagagagaggatcaatggcaagcaggaggatatgattgggtattcagactcacgcctggattcagcgcgtctttcaccaacttggtagatgtacaacggctcggaggaccttgtcaaggtcgcattatcaatctgcagtgaaattgacgatgatccatggacgaggtggcactgtaggaaggggtggtggccccactcatgctgctatctcgcctcaaccacacgacacaagcaatggatcact

SEQ ID NO: 4715 - DNA, 428 bp, Triticum aestivum
  Clone ID: LIB3281-016-P1-K1-C12
ggatgacatctgcttccgcatcgtttgtgctctcgtgatcgtcgccgtcctcgccaccgtggtcaccctgctcgtcatcgccttcgtcccccgccctttcggcgtcagcgtggaggacgcggccctcgcccgcctcgccctcgccgacaagaacgccacggccaccgcgctcgcctacaacatctccatcgccgtcggcgttcacaacgagaactggataatgcgcgccaagcacaccgcgcggctggacgcggatctgctgttcgccagaacgcgcttcgcccgtgtcggactggcgaccgcaggggccgtggtccggccccggcgcagggaagtgtaccacgccacggcagcggccgacagcgcaagcgtcgctctggggagctcaggcatggccgacttcctcaagcagtccgaaacggggaagg

SEQ ID NO: 4716 - DNA, 433 bp, Triticum aestivum
  Clone ID: LIB3281-016-P1-K1-C2
cggacgcgtggggccgtctccattttctttccgtcctccctcctctcccccggccgctcgctgctcccataccgtctcctccgctgccggggcagacggactggagatctgcactcgattcgcctacctcgtcgatcgaacaggaagacagcaacgggtttggagaacctcaagaagagccgaaagatgtcgctaggctatgcggagaagctgtcttaccgagaggatgtgggcactgtgggcatgcctgagaagttcgactcccccaaactcctccaagggaagatagaagagcttgcagttatggtgcaaaagagtaagcatctagtggtgtttaccggagcaggaatatcaacttcatcaggcatacctgatttccgaggcccaaagggtgtgtggactctgcagcgtgcaagaaaaggtgttcctgatg

SEQ ID NO: 4717 - DNA, 453 bp, Triticum aestivum
  unsure (1)...(453): unsure at all n locations
  Clone ID: LIB3281-016-P1-K1-C3
cggaaacccggggcgacccacgcgaccgcggacgcgaggggccgacaccatattcttaccgngcccccagcgcaccccggggcgggcgcagcccccataccgcctcccccgctgccggggcagacggacgggagagccgcacacgagacgcctacctcgccgagcgaacaggaagacagcaacggngtgggagaaccgcaagaagagccgaaagacgacgccaggcgatgcggagaagccgcccgaccgagaggacgagggcactgtgggcaggcccgagaagtacgactaccccaaactccgccaagggaagatagaagagcctgcagcgagggcgcaaaagagtaagcatcaagcggagcgcaccggagcaggaagagcaaccacaccaggcatacactgattccgaggcccaaagggtgcgaggacactgcagcgcgcaggaaaaggagc

SEQ ID NO: 4718 - DNA, 339 bp, Triticum aestivum
  Clone ID: LIB3281-016-P1-K1-C4
gcggcggtggtggataccacgggcttcactgagtcagttctacccccgtcctgcccagcgatgaaatctcatcatcagcgggttggtgatcagtgagtggtggacggtgctaattatgattggtttgcatgcgtgggtatcgttaggtcttctgccattcccgcgaagccccgtttattatctgcactgcagagttgggagttcagaataacagatgtgcgtgtgtgtgtcgctgtgtcaggcgagtgtgagggtgtgttggtgtgttgctttatcaagattttgtaatttcagtgtgtgttttgtataagaagttattatgaatcaagtaatttaacc

SEQ ID NO: 4719 - DNA, 341 bp, Triticum aestivum
  Clone ID: LIB3281-016-P1-K1-C5
gccagaacaagggagaccacgccctactctttgtatctcctacccgcgaccagcccagcgatgaaatctcatcatcagcgggctggcgatcagagagtggtggacggtgctaattatgattggttcgcatgcgtgtgtatcgttaggtcttctgccattcccgcgaagccccgtttattatctgcactgcagagtagggagttcagaataacagatgtgcgtgtgtgtgtcgctgtgtcaggcgagtgtgagggtgtgttggtgtgtttgctttatcaagaatttgtaatttcagcgggtgtttttgtataagaagttattatgaaataagtaatttaacc

SEQ ID NO: 4720 - DNA, 426 bp, Triticum aestivum
  unsure (1)...(426): unsure at all n locations
  Clone ID: LIB3281-016-P1-K1-C6
ggaaaatgaacgatggcgcggttttcctgtggactttgccgatgttccactgcaatggctggtgctatacatggacgcttgctgctatctgtggaacaagcatatgtcttcgtcaggtcacagcgaaggctatcttctcagcgatagccaaccaaggagtgactcacttctgtggggcgccagttgtgctcaacaccctcatcaacgcccctccagctgacaccattctcccgctgcctcgcgttgtggatgtcatgactgctggcgctgctccaccgccctcagtccttgcggcaatgtcgaagctcggcttccatgtctctcatacgtatggcctctcggagacatatgggccatccacggtgtgtgcatggaagccagagtgggacatcctgccagatgacgagcgtgcccgcctncaagctc

SEQ ID NO: 4721 - DNA, 426 bp, Triticum aestivum
  Clone ID: LIB3281-016-P1-K1-C7
cggacgcgtgggctcgcctttcgtaccgtcggtgacacctccttcctgatctgcggagtggttgtgtcggctgcggtctttcttggcgtgctcggcctcttggctgtgtatgccgccggtgcccgtgcagccaagagtgctgcgggcgactacgtggatgagaagcttactgaagtggagatgatcgtggagaagaaggtgctgaccagcatcaagaagacatgaacttgttgcgtcacgccgacatgaagctcgacagccgggcggctgcgatcaaggccaaggaggaggaactgcgtgccaggcaggcggccatcacgttgaagaaaactcaagggcgagccaccaagaatggcgaggaggaaaccgtcaacggtcaggtgcagggacccttttaccggatcctgaagtacgttggactggggt

SEQ ID NO: 4722 - DNA, 426 bp, Triticum aestivum
  Clone ID: LIB3281-016-P1-K1-C8
cggacgcgtgggttttgcttttgtttgtggttctagagcagcttggttttctgcgaaggtccttgatataaatgaagatagtgcatgcatccactatgaagcccacggtgaaggtactggtctttccaaggaatgggtgtcactgaagcaggagggggagaaggcacctcacatacgtcttgcccatcctgctactatatctaatttgaaaggtactagaaagcgccgtagggacacagcaggaaattattcttgggctattggtgatcacgtggatgcatggataaaaaatagttggcgggagggagtcatttctcagaatggtgaatttggtgacacaaagttcgttgtgcaattttcagctggtgattccttagtccttgatgcttggaatcttcgtccatcacttgtttggcaggatggtga

SEQ ID NO: 4723 - DNA, 404 bp, Triticum aestivum
  Clone ID: LIB3281-016-P1-K1-C9
cgtacccgtacgcgatgcttcctttgcccgccctcctcccctcgtaacctccacccttccattcccgtttccgagctgctcgcctcccctcccctcccctccccgctcagccgagcctccccaattcccgtcaccgccgccttctctgacccggtcgtatttatacaggcccattcaaaatccacgccgcaaaatattatccacaaatccatccggggttagggtgctgccagctgaggctgctgctctgcttcactgctcttccctggtgacttccggcctcggctctcgcgtggtaggtatgggcacgggagagggcaggggccggcggcggcggaagctcgagggggacgacagcgacgaggagtatgtgttggaagaagaggaggaggaggaggaggtct

SEQ ID NO: 4724 - DNA, 433 bp, Triticum aestivum
  unsure (1)...(433): unsure at all n locations
  Clone ID: LIB3281-016-P1-K1-D1
ctctcagtctcccctccggtggcctatcttacgatcccacccgccgctccttcgcagaaccttccgctccccgcctctacaaaaccaccaaaacccccacttgccctctcccacctcccgcgccgccatgggctcctcctcctacctcccccacgacacggatttctccccctacctccccgccgacatgggctcccccaccgccgacgacccctccctcaacctctacctctccgacctcatcccgggctcgccctccgaatacctngacctccccccgaccccgcaccacgagcaggagcaccagaaaccctcccccgacggccacggcggcggggtaggcggcggcggcggcgactccccctcatccacgccggaggacctcgtcctgcccttcatctcccgcatactcatggaggaggacatcgacgac

SEQ ID NO: 4725 - DNA, 426 bp, Triticum aestivum
  Clone ID: LIB3281-016-P1-K1-D10
cccacgcgtccgctactggatgaatgaatatcgccctaaaaaacatagggcaattggatgacaggccattcctggcggcatgccgtaagaagctgcctgccgaagaagcaagagaaaaagctaaagaagtacaccgtgtttggcaggggcatatacagaacccagagtggaatcccttcaagactgtcacagttgaaggtatcccgaaggagattattgatgtcgatgatgacaagctgcaagggctatgtgctgcatggggtgaaggggtgcacaaggctgtggtgagttgtttggtagaaattcaagaaagtggcaggctgggagatagaaacattgtacccgaggtctggaattacaagtgcaagagaaaagccactcacagtgagagcatcgagtacttgttcggtcaagtgaagcgtctga

SEQ ID NO: 4726 - DNA, 410 bp, Triticum aestivum
  Clone ID: LIB3281-016-P1-K1-D11
cggacgcgtgggccgtctcttccttcgcatcggccttctcccacctctccctcccctccacctccgctccccacccgccccctctcctccgcctccccaccacccgccgcgccgctcgcctcgtcctcttcgcctccggggccgacgccgccgagccggtcctcgaggcggaggcgcctgccgccgacgacggccccgaggaggtgctcgcggttgaggccgaggaggacgcgctctccgggctggcgctgcgcaagtacgtgaagcagcggctgcccgggggattcgccgcgcagcggatcaccgccacgggccgccggaagatggcgtccgcccgcgtcgtgctccaggagggcaccgggaaggtcttcatcaacttccgcgacgccaaggagtatttgcaagcgaat

SEQ ID NO: 4727 - DNA, 390 bp, Triticum aestivum
  Clone ID: LIB3281-016-P1-K1-D3
cccacgcgtgcgcccacgcgtatgtatagatcggaaaatcatcgagctcgcccagacggatccgatgcatgccatggcggagcccgacggtgcgctcgacccccctccagctgcatgctcttcgggtgggccgaccccgacgtctcagtggcccaaggacggggcgctcgaccccgctgcttccggctctgcggttgctcataccccggcggtcgagtggcccaaggacggattgctgactcggtactgggtggtgacgcttaccgtggtcctcaactgatgctggcggagcatgccgccgcaccagttatcttcggtgctcttcgcgagactcgtccggcggattgtctatgtcaggatcgtcaatctgcaacgagagcccaacatttt

SEQ ID NO: 4728 - DNA, 429 bp, Triticum aestivum
  Clone ID: LIB3281-016-P1-K1-D4
cggacgcgtgggactgcataccatgtgtttcagccctaactacatagcccctgaggtccttctcaacaaaggttatgatggctccatgtcagatgtatggtcctgtggcgttatcctctatgtgatgcttacagggaatcttccgttcgatgacgaaaatatggttgtcctttatcaaaagattctaaaaggggattatcgtattcctaaatggctttcgccaggagcccaagatatactgcgaaaactcctggatccaaaccccattacccgccttggcatggacggactaagggaacacgattggttcaatcaaagttatactccagcagtgccttttgatgatgatgacgataattacgttggtgatgacaactcccacatgaccaagaacaatggcattcaagacaaccccgcaatcaaccagat

SEQ ID NO: 4729 - DNA, 415 bp, Triticum aestivum
  Clone ID: LIB3281-016-P1-K1-D5
cggacgcgtgggccggcggcggcttctttaacaggagaaggagcaggcggcggcggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctgggttcatggacatcatttccattcccaagactggtgagaactacaggcttctttatgacac

SEQ ID NO: 4730 - DNA, 419 bp, Triticum aestivum
  Clone ID: LIB3281-016-P1-K1-D6
cggacgcgtgggcgcgcgcacacatattaagcagccgaggttgcatccttccagggttcggcgcaggagatggaggagggcgctgccggaggaggagggggtgggtggcggctcgtacaaccatctcaagaatcgaaatggctcgtctaactgcctgattgacaagctagccaaggctgttgccctcaagccatcatatgtgagataaaacgcactggacctatttcatttgatcctgatgcgctggaactacctgaaatatgctactctctagcgtgaatatgcaatctattactgtgcatgggcatataaataataatggaaaggatcgtattgacaaagcctaccatgttggtgatatagacatccattgccatcaccaaggatgcggagaactacgggtctttttatgacaccaa

SEQ ID NO: 4731 - DNA, 171 bp, Triticum aestivum
  Clone ID: LIB3281-016-P1-K1-D7
cggacgcgtgggcccgcgtttttttattttagaggacaaggatgaatccttgcaggttccggagcaggagatggacgaggaccctgccggaggaggaggccatggctactgtttagaagaatcatattaataggcttaatgcctcctttatactgtatgcttgacaagctt

SEQ ID NO: 4732 - DNA, 422 bp, Triticum aestivum
  Clone ID: LIB3281-016-P1-K1-D8
ctcttcttctgcatgtggttttgtgttttgcaaatctcgatcgaagatgagcaaaggaacatagcagatgagctgagagccgccactgaagagccaaagttgagcatagaggaaggcagcggcggtgcttcggatgcgatggctgtagactgattaacgatcctagcactagcgagttgcttaccctgcacgctcaagcatgcttcggtagtgtctgggcgcggtgtttctttgtaagagatcccttttttgttgttgctgtggtatcttgaaccgtaagatgtacttgacgtcgaaccattccgtgcttgtatgatagagatgcagaatcattgtgctgtaatatgtactccagatttagaattgcagcgtgattatttatcgaaaacggcggagtcaaaaaaaaaaaaaaaaaataaaaa

SEQ ID NO: 4733 - DNA, 405 bp, Triticum aestivum
  Clone ID: LIB3281-016-P1-K1-D9
ctcacgctccgcccacgctttcgttttacgcgtccgcggacgcgtgggcaagaagcgcccaggaaagaacacacacaggcacaggcacaggcagagaggagaggcaatggcgaccactaagatggcggcggtggcgatcctggcggcgctgctgctgatggcagttgtggagccggctttgtccacgccgcccagcatgctggcggcaagaaagttgcagatgccttgcctcatggatgtcgtcttggcagagtcaaagctggcttgcctcccagcaggcggatgttgcatgtttcgtcctatggatcgctgcggtaactgtggatgtttatatgctgtcggggtttgctactgcacgcggtgtgtggaatgaactgcacgtacgtgtgcattttattactagct

SEQ ID NO: 4734 - DNA, 371 bp, Triticum aestivum
  unsure (1)...(371): unsure at all n locations
  Clone ID: LIB3281-016-P1-K1-E1
annncggcgacgccaccgagcgaatagagctcccggccccccgccaagacgggggggagaacaagaagaccagcgagaacaaaaccaaggaaggcaagcaaggcaagagagaaagagacgggacagacaggcacaaggccgaaggaacggcgaacaggccgacacagagcgaggcaaggacccggccccaaaggcaagaaccggaccaggagcgaggaagcacccaccaagacgggaagaggacaggcgagggcagacgaaccaagaagaacaatacggccggaacacgggaggcagcgggaacccaagacagagaaagcacacacgggagagaacacggggacggcaaaaacgtgaaggggaggaaagga

SEQ ID NO: 4735 - DNA, 420 bp, Triticum aestivum
  Clone ID: LIB3281-016-P1-K1-E10
caccttttgccgagacgagattcttttccgcagccgcccccgtcgccgtcgccgtcgccgtcttttgccaccgcgatgcctcggtattattgcgattactgcgacacttatctgacccatgactcgccatctgtccgtaagcaacacaatgctggatataaacacaaggcaaatgttcgtaactactatcagcaattcgaggagcagcaaactcaaagtttgattgatcaaaggataaaggaacacctgggacaagctgcagcgttccaagttggcgctcctttcaaccaacatcttcttcaatatccaggaaatatgccccgtccccgtcttccgattctgcccacacccatgatgcaacatggttatcctcaacatcaacaacctggtgggccatttgcaaggcctcctattttacca

SEQ ID NO: 4736 - DNA, 408 bp, Triticum aestivum
  Clone ID: LIB3281-016-P1-K1-E11
cctagctatatctaaacacttagttctcccactccctcccaccctcaccaccaccaccgcccatccatcggtcggctcgccgccaccagtcgagcccgcccgaccccggccatggcgcgggaggagctgtcgacggagatcgtgaaccgcggcgtggagccgtcgggcccggacgccgggtcgccgaccttctcggtgcgcgtgcgccgccggctgcccgacttcttgcagtcggtgaacctcaagtacgtgcggctcggctaccactacctgctgagccacggcgtgtacctggccaccatcccggtgatcgtgctggtgtgcggcgccgaggtgggcagcctcagccgcgacgagctgtggcgcaaggtgtgggacgaggccacctacgacctcgccaccgtgctc

SEQ ID NO: 4737 - DNA, 316 bp, Triticum aestivum
  unsure (1)...(316): unsure at all n locations
  Clone ID: LIB3281-016-P1-K1-E12
ccgacgcgtgggcggacacgtgngttcttcacccacgctccacccgccgcagccgcaatgggcacgcgccagtgctccccccgtcacgagaacatcaccctccaggccgggcacggcgcgcccgttgttgacacaccccgaccggagacagccgaatgggggcgccggacatcgaccctccttagcttagctgaaacccgtcacgtcccgccgccgagccgtggcctgcccaacctgcagcggatccgaccaggggcttggccctcctcgcgttagatccagacgaacgccacggggtgcgatccccatcctactg

SEQ ID NO: 4738 - DNA, 430 bp, Triticum aestivum
  Clone ID: LIB3281-016-P1-K1-E3
agcaccaccacccgccacctcaatttacgcaaaggccgaggaggacaagctaggaggagcgagcagccatggcttcgtcggtggccgccgcggcgagcgcgttcctcgggacccggctggcggacccggcgccgcagaacgggcgcatcgtggcgcggttcggcttcggcaagaagaaggccccgccgaagaaggccaaggcgcccccgaccaccgaccggccgctgtggttccccggcgcgcaggcgcccgagtacctcgacggcacgctcgtcggcgactacggcttcgaccccttcggcctcgggaagcccgcggagtacctgcagtacgacgtggactccctggaccagaacctggcccagaacctggcgggcgagatcatcggcacccggttcgaggacgccgacgtcaagtccacccccttcca

SEQ ID NO: 4739 - DNA, 431 bp, Triticum aestivum
  Clone ID: LIB3281-016-P1-K1-E4
cgcctctccagcaaatatcagttttcgtttatatcgtgtcgccagggccaacacggcggcctagcttaccttgtagttcatccagagaacacacaatggccgtagcgatgccagctgcgcgctcgcttctcctgcttctcctcctggttgcgccgctggcgccgggctcgtcggaggcggcagtccggccgaaccccaagatcgtcaactgggtcgcagacaatgcccgcgcctccacgcccgacagcttcggcgccctcgtcttcgacctctccgtcggcacgccgcggcagaccctctccttcgtcatggacatcaccgagcagctcgtctgggcgcagtgcggccaacatgggttcacgcagtcgcaggcgcccaccttcaggcccggcagctccttcgccccgattggctgcaaggacacggcatgc

SEQ ID NO: 4740 - DNA, 426 bp, Triticum aestivum
  Clone ID: LIB3281-016-P1-K1-E5
tgcccctacctcaagttcgaccacttctttttcaaccaggccatcctggaggcgttcgccggctgccgccgcgtgcacgtcgtcgacttcggcatcaagcaggggatgcagtggcccgcccttctccaggccctggcgctccgtcccggcggcccttcctcgttccgcctcaccggcgtcggccccccgcagccggacgagaccgacgccttgcagcaggtgggctggaagctcgcccagttcgcgcacaccatccgcgtcgacttccagtaccgcggcctcgtcgccgccacgctcgcggacctggagccgttcatgctgcagccggagggcgaggaggacccgaacgaggagcccgaggtaatcgccgtcaactcggtcttagagatgcaccggctgctcgcgcagaccggcgccctggagaag

SEQ ID NO: 4741 - DNA, 431 bp, Triticum aestivum
  Clone ID: LIB3281-016-P1-K1-E6
cggacgcgtggggcaagagttgactgaaatggtgcagggtctagcaaaggaggttgagcatcagaagtctgaaaagcagcgcatacctgccatgctagctgaacgagatggtctgcgacaggaactaattcgtaccagggccgctcttgattatgaaaagaatgcaaaggcagagctgatggcacaggtgcaggcagtggagaaggatcttgtaactatggctcaggagtctgagaagcttagggctgagcttgagaagagaaagccacctagtttcagcggccatggagcttacggaccacctatgacaactcttgggatgggcttgcaagacatctacgacagcggctattcttacagagagaaccgctacggtgctggaccatgggacccccctggctatccgcacccatgatttgggcttttgatcc

SEQ ID NO: 4742 - DNA, 421 bp, Triticum aestivum
  Clone ID: LIB3281-016-P1-K1-E7
cggacgcgtgggctacgattcgctttgttgctgtcggtctctgccgcctctccgacgacctttctggccgaatggcggccccgtgaagccatggtgtctgcgctggcttcgtttcttcctcccggcttgatgcctttagggaggcagctattcagcttcggtatggagtcttcctcttccgtcttctaccggagatggagtggtggctgtccggtgatcccaagtggttttgtccccggtgatggcaggactggatctgtgctagagttgatatttggacttgattgtaatcttgattctctggatagggtcctccttgtaagtttcagggactatgctgtagttttattttcctttgaggactggtctgagctttgtactataactgctgggaattaatgaaagctctgagtccttctgg

SEQ ID NO: 4743 - DNA, 402 bp, Triticum aestivum
  Clone ID: LIB3281-016-P1-K1-E8
tctagttctagatagtaactgtaatctgatgtgtatatattataagaatcataagcttagatgtatgtaaatcttttaccattttttggaactatttcgtatttccatcaaatgtagatgcatttttcaacatttccgtacaaatagtagactatattcatcctgtcatatagtgtgtaacattcatgttagcatagataagtaaatttgttaatttgaagagattttgcagcaaactcattatccatgtacttgtgcttatgtaaaatgctggcaacatcatacggcaagtgtgtattttagacttttagttcataacttcagaaaaaatctttgtagattatgttcttgaccccaacatccttattgctacttcatcatttaccattacttgcagtccat

SEQ ID NO: 4744 - DNA, 346 bp, Triticum aestivum
  Clone ID: LIB3281-016-P1-K1-E9
ctcacttcttgatagtaactgtaatctgatgtgtatatattataagaatcataagcttagatgtatgtaaatcttttaccattttttggaactatttcgtatttccatcaaatgtagatgcatttttcaacatttccgtacaaataggagactatattcatcctgtcatatagtgtgtaacattcatgttagcatacataagtaaatttgttaatttgaagagattttgcagcaaactcattatccatgtacttgtgcttatgtaaaatgctggccacatcatacggcaagtgtgtattttagacttttagttcatcacttcaaaaaaaatttttgaagatatggt

SEQ ID NO: 4745 - DNA, 429 bp, Triticum aestivum
  Clone ID: LIB3281-016-P1-K1-F1
gagtaaacagatctgatctctccttttttttctctctcgtccgcggcgatacgatccgagatggcgatgagggcgtggaggcggagcgcggcggcgagggccccggcgcacctgtgcctgtggctggcgctcgtcgccgccaccctggtgctcgcccagggcaagaaatccaacctttctgaggtgacgcacaaggtctacttcgacatcgagatcgacggcaagcccgcaggtcgggttgtcatgggacttttcggcaaggctgttcctaaaaccgcagagaacttcagagcactctgcacaggagagaaaggtatgggcaacagcggcaaacctctccactacaaggggagttcgttccacagaattatccccagcttcatgatccaaggaggcgacttcactcttggtgatggaaggggtggtgaa

SEQ ID NO: 4746 - DNA, 428 bp, Triticum aestivum
  Clone ID: LIB3281-016-P1-K1-F10
gggagcagtttgggaagtttgactttgtgcttgagccaggatgccactgcctgccttggatctttgggaaacgtgtagttggccatctcacactcaggttgcagcagctggatgtgcgctgtgaaactaagacaaaggacaatgtgtttgtcactgttgttgcatcgattcagtaccgacctctggctggcaaagaaagtgacgcatactacaaactgaccaacacaagatcccagattcaagcctatgtctttgatgtgatcagggcaagtgttccaaagctcaacctggatgatgctttcgtgcagaagaacgatatagcaaaggctgtggaggatgaacttgaaaaggctatgtcggcatatggctttgagatcgtgcagaccctcattgtcgacatcgagccagatgcgcatgtcaagcaggcg

SEQ ID NO: 4747 - DNA, 383 bp, Triticum aestivum
  Clone ID: LIB3281-016-P1-K1-F11
gcggttttgtcgaatcagtgtttattttctggtgctgggacatcatggcttgattgccagagatacagatcttccagtttccggaaactggaaggccgtccctagtgcgacttgacgtattcctgcacgatgtgaagaccctcggaatcttcgccgtagtccttcacaacgacacatgagcagcccaccacctagactgactcgcattctgcgtccagggtgcgacgagcaccccagtccccaacagtttttctcctgcgagcagcggccgagtgtacggggttctcaacactgagggtcttgatcagctaaacgaagttgcccttgctgttgcggtcaatacccacacagttgtggagcccattgtctttaagaccgttctg

SEQ ID NO: 4748 - DNA, 414 bp, Triticum aestivum
  Clone ID: LIB3281-016-P1-K1-F12
ccgattgggtggctgccatttttttcacatcaaccaagctcgagctcccatttcatcaccactctgctagcccgagtctccttcttgaccccccccccccccttggtttcaagtctcgcagtcctcgtcccagtctctttctccttccaagaagaatttctttgggttgagggagctgctgttcttgctaggctaggctagatcagcgggagaggctgggtcgttgttccgcttgaaatctctgggttttgttgcgctggaggttcttgctggccatggtttgtccaggcatgctgaggcgcaatctctgagctttatgaagatcgccactcacctgcgccggggctgcttcctccagtccttctccgtcggcttcctctactacttttatgtgatctcataaatggccctctc

SEQ ID NO: 4749 - DNA, 430 bp, Triticum aestivum
  Clone ID: LIB3281-016-P1-K1-F2
tgaaggctggcgcttttatctttgtttgtttgtttgccaatacaactcttgcgttctcaaacctggttggaccaactgaacaaatagagttctatgggcaccccgttgtcttcattgcgcctagtgtttatggagctccacaaggtctgcttgttcaatgtcagagttacaatagcactattatggtaagcttgtccgtcgatgaggaaataattccagattatattgaacttatggatgactttgttgagtctttcgggcgcattaaggatggggcttcaagactttcaacatccatcaagcaagaatagtcaatatgcagatatatcagtgtgctccctaaaattgtataaagacagcaatatgctcctatatattcgctgtgtgtatcacgagttgcgacatactagtaattaagaagcagaacatg

SEQ ID NO: 4750 - DNA, 434 bp, Triticum aestivum
  Clone ID: LIB3281-016-P1-K1-F3
cccacgcgtccgccctccttgcctttacttcgccagcggtccatgggcaagtcaagcaagaagtccgcggcccctactgtcgtggcgccggcggccgtccttaccaaggggaaggccgggaagaagcgcgaagccgatgacgagatcgagaaggctgtaagcgcaaagaaacagaaggctgcgccggcaaaggcggtgcccgggcccaaagaggccgccaagaaggccaagaagcagccgccgcccaagaaggttgagagcagcagctccgaggaggagtcatccgagtccgaggaggaggaggttcctaagaagactgcaaagcctgtcaaacacgagtcttcagatgatagcagcgacgattcctcctttgacgaggaacctgcaaagaagccttctgctaaacctgtgaccccagctgccagcaacggctt

SEQ ID NO: 4751 - DNA, 426 bp, Triticum aestivum
  Clone ID: LIB3281-016-P1-K1-F5
cggacgcgtgggttcacctctggtttctttaacagttggtcagttattgcgcaatgacttctctcgggaacattggatgggagttcttgaaaacaatgagtggcaaaaggagggaaatgttgatgacattatgccatcattaaggattagctatgattaccttcactttcatctaaaaaaatgtttttcgtatttttccttgttccctgaagattataagtttaagaagatagatattacgtatttttggattgcattaggaatcattgaaaaagatgagaattatatagaagaacttgtagagaatggttttctcatgaaggaagatgatgagtttgaaggtcaatactatgtaatgcatgatttgttacatgaactgtctcggagtgtttcatcacaagagtgcctcaacatatgtagttcaaa

SEQ ID NO: 4752 - DNA, 431 bp, Triticum aestivum
  Clone ID: LIB3281-016-P1-K1-F6
cggacgcgtgggtgaggatgaaattatgctagggagaaatattgctggtagaaaaacaggcctcccatgccatcctgaccaaaaatgtattccccgatttggttaaacagacccgtattagcccctggctgcctcaactggtggatgccgtcggctgcccaatgaccatcaacacatatgagctcggtttaatcagaggtgaggccttgcttcttctgcagttttcttctcttcttttgtgtggatttgcatctagcaaaattgaaatttcatggtgggtcagtttggaggcttcatatttcacaattattattgtgtggttcaccctagaatttgattttaacgcgtgcttgcgcatatttggttaggattggcatgcttgtttttatatgtaattgctatgtttcgaggctacttattttatttaaccc

SEQ ID NO: 4753 - DNA, 420 bp, Triticum aestivum
  Clone ID: LIB3281-016-P1-K1-F7
gcgggagccgatgattacacattttgttttggcatccagtggacttctgatgccaagctggtcttcggtgggcaggccacaaacctgccggtccaaaaccagctccagaagcagtattcaactctgaggtattttccagcagacaacagcaagtattgctacacgatgaatgtgaggaccaggacacgctacctcgtcagagctagcttcctctacagaaacttcgacaacagcaacgtctaccccaagtttgatctctccctcggagccactccctggtccacggtcataatcgatgatgccgacacgccggttgtagaggaggccattatcttggctgccgctcccacactcagtgtctgcctctccaatgccagcacaggacagccgtttatatctacactcgagcttcgccagttt

SEQ ID NO: 4754 - DNA, 417 bp, Triticum aestivum
  Clone ID: LIB3281-016-P1-K1-F8
cgatcgcgcaggcgccaggtgttatgtgagagaaaaaaaacaaccagttcgtcggtagggtttcgggggctgcgatggcgatggaggctcggatgaaggggacggtcaagtggttcaacgacaccaaggggttcggcttcatcacccccgccgacggcagcgaggacctcttcgtgcaccagtcctccatcaaggccgacggcttccgctcgctggccgagggcgaggtggtcgagttcgccgtctcggagggcgacgacggccgcaccaaggccgtcgacgtcaccggccccgacggatccttcgtgcagggcggcgcgggcggcggcggaggaggtggaggcttcggatcccgcggcggcggcggatctcgcggcggcgggggcttcggcgcccgcggcggagacggatctggcg

SEQ ID NO: 4755 - DNA, 417 bp, Triticum aestivum
  Clone ID: LIB3281-016-P1-K1-F9
cgcgagtacggtcgattactgtgatgagctcgccgccgcggcagatggcgcggcggatgctgccgtcggggtggccgccggtggcaatgggggcggcctgtcggggttcgccatggactcgttggtcggcgtcctcgacggcttccataacctcaccggtctgccatggtggataacaatcttcgactacactgtggccatgcggctaattatactccccgccctgatagtacaatttcacaagactgctaaaatcggccaactttttcgaaaatgaaggagttatcgtgaccaatactctcttttccagaagaaaaggcgagagcttggttgcccctcctttctttggaattttgcctacttttcagttcagttcccttgctttatactgtggatggcaagcattcggagtatgtg

SEQ ID NO: 4756 - DNA, 413 bp, Triticum aestivum
  Clone ID: LIB3281-016-P1-K1-G1
caccactcccaagtactcgaaggttctttatgaagaaattgtcaaggaagtctcttcatacctgaagaaggtcggttacaaccctgacaaggttcccttcgttcccatctctgggttcgagggcgacaacatgattgagaggtccaccaaccttgactggtacaagggccccacccttcttgaggccctggaccagatcaatgagcccaagaggccctccgacaagcccctgcgtcttccccttcaggacgtgtacaagattggcggcattggaactgtgccagtggggcgtgttgagactggagtcatcaagccaggcatggttgtcacctttggtcctactggcctgaccactgaggtgaagtctgtggagatgcaccaccagtcttttcttgaggcgctttctggtgaca

SEQ ID NO: 4757 - DNA, 427 bp, Triticum aestivum
  Clone ID: LIB3281-016-P1-K1-G10
cggacgcgtggggtattgtaggttttgtgaggagctgtcccaatgtgccaagaaatgtgagagatgcaatgagagagtgccgggatgaatcaaggaggaagaaaagagacaaacaaaatagcaggctgagaattgaaagaaatattatggaagggttgtataaaaaaggaggggtggttaacgtaccagatgatgatgaagaagaaattcagatgaatattagagaagcattgcgtgacccgaatgtctctcgcagaattgaaaggagaattggcaaggggggtgtgggtgatgtgcatgtttctgttggtaaaaggagtatcagcgcctattttgacaggcaattatctagcaacaaagtatatatgcagcccaagatcagtagtgctttggatcctaattcaagagatgcacttggtctagcttg

SEQ ID NO: 4758 - DNA, 365 bp, Triticum aestivum
  Clone ID: LIB3281-016-P1-K1-G11
cccacgcgtccggcgaaatacgcaatccaccttattttaaccctaaccaccagcagaggaggggacgaggcggaccaaatccagccatgttcgacgagaagatgttcgccggcccaaaggccggcgactacgaggcacaccccttcatcgcgacacaggctgtgaaggagatggcggaggcgttcgccggcaaggccagggcggagcggcagccgtacgccctcaaggccaaggcggaggggagcgaggttcgttgtcaaggcggggtgtagatataagaggaacgccgacgaggaccgtgaggaagacgcggcgttcaccttcaaagccaagtcagaggaagaggcggggatcaccttcaaggc

SEQ ID NO: 4759 - DNA, 253 bp, Triticum aestivum
  Clone ID: LIB3281-016-P1-K1-G12
gagctccgtccctcgttttgttattttttaaaacacgaaggagggggacaaggtaacccgaacccgaacccgacacgaacgatggaacaaggaaacgacgccgtttgcgactctgtaaatgacaggataccaccaccaccctattagtgaacagcccgcctggagcatcccataatttacatggtgctttcagcctgtcggtaatatcaccaccaccatcattgtttgatcatagcaattatttgctgctgct

SEQ ID NO: 4760 - DNA, 434 bp, Triticum aestivum
  Clone ID: LIB3281-016-P1-K1-G2
aaccacccttctgccgccgccggttcgtttatagcaaagcaggaggagcaggatgccggcggcccacggtctgcggtcgcggacgcgcgacctgttcgcgcgcccgttccggaagaagggttacatgccgctcaccacctacctgcgcacctacaaggtcggtgagtacgtcgatgtcaaggtgaacggcgccgtgcacaagggtatgccgcacaagttctaccacggccgcaccggacgcgtgtggaacgtcaccaagcgcgccatcggcgtcgagatcaacaagcaggttggaaaccgcattatcaggaaaaggatccatgtccgtgttgagcatgtgcagccatccaggtgtgcggaggagttccgcctgaggaaagtgaagaatgaccagcttaaggaggaagccaaggcacgtggtgaggtcatcagca

SEQ ID NO: 4761 - DNA, 431 bp, Triticum aestivum
  Clone ID: LIB3281-016-P1-K1-G3
acctacataaaaccctcctttgcttttcattgctcagggctcacagccgcgtctgcgaggactcgaggaggaaggcaccgcgtctgcgagaggattcctgaagagagcaagtgcaagagctatgggcaactcctgtgtcactggctccagcagcacctcaaaccacgggcagagtctgaaatccaacggggaaaaagctagtgacaattcgtgtgttactggttcatgcctgtcaaaccagggccagagccaggaatccaatgggtcggagacaaccttcaaatggaggattgatggtttctcctcgcttcttgataagggatggaccagctccagtgtgtttaacatcagggggtttgactggtacatggtgctgaacctaagggacagaaagagtggtgacaaaaatgaatatgtttctcttgagcttg

SEQ ID NO: 4762 - DNA, 431 bp, Triticum aestivum
  Clone ID: LIB3281-016-P1-K1-G4
acctccataaaaccctcctttggctgcatgtctcagggctcacagccgcgtgtgcgaggactcgaggaggaaggcaccgcgtctgctagaggattcctgaagagagcaagtgcaagagctatgggcaactactgtgtcactggctccagcagcacctcaaaccacgggcagagtctgaaatccaacggggaaaaagctagtgacaattcgagtgttactggttcatgcctgtcaaaccagggccagagccaggaatccaatgggtcggagacaaccttcaaatggaggatggatggcttctcctcgcttcttgataagggatggaccagctccagtgtgtataacatcagggggtttgactggtacatggtgctgaacctaatggacagaaagagtggcgacaaaaatgaatatgtttctgttgagcttgt

SEQ ID NO: 4763 - DNA, 433 bp, Triticum aestivum
  Clone ID: LIB3281-016-P1-K1-G5
cggacgcgtgggtttgggctgaaatctggtccttccgagccggtagcacagagagagaaggtgggaggcgaatctcgtggaattctttctccactgctcgccggaaaccaagaaataacccacgaatcttccctcacaaccagtccacaccgccgcgccaagtcccgatcttgccggccgagctgcactccggccgtccccagttccccggctcgagcctcgcgccgcgaattcggccggttcgtcgaccctggcagatgatgaacagtatatccaccagcactagagtctaatcatagccactcagtcgctcacctgcagcaaatggaatcaggtgaaaacaacatgggctcgaatgatggaccaaacagcaaagctagcttgcctgcgaggcaacgcttgcggtggacagatgagttgcatgaacaatttg

SEQ ID NO: 4764 - DNA, 428 bp, Triticum aestivum
  Clone ID: LIB3281-016-P1-K1-G6
ctaatattgcaaaggaaatgcatgttgttttatctaaggtcaacaatcatcggagacaccttagcacgcatgtttgaattctcaaatgttgaagttctccgatgcaatcatgtgggggactggggtacacagtttggaatgctcatagaatttctatttgaaaagtttccgaattgggaggaacttggcagccaggctattggtgaccttcaggttttctataaagcatccaaacaaagatttgatgaagatgcagaatttaaagatagggcccaacaagctgttgttcggttacagggaggggaggagaagtatcgtgctgcttggaaaaagatatgtgaaatcagcaggaacgaatttgaccaggtttacaagctcttagatgtacaacttgaagaaaagggggagagctattataatccctatat

SEQ ID NO: 4765 - DNA, 415 bp, Triticum aestivum
  Clone ID: LIB3281-016-P1-K1-G7
cccacgcgtccgcgcgagtttcctttctataaatttttaaggaaatttgcagatatttctgcataaactagaatatatttttaatagaggtgattcctttccgtgcatcaacatacatcatgtactattacacatgtgtggaaggtctggtcatccatttatttggtcataaagtacttatcaagattatttatttatgcgtgatcacatccacacatgcatagatcgaggacccatagtactactatctcactgtgccgcgagcccaacgttgaacgacaattgggtgtcgcaattgagggtattcccgtagccgatgccgaagaatgtacaatagcgcttggtgaacccgatccgatcgcccaccttgtggttctgtcccatgccgcactcgatcccgccgttgatgacgttt

SEQ ID NO: 4766 - DNA, 282 bp, Triticum aestivum
  Clone ID: LIB3281-016-P1-K1-G8
cccacgcgtccgcgcgagctttcgtcctttatttcaagcacaaaaggggccgatacttctgcgtagactcgaatgccattctcaaaagaggtgattccttgccgcgcactaacatacatcacgtactcatacacatggctggaaggtcaggtcaatcaattatccggtcctaaagtgcatatcaagaaaatctatttatgcgtgatcacattcacacatgcacaagatcgaggacccatagtcctactatttcactgtgtcgggggctacactctaaacgac

SEQ ID NO: 4767 - DNA, 328 bp, Triticum aestivum
  Clone ID: LIB3281-016-P1-K1-H1
cggacgcgtgggcggtgacgtgtttttctaggcggcaccggcagtgcccgaggaggagaagaaaggcttcttggaaaagatcaaggagaagctgcccggcggccacaagaaaccggaggacgctgctccggtgcccgtcacgcacgctgctccagcaccagtgcacgcgccggcgccagccgccgaggaggtgagcagccctgacgcgaaggagaagaagggcctactgggcaagatcatggacaagctgcctggttaccacaagacaggggaggaggacaaggccgtcgtcgctgcaggcgagcacaagcccagcgcttgatcgccg

SEQ ID NO: 4768 - DNA, 378 bp, Triticum aestivum
  Clone ID: LIB3281-016-P1-K1-H10
cggacgcgtgggcggactcttgggtaattattctcttccacgaccgggagcttccccctgtcccctccattccccccgcacaggattccccagatcgacgccccggttcctcccgaaccgcaccggaatcccccgccggattggccccgcccatggtgtaatcaggggtcccgaccgcgctggcgatggtggcgcagtggcttgccgagtacccgcaccaggccgtcgacaaccggccgtgcaagcgcccccgtctcgtatgggatgccgcgcctcatctttttccgccctccaaggcaattccgttgctatattgtgggctggaactaatcaacggcaatttcactactgctttcctggcgcccccacctattttat

SEQ ID NO: 4769 - DNA, 422 bp, Triticum aestivum
  Clone ID: LIB3281-016-P1-K1-H11
caagaaggtgtttgtaatgtctctttccatcctggaccaaaagaatgggaaacacttgactgcaacttcaggtctctgggtatgtaataacggatgcggatggggatgggctgacttctttggactcaagaaactcaaggacccgtcgggaggctatgttgtgggatcgagctgcattgtgaaggcagatcttaccatcattggttcatccaatgatggctagatgtttttacctcatggcctgatggagagataatgctctttaatcctagtagctactaataaccagacttatatatgagacaatgttgtggtagcagtactaagaacttgtggaatgattagtagtagtaatgggccggatttgagaagtgagatgatttcacgcatatatatttctatgtatatgtgccggacagaaa

SEQ ID NO: 4770 - DNA, 403 bp, Triticum aestivum
  Clone ID: LIB3281-016-P1-K1-H12
cttgcagctgcagcagcattgttttcataaagatgccaaaagaaggggaagcacttgactgcaacttcaggtctctgggtatgtaataacggatgcggatggagtatgggtttgacttttttggactcaagaaacttaaggacccgtctggaggcttatgttgtggtatcgagctgtattgagaaggcagatcttaccattattggttcattcaatgatggctagaagttattacctcatggtctgatggagagataatgctctttaatcctagtagctattaaaaaaccaaactttatatatgagacaatggtgtggtagcatgtctaataacatgcggtatgtttatgtttattaatgggccggatttgagaagtgatatgattacactcttatatatttt

SEQ ID NO: 4771 - DNA, 284 bp, Triticum aestivum
  unsure (1)...(284): unsure at all n locations
  Clone ID: LIB3281-016-P1-K1-H2
cgcaccggcagggccccaggaggagaagaaaggcgncgggggaaaacaacaaggagaaacggcccggcggccacaagaaaccggaggacgcngcgccggcgcccgacacgcacgccggcccagcaccagagcacgcgccggcgccagccgccgaggaggagagcagccccgacgcgaaagagaagaagggcccaccgggcaagaacaaggacaagccgcccgggcaccacaagacaggggaggaggacaaggccgcccgcacggcagcgaacacaagcccaacg

SEQ ID NO: 4772 - DNA, 429 bp, Triticum aestivum
  Clone ID: LIB3281-016-P1-K1-H4
cccacgcgtccgcggacgcgtggtttagatttcgctctcgcctccttgcgcagccatcgtcgagaggagcaagagaatggcggcgagcaacggcctcgagggtgtgctcctggggatgggcaacccccttctcgacatctccgccgtcgtcgacgaggccttcctcgctaagtatgatgtcaagctgaacaatgccattctcgccgaggacaagcacttgcccatgtatgatgagttgtccagcaagggcaatgttgaatatattgctggaggagccacgcagaactctatcagggttgcccaatggatgcttcaaactcctggtgcaacaagttacatgggttgcattggaaaggacaagtatggtgaggagatgaagagtgccgctaaagctgcaggagtcactgctcactactatgaggatgaggc

SEQ ID NO: 4773 - DNA, 140 bp, Triticum aestivum
  unsure (1)...(140): unsure at all n locations
  Clone ID: LIB3281-016-P1-K1-H5
accacgcgtccgcggacgcgcgtatagatttttttctcgccaccancaccagacataaactagaggagcaagagaatgccccaaagcaactgactatacggttgcactcccggagatgaacaacctacaaatagacatca

SEQ ID NO: 4774 - DNA, 435 bp, Triticum aestivum
  Clone ID: LIB3281-016-P1-K1-H6
cggacgcgtgggccgaattcctcgtgatttctctcccctcgcctcctcgtcctccccctcctaggggatcgccggagaggaatcgcgacgagggcttcctcctatcagttaaatcaaagccatggagcacaaggagaccggctgccagtctcgggagggtcccatcctttgcgtcaataactgcggattctttggcagtgcggcgaccatgaacatgtgctccaagtgccacaaggagatggcgatgaagcaggagcaggccaagctggctgcctcctctttcgacagcatcgtcaacggtggcgatgccgcgaaagaacaccttgctgctggcagcacggcggtggcagttgctcacgttgaggcgaagacgcttattaccgcacagcctgctgatatcgccggtcccagcgaggcggcgatggagaaccccaa

SEQ ID NO: 4775 - DNA, 382 bp, Triticum aestivum
  Clone ID: LIB3281-016-P1-K1-H7
cggacgcgtgggccgaattacatacgtattcctctcccctcgcctcctggtggtgcccctactaggggatcgccggagaggaatcgcgacgagggcttcctcctatcagttaaatcaaagccatggagcacaaggagaccggctgccagtctcgggagggtcccatcctttgcgtcaataactggggattctttggcattgcggcgaccaagaacatgtgctccaagtgccacaaggagatggcgatgaatcaggagcaggccaagctggatgacgcctctgtcgacagcatctgaaacggtggcaatgccacgaaagaacaccttgctgctggcagcactggggccggaactggttcacgttgaggcgaagacgcttatta

SEQ ID NO: 4776 - DNA, 400 bp, Triticum aestivum
  Clone ID: LIB3281-016-P1-K1-H8
gcgcggacgcgtgggccgagtcttttgtgcaattcctatacgacctcgatccccctcctcccccaacaagtcgaatccgcccgcgttgaggaaggatgtgctcccaagcccccaaatccctagacctagacctcgaccttgaccccctcccagtccccaagatcctagacctcgaccccgattccaaccctgccccggcgtgacgacgacggccgagcttccccacgaagcggagaacccctgcttggcgcgggtttcccaaccggcgacttcttgcctttcctctcgcgccagcgctacgatgtcgcctttaacgggctgatgctacaagcgagggagcccttctgctttgaagcgtcttgcaggggctcgtgaggggaaggccctgtgggaggatgcc

SEQ ID NO: 4777 - DNA, 425 bp, Triticum aestivum
  Clone ID: LIB3281-016-P1-K1-H9
cggacgcgtgggcggacgcgtgggttatcatcctcttcctcgacctcgagcttccccctgtcccctccattccccccgcacaggattccccagatcgacgccccggttcctcccgaaccgcaccggaatcccccgccggattggccccgcccatggtgtaatcaggggtcccgaccgcgctggcgatggaggcgcagtggctcgccgagtacccgcaccaggccgccgacaaccggccgcgcaagcgcccccgcctcgcatgggatgccgcgccgcagctcttcccgccccccaaggcaatcccgatgctatattgtgggcaggaactaatcaacggcaatttcactactgctttcctgccgccaccaccaatttattatgctggaccaccgcggaatctttcgcccccttggaggccggatgac

SEQ ID NO: 4778 - DNA, 359 bp, Triticum aestivum
  Clone ID: LIB3281-017-P1-K1-A10
cggacgcgtgggttgcatagttccgttggcaggcacaccatgtccatctccaccgcttcccgccgcgccctcagccggatcggcggcgccctccggcggtccttgtcgtcgtcgtcatcgtcggtgccggacgcctcggggtaccacgtgtcgggcgggccgagcttcatgcgcgcggccgtgttctgggagcccggccgcccgctcaccatggaggagttccgcatgccgcgccccaaggccggcgaggtcctcgtcaagaccaaagcttgtggagtctgccactctgatctccatgtcatgaaaggcgagctccctttcgccagcccttgtgtttgtggccatgagaacaccgggga

SEQ ID NO: 4779 - DNA, 431 bp, Triticum aestivum
  Clone ID: LIB3281-017-P1-K1-A11
cggacgcgtgggcggactcgtggtttagacctattccaggagctgcagaagaagaactatacacctttcccaaagaaaaaacccacgtccgggccagttgctgtaggatctacagaagcagatgaagataatgatgagagtcctgctgaagctgcagcaagtgattatgagtatcttcttgcaatgtcaattggtaccttgactatggagaaggtgaaggagctcattgcgcagcagaataaggtagaggctgatcttgaaatcctgcgtaacacagagccaaaaactctttggctgagagaccttgacgctcttgagaaggaactggatgtgcttgatgcaaaacttgaagctgaacagaacgacagatcacgcaagcgcgccaaaaattctgaaaaggcgagggaccctaagccagcaaccaagaaaca

SEQ ID NO: 4780 - DNA, 436 bp, Triticum aestivum
  Clone ID: LIB3281-017-P1-K1-A12
gcaccggttcgcgcaggagcacattttgccgcacgccgccgccatcgacgcctgcaactacttccccaaggaggtgaatctgtggaagctcatgggggacttcaacctgcacggcctcacctcgccagaggagtacggagggctcgggctcggttacatgtaccactgcatcgccatggaggagatcagcagggcgtccgggtcagtcggcctttcctacggtgcacactcaaatctgtgcatcaaccagctggtccgtcacggcagccccgcccaaaaggaaaagtatttgccgaagctaatcagcggggagcatattggggcattggcaatgagtgaaccaaactctggctctgatgttgtcagtatgaagtgcaaagctgagaaagtagatggcggctctgtcattaatgggaataagatgtggtgcacaaat

SEQ ID NO: 4781 - DNA, 443 bp, Triticum aestivum
  Clone ID: LIB3281-017-P1-K1-A2
caactaggccaacgacggctgctagcaatgatatatacatatcaacaattccaaggaggtgcatgtgtcagtatgcatagcatagtatatatatgcttgacactgtgactggaggagatccaggaaggggtgaactcaaaatcatctgtgatttgattggaaaatactctccagcatctgaaatatctaaaggcgatcactcgaccaagtatgttatacaatatacccagctcgatgattggagcagtcccagccgctaattagtgctaattagtactccagtgttgaatcacacagctaagtatcaaccctccctcaagacttggctattaacaaagtagtgctaggtcctcagcgttcgttcttactctctattttcttgaagtggtttctctttattcactttttgctttctattttcattatcactattcatttggatc

SEQ ID NO: 4782 - DNA, 316 bp, Triticum aestivum
  Clone ID: LIB3281-017-P1-K1-A3
cccaaaacgagcgccgccagagtccaaaaattttcccttcttaagccgatctcgccgcaccatcttcgccgcgcacggcgccgtcagccgaccaggtcgccgccgcgtcgtctgctcctccgctgacctcatgcctccagttccttccccgtccccgtcgccccttctctcgagccgccggctggtgctctctgttcccccgggtcgtccactccgcgccgtcgattcgaaccaggagcggcacgggtagaggcgcagggcgaggagcgtccgccggaggtgctcgatgccccccttctacatccattgtaggcgc

SEQ ID NO: 4783 - DNA, 438 bp, Triticum aestivum
  Clone ID: LIB3281-017-P1-K1-A4
cggacgcgtgggtgttgatgaggttgctgagatcagggctgcccacttcgaggagtcgatgaagtatgcgcgccggagcgtgagcgacgccgacatccgcaagtaccaggcctttgcccagactctgcagcagtctcgtggattcggcagcgagttccgtttccctgatcagccggctgcgggcgcttcctctgccgctgcggccgacccttttgcttccgctgctgcagcagctgacgatgatgatttatatagctaaatcctttcgcgttcgtagatgttgtgctccggtacgcagtacacggaagaactatgttcttaagttaatattgtgatgcacagttaatcgttctgcccgttatttccagctttatctttttttctgtgatgtttgcttgagtagctttgcatatgtcatgccgtgttcatgtgcgctga

SEQ ID NO: 4784 - DNA, 439 bp, Triticum aestivum
  Clone ID: LIB3281-017-P1-K1-A5
gtggaagcctccgccggagctgccgtccgcgatgtccaaggccgccgcagccgccgcagcggcggcgtccctcccgccaccgccgcccgaggtggcccacctggtggagcagctccagcgccatcacctcgccccggacgcctccctcctctccagctccgcccactccgacctcctccaggcgcgcgaggaggtcgcggcggagcgcgcccgctacctcgaggccctggcggtgtacgcggaggcgatggccatggtggaggagtaccagcacgcgaccgccgcgggcagcgccggtgccgccaagaagctcaactgctccccggaggtctacgagtccttggagcaccatttggcggtcgccgaggcggtccaaaggttgaggctcccactgctctcgcaggacggtgaggtgcatgaggaggagatagaaaagctg

SEQ ID NO: 4785 - DNA, 454 bp, Triticum aestivum
  Clone ID: LIB3281-017-P1-K1-A6
ctacgacgacggcaggcttcgaccacttcttacgtgttgcccgataaaagtgctgcaatggcgagcgccaacgtcctcctcctcccggagtccggctcgggccacctcatgtcgctcatcgaggccggcaagcggctgctcgcccacggcggagacgggctcaccgtcactgtgctgatcatccggccagccacgcccgagtcggcctcccaggtcgactcgcacgtcaagcgcgtcgcggcatctgcctgtgggctcggcatccggttccaccacctccccgccgtcgacccgcccacggactgcgccggcaacctgcaggagttcaagtcccgctacatgcagctgcacgcgccccacgtcaaggccgccgtgtcggacctcggcgccgcggcgctcgtcatagactttttcgccaccgccgtcatcgacgtggcgcacgagctcggcgtgc

SEQ ID NO: 4786 - DNA, 424 bp, Triticum aestivum
  Clone ID: LIB3281-017-P1-K1-A7
atcggataaaaaatgaaaactctcttctgtctaagacgatgagactttttagcactaactatcgtctactcatcacaggcactccactccagaacaatctccatgagctttggtctctactcaatttcttgctgcctgagatatttagttctgcagagacctttgatgagtggttccaaattactggtgaaactgatcaacaggaggttgttcagcagcttcataaggttcttcgcccatttcttctccggaggcttaaatctgatgtcgaaaagggtttacctccaaagaaagaaattatccttaaaggtgggatgtctcagatgcaaaagcagtactatcgaggtctgcttcagaaagatttggaggttattaatgctggtggtgagcgtaaaaaggtgcttaacatagctatgcagttacg

SEQ ID NO: 4787 - DNA, 405 bp, Triticum aestivum
  Clone ID: LIB3281-017-P1-K1-A8
caccctcaccctcaccctcaccaaatcctcctcctcctcctctggctagcaaagctcaccaccaccaccaacaagcaacaacatcactcatccatccatccatccgtccgacaccagatcgagccaagaaagatccaagaaatttcccaattgaggaccaagggagaagaatttgttgtcgatccactcagcaagcttacctagctagctgcttcttcatctcatctcttggtcagcttcgattggttgggggaagcaatccccatggagttgttcccccggcagccggacctggcgctgcagatcagcgccaccagctcctcctcctcgcccccggccgcgccgccgggcagctggggccggccaccggacgccaccaccggcgccaccagcatggatcaattc

SEQ ID NO: 4788 - DNA, 435 bp, Triticum aestivum
  Clone ID: LIB3281-017-P1-K1-A9
cccgctcctgctccccacgaatcttagctgacccactctactcgaccactcagcaagctgtacccacgagagcgcgcgaccacgcataccgtcggtagcccactctgctgcgcgacctccgaaacgaagcgccagatttgattacctcgccgtccgaggaggtcgcagctcgaccggcgccgggcacaacctgattggatcggatccgtggaccttggcataggtcattctgggtcttggaggttattgctagcccatctcgaattagatatggaggtagagaagaagtccaaggatgagttacatctcaagattaagagtaaggacaagtcctcggtgaatgaggaggacgagaaggagatcgagatagaaatcgacgccaaggttgtggagaaggaagaggtgtccagtgatggttcaaagtctggcagcaaa

SEQ ID NO: 4789 - DNA, 417 bp, Triticum aestivum
  Clone ID: LIB3281-017-P1-K1-B1
gccaaagaagcgagatggcacgcctatcttccattcccatctccctcctgctgctagctagcctcgcctccgccgccgcctcggcagcagccgtgggtcaagaggaaggaggcatcaagatccgcgtgcggtatccaaccaaggagcagtcgcggtggctgaaccgctgggcggagaagcatcaggctcaaggatccggcgaaggcttcaggatccggccggccaccgacgaggagtcggcgtttctgaaccgcatgtcagcccgcggtgcggagaaaaccggcggccgagccggctacgacggccgcatcgagtttggcgacgaccatccaagaatcgttgtggatgcctttcactctcgagctcacacgtccaaggcgaacgatgaactttaggagcatttgtgcctaactggcg

SEQ ID NO: 4790 - DNA, 361 bp, Triticum aestivum
  Clone ID: LIB3281-017-P1-K1-B10
cgccgctgcgctcgttttctccggtgccgccttcctcttcgccgccgtccgccactgaagagactgcctccgtcttccccgtcgatggctcacctacctagtacaaccacatatagatccatttatttgtcattagcgatttgttcgttcgtgtcattttgcccagatctgcttctgtctgcaaatcagagatcggtgagtagcatttccttattagaagagattgtacccttgtgcttgtaaatactatttatcctgtttgatctagaactcatatgatcgctccatttagttgtgatgatgcttgctgtctccccttgttaatcgtgcttattttcaggatcggggtgccccccttttt

SEQ ID NO: 4791 - DNA, 427 bp, Triticum aestivum
  Clone ID: LIB3281-017-P1-K1-B11
ggatgtttgtgttccattgtctattcttgcagaatgcatatctgtatctaagcaactacttgatgcgtcaccattgacttgtttggttatcgcccatgccggtgacggaaatttccacacaattatcctatttgatccaagccaggaggaagagcgaagggaagcagagagactaaaccatttcatggttcatactgctctgtccatggaaggtacatgcacaggagagcatggtgttggcacagggaaaatgaagtacctggagaaggagctggggatggagtcactgaagacgatgaaaaggataaaggccgcgctggatcccaacaacatcatgaatccaggaaagctcatcccaccccacgtctgcatctgaccaacgaagtgcctgattccatggcagtgggttcggttgatcaagtttgtc

SEQ ID NO: 4792 - DNA, 443 bp, Triticum aestivum
  unsure (1)...(443): unsure at all n locations
  Clone ID: LIB3281-017-P1-K1-B2
cggacgcgtgggcgccgtccctccacttcgaaatcctcctcccacctctcgctcccctcccgccgctcactccacctcccgcgcgccgccgccgccgccgccatgggttccgtcgccggggacgccgtgcgcctcgcctacccgcccgtccgccgcgacgagtccgtcgtcgacagctaccacggcgcccagatccccgacccctaccgctggctggaggacccggactcggaggagaccaaggagttcgtggcggcccaggcggagctggccgagtcggtgctcgccggctgcgccgacagggagggcctgcgccgcgaggtcacgcgcctntttgaccacccgcgccacgccgtgcccttccgncgnggngacaagtacttncacttccacaactccggccttcaggcccagagcgtnctctacgtgcaggatgatttgga

SEQ ID NO: 4793 - DNA, 373 bp, Triticum aestivum
  Clone ID: LIB3281-017-P1-K1-B3
ctcctctccgcctccgcaccaccattagaggaaagccagcgggaaggggggaaatccccatgcccccacccctcgccggaccagatccccggcgggccggcgcggagccttaggcggggaccggcctgaccgatgggcggggaggccccggagccgcggcggctcagccgcgcgcttagcttggacggcagcggcgtcccggaggaggcgctgcacctggtgctcggctacgtcgacgacccgcgcgaccgcgaggcggcctcgctggcgtgccgccgctggcaccacatcgacgcgctcacgcggaagcacgtcaccgtgcccttctgctacgccgtgtccccggcgcgcctgctcgctgcgcttccgcgcc

SEQ ID NO: 4794 - DNA, 320 bp, Triticum aestivum
  unsure (1)...(320): unsure at all n locations
  Clone ID: LIB3281-017-P1-K1-B4
cccacgcgtccggcgactccaacgccgccgccgtcgccgtggntgcggctgcggctgcggcttanctcgccccccgtcctcctccactgaccatggcctcctctcccaccgacaatcacccccccgctgatccctgcccagacaccaacccccccagccctgccctccgtcctagctcctctcccgatccagatccagagcccctggctgccgatgctgaggacgaagacggggtctctcctgcacgctaaagatgacggcaccttcctccgctgaagctgccgacacctaccttcgtcttccgagatagccatgggatc

SEQ ID NO: 4795 - DNA, 437 bp, Triticum aestivum
  Clone ID: LIB3281-017-P1-K1-B5
atttgagaaggaccaagagcagaagtcgaactcgcggttcatgacccaaaaacccgcatcagcaatagtgtcaaagctggagcagatagctgagacagagtccttcaaggtgaagaagcaggacggactggtgacgctgcagggatccaaagaagggaggaaggggcagcttgcgattgatgcggagatctttgaagtgactccatccttctatgttgttgaggtgaagaagtcggcaggagacacattggagtacgaacggttctgcaagaagggcctacggccttctctcaaggacatctgctggaatggtccgtcagaggaaaagcttccatcagtatcggagtcagtaccttcaactccgtcctccaagtcgaccaaaagaaatggcatttaagtgtgatatctttcgagttgcaatacaatctattctcctc

SEQ ID NO: 4796 - DNA, 441 bp, Triticum aestivum
  unsure (1)...(441): unsure at all n locations
  Clone ID: LIB3281-017-P1-K1-B6
ccaaacactcgcctgccttccttccttccttgttcgttcctcgacgcacgcacgcagatctcatccatccaagccaaggcaggtcaggtacgagatggctctcaccagaattggtctcgctggcctcgcggtcatgggccagaaccttgccctcaacattgccgagaaaggcttccccatctctgtctacaacaggacaacgtccaaggtcgatgagactgttcagcgtgccaagctagaaggaaaccttcctctctatggtttccatgaccctgcatnctttgtcaactccattcagaagccacgtgtcgtcatcatgcttgtcaaggctggtgctccggtcgaccagaccatcgcaacgctcgcagcacacctggagcaaggtgactgcatcgttgacggaggaaacgagtggtatgagaacacagaaaggagggagaa

SEQ ID NO: 4797 - DNA, 441 bp, Triticum aestivum
  Clone ID: LIB3281-017-P1-K1-B7
cggacgcgtgggaagaggttgatatggaaagtgaagatgcgacgccattgaaagtaccacgccgtgccacttctaccagacagtctggtaatcaagggttgtgcattttattatgcttattaatcgccacattggttattgtcattggctggttttcagaaacgcggcctgcaaaagaaacagcacctgggctctcagtagctgtcactaatggaaaataagatttttccatcaaagaagtggatgcgggcgattgattctacatgggtgtaccagcttctcctttcaatttgtacttgtactgcaacatgagtttactttcatgcatgtcgatttggtggctttctgctgtaagggagttcaccagatatgctgtaaggatatatatatttggtccaaggtcaactttgacatctattttccagaacctttgtagtcata

SEQ ID NO: 4798 - DNA, 401 bp, Triticum aestivum
  Clone ID: LIB3281-017-P1-K1-B8
cccacgcgtgcgcggttgcgtgggtgggcagaccatccccatgccgttcatcggcgcgcaggccattacattcatgccaccggcgccgccttcgcagcctcacgccacgcccatagcatactccgccgcgccagttcatccacgaccgccgtcttcgcagccacctgccacgcactcgccgcctcaacctcaaccctcgccacggcagcagaagccgccaacaatgccgcccgtgacgccgcagccgcacaagtcgccggctccagcgacgccacagctacagcagcaagcgccggccgtaaattcaagctggatggacatcgtcgtggcgccctcggaagcgccgcacgactcgtcgggctaccacgggttcggtggcggcagcggaccgacatcgtcgc

SEQ ID NO: 4799 - DNA, 424 bp, Triticum aestivum
  Clone ID: LIB3281-017-P1-K1-B9
cggacgcgtgggctctacctcgccttcagcccgccaccgccgcgatgtcgtcggagcccgcgcccgcctccgcctccacggaggagctcgaggccgacctctccgccgcgaccatcagcaagaagcagctgaagaaggacgcccgcaaggccgagaaggccgggaaggcgtcgcatcgccagcagcagcagcagccgcaggcggaggaggccgacctcttcgcggccaactacggcgatgtccccgtcgaggagatccagtccaaggccatcttcggcaggtcctggaccgacatcggcgacctcgacgaggccgccgcgggccgctccgtgctcatccgcggctccgcgcagacgctgcgccccgtcagtaagaagatggccttcgtcgtgcttcgccagagcatgagcaccgtgcagtgcgt

SEQ ID NO: 4800 - DNA, 397 bp, Triticum aestivum
  Clone ID: LIB3281-017-P1-K1-C10
cacagactgactcgcattacacctaccacgcgcagcgcgcagagcgagatcgagatggcgacggagctgacggcggcgcaactgcgggcgtacgacggcaccgacgcgtccaagccgatctacgtcgccatccgcggcaaggtcttcgacgtctcggccgggcgcggcttctacgggcccggcggcgactacgcgctcttcgccggccgtgaggcctgccgcgcgctcgccaagatgtccaaggacgcctgcgacttcttcggcgacctttgcggccattccgacaaggagctcggcgtgctcgccgactggcagtccaagttccaggccaagttccccgtcgtttcccgtctagccttctgaactgaatcgtaattggtcatcggcacccttcttt

SEQ ID NO: 4801 - DNA, 440 bp, Triticum aestivum
  Clone ID: LIB3281-017-P1-K1-C11
cgctctcacgattgggggcgacgcttatcgcggagccaccacttccaatccactctcggtctctcgcggacgccgtgccgagctgttcctgctctgtcttcaactactccaagatttgttctttagacgcctgcagcttcggtgcgcagggacggcggagagctcggtacttggttcacagcttaggatctttgccgattcacgttttgattggcttcgtctgctcgtctggctgggttgtaaatttggaactggaaggaagaatttgagcacagatgggccagtgttgcagcagagctacgtccccggattctgtccaaggaggagccaatggctatggctattctcaccagccaaaacaagcacatacaccttctagttacaacaatgctcagtcaccaccacaagctgaggtgaggtacacaccgccagcgatgaac

SEQ ID NO: 4802 - DNA, 197 bp, Triticum aestivum
  Clone ID: LIB3281-017-P1-K1-C12
cggacgcatgggcctttatcctcttgttcgcctaccctcctcctggaactggttggtgtggtggctgctgcgcacatcatcacactaggtgctttgttcgcccctaccaccagtcacattacatagcgcgacgcagagagagatttgattcacagacaaaagaatggcgactcgcgtcataccttacgttttccgcc

SEQ ID NO: 4803 - DNA, 407 bp, Triticum aestivum
  Clone ID: LIB3281-017-P1-K1-C2
ctggggtagtcagccaagagtgcaaaacaattgtttctcagtatggacaacagatcctcgacctgttgctagcagagacccagcccaagaagatctgctctcaggttggtctgtgcacctttgatgggactcgtggtgtcagtgctggaattcggagggtggttgatgatgagcctgtgaaatcgaatggcctccgtaccgatcccatgtgcagtgcctgtgagatggctgttgtgtggatgcagaaccaacttgcacagaacaagacccaggatctcatactggattacgttaaccagctgtgcaaccgtctcccgagtcccatgggagaatcagccgtggactgtgccagccttggatccatgcctgacattgagttcaccattggtggcaagaagtttgcgctg

SEQ ID NO: 4804 - DNA, 431 bp, Triticum aestivum
  unsure (1)...(431): unsure at all n locations
  Clone ID: LIB3281-017-P1-K1-C3
gcctcccgcacgcttctcctccgcttcccgccccgcctcgagcagctcagggacgcgcacagccatggcgacggagaccgagaccttcgccttccaggccgagatcaaccagctcctctcgctcatcatcaacaccttctactccaacaaggagatcttcctccgcgagctcatctccaactcctccgatgccttggacaagatcaggttcgagagcctcacggacaagagcaagctagacgcgcagcccgagctcttcatccacatcatccccgacaaggcgaccaacacgctcacgatcgttgacagcggcattgggatgaccaagtccgacctcgtcaacaacctcgggaccatcgccaggtcggngaccaaggagttcatggaggccctcgccgccggcgccgacgtgtccatgattgggcagttcg

SEQ ID NO: 4805 - DNA, 406 bp, Triticum aestivum
  Clone ID: LIB3281-017-P1-K1-C6
gtggatacctgtgcatcctgtgcctgatgcaatccttgtaattctgtctgaccagacagagatcataaccaacggaagatacaagagcgccgtgcatcgagctgtggtcaatgccgaccgtgcccgcttgtcagtggcgacgttctacgatccacctaaatctcagaaaatatgtactgccccccagctcgggagcaaggaccatccgcagaagtatcgtgatgtggtttacggcgactatgtcttattctggtacagcaaaggcccagagggcaagcgcaatatcgacgccctcctgatggagcaatagacagggccattgaaatgtaccacaaaaatttgttacacacacagcgcgaacctgacaagcttgatcaataaaaaggtggaaaacaaggttgtacat

SEQ ID NO: 4806 - DNA, 377 bp, Triticum aestivum
  Clone ID: LIB3281-017-P1-K1-C7
cgtattcgtactcgtctttctacgtgcaaccgagccttccgcccaccttctcgccattttgccagcggtgcacccaccaaccacccccacccgccgtcatgagggagtgcatctcgatccacatcggccaggccggcatccaggtcgggaacgcgtgctgggagctgtactgcctcgagcatggcattcagcctgatggccagatgcccggtgacaagaccgttgggggaggtgatgatgctttcaacaccttcttcagcgagactggggctgggaagcacgttccccgtgctgtcttcgtagatctccagcccactgtgattgatgaggtgaggactggcgcttaccgtcagcttttccaccctgggcagcttatt

SEQ ID NO: 4807 - DNA, 418 bp, Triticum aestivum
  Clone ID: LIB3281-017-P1-K1-C8
cggacgcgtgggtttttttttcagtaattcaaagctttctgagtatgcaaggcaaaatagctcaacatccagttcgctatgagcatttctcgtaagtgttgtagacgacaaaatatactacagttagatcccaatactgctataaatcattaacagattacaagattatatacataagcacataaccacaaattgtagaaagagaggccgtatttattaaaagaagaaatgggaggctcagagttggctcgtctatcatatgggcaaaacgcactctgtatccgatacacttggtgatacacgttggagatgcccctgtgtgacatttcagcattccaatggttgctcacggaaagcaagcaatcctcatatgaacgcttccacctagtcacacaaaaccctaacacataccataaat

SEQ ID NO: 4808 - DNA, 413 bp, Triticum aestivum
  Clone ID: LIB3281-017-P1-K1-C9
aattaatctcgtcgatgccaaaggcggtggtcttctgatgagtccaggggaagcagacgaatctgaaagccatcacgttgaacttcttggtgtttcaaccgcaagtggggatgaagtgtcgaaggaagaagttgataacattaaaaagattcaatattcatttggggtcgtatcagttcccatgctagttgcgggtgattcctggtcctgcaaattggaaattaaatggcatggagcaaagtcactcatgctctatgtttcacttggctattctctagactcgagtgaagatgcatcactacacagacttaacgtgcacagaagcttgcaagttgaaggaaagatccccatgatagttggtcaccagtttttgagaccatttaggcgagaacccttgttgctatctaggatca

SEQ ID NO: 4809 - DNA, 442 bp, Triticum aestivum
  Clone ID: LIB3281-017-P1-K1-D1
tgtcaattcaattgtcaatgacatgctccagtggccacacaggcttgttgttccacttggcgtcaatgttgatacaagtgagctggagcttaaacctgagggaaaactttctgttactgtagtaaaagcaacatctctgaagaataaggagttgattggtaaatctgatccctacgtgaccctgtatgtgcgtcccatgttcaaggtcaaaacaaaagtcatagatgacaacctaaatcctgaatggaatgaaacatttgaactgattgttgaagacaaggaaacccaatctgtcatttttgaggtttatgatgaagacaaccttcagcaagacaagaggctaggtgtggctaaattagcagtgaataatattgtgcccgagactcccagtgaaatcactctgaagcttatgcagtcagtagattcactttaagataaagac

SEQ ID NO: 4810 - DNA, 400 bp, Triticum aestivum
  Clone ID: LIB3281-017-P1-K1-D10
ctctttatctagaactagccgcaatcattcctcggttcggattttattgaacttctgaaggtgggaagagcatgaggccgtgggcatgggtggcggccgtcacatggatggctgcctgctccgtcgcggcggcccacggcgagcagccgctgtcgatgatcgtcgtcgagaggaccaccctcgccgtcgacgacgcggcgcacgtcaaggcgtcccctgcggttcttggactggagggccagtacagtggatgggtggaggtggagttcttccatcccgacccctgcggcgatgactggatcggagtcttctctcctgccaattccagtgctcggatttgtgagcctgagaataagaggctatatcccccagtgctatgcacagtacctatcaagtacca

SEQ ID NO: 4811 - DNA, 230 bp, Triticum aestivum
  Clone ID: LIB3281-017-P1-K1-D11
gtcctacatcgctgttttccctctttatctagaactagccagaggcattccggggttggcattttcttgaacttcagaaggtgcgaagagcatgaggccgaggtcatgggtggctgccgtcacatgcatagttgactgctccgtcgaggcggcccacggttagcagccgctttttatgattgtcgtcaagtggaccactctcgccgtttactactccgcgcacgttaagg

SEQ ID NO: 4812 - DNA, 307 bp, Triticum aestivum
  Clone ID: LIB3281-017-P1-K1-D4
cggacgcgtgggcggacgcgtgggttagagttagctaactctaaagtacaagagaaaaaggctgttgctatttaaccagacccagacattacacttatacttatattagggatagctcagagcaagatcattgatagccataaccgccgcgttctcctctccgccgccatcgacatctactactacgacgagcaggatggcttcgactacgaccagacgagcgaggagggcgagtggatgatcaaggccgccgccatcgaaatggtcaagctgctcgagctcgacgccttcgcctaccacaaccact

SEQ ID NO: 4813 - DNA, 445 bp, Triticum aestivum
  Clone ID: LIB3281-017-P1-K1-D5
cccacgcgtccgcccacgcgttcgtctcgcaccgcgtcccctccctctcctgtcgcgtgcgctcggccagcaaaaagcttccacataaaggccaacaagagaaaccataatctgttgggtgccagtcaaacctcaacaacaaagtttcatgtctgatctcgacgttactctgccatctgccttcgatccttttgctgaggcaaatgctgaggatgctggtgcacgcccgggcgcaaaagattatgtgcatgtgcgcattcagcagcgcaacggcaggaagagtctgaccactgtccagggcctgaagaaggagttcagctacaacaagatcctcaaggatctcaagaaggaattctgctgcaatggcacagtagtccaggatccagagctaggccaggtcattcagcttcagggtgatcagcgtaagaatgttgcttactttcta

SEQ ID NO: 4814 - DNA, 439 bp, Triticum aestivum
  unsure (1)...(439): unsure at all n locations
  Clone ID: LIB3281-017-P1-K1-D6
cccacgcgtncgcggacgcgtgggcccacttccactttccaagtggctgcgtaggcggcggccaagcatctgcccagcgaggagaaccttcgcgatggcggcgtccggattcggaggcggcgaggcgttccggctgtcggctgcggcgggggccggcgcgctgaagctgcacaagggcgacatcaccctctggtccgtcgacggcgccaccgacgctatcgtcaatgctgctaatgaacgaatgctaggagggggaggtgttgatggagctatacatcaagctgctggaccacagcttgtacaagcatgccgtgaagttccagaggttaaacctggagtccgttgccctactggagaagctaagaatactccagnctttgagcttnccgtgtcctgtgtgatccatacangtgggcccatatatgatatggacaggaag

SEQ ID NO: 4815 - DNA, 430 bp, Triticum aestivum
  Clone ID: LIB3281-017-P1-K1-D7
accgaattgggtttagatcggggagagacggccatggacgaggaggagcacgaggtgtacggccaggagatccccgtggacggcgacatggaaggcgccgacgtcgacatgaccgccgccggagacgacgcagcgaaggagctcgacgagatgaagcgtaggctcaaggagatggaggaggaggccgccgccctgcgcgacatgcaggccaaggtcgccaaggagatgcaaggaggagatgccaatgcgtctacagctgaggcaaaggagcaggtggatgctcgctctgtttatgttggaaatgttgattatgcgtgtacaccagaggaagtgcagcagcatttccaagcttgcggaactgtcaacagagtgacaatcttgaccgacaagtttggacagccaaaaggctttgcttacgtggaattttaga

SEQ ID NO: 4816 - DNA, 381 bp, Triticum aestivum
  Clone ID: LIB3281-017-P1-K1-D8
cgcgctctacctctacgccctcgccgaccgacggctgcccgacgccgcgctccttcacctccgcctaatcgaccgccccggatcccccgtgcccccctccccgaccgactaccgggccgtcgtcaggtgcctcgtcgcggaccacggtcgcctcgaggacgccgtcgcgctcaaggacgagatgctcgcctccgggttcgccgggcccgatccgcatgtctacagcctcctcatggctgggtttgtggaagccggggatggggccaaagcagtggagctgcaccaagaactgcaagacaagcttggcggcaagcccgtcctcgatggcatcgtgtacgggagcctcatgaaggcctacttacttatgggaatggaggagaa

SEQ ID NO: 4817 - DNA, 411 bp, Triticum aestivum
  unsure (1)...(411): unsure at all n locations
  Clone ID: LIB3281-017-P1-K1-D9
gttcaacaaagctcaaggtgctaaaaattgaaggctggtttacacacctcaatctgcatgctccttatcttacttccgtatggatcggattggaactgaattctgacacagatggtgcttcgacaaccagatgcaacttcaatctttctccatttattgcttctctttcagatgttgagactattaggtttcatggacacatccttgagtgcgtagaacatgaatttctgattctcaagcagccaaaattattcaaccggctgacagagataagcctggagatcaatctcggtgatctcaaggaagcaaattttgccttgtgcttatttcagcatgcccccaacctgcgatttgtcaaactaaagctcatttncaggaattccgtggtaccaacagtgcatttctgggaat

SEQ ID NO: 4818 - DNA, 351 bp, Triticum aestivum
  Clone ID: LIB3281-017-P1-K1-E1
ctccccctcaccaccacatcagcggtgccacccttggcctcttcttccctgcatttgattgatccgtcgcttgcccggtcgcccgtcgatccgtttacccgccgtccgcccgtccccggcagccgcagccgcaccgcagttgcaggtggactgcgaatgatatagatgcagtttagcagcgtgctgcccctggagggcaaagcgtgcatttcctccgtcaggagagagggctacgtctgctagcgcctcaaggtcggggacagcagcagcatcaggcactagagggccttcaggaggatgtgcaacggtggcaggggcccctccgccaccggcgcgcagtgcgtgctcacc

SEQ ID NO: 4819 - DNA, 160 bp, Triticum aestivum
  Clone ID: LIB3281-017-P1-K1-E10
ctccccaaccagggaatcccaccatccatgaagggggccaaattcaagggcgccggcaaggcccacaccaagtttgcggcgaagagcaagggattggagaacccgtctgccaaggggaagaagggcatggcccgtttggaccctaacaagcccaataggt

SEQ ID NO: 4820 - DNA, 410 bp, Triticum aestivum
  Clone ID: LIB3281-017-P1-K1-E11
cccacgcgtccgcccacgcgtccgtccacgcgtccggtcgctgtcttcttcttcttcagttccgccttcccatccccgcctgatcggagtctcagccgcggcagccatggcgaagacctaccccgtcgtcagcgccgagtaccaggaggccgtcgagaaggccaggcagaagctccgcgccctcatcgccgagaagaattgctccccgctcatgctccgcctggcgtggcactcggccggcaccttcgacgtgtagtgcaagacaggcgggccgttcgggacgatgaagaagccggcggagcaggcgcacgccggcaacgcgggcctggacatcgccgtgcggatgctcgagcccatgaaggaggagatccccaccatctcctacgccgatctctaccaacttgcgggag

SEQ ID NO: 4821 - DNA, 429 bp, Triticum aestivum
  Clone ID: LIB3281-017-P1-K1-E12
acccccaccgtctcgcctccgccatcaccgccgcagctagataagaagaaaaaaagagagagaagaactcgtcgggagggctcgagatctgtgtcgggagagagggaattcttgagatcggaatcggaacaagcgggcgcgctcgggatcggggttaccatacaatttttcccaggaacctttagtgaatgtgctaatggcggtgcaccttgtcccaatgtatatcccgaggggcaacctgacgtacgaagcactcatcatctacagccttgaagacagtccacctgctagaggcgccaagaagatctgtgttgcatactcgaactgggcgaagacaccatgctgtttttgtttctggcaattcccttctcgttatttaggatttttatgcacttttatttgactcttttctccaccaaatcatttggc

SEQ ID NO: 4822 - DNA, 291 bp, Triticum aestivum
  Clone ID: LIB3281-017-P1-K1-E2
ggagcgtgggcctctagtccaatcccctcgcccacacgctgaacccctccctgcctcgatttctctccctcgtcagccgtcacagcagaggccacgaaccctagccccctcccactcaccggctctcctcccgcttccccaccattgccgcgaattctctaaaggctaccacggatccatgtctatttggagggtacaaggcagggaaggacgccatcgtcggcccatcgcttaggctggcggcgcccggatcgggaagcagcagggttggtgcagcgggaaaatgcaagc

SEQ ID NO: 4823 - DNA, 276 bp, Triticum aestivum
  Clone ID: LIB3281-017-P1-K1-E3
gccgcggaatccgcggggagacacacgcgcgcccacacgcgtgcggacacgtgggttttcccccttatatcagcccccaacctagctctttcttcatcggccggcggctggttgctgcttgaataactcgtcgtcggctgcgtccccaaaaacctcgcctattatattatctctttggcccgctccgtccccaaataaatcgcctatttcatcctttcgttcgtccgctccgtctgattgactgattagtaagccaccgaccgctacctccgaagg

SEQ ID NO: 4824 - DNA, 384 bp, Triticum aestivum
  Clone ID: LIB3281-017-P1-K1-E4
gattttctgaagaacaagctcaaattccggggtttcgtgatttcagactggcaaggcattgatcggattactagtcctccaggtgtgaactattcttattcagttgaggccggagttggtgccggtattgacatgatcatggttccttttgcctacaccgaattcattgatgatctgacataccaagtaaagaacaacattatccccatgagcagaatcgatgatgctgtctacaggattcttagggtgaagttcaccatgggcctgtttgagagcccctatgctgacccaagcctcgttggtgaactcgggaagcaggaacaccgcgatctcgctcgtgaagccgtcaggaagtcattggtgttgctgaaaaatggaaaatct

SEQ ID NO: 4825 - DNA, 440 bp, Triticum aestivum
  unsure (1)...(440): unsure at all n locations
  Clone ID: LIB3281-017-P1-K1-E5
cccacgcgtncgcccacgcgtccgtaaactcgtgatgcagcgcctgatgaaaatgaagcagcaacgcctgctgaagctggagatgctgcttcaactggattcaagaaaccgtgtgggaggccgagaaaggagagaccaccagcatcaatccctgctgaaactgaagatgcaacccctgctgagactggtgatgcaaggcctgctgaaactggagcagcaacgcctgctgaagctggagcagcaacgcccgctgaagctggaaatgctgcatcgacagggatcaagagaccgcttggaaggcctagaaaggtgaagaagcttgggaggccaagataggagaagccagaagaagcagcaatatctggtgaaactggagatgatgctgcagcagctatatttgctgaatctggagcagcaacgcccggtgaaaaagctggaga

SEQ ID NO: 4826 - DNA, 440 bp, Triticum aestivum
  Clone ID: LIB3281-017-P1-K1-E6
gcgagcagagcacacgagcacgtacggcgcattcatcccgtgttcagcagctagcaatagcatggcgagcgggggcatcaagacgatggcctcgggcctcctgttcctgaacctcatcatgtacgtcgtcgtcgccgtcatcgccggctgggccgtcaactacagcatcgaagacagcgcccactcactgaggggcgcgtcgccgccggtgcgcctgttcccgatctacttcccgatgggcaacctggcgacggggttcttcatcatattcgcgctcctggccagcgcagtcggcatctccacctagctcaccggcctgcgcgacgtcaccgagggctaccccgccagcatgatgtcggccgccgcctacggcgtcgtcttctggaccctcaccctcctctgcatgggactggcgtgcaaggagatcagcatcggctgga

SEQ ID NO: 4827 - DNA, 376 bp, Triticum aestivum
  unsure (1)...(376): unsure at all n locations
  Clone ID: LIB3281-017-P1-K1-E7
ggaaagaaatgaataattcgcccttacaatcatcgctcgcatgactcaggggagctccgncgnctcaacgccgccacgcggaatggccgtcgactacgcccccgaggtcgcctgctgcgtatcatccatggtcgacctcggcggcgccgccggcgtggagagccagcgcctgttcctggcgcgccgcacggcgctggagatgctgcgggaccgcgggtacagcggtccggaggacgagctcgcccgcaccctcccggagttccgcgcgtggtggtccgagacgcccgagatcgagcgcctttccttttacacaaccctcgccttcgacgagtccaacaaggtgcgaattgtcttcttgccacctgagcccgtcaaa

SEQ ID NO: 4828 - DNA, 373 bp, Triticum aestivum
  Clone ID: LIB3281-017-P1-K1-E8
cggacgcgtggggacccaaagtattgtaaggtgtcgcctcagtggcttgcttttgctgaaaactcgacattgaggaacctgaaaacatattgcccgacctttggcattcatggtgacagtgttgtctaccttttagcaaaggtgaaacctgaagatacaagacatggattggtggtgttgacattgaaaagaagatgttgagactaattcaaccatatacttatgcggaaggtggctatgctctaccaacgttgcttccctctacattctcctattatctgaaaaatacaactccaggtcttttcccatccacagagacaaactactctgagaatgccctcaataatgcaacaatccatggtgatacctctgt

SEQ ID NO: 4829 - DNA, 300 bp, Triticum aestivum
  Clone ID: LIB3281-017-P1-K1-E9
gggttgtaagaacagaccgccaacattttcattccagagccaagccaatccgagccgagagtttctttttcgttgccagcgccgccgagcagacgacggcgacgacgatgggcaagatcaagatgccggccctcttccgccgccgttccttctacaagttgcgctccgcgtcgccgccgcctacttcccaggaggaagagggcacccggccggcgtcgggcgcggggtccccggcgcggtcggcggaggaggagatggagcgggtgtttcgcaagttcgacgccaacggcgacggccgga

SEQ ID NO: 4830 - DNA, 410 bp, Triticum aestivum
  Clone ID: LIB3281-017-P1-K1-F1
cccacgcgtccgctcgcgaccttttccccctcccggtctacaaagaccgcctcggctttcctccgcctccacttcttccctccaaagcacccctcaccctttctcctctttccctcccaagcaaatcctctgcgctcccctcgcatcctcctccttcctctgccgcttgccgtgtttggttcgggaccgaaatggcattccacgacgaggcgccgctgctgctcaggatcaacaccgccagaggcggccacatgggcggaggcgagtgcgacgaggccgagaaccagcggtggccgccgtggctcaagccgctgctggcgaccagcttcttcgggcaatgcaagatgcacgcggacgcccacaagtgcgagtgcaacatgtactgcctcgactgcgtcaacggcgcgctc

SEQ ID NO: 4831 - DNA, 252 bp, Triticum aestivum
  Clone ID: LIB3281-017-P1-K1-F11
ggaaggaactgcagcattgacaatttgtgacataaaaccagtcctgctggatttacagtgtactacttccgatggggaagaatttacttttgatttacgcaaaatggttgaagcatgtagaaatgaggagatagagtcgcttgtgaaaaagaaatacgggcaagaagcttctacaatctttaagctattggtcacacaaagttgtacagttgagacagatcaaattattgacacaagagcgcaacataatcg

SEQ ID NO: 4832 - DNA, 235 bp, Triticum aestivum
  Clone ID: LIB3281-017-P1-K1-F12
aacagcagcatcacttttatgcgtttgtaacatgcaaaatgggcggctgggagaacatcttacactgctcaaaatgtgaatgttgacattccaaagacgcgaagaacagtcatgcatgtgaagaaagagccatgcatcattactgtacaagatgcttacagtactagctttatcaaagataaggttactgtgtacacacatgtggtcattctattcatggtcacaacatgcaact

SEQ ID NO: 4833 - DNA, 384 bp, Triticum aestivum
  Clone ID: LIB3281-017-P1-K1-F2
cccacgcgttcgcaacttttcttcttcatccccttcctcaccgaactcgtccgggacggcggcggcgctgcctagaagctgttccggcggcatgtctaccgatggcgcaagctaaacaggggcgtcgacggagctgcggtgtggaccgctccagtactgccactggagtctcaggattccatgagcgtggtgaatgtcgagggggtcgccgccggcaagccgcgcgccgtgggagaggcagccacagatgacgtttgctctgaagcgacaagtgggtggacgcgaagcttagtcagggaaacaccactgcaaatcattttgtttaggaaaaaatgcacgatgaatgggtcgctcatggaccaatgattagcagcattgcagcaa

SEQ ID NO: 4834 - DNA, 434 bp, Triticum aestivum
  Clone ID: LIB3281-017-P1-K1-F4
cggacgcgtgggtgtagcttggcctatggtcagttgaatgctcaagacatgggtagtttagtttcaggttcaggttcagcgagatggctctttgaaccatgagtaggtagcacaacgcatgccttgccggctgacagtagttgtgatgcggctctactactgtaccatgtgttcctactactagctctagtcgtggatgctgggtagctccatgttttctctgtttttatgcaatcctagatagaaccatacaactgtggatgacaaacactgcaatttaatctaaaattgtcatcatgatcctagcaaatactcctcaaattactgtaaattgttgcacgattaggggctagtgtagatgcaaaataaggttgcacttttagaggagataagccactgatgttggatgcttggtagttgtcttgtgttgtgtg

SEQ ID NO: 4835 - DNA, 432 bp, Triticum aestivum
  unsure (1)...(432): unsure at all n locations
  Clone ID: LIB3281-017-P1-K1-F5
gccgccggacgtcctcaccaccgttctcggcgtcctcgagttcccggatctattccgcgccgccgacgtctgcaccgcctggcgggccaccgcccgcgccctccgccgcctcgggatctacagccgcccccaaaccccctgccttctntacaccaccgacgccgccggcccccgcgccgccgagctcttcagcctcgccgacaagaaggcctacagggcgcgccttccggacccttccatcggggagcgcaacatcatcggctcctcgtacgggtgggtcgtcaccgacgacgcccgctccgagctccaccttctcaaccccgccaccggcgagcaggtcgcgctccccttcgtcgccaccatcgagcaggtaagccccattcttgaccgccaaggcaaccttgaaagggaccatctttctctccatgggga

SEQ ID NO: 4836 - DNA, 341 bp, Triticum aestivum
  Clone ID: LIB3281-017-P1-K1-F6
agctcccgtcacctgccaagcagttttcgctgttccgggaccacatagtgtcggctgaagggacgaaatggcggcgcttgctggctccaacctgctgctgctcgcggcggcgctgatcctctgcgggccggctagcacagaggcgtacgatacgctagatccgaacggaaacatcaccataaaatgggatcttaatgagtgcactactgatggatatgttgcactggtcacaacatacaactaccatcatatccggcacatatccccgcccgggtggcagctgctgtggacgtgggccaataacgaggtcaatctgaccatggtgggggctcagaccaccg

SEQ ID NO: 4837 - DNA, 342 bp, Triticum aestivum
  Clone ID: LIB3281-017-P1-K1-F7
cccacgcgtgcgggttaatgtggattttgctatgcgctgagtggatatcaacagaccgggtacatgatggtctgcgcatggcaattctaggagcgccatggacaatcggtattctgtattgctctacagattgggtccgagatgttagctgggttcttatgctgtacatttggcctcaatggatgctcaacctaatacccggagagagatcagtgagacagtatctgaataagtatggaggtgttgatacgagcccaattgagggtggtggttcagcggtcatctgcaccaagtatgggagaaatctgtggtcagggtttattaaggggataactgatgctc

SEQ ID NO: 4838 - DNA, 278 bp, Triticum aestivum
  Clone ID: LIB3281-017-P1-K1-F8
cccacgcgtccggggtttactcctttatgtacaacgcaatttgggggatgacgcataacctacagaacatcataaagtaaatggattcgaacgaccctttcaaaataaaggtgtcggacatgctaatcgctaagctgactaatctgggttttatctcaacaaataagatttcgaggaaatgggataaacttgtggtgagcgccttcgcaaggcgtagactagcaacaattatggtgaagcttaattttttgtgttgaagcgacaaggggctggaccca

SEQ ID NO: 4839 - DNA, 445 bp, Triticum aestivum
  Clone ID: LIB3281-017-P1-K1-F9
ctagattgtcaaagaccagaacttttaaataagaggaaagttcaggggaaaattctattgtgcggctattcttttaattatatttctgggacggcttcaatcaagaaagtgtctcaaacagccaagagtctaggtgcagctggctttgttgttgctgtagaagatagttacccagggacaaagtttgatcctgtgcctgtcaatattcctgggattctcatcacagatgtcagcaaaacaaaggatcttatagactactacaactcttctacaacgagagactgggctggacgggcaacagcgttccaagcaacagtcggtattgcagatggcttggcaccaacactgttcaattcagctccccaggttgcgttgttctcttcccgggggcctgatgtaaaagattttagccttcaagatgctgatgttctcaaacctgatatac

SEQ ID NO: 4840 - DNA, 455 bp, Triticum aestivum
  unsure (1)...(455): unsure at all n locations
  Clone ID: LIB3281-017-P1-K1-G1
gttcgcggcgcagagcacggacggtggcgtgccgctgcactggggcgtggcggcggacgggtcggtggtgatctgcgacgaccgcgccgtggccaaggccgggtgcgggcggtcctacgcgccgttcccgcccgggtgcatgttccacagcgagggcgggctcaagagcttcgagcaccccatgaaccggctcaaggcgctcccgcgggtggacagcgagggcgtcatgtgcggcgccaacttcaaggtcgacgccttcaccaagatcaactccatgccccgcgtgggtagcgccaccaactgggccgccacctgggacgaagccgccatctgatatagccatcgtcgctccccggcgccggcgacgctcgcctagctcgtcggacttctggatttgggcttactgcattntacttatttttttctttggcaatgtacattctgaatctgatctg

SEQ ID NO: 4841 - DNA, 184 bp, Triticum aestivum
  Clone ID: LIB3281-017-P1-K1-G10
gcgaggcgtccacctttacaacctttacaaaccaagacccgagtgaggaaaggagcggagctcactttgttcatggctgccaacacacgcgcggtgggtggacctggccatcgacttgtcggaggagagccgggcggtgctgcaaattaatgtgtgcacaaccgagatccacgctcttcaacaa

SEQ ID NO: 4842 - DNA, 227 bp, Triticum aestivum
  Clone ID: LIB3281-017-P1-K1-G11
cggacgcgtgggccgtttagcttgtcaaaaccgcgaaaaccatcgcatcggcgggcaggggtatccttgccatggatgagtcgaatgccacctgtggcaagagactcggctcgattggccttgagaacactgaggctaaccgccaggcttaccggaccctccttgtcactccaccaggattgggaaactacatctgtggtgctatcctctttgaggagaccctctac

SEQ ID NO: 4843 - DNA, 244 bp, Triticum aestivum
  Clone ID: LIB3281-017-P1-K1-G12
accggcagcggaccggcccggaagacccacgccgacccacgcgtacggggacgcatgggacgtttttatgtgttaatacctggaccacaagcgcatctatgggtaggtctattctgctcatgacagaatcgaaagccaccttgcgaggagagacacaactatgacgtcgctgaaaacacgaagcctgacctgcagacagacaccacacttgctgacattatgacaggatatggagactacatat

SEQ ID NO: 4844 - DNA, 406 bp, Triticum aestivum
  Clone ID: LIB3281-017-P1-K1-G2
agatcaccacaacattcatcaacagacacaaaatacataacaatattcgccaccagcatccgctgctaattcgcagcaggcagaagtctgaagcaattttccgacgtttctacagcacaacaagggggacactgtaactgcaacagagactaagctagcctaccaaacaacggaaaaaacacatgggtttttgaatgctggtttctgttgatcctctggaaggacaggaaataaagacagggagaactccgagagcggctcgccgtctcaggcgacatgctgaagctgcacttgctgctgctgctgctgctgccgcttctgctgcttctgtacattggccttgtgcttctgcccggccaggtggaactcgtagaccttctggctgttgacgacgacgttgcacgct

SEQ ID NO: 4845 - DNA, 447 bp, Triticum aestivum
  Clone ID: LIB3281-017-P1-K1-G3
accgagcgagagagaaaataaagggggctcgtcgggctcgtgcagggtcgagagagaaaaaaaagagagagagctcgctcattcccattcccatcccatcccctcccctcgtcggagccgcgccgccgcccgccaatccgccgccgccgcccatgtcaaagacgccggggaagacgccgcggacgcccaggcggatcctggagtcctacaccatcaagggatccgacggcgtcatccgccctggggactctgtgctgatgaaggcgcccgacacatcaaagccttcgtatgtggccaagattgaggaaatcgaggcagcaggacctcggggcgcaaatgtcaaggttaaagtgcgctggtactaccgaccagaggagtctattggtgggcgcaggccattccatggcgaaaaggaggtgttcctctctgaccaccaagatgtgcaga

SEQ ID NO: 4846 - DNA, 409 bp, Triticum aestivum
  Clone ID: LIB3281-017-P1-K1-G5
cggacgcgtgggtgccggtccggatgcgtccgctccccctcctacccctttccccggccgagtgcgggccgatgtagctccggcgttgttcgaggcgggacgtatgctgcggtttggcggtcgggtgcgtcctttggggcaaagccggtgactttggctggtcttgggggtgtctggatgcagggcggcggccttggcggtgggagacgcgacgtttgtgggcggagctcgcgtctcaggtgctggtgtgcagccatatccacgcgggtggtttggttgcgggtggttggcggaggtagggtgcgttggaggggtgtgagcgccgggtacaccacttgctcatgggccgacggtggcgacgtccgtggacgccgtattcttcatcaaggctccgtcgcggtgttcccac

SEQ ID NO: 4847 - DNA, 421 bp, Triticum aestivum
  Clone ID: LIB3281-017-P1-K1-G6
cccacgcgtccgcggacgcgtgggatcttatggcaactgcaggtcttgacaagaagattaagatttgggatctcaggaagtatgaggttgtgcatacacacgctgcacgagctgagtccttggatttcagccagaaggggttgttggccgccagtgatggatctctagttgagatatacagggatgctgggggccatgattataaagtttatttgaagcataggatggtaaagggatatcaggtcggtaaggttttgttccgcccttacgaggatatctgttcgattgggcactccacggggttttcttccattctcgttcctggatcaggcgaggccaactttgatacctttgttgagaaccctgtggagactgccaagcaaaggagggagagggaggtgcatgctctcctcaataagct

SEQ ID NO: 4848 - DNA, 448 bp, Triticum aestivum
  Clone ID: LIB3281-017-P1-K1-G7
gcaagaccggaaggagcggagccgtcgagccgggaagagccaccaccccatcttcctcgcctccgcttccgaagggtcagagatggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagctgctacatgactcagaaccttggcatcagtgtccccatgatgtcatcttctccattgtttgccaatgcaccacctgagaagaaaggtgtcaagaactttgcaattgacttcctcatgggaggagtgtccgctgcagtttccaagactgctgcagctcctattgagcgtgttaagctgcttatccagaaccaggatgagatgatcaaggctggcaggctctctgag

SEQ ID NO: 4849 - DNA, 439 bp, Triticum aestivum
  Clone ID: LIB3281-017-P1-K1-G8
cggacgcgtgggaggagatcggtgtcatcgaggaggagggcctgctcgacgaggaggaccagcgccgccccatgcccaagcgctgcaagtactgcctcatcttcgtcggcggcttcgcggtcctcttcaccttcttcgcgctcgtgctctggggcgccagccgctcccagaagccgcagatcgccatgaagagcatcacgttcgagaacttcatcatccaggccggcacggacgcgtcgctggtgccgacggacatggccaccaccaacgccaccgttaagttcacctacaagaacaccggcaccttcttcggcatacacgtcaccgccgaccccttcacgctctactactcccagctcaacctcgccgtcggagacctcaagaagtctaccaggggcggagcgggcggcggacggcgagcgtgaacgtcaaggggaac

SEQ ID NO: 4850 - DNA, 419 bp, Triticum aestivum
  Clone ID: LIB3281-017-P1-K1-G9
caccgccttccactctgaaattgttgagctcctgtacagcgatgttgagaacgatgaacacaaatttgtgttgaaggacaggaacaagccaatcatcttttcaatggctcgtcttgaccgtgtgaagaacatgactggcttggttgagatgtacggcaagaatgcacatctgaaggatttggcgaaccttgtgattgttgctggcgaccatggcaaggagtccaaggatagggaggagcaggctgagttcaagaggatgtacagtctcattgaggagtacaagctgaagggccatatccgttggatctctgctcagatgaaccgtgttcgcaatggtgagctgtaccgctacatctgtgacaccaagggagcatttgtgcagcctgcattctatgaagctttttggccttactgtcatt

SEQ ID NO: 4851 - DNA, 413 bp, Triticum aestivum
  Clone ID: LIB3281-017-P1-K1-H1
cccacgcgtccggaagccagggaagatacaggtgagagaacaaaaacaacagaagaacatcaggttcgagcaggttggatgatgatactgaggcatcaggcgaggactgggacactgatgatggcagggatagtatggtttgcttcgacaaggagaggcatatacctgatgaacatcctcggcgatttgacagcatgcgacatgacaggagtagttccagtcacaggcagaattacatgcctggggcctccagaagccccagccggaccccaaagaatgcagttagtgtttctgatgacagcgaggatgacgtttcagacagtgaagatgatgaggtgtggggagcagattacaaggaagagacgagctcgagtgccccgaaggtgaatttttctaattacaagagcagcagc

SEQ ID NO: 4852 - DNA, 273 bp, Triticum aestivum
  Clone ID: LIB3281-017-P1-K1-H10
cggaagacccggccgacccacgcgtcggcatcatgcgattttgagattatttcctgcccagagcacgaaatgattagatctaatttgcttctacgaaacaactagtgtgtttcgggcgtaagaaccatacatggttgaatatccaaaagctggagttcttaaagaaaccggaattggtcacatgaggaacctctaatgactctggttattccgttcagctttctggccttttggccaagtttgcttttggggaaagaaacaaaaaaggcctaa

SEQ ID NO: 4853 - DNA, 429 bp, Triticum aestivum
  unsure (1)...(429): unsure at all n locations
  Clone ID: LIB3281-017-P1-K1-H11
attcccgcagccgcattcgccgccctcgcgccaaccacctccccccgaaggacctcgatccgccgccaatggcgctcccagacccgcgacggccacggcctcggcgggcgaatctgctcgacttcggcgccgggagaggagaggagccgcccctcccctcccctctgcgtggttccgctcgatggccgagcggttccgcgtgaggcgagggctcgactgctccgacgcctcaaggtgcacgaaggccctaggtgctggcgtggtgcaggggatctcacgaattccaccacacacacctngccgccgttcatgctccgtccggcttcagcagggccagcaagacgcgacttccgcttctttctgtcccacgacgccttctccaagccgctcaaggaatctggagttcatgtatcattatcaaacacaagc

SEQ ID NO: 4854 - DNA, 421 bp, Triticum aestivum
  Clone ID: LIB3281-017-P1-K1-H2
ctctcccctccgcagcctgcactgttcccccattgttttgtgtcctgagccatggctgccaagctgactcgcctccacagcctcagggagcgccttggtgccaccttctcctcccaccccaatgagctcattgcactcttttccaggtatgttcaccagggcaaaggcatgctccagcgccaccagctgctcgctgagtttgacgaactgttcgaatccgacaaggagaagtatgcaccctttgaagacatcctccgtgctgcacaggaagcaattgtgctacccccatgggttgcacttgccatcaggcccaggcctggtgtctgggactacattcgggtgaatgttaatgaactcgctgttgaagagcttactgtttctgaatacttggcattcaaggaacagcttgttgatgagcatg

SEQ ID NO: 4855 - DNA, 442 bp, Triticum aestivum
  Clone ID: LIB3281-017-P1-K1-H3
cggacgcgtgggttccaatgctaatcttgagcttaatgataaatatcatcctcatgtcagtgttgaccttgctgatttctaccatcctaaacatgtgctttatagctatgcttatgtaattggatactcgatgatgacttggagggtattatccctaccgcttgcattgtctcttttgtggagtgttctttcaggtttttgctactgcaccgtttactacatgctgaccaggttcgaggtgacattccttgggatcccggtggattcacggtatggtgatgagaagcaaagagcacacatgaggaagagcgaagctggagcttgcatgtggaagcaaaagaagaagagcatcagcttagagagtgatcaagcgagtgctacatgatcaaagcccggtgagctgtttcgtgatccattctgaaattatcattcattgatgctt

SEQ ID NO: 4856 - DNA, 390 bp, Triticum aestivum
  unsure (1)...(390): unsure at all n locations
  Clone ID: LIB3281-017-P1-K1-H4
ggtgcaaaatgcactcgagggcaagttcgaggctgtacttcgctggcctaaagcaccactctgactagctctgctctgctacccacatacgcactactctcttacgaggcatcaagaactatgacatggctgaatttctgaagctggagttgctgaaggaaaccggatttgcgcacatgaggatctgtgacggcgtcgggtcattccttcagctttctggccttctggccaagtttgctctggtgagagaaacagcaaaggcctaacgctgtgcagctgctctgacatcagataacagtgttgtcatgcatagcctgttttatcgctactcttgncgcggtatctcagtgtgtaagaatagttctttccttgaagtgaaactatttatgc

SEQ ID NO: 4857 - DNA, 311 bp, Triticum aestivum
  Clone ID: LIB3281-017-P1-K1-H5
cggacgcgtgggtgcaggcagagcatagttgagcgtgtgggagtcgaaggagatcgagatggcaactgcatatgctcctccgatggcgagccaggtgatgaagagcggcttggtgagctccaagccgcgggggctgtccggcgcctcactcaccaggaggccccgcttcgtcgtcaaggccgtcaagtctgacaaggggacgtaccaggtggtccagcccatcaacggcgacccgttcattggcagcctggagacgcccgtcaccttcagcccccttgtcgtgtggtacctttacaacctccccgcgtacc

SEQ ID NO: 4858 - DNA, 339 bp, Triticum aestivum
  unsure (1)...(339): unsure at all n locations
  Clone ID: LIB3281-017-P1-K1-H6
acggcctcgcagcgctaattccttggaacactgcgccggtagaggagaggagccgcccctccccttccctctgcgtggttccgctcgatggccgagcggttccgcgtgaggcgagggctcgactgctccgacgcctcaaggtgcacgaaggccctaggtgctggcgtggtgcaggggatctcacgaattccaccacacacaccttgccgncgttcatgctccgtccggcttcagcagggccagcaagacgcgacttccgcttctttctgtcccacgactccttcttccagccgctcaaggaatttggagttcatgtatcattatcaaacacaagcttgt

SEQ ID NO: 4859 - DNA, 445 bp, Triticum aestivum
  Clone ID: LIB3281-017-P1-K1-H7
ggtgatcatgagcaccatggcgatgtcggcgctgaacccggacgcgcccatgttcatcccggcggcgttcaagaaggtggaggactactcgcccgagtggtgggagctggtcaaaaccaccgtctggttccgcgaccactggttccgccagcaccagctctacgaggacctcgccgacgacgtcgacgacgtcgtcgccctcctccccgacgactccgtcgacctcctcgacgccgacgacctgttttactccccgccgtcgccccagccccagcccgacttctaccactacaaaccagcaggtacggttcggtacacctttcaccgtctccttctcgccagagcagcagaggtagtatggcagcagcgggaagctaaccgggatcgctctgaatttgcagggttcggcggcgacatggacgcggtgctgaagacgctgagcctg

SEQ ID NO: 4860 - DNA, 441 bp, Triticum aestivum
  unsure (1)...(441): unsure at all n locations
  Clone ID: LIB3281-017-P1-K1-H9
cccacgcgtccgcccactgtccgtttcgccaccttgctctgcctccggcagtcatttcatccaatctggctggtccgctccccacctcggcggctccttcagtccggcagcacaccacgctcaagcctccaccaccccaactcctcaagttacagtagacaaggagctccgctctacctctcatctctctccctgtcctggtggtcacgggctgatgttgctgctcctctccttcagggcttttctttggtgtatcaggcattcaggctggtgtaatttgttntcagaagtgaacatgttgtacagtccaatgtatctacaaaagttaagttatggtgagttgttcatcatgttgcttgcatattttttgtctaacaagctggatacttcagttntgaatataaacattgagtaggtgctcaaatattttgctaatgatag

SEQ ID NO: 4861 - DNA, 396 bp, Triticum aestivum
  unsure (1)...(396): unsure at all n locations
  Clone ID: LIB3281-018-P1-K1-A1
ggacgcgtgggtacccacgccgtcttcgttcccctccggcaaccatggctgggatggcatcacgctgcgaaggcaagacaaccggcgacaaaggctactgtagtgtgatttattcaccctatccacagtcgtcgcctcttcctcctcgcctggccgacctgttccaacactttggtctggacaagatccgcgcgatcatgaacagttctgatggtaagacgttcgagcaaaagatcgacaagttacgagaggaaatgagtgctttcgaacgtgctcgtgatgtattctacatcgtcgagggcgaggatggcgacnaggacgacgaaggcgacgaggacgacgacgtggatgtggacaagtcggatagaaagctcttagatgatgaaaagaaacccg

SEQ ID NO: 4862 - DNA, 287 bp, Triticum aestivum
  Clone ID: LIB3281-018-P1-K1-A10
acacggtaaacttttcagataatacaagaacaggtccggcaataatattgagcacaaatagcagcttgtacgcctctaatagaatcctgcacttgacaggccactcaaccaagcaatagtactatatcgacccacacactaatgtctgacagcaaaccaacataggagcaaactaacgacacatgaatgaaaaggtaaataatgcttgcagtaaaactacccgcggttcatcacttcttctcatcccgctcacggttccactgctcaatcttggccctgcgctcctc

SEQ ID NO: 4863 - DNA, 415 bp, Triticum aestivum
  Clone ID: LIB3281-018-P1-K1-A11
ttcggggaggccagtttgtacgttttccgcgggcccgccgcctcctcctccaagggcgcggtggaggcgatgaaggacaccctgtcgaggtgggggaagtccatggcggagaccaccagcatggtcgagagcctcagccgcgacacgtggcagcacttcaagacagggcctagttttactgaggctgctatgggacggcttgctcaaggaacaaaggtcttagcggaaggtggctatgaaaaaatatttaaacagacgttcgagattctgccggatgagcagctgaaaatgtcttacgcgtgctatctatcaacatccgctggtcctgtcatgggagttatgtacatttctacagctaaaattgcattctgcagtgacaatcctctttcttacaagggcggaaacaaaacagagt

SEQ ID NO: 4864 - DNA, 375 bp, Triticum aestivum
  Clone ID: LIB3281-018-P1-K1-A12
ctaagccttggacattttcaagcgtaaaaccaaagagggagtgagagagagagagatgctggtagacaaatgactcctcgatgcgttgcgccgtgctgcacctgcttgtgttcgcgagcgtcctcacagccaaagccatttacattcctaacttaaaaaactcgcacttcataccagttacggccaatgtcgtgctggtgaacgggaccgtggtgaacggcgttaaggccatccccaagtgggagacgtcgggcttcgcggagtacatcgagttcgatcacaagcagggcgacatgctgttggtggtgccgtaaggcgcttactccgtacgtctcgacaacgatgcctccatccttcagtgcattcccgtcgtcc

SEQ ID NO: 4865 - DNA, 412 bp, Triticum aestivum
  Clone ID: LIB3281-018-P1-K1-A2
cggacgcgtgggttggacctgttattaacactgattcagtaagtggggttgagagtagacagtcacagtcaaattcaggagttgagcatggaattgctaacctggcagcacatgtagataggtcatctttaaacacatcctctgattctgacggtattgccaatacatcgagagcggtaagtcaggcaacatcaagctccctgatatctgacgccactggcaaaagaccgcagtttgtaggcgaggatagccaaccattggcttctggtacatcaatgcagcatggaacacatgttgctagtgtggcaatttcaccaattgaaatggtccaagccgtctttgtgcttgttgaagatgaaatgatgggtgatcctgcatccctaattgctgtcatcatggagtttttacgaag

SEQ ID NO: 4866 - DNA, 169 bp, Triticum aestivum
  Clone ID: LIB3281-018-P1-K1-A3
agtatacagttacatcaaattcaggagttcagcatggaattgctaacctgtcacacatgtttaaggtcatcttaaacacattctctgttctgacggattgccatacatcgagagcggaagccaggcaaataagcttcatgatatttgactccactggaaaaaccgcatt

SEQ ID NO: 4867 - DNA, 241 bp, Triticum aestivum
  Clone ID: LIB3281-018-P1-K1-A4
attacacggtcaacttttcagataatacaagaacagccccggcattaatatcgtgctcaagtacgacattcgcggcgccgaatagaatactgcacttgacaggccactgaaccaaacaatagtggtagtttggcccacacactagagccgggccgcaccctatactggtttggcggctgagcgccatgaatgaaaagggaaataatgcttgcagtaaaactacccgcggttcataacttct

SEQ ID NO: 4868 - DNA, 335 bp, Triticum aestivum
  Clone ID: LIB3281-018-P1-K1-A5
tccgacgacatctaaaaaaaacccttttttgatttttcaagggcccggcaccaaagaggtcacggcggctctgttgacgccgactgcggcagtcttcaaagctgaataccctaccccaccggcggccgaccggctcggagacgactaccttatgttgttcacgcacggcgcggggttcctgctgccctggaacgcctacataaccgccgtggactacttcttatacctatacccgggcgcgccgggcgaccgagtcttcttctgctactacatgcattgctgcctcataccgctgctgcatattatgctggtctttcctaaaaacagcggccggg

SEQ ID NO: 4869 - DNA, 410 bp, Triticum aestivum
  Clone ID: LIB3281-018-P1-K1-A6
gctcgagctcgtaagcttgaaccatctcgaagcgtttaaaccaaagagggagtgagagagagagagaggaaggaagacgaaggacgccgcgatgcgttgcgccgtgctgctcctgcttgtcttcgcggcggcgcgcgccgccgcggtcgtcaccgacggtctcctgccgaacggcaacttcgagctgggtccggccaagtcggagctggtgaacgggacggtggtgaagggcgggaaggcgatccccaagtgggagacgtcgggcttcgtggagtacatcgagtccgggcacaagcagggcgacatgctgctggtggtgccgcagggcgcctacgccgtccgcctcggcaacgatgcctccatcctccagcgcatccccgtcgcccggggctcctactacgccatcacct

SEQ ID NO: 4870 - DNA, 401 bp, Triticum aestivum
  unsure (1)...(401): unsure at all n locations
  Clone ID: LIB3281-018-P1-K1-A8
cggacgcgtgggccttgcctagcatgactttgatgatgagagggaagaaagcaaaggtagtggaggggaatgctcagctgctctgcagtgatgcgctcaccgaggtcttccacaggctgcctgcccgcaccctcgcttcttgcaggatggtatgcaaatcctggatgtcattgctttccgatgtgcattttgttcacgagcacctgaaccgaagccagcagaagttgctgctctttgcaaatgacagagcaaatgataggtctcttgccatggtgctcgcagacgccaatggatacatgtaccagctgtctaggcccttggttgctcagaccctgtttgtgcacaactcttgcaacggnctgctctgcctaggtgacagtaaaggagcagtggagttgctc

SEQ ID NO: 4871 - DNA, 383 bp, Triticum aestivum
  unsure (1)...(383): unsure at all n locations
  Clone ID: LIB3281-018-P1-K1-A9
cggacgcgtgggcggacgcgtggtgcctgcgtaacttttgagaccaagttggctaattcaggcagcggcggcgcatctggacggtgccagttaatttctctctctctctctcggtgtcagcctaatgcttgcttgttgatgttgttgtttgttgtatcatgtgatgtaatccccgtgaaaagagtggctaaagacagatgtgatttgggtgaacgaattcacctcgattccacccgctccctccctgtactcctgatagactgtcggccagattggatttgtatattagtctctatctattctttcaaaanngaaaannannnnaaaaacaaagattccaaacaaaaaaaangggggcggccgttttagaggatccaagctta

SEQ ID NO: 4872 - DNA, 424 bp, Triticum aestivum
  Clone ID: LIB3281-018-P1-K1-B1
aggactcgtgggcggacgcgtggtataagatcgtgcgagcgagaaatccccaatccccaccaaaccctaacccaaaccctaaccctgattgaaacgaccagcataggagaggagaggagcgtatccggctatggcacgtcgagaagatgcacttgtccatgccgttgcccgccggcttggagggtttccccttcaccacgttccaggcggagctggaggccttcaccgtcaagttgagggcggaggcgaagaaggccaaggccaagccggaggtcaaggaggccaaggccaaggaggagaaggccaagccggaggtcaaggccaaggtgaagaaagccaaggcgaatgaggccaacccggaggtcgaggccaaggcaaaggaggccaaagcaaaggatgccaagggcgaagaggccaagcccga

SEQ ID NO: 4873 - DNA, 409 bp, Triticum aestivum
  Clone ID: LIB3281-018-P1-K1-B10
actagatatagagcagtagcggtcgctctagagtgagctagctgagcgtaccgatcatgctgctcaatgttgggccactttccagcaacagtatgttgaaatgcagcaaggttttctgcatacaatacaacgactccagctagaacttattgagttaagagaccgtactggagaacaagaagatgtttcgcaagctgctcaggagggttcagctgaagcgtcatatgttcaaagcaagggaagcaacatggctgcaaatggtagtgcattagcagatggcaatcagtccacaaatgactcctttaagggaaataatgcccatgctgtacctgttgttccatcactattgggactaagtggttttgttcctcctgggcagatggctgggatgcattcttatatgctgcat

SEQ ID NO: 4874 - DNA, 310 bp, Triticum aestivum
  unsure (1)...(310): unsure at all n locations
  Clone ID: LIB3281-018-P1-K1-B11
ccggaattgnnggggacgcccaggcgtgacccacgcgtgacgcggacacgtgggctgtttcaacatatgtagcctacaggactccgttcatttgtgggaatattgcgagaggatgtcatactttacatgcttaaaaatggagaagtccctatgtgcccacactgccaaaataacatacatctatgtcagccagccttactcgttaatagtcccaggctctgacgattgttccgtcattttggggaaccatgacagcctgttttttgtaaacaattgtctagggttccaacataagtttctttttttacat

SEQ ID NO: 4875 - DNA, 419 bp, Triticum aestivum
  Clone ID: LIB3281-018-P1-K1-B12
cgtctcctctctcctttccccaacccaaaccaggagcgccctccctcccccagccgcccgccccctccccacccaggaaaccagccatgaagggggccaaatccaagggcgccgtcaaggccgacaccaagttggcggtgaagagcaagggggcggagaagccggccaccaaggggaagaagggcaaggccggcaaggaccccaacaagcccaagagggcgccctccgccttcttcgtcttcatgggcgagttccgcgaggagttcaagcagaagaaccccaagaacaagtccgtcgccgccgtcggcaaagcggccggtgagaggtggaagagcttgagcgaatcggagaaggccccctacgtggccaaggccaacaagctcaagggcgagtacaacaaggccattgccgcctacaac

SEQ ID NO: 4876 - DNA, 356 bp, Triticum aestivum
  Clone ID: LIB3281-018-P1-K1-B2
acgccggcacggaccggcccggaagacccgggccgacccacgcgggcactaacactacactgattcactcacaagctaatctagcggcgtagctcacttcagtccagtcggcatggcggctccgaggggcgcggcactggtgctggcgatggtgctcgcggcgatgctggtggcgccgccggcgacggtgcacgccatatcctgctccacggtgtacagcacgctgatgccgtgcctgcagtacgtgcagcagggcgggtcgccggcccggggctgctgcaccggcatccagaacctgctggccgaggccaacaacagccccgaccgccgcaccatctgcggctgcctgaagaacg

SEQ ID NO: 4877 - DNA, 431 bp, Triticum aestivum
  Clone ID: LIB3281-018-P1-K1-B6
ctggagtgagccatgatggcaacattctcaccacttgtggtgatgacggagtagttgcagtatggagatttgtgaaggatggcattcgtcgtctcctgaggatggagaaagccctgtgtgcccacactgccaaaataacatgcatctatgtcagccagccttactcgttaatagtctcaggctctgacgattgttccgtcatcttgtgggacctgacaggcctggtctttgtgaagcagctgcctaggttcccagcgtcagtgtctgcattacatgtgaacaacctcaatggtgagattctgactggtgctggtgttctttttgctgtttggagcgtcaacggagactgtcttgctgtggtgaacacctctcagcttccttctgatctcatcttatctgtggcaagcacgacacactcagactggcaggat

SEQ ID NO: 4878 - DNA, 369 bp, Triticum aestivum
  Clone ID: LIB3281-018-P1-K1-B7
cccgccgacggggctctccatggcgtccacctttgttggcaactcgacctccatccaggagatgttccggagggtgagcgagcagttcactgccatgttcaggaggaaggctttcttgcattggtacactggtgaaggcatggacgagatggagttcaccgaggcggagagcaacatgaacgaccttgtctcggagtaccagcagtaccaggatgccactgccgacgaggagggtgagtacgaggatgaggatcaggaggccgaggaggacatgtaaggagggaggtccatgtggtgctttgctgggtgggggggttctgggggcagagattgatctgtttgtgcttggtatgaatctgttatcatcgc

SEQ ID NO: 4879 - DNA, 414 bp, Triticum aestivum
  Clone ID: LIB3281-018-P1-K1-B8
gacccacgcgtgcgcgtatagaactcataattgatgaagtgcaagacgtgcagctatggagctgcatactatagactcagcagttcctgaggagcctgaacgacagggatctaaaccagaatcatgatattcaccccggcaggacaacacactagtgaggcccgaaagtttagatcaaccgcatggtaagccgcacgataccagtgccggagccgctccctatgaattgcctgctcctgatcagcctgagatgaaacgagaggagtttgaagcataaccgccagtttcatcccgtcaggacaacacagaagcaagccccgaaagtttagatgaaccgcattgtcagttagaggacacctgttctggagccgctaccccacaactgcctgtttctgagctgcgacgcatggatat

SEQ ID NO: 4880 - DNA, 317 bp, Triticum aestivum
  Clone ID: LIB3281-018-P1-K1-B9
cggacgcgtgggctgtagttacaattggagcctacagaactcctttcattgggagcaaatgtccagcgagcgagccagcgacgcattcatggcggaacacaaggaggagtcggcgatggacaagatcacggagaagttccacggggggtcctcctcctcgtcgtcgtcggacgacgaggggaagctcgggtcgtcgtcgtccgtcaaggccaagatctaccgcctcttcggccgcgagaagcccgtccactccgtcctcgggggcggcaagcctgccgacctctttctgtggaggaaacaagaagatctctggcggg

SEQ ID NO: 4881 - DNA, 342 bp, Triticum aestivum
  Clone ID: LIB3281-018-P1-K1-C1
cggacgcgtgggtgccgaacggaagtttctgcttatggaagcacgtacagagactcgcgtttcatatggagcaaatttacagcgaacgagccagcgacacattcaaaattgcacacagaagactgaatatgcaatacactaaatcactcaagccttgctaaacagcaagtcttacagtaaacaataggacttaattacttactctactactaacagcaagcctatgtctagttccaactgaaatttttatcatgctactgtgacatctactgtaaatttcaaacaaatgaaaggagtactgtaggcaccaattgaaactacagcctacgcgtccgcggtcgc

SEQ ID NO: 4882 - DNA, 290 bp, Triticum aestivum
  Clone ID: LIB3281-018-P1-K1-C10
acccacgacgccgcgcgctgacgcgtggttttgttgctttctaatactatcacccaaagcctagttgcttctcccccccgcgagccgtggccgagacagcacaagcaggcgcgggtgggcattggcgggcaaggaggacagccgcctctttctgggcgttctcctgttccacacagacaaggggacgaccacggacgccttgcgccgatgcggcaaggtacctgtcacccagatcatgctggagaggcacacacaccggtaccgtggctttggcttcgtgacgttttcag

SEQ ID NO: 4883 - DNA, 421 bp, Triticum aestivum
  Clone ID: LIB3281-018-P1-K1-C11
tgattacaaagaaaatggtatcgatcagtatggagaagaagctggagcaccagcgagtcttcaccccttcagttgttgagccctcatttggcatagggaggataacctattgtctgtttgagcattccttctacacaagacctagcaaatcagaagaggagcagctgaatgtcttccggttccctcctatcgtggctcctatcaagtgcactgtgttcccgctggtaaagaatcaagagtttgatggtgccgccaaagtgcttgctaaagaattaacagctgcaggcatctcacacattattgacacgactggcatttctatcgggaggaggtacgcaagaacggacgagataggtgttccttttgcagtaacggttgattctgcaacagaggtgacgatccgagagagggacagcaaaca

SEQ ID NO: 4884 - DNA, 429 bp, Triticum aestivum
  Clone ID: LIB3281-018-P1-K1-C12
cccgcacgtaccgttccgggtcgaccgcatcgtcccacgcagtccgtacgcaagccccatgctaccaagcttagatcgaccatcacaccgggcacggtgctgatcctgctcgcggggaggtacattggaaagcgcgtgctgttcctcaagcagctcaagtccggccttctcctcatcactggacctttcaagatcaatggcgtgccaatccgcagagtgagccaggcttacgttattgccacatccacaaaggtcgacatctctaaggttaatgtgcagaagtttgatgacaagtactttgctagggagaagaagactagggcaaagaagactgagggcgagctatttgagtcgggaaaagaggcaaccaaaaatttgcccgacttcaaaaaggatgatcagaaagccattgatgcccaattgatgaag

SEQ ID NO: 4885 - DNA, 260 bp, Triticum aestivum
  Clone ID: LIB3281-018-P1-K1-C2
attcctcccaccctcgccgtctcgttttcgtcaccaccgcagctagataagagaaaaaaagagagagaagaactcgtcgggagggctcgagatctgtgttcggagaggggaattcttgaggtccgaatgcttacaagcaggcgcgctcatgatcagtgatacccatccactgttatcatgaaccgtgaggggacttgcctatagaacataaatgcacatgaacagctcaaggagacagatttgctgatgaagaagattgc

SEQ ID NO: 4886 - DNA, 391 bp, Triticum aestivum
  Clone ID: LIB3281-018-P1-K1-C3
cggacgcgtgggaaacaaggggtatttgtaaaccttattggaagaaaggtgagtagatatatccagtaccctgtggttttttctctggctgtgtagtatactcaaaagaagcggcaagaatacctacgtgtggccacacagtggcggatttcaacggcctgttcgtgtaccacatgctaggcctggccttcctgctggccgtgttctacttttccctactaggcgaggtggacttccgcttgaccggcctcctcccgtcccccggtgcgtcccggtcccacgacgcgtacctgccgatcgtggagcggcgcggcgcgcatctcttcctggagggccgcccattctacatcaacgggtggaactcgtactggctcatggaccaggccgtgga

SEQ ID NO: 4887 - DNA, 420 bp, Triticum aestivum
  unsure (1)...(420): unsure at all n locations
  Clone ID: LIB3281-018-P1-K1-C4
cccacgcgtccgcggacgcgtgggtttgctactagctaacagcagcagcagcagcagggtagctcctcagtccagtacgtctcgggtgaacaagatcagcaggtcgatggcgctctctcgtcgcatgaccgcgtccgccctcctcctgctcttcctcctcgtcgccacagagatggggacgacgacggtcaaggtggcggaggcgcggaactgcctgtcgcagagccacaacttcaagggcgcgtgcctcagtagcagcaactgcgccgtcgtctgccgcacggagaacttccccgacggcgagtgccacgcgccgcactacgagcgcaagtgcttctgcaagaggccctgctaggccgctcgctcgtcccgccctgctggccagcgccgagacacgtnccatgatagctagatcatccg

SEQ ID NO: 4888 - DNA, 425 bp, Triticum aestivum
  unsure (1)...(425): unsure at all n locations
  Clone ID: LIB3281-018-P1-K1-C5
gccttctgcgtcgtcttacgccttgtagcacgctgcagcctgcagccggagtggcagctagggttgaggcggagggtggagctctgccaaagatccgaccccctcgcacgcggcacagccaaaccctaaccacctgatcccaatgcgcaggggcctcagcagcgagacgtcgctgcgccggcaccgcgcacgggcgcggntgtgggtcgccgtcgcggcgctggttaccggcaccatctggctctggtcctcctcctccgttgtcctcttcggcacccacagggtccaggattttgttgtagatgagttgtggagaactgcagattcaaatggttggagagcatcttctgcaccacgcacctattggcctnccccaccaactgaatccgagagcaatgggtacttgcgtgtccggtgcaatggcg

SEQ ID NO: 4889 - DNA, 427 bp, Triticum aestivum
  Clone ID: LIB3281-018-P1-K1-C6
cccacgcgtccgcggacgcgtgggggaaacctatccgcgttctcctctgtggcacgcaacctttgtcccctctagatatagaacaacacgcctcgtccacccatacctctagaagtctagatctaggcctgacccgtagttttctgatcgtgttcgcttcgatctcggggtaagctgagttcggcgtccatgatttgttcctatcacccgtttgttatctgattctcaggtttctccttctgatcggcgagttggggcttgcggcgatcttggagcatagacgggaggcaagctggatctgcgcacggaagcttccgatctgaccggctggcgtctcagatctgctgctggtctgatgctaaacggcggatctagatgtttcccgcggtctcggtatgttgcagcggcgggcccggaggggctcttt

SEQ ID NO: 4890 - DNA, 175 bp, Triticum aestivum
  Clone ID: LIB3281-018-P1-K1-C7
cggacgcgtgggcggtcgcgtgggttagtttctcactcaacagcagcaacagttgctgcttcaagcacagcaaaatattacatcttcatctggagagatggatgctcgagagctcggaatgctaacaagcagtcgcactcgtgatcagtgaaacccaacaacagatatcaggaac

SEQ ID NO: 4891 - DNA, 354 bp, Triticum aestivum
  Clone ID: LIB3281-018-P1-K1-C9
acgcggacgcgtgggctactaccctctgttccatgctctgactctccctccctagggtcaaccggcggggccggctgaaccctagccaagacgagctgtatccgagtctcggtgtgcgcaggttagaatgtgtgaccgaccggcacccgtctcctccgatgatgatggcaagctcggcgacgaggagggcgttgagatccgcgaggtatgggcgaacaacctcgaggcggagtgcgccgtgatccgtgacgtaggagacgattacgggtacatggtcatggacaccgagttgccggacatagtgtgccgcccgctcgggagctttcgctccaatgacgagtacaactacgccac

SEQ ID NO: 4892 - DNA, 406 bp, Triticum aestivum
  unsure (1)...(406): unsure at all n locations
  Clone ID: LIB3281-018-P1-K1-D1
cttcctcatcttattactttccccatcacgccgtttcgatggtctgactctcaatccctagggttaaccggcggggtcggctgaaccctagccaagacgagccgtacccgcgtcctggtgtaggcagctgacagatggagaagggggcgtcggagtcgtcgccgctcgactgcgctcgctgcggcaagcccgcgtctcttcaatgccccaagtgcgcacaactgaagctcccccgtgaagctgctgctttctgttcgcaggattgtttcaaggcagcatgggcctctcacaagtctgttcacacaaaggtagatgcactgacatcccagctgtctcaaagaggctggaaatattgtttgaaaaaagggcgngacccgactatggagccttcctcgtttgattggac

SEQ ID NO: 4893 - DNA, 392 bp, Triticum aestivum
  Clone ID: LIB3281-018-P1-K1-D10
acgtatccttttttacgcatgaacagtgtgcgcgttactgtagcgacgagggcagcgacgagggcagcgaaagcgagcaggcggcgcaacaaagcgaacagcgagagaaaaggggaagcgagcggccagcacgagaaaaaagacctagcccgcgcccccgcagccgcctcctctcctgccgccgccgcctcgtcctcgtctcgtttcttgccctcagcgccgcctcctctccttcctctctctccctctgcgccacctcctcttctcttcatgcgtggtggcgtctcgtcatccccagccttctcaatcccctcctcccgcacgaaccctagcagagagagaagatgagagggagagagaagggaagagaggagaggagggagaaagagaga

SEQ ID NO: 4894 - DNA, 454 bp, Triticum aestivum
  Clone ID: LIB3281-018-P1-K1-D11
cgccggtccggaattgccccacggacccacgcatccgcggacgcgtgggcggactcgtgggtaagaagaagcagccgcagccgcagcgcgaccccgcgaggaaaccctaccgccgccgcagcaggagcagccatgggtatcgacctcgtcgccggcgggaggaacaagaggaccaagcgcgtcccgcccaagtccgacgatgtgtacctcaagctcctcgtcaagctctaccgtttcctggtgaggaggaccaagagcaagttcaacgccgtcatcctcaagaggctcttcatgagcaagactaaccgcccgccgctcttcatgcgccgcctctccaacttcatgaagggaaaggaggagaagaacattgctgtggttgttggtacaatcacagatgacatgcggatccaagaggtcccagcaatgaaggctaccgatctgaggttcacagaga

SEQ ID NO: 4895 - DNA, 425 bp, Triticum aestivum
  Clone ID: LIB3281-018-P1-K1-D12
ccaatccccaatctcccatccaattcaccaagcaaaccctagcccagccccgatggcccgcacgaagcagacggcgaggaagtccaccggcggcaaggccccgcggaagcagctggccaccaaggcggcgcgcaagtcggcgccggccaccggcggcgtcaagaagccgcaccgcttccgcccgggcaccgtggcgctccgggagatccgcaagtaccagaagagcacggagctgctcatccgcaagctgcccttccagcgcctcgtcagggagatcgcgcaggacttcaagaccgacctgaggttccagtcctccgccgtgtcggcgctgcaggaggccgccgaggcctacctcgtgggcctcttcgaggacaccaacctctgcgccatccacgccaagcgcgtcaccatcatgcccaaggaca

SEQ ID NO: 4896 - DNA, 385 bp, Triticum aestivum
  Clone ID: LIB3281-018-P1-K1-D2
acaaccccaccgactccagctcggtcgcgtgggcatgcagggagcgagattccgctcccccatgctccctccagctccgcgcgccacgatcccgacccggccggcggggctcccctacaggctgctgcggcgcgccccgaccgccgggcgagcggagggagcctagctagctcggcggcggcctacgacttgcagcacccgattgtctggcgggcggcggcggtgagcaagccgtggaggggttcatggtccttgcggccggatggagtacgccatgttcgggtccaggcgggtcgacgacgacacggggttcaggcgccagcggaccgtcagattccgcgacgagagggcaaaggcaacgatgcccattcaccagaagcaggct

SEQ ID NO: 4897 - DNA, 450 bp, Triticum aestivum
  Clone ID: LIB3281-018-P1-K1-D3
gcctgattgggtgaaggaccttgctgctgtgggtgctgaatttgtgatggacatactgatatttcattgcccaagaccctatgtgctactaagattgcgagtttgtttgatggtaaagagaagattgaatcagacagacaacttggtagcctttgcaggaagacaacatatggtaggaagtaacataggattcctactgcctgttgcttatgccttcttcatgtaggaacttttctttaactttaaatggaggattagctaaataatgcccaacaaggtgactagccttatatggagggtcttggaagagaaacccctgtgttactttccaagataccattggcgaactgctgctctgtactgcttggcgcatatgcattggcatgatgaatggttgagagttcctgactttgcattgagctatggggctggtactggctcaaatggaaa

SEQ ID NO: 4898 - DNA, 416 bp, Triticum aestivum
  Clone ID: LIB3281-018-P1-K1-D5
cggacgcgtggggtttgctactgctggtgctcatcggactccccgacgccgccgtcgccgccaacatgaccgaggtctgcgtcaaggccgccgtcggccaccccgacacgctcggcgactgtcccttctcccagagggtgctgctcacgctggaggagaagaaggtgccctaccagatgaagctcatcgacgtcagcaacaagcccgactggttcctgaagatcaatccggagggcaaggtgcctgtgtataacggtggtgatggcaaatggattgctgattctgatgtgatcactcaagtcattgaggagaagtacccaactgcatcacttgtgacccctcctgagtatgcatcagtgggatcaaagatcttctccaccttcgtcacgttcttgaagagcaaggatgccagcgat

SEQ ID NO: 4899 - DNA, 419 bp, Triticum aestivum
  Clone ID: LIB3281-018-P1-K1-D6
ctcagccgcgatcgccggacctttcttgttcgttcccgccgacgctgctgcagatcagtcccacgccgcgcgaggggccgaggagatgtcgacgccgggcggggaggacgacaagaagccggcgagcgcgggcggcgacggcggcggcgcccacatcaacctcaaggtcaagggccaggatggcaatgaggtgttctttcgcatcaagagatctacccagctgaagaagctgatgaatgcctactgcgaccgccagtctgtggatatgaaagctattgcattcctgtttgacggtcgcaggctccgtgccgagcagacccctgatgagcttgagatggaagatggcgacgagatcgatgccatgctccaccagaccggaggccgtcttcctccacgcgcctagaagaagccgtcgagag

SEQ ID NO: 4900 - DNA, 378 bp, Triticum aestivum
  Clone ID: LIB3281-018-P1-K1-D7
cggacgcgtgggctgttttcgtggttattcagggagcgagtaagcgctggaagatggacgcctgcgagctgaagaaggtggacgggaagaagttcggcgggccgaggaagaagttggtgaccaggtccgtcaaggccggcctacagttccccgtcggacgcattgggcgcttcctcaagaagggccgctacgcccagcgcgtcggctccggcgccctcgtctacctcgccgccgtcctagagtacctcgccgccgaggtgctggagctggccgggaacgccgccaaggacaacaagaagacccgcatcgtgcccaggcacctgctgctggccatccgcaacgaccaggagctcgggaggctgctgtccggcgtcacca

SEQ ID NO: 4901 - DNA, 414 bp, Triticum aestivum
  Clone ID: LIB3281-018-P1-K1-D8
ggaccttgctgctgtgggggagaattgttaggagtattgagaatcctcttactctcttgaatgatgcgtcctatgttgagccgttggggaactgtgggaagaaggtcctactgtggtggctccgtgttgaagcccgggccgacagcaagttcccacaagggtgggtgattgagccaccgttggaagttgttgttcccgccaagcgcacaccatggccagaaaccaccatggatgtctcatcggagatgttagacgccaagcaagagcaagaggacaggcagctgccaaggaccaacaacaggtcagcccggccccgaagcaccaccacgaagcggaagggcgacgtccacaactgaggcaggataaacagaccatgtaatgtacatctcacaccaccttacacccgcggtattt

SEQ ID NO: 4902 - DNA, 408 bp, Triticum aestivum
  Clone ID: LIB3281-018-P1-K1-D9
ggtctcgatggcggtttgtttggcatcaccagcaccttcatcggcatatccgagagcaggccgtggtggctgcagtgagggtgcgtgcggcagagcagatggcgttctgaagagctactacaccttggatcccgatccctcgctgaaggtgctcgatcttggtgtttgaatgctgctaccgtacagcaaggtctgtagcagcttttgcaatggattcctttttatgatggtagagtttattttggtttagatttggtattgttgttctgtccacttaacccagtctatagcaacagattttgatgtccgttccttgccgacaaaggtcataacttatcacgtctgcaaatgattttttggctgtagtatgaatagagaagttcggtcagatgcaaggcatgcttagca

SEQ ID NO: 4903 - DNA, 412 bp, Triticum aestivum
  Clone ID: LIB3281-018-P1-K1-E10
cggacgcgtgggcggactcgtgggctcctatgagtgccatcgcatgcgcgtccgacttcttccggattcccgaacgccaaatcccacccccacccctaactgctgcccttttgtcaactccacttctccccaccgccgccctccgtgctgacgcctctcgctccccggagccaccgcgacaagctcgccgcgccgccgtcatggatgaggagtacgacgtcatcgtgctgggcacggggctcaaggagtgcatcctcagcggcctcctctccgtcgacggcctcaaggttttgcacatggatagaaatgactattatggcggagattccacttctctcaaccttaatcagctctggaagaaatttagaggggaagacaagcccccggcacatctaggctcaagcaaagatta

SEQ ID NO: 4904 - DNA, 405 bp, Triticum aestivum
  Clone ID: LIB3281-018-P1-K1-E11
tctttcgcagacgcttgcagacatttgtcgtttaggtgtcagggcttgcaagcaggctcagttacggagagccccggtcagacccgatcgccgcggagaacgtaggctccacggcggttgcagtggtagtgtgctcctctcatgtagtggtcgccaattgcggcgattctcgcatcgtgctcttgcgcgggaaggagcctgttgctctctcaattgatcagaagcctgacaggaaggattggcgcgccaggattgaggctgcgggaggcaaggtcatccaatggaatggacaccgagtggtcggcatactttctatgtcacgatccattggtgaccgatacttgaagccatacatcatcttaaaaccagaagttacggtttgttctcgggctaaagatgacgact

SEQ ID NO: 4905 - DNA, 374 bp, Triticum aestivum
  unsure (1)...(374): unsure at all n locations
  Clone ID: LIB3281-018-P1-K1-E2
acccggggcgacccacgcgnccgcccacgcgnccgagacctcgcccttttcccctcttacctaatccgcggcagccaaatggcgctcacctcccagagcctcttcttcaccccgtcgcccgccgggccttcccggcgaggccgggggcgccccgtcaccatgtccgccgccgcatcgcacaactcgcaaccccgaaacaaccccttcgccgtctcatcctccgcccccaaatccgaatccaatacctccaaaaccgacctcgcccttggctccgccatcgccgccgccgactacggcgcattcctcctcgacacattggccgatatgggggcagactctggggcccccacggatggggaggcagatggggcaga

SEQ ID NO: 4906 - DNA, 427 bp, Triticum aestivum
  Clone ID: LIB3281-018-P1-K1-E3
gctgttatcgcgctgaggatgctgctggaaaacatggacatgtttgatctggttatcagtgatgtgcacatgccagacatggatgggtttaagcttcttgagcttgtggggcttgaaatggacctccctgtcatcatgttatctgtgaatggagagacaaaaactgtaatgaaggggataactcatggtgcttgcgactatctcctaaaacccgttcgcatcgaggagcttaggaacatctggcagcatgttgttaggaggaaattcagtacccgtgactctgttaatcttgatacctatgaagagtgcaataagccaccaagtgcggactctgactatgtgtatggccaagttacatgtgggtcgcccgaccaaagtgggaggcctagcaaggagaggaaggaataccaatatgaggaggaagatt

SEQ ID NO: 4907 - DNA, 406 bp, Triticum aestivum
  Clone ID: LIB3281-018-P1-K1-E5
ctcttcaccaggtgtttccagacagtggacgactaggtgtcagggcttgcaagcaggctcgtcgacggagagccccggtcagacccgatcgccgcggagaacgtaggctccacggcggttgcagtggtagtgtgctcctctcatgtagtggtcgccaattgcggcgattctcgcatcgtgctctcgcgcgggaaggagcctgttgctctctcaattgatcagaagcctgacaggaaggatgagcgcgccaggattgaggctgcgggaggcaaggtcatccaatggaatggacaccgagtgtccggcatacttgctatgtcacgatccattggtgaccgatacttgaagccatacatcatctcaaaaccagaagttacggttgttcctcgggctaaagatgacgact

SEQ ID NO: 4908 - DNA, 414 bp, Triticum aestivum
  unsure (1)...(414): unsure at all n locations
  Clone ID: LIB3281-018-P1-K1-E6
cggacgcgtgggcacatcgcggctgcggcgacgaggaaaaatacactgcacataagagagggaggggcgagcgagagaggcagggagaggcggcgcgccgagcaggccagcccacaccccgcccgcggccatggccggcgccgacctcaaccggagcttcattaaggacgtgaagcgcatcatcatcaaggtgggcactgcagttatcaccagaaatgatggaagactggctttgggcaggattggagccctgtgcgagcaggtgaaagatcttaatgctcaaggatatgaggtgattatggtcacctcaggcgctgttggtgtggggcgacagcggctcaggtaccggaagctngtcaatagcagctttgctgatctgcaaaagccgcagatggagctggatgggaaggcatg

SEQ ID NO: 4909 - DNA, 340 bp, Triticum aestivum
  Clone ID: LIB3281-018-P1-K1-E7
gataggaacatatcatttattgcataataatcgactacacacgcatcttgcgatgatcgcaccattattcccttgtactaggcgatgtctatcgcaacgccattgttacaatatttagtgtgagcctttattttttgcatgtcttctcgcatcatatagtcgatcgactatgcgaacggcctttggttgtagcagtccaggttgtcaccgtagctgacgccaagaaggtcgcagtagcgcttgtagaacccgatccggtcggcgacacggccgtcctgcccgcgcccgcactcgagcccaccgttgatgatgttggtgatcacaccgtacccaggcaccc

SEQ ID NO: 4910 - DNA, 420 bp, Triticum aestivum
  unsure (1)...(420): unsure at all n locations
  Clone ID: LIB3281-018-P1-K1-E8
cggacgcgtgggcgccagccggggaaaaggcagccgcagccagcgacgcctcacctcacctgacctccctcctcacccccgcccccagccgcagcgcccgccggaaggttctagagatggcggaggagaaggagtcgacgtcggtcccgctcagccaggcggcggaggccgtcgaccccgaggacccggccaagtcgccgccgcgccccagctcgcccaccacctccacccgcaaggcatgctgcgctgttcttcagagttgggtgtcgagaaaatttatgactggatgtgtggttctttttcctgtggctttcacgttcttcatcacatggtggttcgttcagtttgttgatgggtttttcagcccactatacgcanaactcggagtcaacatatttggtcttggttttctgacttctc

SEQ ID NO: 4911 - DNA, 415 bp, Triticum aestivum
  Clone ID: LIB3281-018-P1-K1-E9
cggacgcgtgggcggacgcgtgggataggcaccaccatagagatcgtgagagaactcgtgatagggaccgagaacgggaccaggagagagaccgtgggcgtgaccggcgtgatagggataggcacaaggatcatggccgggatagagaccaggatagagacaggaaacgtgagcgctctcatggcaggggcagagaccgtgacagagattacgagcgtgcaagtcacgaacaggaccctcgcagggaccgagattacaagcgtgcgcgccatgaacatgatcgtggtcacttgcaggagagtgatgctgattatggtaatggtgagcttggctataaccagcatgagcaccacagaagtcacgaacagtatggttatggcctagatggacatgagcgctcaaagcgacatgagca

SEQ ID NO: 4912 - DNA, 425 bp, Triticum aestivum
  unsure (1)...(425): unsure at all n locations
  Clone ID: LIB3281-018-P1-K1-F1
cggacgcgtgggaaaacttgaaattctggacttttttggcaatgcctcctcattgagtgaaccttctgtggtttcttcattaccacaactgcaggaactatatcttaggcgaatgaaacttcaggaatttcctattgggcttgtacaattaaaacatctacgaattcttaacctcagtcaaaataatctctcaaccataccagagggtatcaaggattttagtgctctcatcgagctagatctttcagacaacaatataacaaggcttccagctgagctgggtctgcttgagncctagcctgcagtgctcaaacttgatggaaatcccctcaggagcataaggcggactgttctggagcgaggaacgaaagcttgtctcagctacctcaaagaaaagctttctccaactgaattataccatcatc

SEQ ID NO: 4913 - DNA, 400 bp, Triticum aestivum
  Clone ID: LIB3281-018-P1-K1-F10
ggaacgcccgcaggggcaggtccgggacgaccgacgcgtccgagcgcccaggaaagaacacacacaggcacaggcacaggcagagaggagaggcaatggcgaccactaagatggcggtggtggcgatcctggcggcgctgctgctgatggcagctgtggagccggcttcggccacgccgcccagcatgctggcggcaagaaagttgcagatgcctcgcctcatggatgtcgtcttggcagagtcaaagctggcttgcctcccagcaggcggtttttgcatgtttcgtcctatggattgctgcggtaactgcggttgtttatatcctgccggggtttgctacggcacgcggtgtgaggaatgaactgcacgtatgtgtccattttattactagcttatcac

SEQ ID NO: 4914 - DNA, 427 bp, Triticum aestivum
  Clone ID: LIB3281-018-P1-K1-F11
caaatcccccaccttcttccagcactacccaacgcacccgcaaatcccccactctcccgaacaagcgatggcccccaaggcggagaagaagccggcggcgaagaagcccgcggaggaggagcccgcgacggagaaggcggccgagaaggccccggcggcgaagaagcccaaggcggagaagcggctgccggcgggcaagacggcgtccaaggaggccggcggcgaggcgaagacgaggggccgaaagaagggcagcaaggcgaagaagagcgtggagacctacaagatctacatcttcaaggtgctgaagcaggtgcaccccgacattggcatctcctccaaggccatgtccatcatgaactccttcatcaacgacatcttcgagaagctcgccgccgaggccgccaagctcgcccgctacaacaag

SEQ ID NO: 4915 - DNA, 425 bp, Triticum aestivum
  Clone ID: LIB3281-018-P1-K1-F12
gaagatagcaatctagccattgcagacttgtgtttgacaaatgatgactcactggttgctgtagctattcaaagtttgaatggcataatgctcttagcatgtgatctcgtagcgaagaagttgtcttttctgaaggtgattacgacggaaaagagctacattcccactagcttagcctacagctcatccgcagatcttctgtggactgtcatgggcgcatcaaacatgcctaaccaggccgcctcccagttactaacccgtgtcagaatcatcccccgctcccagaaggatctatcagccgaccctgcggtcctggaggacagcgaagtaccacatggcgagaagcttctgctggcgctgcagggaagccttgacgcctcaaagcaggaggaggtgctggcggcggtgctggccgccctcagagt

SEQ ID NO: 4916 - DNA, 433 bp, Triticum aestivum
  Clone ID: LIB3281-018-P1-K1-F2
atcccttctggatcagcagtagaggtgcagttccgttcatatttccttgcggctaaaaaaatggaggagtctcctagcctgttccaagatggttcaactagccagacaccacctattgaaactcccactgtcgatgcagctgcgacagggcggcaggtagctactccgccaaggcctgctcaagttaaagtgatggaggagaaagcagtttcttctttgcccaagccaagtactgaacaacgcagatcaagaagggtgctcgttcggcctagtcttgaacgaattgaagagccccaggctgatgcggctacaccagttgtcgatgtttctgcagtacaggagaaaggtggcacatcgacagaacgaggttccacagtagttcaggaaaaaggtggcccatcactggagcgtgaaacttttggcagtgtgtctg

SEQ ID NO: 4917 - DNA, 439 bp, Triticum aestivum
  Clone ID: LIB3281-018-P1-K1-F4
cacgcctccggccacgcacaccgccgatcgcgagggtctctcgtatcctgacaggctccagctaccactaaaacgggagagagagcgacgccggcacctccctccagcggagctcgccgtcgtccatggcctccccacaccctcctgctccgcccgctcctactccctccacgcctaccgcacaccattgccgatttcccaaaccagaccgcctccccggttcattccttcctcccctcccacccacccgtctcggcgccgccacccaactcgccgacgaccttacgcatcgccgccgacctacgctcacacccgctgccccaccctctccacctgcccttctccccctaccccggtagcacccaggccaacaacacatgcagcagcaagatccaagatctagcaagctggcctatgcctcaccggaggcgcacacgca

SEQ ID NO: 4918 - DNA, 253 bp, Triticum aestivum
  Clone ID: LIB3281-018-P1-K1-F5
cgcaccggcaggcccgggacgaccgacgcgtccgagcgccccggaaagaacacacacatttacagtctcaggcagagaggataggcaatggctaccactaagatgggggctgtggagatcctggcggcgcttatgatgatggcagcatgggagccgacttcggcgcacgcctcccagcatgctggcggcaagaaagatggagatgcctcgcctcatggatggcctgttggagagatcaaagcagtgttgccta

SEQ ID NO: 4919 - DNA, 405 bp, Triticum aestivum
  Clone ID: LIB3281-018-P1-K1-F6
cggacgcgtgggttctattctgactttttgttgtatttcaggacccttctcttacgatgattcaggatgctgtccaggagggactgaaatctgatgctctgaagctcgtggtccaagctgcagtcgatgagggtctcaaatcgcaggatgctctaaagcataccattgaactggcagttcaaaaggcattgaaatttgacgtggaaggacccacgaaagctcaggccatgggggtttacagtgcgtccagttcggcagatccccttcccaagagcgacgcagcctacagcacttcaggatactggccggccgatccccttcccaagagcactagcgcctactgcctttctggatccagggtttccaggtctgcggatctccttatcaagagctctgctgcatact

SEQ ID NO: 4920 - DNA, 416 bp, Triticum aestivum
  unsure (1)...(416): unsure at all n locations
  Clone ID: LIB3281-018-P1-K1-F8
cggacgcgtggggtgtcgaggaagttaacacatgaagtaatcatatgattctaccatgacttagtgctgcacatatgtagaggtagttacgcagacatctgttctaccaaggttcttacttatatgcacttgtacattctgttgttatagttgattgaaatgctctaacttatggtttgccatatggccatggattgtatatagtttggtttcaacactcccaaataataaatggntcctttgattgtttttgtgtttcatagcaaggattaaataattagaacccaaaagtgagtttcaggatttgtaatgaaatcctatttgtcgccttatgtagaggcagccatgacgctctctgttgctaatataccacaactaattttacaactcaccccaggcgtattccttatgagctg

SEQ ID NO: 4921 - DNA, 428 bp, Triticum aestivum
  Clone ID: LIB3281-018-P1-K1-G1
cggacgcgtgggtccgcgagcagctggtgcgcgcgcggagctgaggccatggcgatggcgaaggccaaatccaccgccctctccgccgccgaaaagtgccggaacatcctgggcgccagttgggaagcccacctcaacaccatcaaagccgacgccaagggaagcaagggggacgtttacacgtccagggtgcactacatggtccaaaagggcatgccctacctgatcgtccccgagaacgacatgcacaacattaacattataatcgacgagcggggttctctctcggtgtccagtccagtcccaggtcgccttgccagcttgctcaagtcaatcaacaagttgcctccccgggttgctatgaccggcgatgtcctgcgcatgaaaggagacaaagatccagttatagcttgaagctttaagaaagc

SEQ ID NO: 4922 - DNA, 409 bp, Triticum aestivum
  Clone ID: LIB3281-018-P1-K1-G10
gccccaaccccatgactgtgttctggtccaagatggcacagagcatgactgctcgcccaatgaagggaatgttgacaggccctgtcacaatccttaactggtcttttgttagaaatgaccaaccgaggtttgagacttgctaccagattgctcttgcaatcaagaaggaggtcgaggaccttgaggctggtggtattcaggtcatccaaattgacgaggctgctttgagagagggtctgccactccgcaagtctgagcatgctttctacttggactgggccgtgcactccttcaggatcaccaactgcggtgtgcaggacaccacccagatccacacccacatgtgctactccaacttcaacgacatgatccagtccatcatcaacatggacgctgatgtgatcaccat

SEQ ID NO: 4923 - DNA, 429 bp, Triticum aestivum
  Clone ID: LIB3281-018-P1-K1-G11
agcaacctgagcgagacctgcatgtaacaaacactcgtcggctagcggccggtcggcatcgattttgggtaccggtggacgctatggctgcgaaaggcaggaccgacatggaggtgggcggcgatgctgttcacgccatgaacaaatacaatctactagtcaactctctctgcattgatgtactgctaagatgaaagtgaaagttatatacaagctcttcagagtacacaagtcaaagctattgctgttacatggaaaggacggaaattgtctggaggatgctatagtagttcctttcgcgatcgctacaggaggagaatggaccaggcaaacgttgcctacatatcacatagacattctcactgtacttcagcaaggaacaacatagccatcaggggctgcaactgatggtctttgtcttgctggagt

SEQ ID NO: 4924 - DNA, 426 bp, Triticum aestivum
  Clone ID: LIB3281-018-P1-K1-G3
tcgcggacgcgtgggcacggcgcacggttagctcagttcagtacagcgaggggaaggagcactggggggacagtagctagcgttgcgagttccccggccaatggcaatggcgtggtggaagaacggcgccttggtcgccgcggcgaccctcgccgtggccgcggtggtctgcgccggcgtggcggcggcggcgagcaagttcgacgacgtggtgcagcccagctgggccaacgaccacgtcctctacgaggatgacctcctcaagctccgcctcgacagctcctccggcgggggattcgcgtccaagaacaagttcttgtacggcaaggccaccgccgacctgaagctcgtgccgggggactccgccggcgtcgtcacggctttctatgtgactgtcgtcggcgggggacaagcacaacgagttcg

SEQ ID NO: 4925 - DNA, 265 bp, Triticum aestivum
  unsure (1)...(265): unsure at all n locations
  Clone ID: LIB3281-018-P1-K1-G4
cggacgcgtgggcacagntcacgttttgctcttttcagtacagcgagagaaaggagcactggggggacagtagctagcgttgccagttccccggccaatggcaatggcgtggtggaagaacggcgccttggtcgtctgtgcgacccttgccgcggccgctgtggtttgcgccggcgtggcggcggctgcgagcaagttcgacgacgtggtgcatcccagctgggtcaacgaccacgtcctttacgaggatgacctccttaagctc

SEQ ID NO: 4926 - DNA, 431 bp, Triticum aestivum
  Clone ID: LIB3281-018-P1-K1-G5
cccacgcgtccgcttcttttctttaggttttatgtgtattctttctgtacatctggtgtgctgcgacggatccagcagatccaggggtcttcaaatcaaagaagtaccaaagattgtatggaggctgcaagcataggcgcctgaaggagtccatacaaggtgtttcagatgttggattacgactagagggaactggagaaaagagagaacatgaggttgctgatgctaatgaaaagtcaatgactgaactgaagaacaaaagctcatcttgctgcagtgcaattttctctgcatttctccttatattccgccctctttcttttgttttttcctgctgccaatcacgtgaatggtcctctgagcagcaagacagtgaagatgggatgtttttctgcagcctttgtgaagtcgaggtgttgaagtacagtaag

SEQ ID NO: 4927 - DNA, 302 bp, Triticum aestivum
  Clone ID: LIB3281-018-P1-K1-G6
gccagcccggccgtccgctcccggtcgaccccgccatgaactaccgcttccagaacctgctgggcgcgccataccgcggaggcgacgccgtcttcgcgggagactcctccgtgctcctatcggcggtggggaaccgagtcgcgaccaccgacctagtcgcctgctcctgcctaacgctgcgattcgagtcctccgccaacatagaccgcactcgcacctcctgcttggacgacttgctcctctgctgcgacgagaagggccgcgcgctatacaccaaccttcgacgacgcgccgtcctacac

SEQ ID NO: 4928 - DNA, 395 bp, Triticum aestivum
  Clone ID: LIB3281-018-P1-K1-G7
cccacgcgtccgagaagatcgagcgagcgagaaatccccaatccccaccaaaccctaacccaaaccctaaccctgattgaaacgaccaggagaggagaggagaggagcggatccggcgatggccgtcgagaagatgcacttgtccatgccgttgcccgccggcttggagggtttccccttcaccacgttccaggcggagctggaggccttcaccgtcaagttgagggcggaggcgaagaaggccaaggccaagccggaggtcaaggaggccaaggccaaggaggagaaggccaagccggaggtcaaggccaaggtgaagaaggccaaggcgaaggaggccaagccggaggtcgaggccaaggcaaaggaggccaaggcaaaggaggccaaggcga

SEQ ID NO: 4929 - DNA, 406 bp, Triticum aestivum
  Clone ID: LIB3281-018-P1-K1-G9
acccacgcgtgcgtggacgcatccgatccatgccatctatctacgcccacgaaacacaaacatgcagatactcaacgagcagctggctgcaccatccacaggcctaatggtgaaggagtctgcgtccccggggtcggggtcgggatcggcagggggggctgctgagaagatggggagagggaggatcgagatcaagcgcatcgagaacaccacgaaccggcaggtcaccttctgcaagcgccgcaacggcctactgaagaaagcgtacgagctctcggtgctctgcgacgccgaggtggcgctcatcgtcttctccggccgcgggcgcctctacgagtactccaacaacagcgtgaaagcaaccattgagagatacaagaaggcaacaagtgacaccttcagcgct

SEQ ID NO: 4930 - DNA, 300 bp, Triticum aestivum
  Clone ID: LIB3281-018-P1-K1-H1
gccgtgcacgcgtccgatcgatgccatatatatacgcccacgaaacacaaacatgcatatactgaagaggagatgactgaacatcccaagaagaggagcgcctgataaaagagaaggaagaaaagagaattaaataagaagctggagcacatgcaaatgagggaaacaaagcagatcgagatctagcggaagcagattctcaggacactaatgagaaggcacaagaagatgaaagcaaggtctttgaaataaggatagaaatttacgggccatgacaatccctggaggcactgagagaca

SEQ ID NO: 4931 - DNA, 389 bp, Triticum aestivum
  Clone ID: LIB3281-018-P1-K1-H10
cagcaacatcaaggagttcctaaatttgggaactgggaggacgaaggccaaggctacacgcagtacttcgaaaacgcccgcatgggcaaatctccggggaggcctgtcaaccaaaacgatcgcaatgaaggcgctgcacaggcaccctcgaacgacccgccgtcggtcaaggcctcccccttgaggccggggtccgagccggggctgcggaagaacagggacgaaaggcgtgccacccgagaagacgacctccgtcgccacgaggccgctgcccggaaaacgcatgccgagtcacctaaccacagatatggtgaccagaccaactacgacggcgctgcaaggaaagcaagcaatgagaggtcacccattccatcctcgcagcaggcaag

SEQ ID NO: 4932 - DNA, 377 bp, Triticum aestivum
  Clone ID: LIB3281-018-P1-K1-H11
gagaactccatggcagtcgagggttccagcggcggcggcggcggcggccggaaaacaccgttgcctcataacccaagagagcgcggagcggcgaaattcctcaccggcttgccatcgcgaggaaacttctcctcaagttccatctcttccaatctgggaggcctcagggtttatgtctgcgagcacgacacaaatcctccagagggacaagtgatcgagacggatacgacaaatatcttaatcagacatctgcaactaaagaagaaagagagtgaggccaaagacgcaggttctaggactccaggggaaagtggcaagggtaaaagatgtgctgccagaagtttgggtgtgcaaaagtcatcaaaaaagcccaactt

SEQ ID NO: 4933 - DNA, 392 bp, Triticum aestivum
  Clone ID: LIB3281-018-P1-K1-H12
tagccatctcctctcgccccagccctcgtcgagcgcgcgcgttccaggagcttccggtgccggcggcgccatggcttcggagaccgagaccttcgccttccaggccgagatcaaccagctgctctcgctcatcatcaacaccttctactccaacaaggagatcttcctccgtgagctcatctccaacgcctccgatgcgttggataaaatcaggtttgagagcctgactgacaagagcaagctggatgctcagccagagctgttcatccgtataatccctgacaaggccacgaacacactcacacttattgacagtggtattggtatgaccaagtcagacctcgtgaacaaccttggtaccattgcgaggtctggcaccaagggatttcatg

SEQ ID NO: 4934 - DNA, 160 bp, Triticum aestivum
  Clone ID: LIB3281-018-P1-K1-H2
tcgcggacgcgtgggttcgattatacatgtttaaatttagattccatgggaagcgctggacaggctgttaacgatttaacaagtacagatgaagatgacatcgaccaacagctgctttcagaagcaaaagcggcatgggctcaacacgagtggaccatcc

SEQ ID NO: 4935 - DNA, 409 bp, Triticum aestivum
  unsure (1)...(409): unsure at all n locations
  Clone ID: LIB3281-018-P1-K1-H3
gggcattaccaagacggnnatcccgaggctgttactgagcaaaccatgcgaaattctttagcagattgattgacctgcgacgaagcacacgaggcaattcattgcacagatgattcatgctgcgcaaggatgcgctgaaccaagtcccagatgagcacaaaattcgatcggaccggctctgacgagaactatgttagtactacatgctaagcttagatgcatgtattgtttcagaaggaatggtgtgccagtgatcagatcatgtgctaaggcctgtgtaacctctattcagcgcctccgttatgccggatttctcttgaattgtcgtagtttcatacagtatatccttctgttggggaattatgtgcttagtatactacttaagattacttttcggatttgtgtgatt

SEQ ID NO: 4936 - DNA, 350 bp, Triticum aestivum
  Clone ID: LIB3281-018-P1-K1-H4
cggacgcgtgggcggacgcgtgggctgacgcgtgggacacaatccaagccaatcccaccggagagaagagaagatgtcgggccgcggcaagggaggcaaggggctgggcaagggcagacccaagcgccaccgggaggtgctgcgcgacaacatcctaggcatcaccaagccggcgatccgtcgtcttgcgcggcgtggcggcgtgaaccgcatctcggggctcatctacgaagagacccgcggcgtgctcaagatctttcttgagaacgttattcgggacgccgttacctacaccgagcacgcccgccggaagaccgtgaccgccatggacgtcgtctacgcgctaagcg

SEQ ID NO: 4937 - DNA, 435 bp, Triticum aestivum
  Clone ID: LIB3281-018-P1-K1-H5
cggacgcgtgggtttctttctcctttcgccgttgcctcctcctcctctcacccaaaccctaatcccctctcccccccgcgagccgaggccgcgggcgcgcaggcaggcgcgggtgggcaatggcgggcaaggaggacagccggatcttcgtgggcggcctctcgttccacaccgacgagcgcaagctcgaggacgccttccgccgcttcggcaaggtcgtcgacacccagatcatgctggagaggcacacaaaccggcaccgtggctttggcttcgtgacgttttcagatcccagggcagttgagactgctatcaacgacatgcacaacaaagagttagatggtcgtaccatttcagtgaacagggctgagccaaagatgcaaacagatgacacacggtacagcagtggtggtggccgttgtgaccgtggggatt

SEQ ID NO: 4938 - DNA, 415 bp, Triticum aestivum
  Clone ID: LIB3281-018-P1-K1-H7
cggacgcgtgggcaaaactgaaggtgtgaagagaagatactccaggggcttgtcgacaagctcaaagagcaaaagagattaatagaaaaggcagaggaagaggagcgcctaataaaagagaaggaagaaaagagaattaaagaagaagctgaaaaacaagcagctgaggaaaacaaagcacctgatgcctctcaggaagcagattctcaggacactaatgagaaggcacaagaagatgaaagcaaggtagttgaacatcatgatggagatatcacggaccatgacaatcactcaccagaaggcgagacatctgttgaagtgcctgacattaaagctgggactggagatgatgaaccaccggtggagacatctgcagtacctaccgaggagcaggaccctacttctgtcaactctg

SEQ ID NO: 4939 - DNA, 346 bp, Triticum aestivum
  Clone ID: LIB3281-018-P1-K1-H8
cggacgcgtgggttcgattatacattaaaaataaagattccatggaaagcgctggacaggctgataacgatttaacaagtacagatgaagatgacatcgaccaagagctgcttgcggaagcagaggcggcatgggctcaacgcgagtggaccatccagcacgtcttgttcccgtccatgcgacttttcctcaagccccctaagtcgatggcaacagacggaacattcgtccagattgcttctctagacaagctttacaagatcttcgagagatgctagccgacacaaaagcagccggtcgcacgatatgtagagaaagaagggagagcgcgaccgaccgacgcctt

SEQ ID NO: 4940 - DNA, 367 bp, Triticum aestivum
  Clone ID: LIB3281-018-P1-K1-H9
gcggaaggttaggccgaggctgtcactgagcgaaccatgcgaagcgcatgtgggggctcatctacgaggagacccgcggcgtactcaagatcttcctcgagaacgtcatgcgggacgccgtcacctacaccgagcacgcccgtcgcaagaccgtcaccgccatggacgtcgggtacgccctcaagcgccagggccgcaccctctacggctttggcggctgagcgccatcagctcgctggctgaccctgctgtttcctgcgttgctctgtagtcgtatcccccctgtcgtgaatctagtgcgctggctatgcttgtttctcgagtttgactagtgaaatgcaacttctagttggaactcctatcggtt

SEQ ID NO: 4941 - DNA, 409 bp, Triticum aestivum
  Clone ID: LIB3281-019-P1-K1-A1
cggacgcgtgggcggcatctcctccaaggccatgtccatcatgaactccttcatcaacgacatcttcgagaagctcgccggggagtcggccaagctcgcccgctacaacaagaagcccaccatcacgtccagggagatccagacctccgtccgcctcgtcctccccggcgagctcgccaagcacgccgtctccgagggcaccaaggccgtcaccaagttcacctcctcatagactgaagatgcgtccgtcgcctgtagttggtctctgtatctgcacctgtactgtcgactctgcttgtctctctgcaagtagtgctggtagtctgctgggtgatcgccaacgctttgttggctaattaattggttgtaagaactgaagttgttgtgtttggcagactgatatatctat

SEQ ID NO: 4942 - DNA, 377 bp, Triticum aestivum
  Clone ID: LIB3281-019-P1-K1-A10
cggacgcgtggggcaaaaacatccagtcatccatcctacgatcccaatggcccacgtcctcgccgccgccgagcccctcaccctcctcaagcgcccgcccccgcagaacgatggcttcggcgacgacaacggcagcacggaggagaaggcgcccaaggcgcgccgccgggagtccgaccccgcggcggcactggccgcggcccggcacgagttcggcgagcacggcggcgtgaacatgtccatcgaggcctcggccacgttcaccgtgatggagccggacaccatgcgccggctcttcacgggggagctgggcccggggcgcggcgacctgtacaatctacagccgccacttcaaccccgatggtgctggccgctgg

SEQ ID NO: 4943 - DNA, 391 bp, Triticum aestivum
  unsure (1)...(391): unsure at all n locations
  Clone ID: LIB3281-019-P1-K1-A11
cggacgcgtgggcggacgcgtgggcggacgcgtgggcaggaaagaacacacacaggcacaggcacaggcagagaggagaggcaatggcgaccactaagatggcggtggtggcgatcctggcggcgctgctgctgatggcagctgtggagccggcttcggccacgccgcccagcatgctggcggcaagaaagttgcagatgcctcgcctcatggatgtcgtcttggcagagtcaaagctggcttgcctcccagcaggcggtttttgcatgtttcgtcctatggattgctgcggtaactgcggttgtttatatcctgccggggtttgctacggcacgcggtgtgaggaatgaactgcacgtacgtgtncattttattactagcttatcacgca

SEQ ID NO: 4944 - DNA, 234 bp, Triticum aestivum
  Clone ID: LIB3281-019-P1-K1-A12
atttcataacaagtgcttgctatatgtgaacgtgggtgtgcatatattgggcattttatctcagaccctactattccccacccagccatatcgccttctttctctttgtttatctcaaggtcacaaaactaatcatgatttaatctatcctgtggtcatggcatcgctactgattagatctaaatgttggtcctaactagcgctactcattcttgtacaccatataggtggaaa

SEQ ID NO: 4945 - DNA, 400 bp, Triticum aestivum
  Clone ID: LIB3281-019-P1-K1-A2
acccctcacgcgtccggcgttaacccattttgaagttctgattgcaattcatgatattaatccagaaaaggacaaagttcctctaaagaaggtcatagatgcttgtactgcttgctttgagcagcgcacggtatttactcagcaagttctagaaaaggcactaaataaattggtcgacaatgtaccgattcctcttctttttatgagaacagttattcaagcactcgatgctttcccagctttggttgattttgtcatggggatactttccaggcttgtcaataagcagatctggaaaatgccaaagctgtgggttgggttcttaaaattggcataccagactcaaccacgctctttcgatgttttattacagttacctccaccacagcttgaagttgca

SEQ ID NO: 4946 - DNA, 248 bp, Triticum aestivum
  Clone ID: LIB3281-019-P1-K1-A3
ccctcgcccaaaccctcgccgccgccatggccgccgccacctcccccgccgtcgcattctcgggcgccaccgccgccgccatgcccaaacccgcccgccatcctctcccgcgccaccagcccgtctcgcgccgcgcgctccccgtccgcgtcgtgaggtgttgcgccttgttctttgcctcctcttggggggtgcctttttcaggtgctcttccttcgtgctgcgggtgcagctcgcccgcggtggcg

SEQ ID NO: 4947 - DNA, 396 bp, Triticum aestivum
  Clone ID: LIB3281-019-P1-K1-A4
agccggtgaattcctgcatcttgagaaacctgtaaagaattggaggggggatcacttctggttctacaactttgggtttcacccattgacagaggattacaggattacacactgtcttggtgatttcatcgagggtcgcccttgcctgcgtaataataacagattcagcgtcattcaagtttacacgcttggtgatgagaaatggagggatatcaaaactccagaagccctaagcttaaactgtgtaaaaaactctggagcggtcactattgacggaacactgtattggctaattgaagacatggtagccagctggcagcatgcagttatgaccttcgatctctgtggagaaagttttgcacagatacaactgccagcaactaaacctgaagattt

SEQ ID NO: 4948 - DNA, 401 bp, Triticum aestivum
  Clone ID: LIB3281-019-P1-K1-A6
cggacgcgtggtagacagcggccagagaagaggaactgaaaagaaaaaacggggaagaaaaaggaggcaagcagtgcacaggtctagtggaaaatggcggaggcggcgtgctcgacctagggcacgtagctcacgcgcagctcatcgttccccgtcgcgttctccagagaccccgcgccgtcggcggcgaccaccagctcccccgtgcggcggctccgtgtctccacccgtctcgttctcccgctagggtttcccccgatccccaatcactagtttgcgaatggcttcatcacagcatgttgaagtggaggctgcgaagctacttcaaaaactcattctggaatcaaaggatgagcccgctaaattagcaacaaaactttacgtgatatgtcaacatatga

SEQ ID NO: 4949 - DNA, 295 bp, Triticum aestivum
  unsure (1)...(295): unsure at all n locations
  Clone ID: LIB3281-019-P1-K1-A7
cggacgcgtgggaatccatcttttcatccgcattcatctcctttgagcagctcctctcctctccattgtttctctgctcgaagatgaagctctccatgcagtcgctggcccggaagctctccatcccgtcgcccaagcggggcaagaagcagcagcagcagcaggacggcggcaagcgcggcatctcccggagcgaggcgccgtcgttcgcgtcggcgttctcctcctccaccacctcgtcctnctncgaggacgcgctgccgcgggcgtcgacgccgcggtcggtgctgcccgc

SEQ ID NO: 4950 - DNA, 211 bp, Triticum aestivum
  Clone ID: LIB3281-019-P1-K1-A8
cggacgcgtgggaatccatcttttcatccgcattcatctcctttgagcagggcctctcctctccagggtttctctgctcgaagatgaagctctccatgcagtcgctggcccggaagctctccatcccgtcgcccaagcggggcaagaagcagcatcagcagcaggacggcggtaagcgcggcatttcccggagcgaggcgccgtctttcgc

SEQ ID NO: 4951 - DNA, 408 bp, Triticum aestivum
  Clone ID: LIB3281-019-P1-K1-A9
gccggaggtccgctcccccgcagctcggctcccccgcagctccccgcatcgccggagctctcccgccccacgcctcccccaccccacgcctcccccgcagcttccctctccttgttcccctcctccttccccatggtgatccccgacgagaagaagactgattttttctttcgatctgctcggcggcggccatttccaggtcctcctcctcggcgctgcggcggcagctcgcccgcggtggcggagcaggcgagtagcagcagtgggcgcgcgagcatgcggcgaaggaggtcaccttcggcgtcggcgcgcacgccaccatgccgcggtgcgtcaacgacctcgcggacgccgtcaaggtcaccatgggccccaagccaacagcagcagcagaggcaatcagtagtc

SEQ ID NO: 4952 - DNA, 219 bp, Triticum aestivum
  unsure (1)...(219): unsure at all n locations
  Clone ID: LIB3281-019-P1-K1-B1
ttntannttnttganaaatatgttctttctcttagaaaaatcatttttataagagggggggttttaacaattgggggtgttttttccctaactaatattatcaccgggaaaataaaaaggcggggaagaagaccccctacattcataaaaaaggcttggtcaacaaacgattttttttcttcccccccggtttcatcacatacccaacgaggggggggg

SEQ ID NO: 4953 - DNA, 386 bp, Triticum aestivum
  Clone ID: LIB3281-019-P1-K1-B11
cccacgcgtccgcccacgcgtccgcccacgcgtccgcccacgcgtccgcccacgcgtccgcggacgcgtgggctccaccaagagtggtgatgagctgacgagcctcaaggactatgtgaccaggatgaaggagggacagaacgagatctactacatcactggtgagagcaagaaggctgtggagaactctcccttccttgagaagctgaagaagaagggctatgaggtcatctacatggttgacgccattgatgagtatgccattggtcagctcaaggagtttgagggcaagaagcttgtctctgccaccaaggagggtctgaagcttgatgagagcgaggacgagaagaagaagcaggaggagctcaaggagaaagttgaggggc

SEQ ID NO: 4954 - DNA, 332 bp, Triticum aestivum
  Clone ID: LIB3281-019-P1-K1-B2
cccacgcgtccgcccacgcgtccgcccacgcgtccgcccacgcgtccgcccacgcgttcgcgaggacggggtcctcaaggtcgcggactttggtcaggccaggattcttcaagaacagccatctgatgaaccggaaatttctgctgctcaagagccagagacactcactgcagctgattacctacatgagattgaccaactccgggccaagtccacttatggagatgttgacagaatgagccttcaagatggaaacacctcctgtcttgccacttgcagcacagctgacatcgacgatgatccatttagagcctcatattcgtatgatgctg

SEQ ID NO: 4955 - DNA, 404 bp, Triticum aestivum
  Clone ID: LIB3281-019-P1-K1-B3
ggaggagtcagagcgtgatgcatttgaggggtgtagcggtggagtggagatgaactggggtattggggatgagaaggggggcgaggggacgacacattgtttacagcaatgtgactttccaggggtggagtttgagaatttgaataaagggaatgttgggatgagggatggtgtgagctttgatgatggattcaaaatgggctccttgcatgggatggagtcaaacctcctccaggctatgaactcagatcctgcggcatataatggcacggagaatgcacatgacctgtcctctggaaatttcttggctatgggggctgatgcacataagaatggagtggacctgggggccggcaattcatttttctttggcaataataatgggaagaggcatgttgaggata

SEQ ID NO: 4956 - DNA, 171 bp, Triticum aestivum
  Clone ID: LIB3281-019-P1-K1-B4
cccacgcgtccgcggacgcgtgggtgaagctgaccggatgctcgatatggggtttgagccacagatacgcaagattgttgagcagattgacattccccctcgttgggtgaggcagaccatgctgttcagtgctactttttcaaaggagatacaactcctggtattagattt

SEQ ID NO: 4957 - DNA, 373 bp, Triticum aestivum
  Clone ID: LIB3281-019-P1-K1-B5
gttgtactcctggaaatactgaggcaaccactttagaagcaagcagaaaccctatgaggcgtcaggttgctaatccaacaaggcctacaagaacgctgacctctttgactcgtgctgtgaggagagggggtgaaaatgcaggagccgatggcaatgggaattctaatgacttctcaacaaagttactccatcttgcgtggcacccaactgagaattccattgcgtgtgctgctggaaatagcttgtacatgtattatgcatagggaatgtgctagagaagattcactgtttttggtttgttcaacgtgaaagcttgggccttgcacatgcaatcaggaaaatggtcgtcaattccgtgattgggggttgaaag

SEQ ID NO: 4958 - DNA, 377 bp, Triticum aestivum
  Clone ID: LIB3281-019-P1-K1-B6
cggacgcgtgggcttggaggaacatgtgctattcctggagctttcggttgtggaaaaactgtcattagtcaggctctctcaaagtattccaattccgacactgtggtgtatgtgggctgtggagaaagaggaaatgagatggctgaggtccttatggacttcccgcaattgacaatgacgttgcctgatggacgtgaagagtcagtcatgaaaagaacaacacttgtggctaacacctccaacatgcctgtcgccgctcgtgaagcctccatttatacaggaattaccattgctgaatacttccgtgacatgggctacaatgttagtatgatggctgattccacgtccaggtgggccgaaacattgcgtgaaatttc

SEQ ID NO: 4959 - DNA, 285 bp, Triticum aestivum
  Clone ID: LIB3281-019-P1-K1-B7
gttggagcaaccagggcagtataagcaaagaaaatcatttggaaaaaaagggaagcaaaaacaattgggggtgttttggcgcgaactaatagaagcacggggaaatgaaaagggcgggaaagcagcccgccaacatccagcagaaagcctcgccaaccgatctctcttctcctcccccgctgtcttcacatccgatccgaggcgaggcggcgatgcaaatccaagtccggtgcgggtgcggcgaggcggcctgccccgagtgggcggtggtggaagtgcaaggcg

SEQ ID NO: 4960 - DNA, 443 bp, Triticum aestivum
  Clone ID: LIB3281-019-P1-K1-B8
gtcagaccgtgctttgccaacccaccgaaggaaaggctaggctcagggagggatgctccttcgggcggaagggcgactaatctacactcctgtttatgtgaaaaaagaacacaccccgtaaattacttttttaaaaatcatattattaacccccgtgacccccctcaaattttgtttatataattcatgtgtcacaataactaacccttggacagaagtgggtttactatttgtttatatttattccccctcttttttttttgtttgtgaaataataacctttttttttcttccctttttttaatattgttagggatttcttatataattacataaaataatattttcctcttcttttttttttttaaaacttatatatttcactttttttatgatatatctataatttttttttttttttttgtttgggaacatttaaaatt

SEQ ID NO: 4961 - DNA, 288 bp, Triticum aestivum
  Clone ID: LIB3281-019-P1-K1-B9
gccagacggtgctttgccaacccaccggaggaaaggcgaggctcaccgagggatgctccttccgccggaagggcgactaagctacactcctgtttatgtgaaaatgaagcccagccgaaccttacttttcaagtaactagttatccccgatgtgtactggtcaaattttgttaattatgcttgcccatttgccagcctgaacgttgtagcaacgtgttctatgtcatgcacttttgatttgccaaaaaaaaaaaaaaaatgaaaaaaaaaaataacacagggcgtgac

SEQ ID NO: 4962 - DNA, 392 bp, Triticum aestivum
  Clone ID: LIB3281-019-P1-K1-C1
gctctcccaatcttcttaggttagggttaggctaggggcttcacagagctcgcggaaatggtggccttcaggttccatcagtaccaggtggtgggtcgtgcgctgccgacgcccggcgatgagcagccgaagatctaccgcatgaagctctgggccaccaatgaggtccgcgccaagagcaagttctggtatttcctgaggaagctgaagaaggtgaagaagagcaacggccagatgctcgccatcaacgagatctttgagaagaacccaaccacgatcaagaactatggcatttggctgcgttaccagagcaggactggctaccacaacatgtacaaggagtaccgtgacaccacactaaatggtgccgtggagcagatgtacactgagat

SEQ ID NO: 4963 - DNA, 353 bp, Triticum aestivum
  Clone ID: LIB3281-019-P1-K1-C10
gagatgcaccacgagtctctcctggaggcgcttcctggtgacaacgtcgggttcaacgtcaagaacgttgctgtgaaggatctgaagcgtggctttgttgcatccaactccaaggatgaccctgccaaggaagcggccaacttcacctcccaggtcatcatcatgaaccaccctggtcagatcggcaaccgctaccccccagtgttggactgccacacctcccacattgctgtcaagttcgccgagctggtgaccaagatcgacaggcgatctggtaaggagctggaggcgctgcccaagttcctgaagaacggtgacgctggtatcgtgaagatgattcccaccaagcccat

SEQ ID NO: 4964 - DNA, 392 bp, Triticum aestivum
  Clone ID: LIB3281-019-P1-K1-C11
gttcgggccaccagggactggcaagacaatgcttgctaaggctatagcaaatgatgcaggtgccagcttcatcaatgtgtcaatgtccaccatcacatccaaatggtttggggaggacgagaagaatgtccgagcattgttcagcttggctgcgaaggtggctcctactatcatctttgtggatgaggtagatagcatgttggggcagcgcgctcgctgcggtgagcatgaggcgatgcggaagatcaagaatgagttcatgagccattgggatggtatcttgtcgaagtccggtgaaagaatccttgttcttgccgcgacaaatagaccgttcgaccttgatgaagcccatcataggagatttgagcgcaagtctgttaaatgcagcattt

SEQ ID NO: 4965 - DNA, 338 bp, Triticum aestivum
  Clone ID: LIB3281-019-P1-K1-C12
gtgacgcccaccatggactggcatgacaatgcttgctacgactatggcaagtgatacatgtaccagctttatcaatatgacaatgtccaccgtcacatccaaatggtttggggaggtcaagaagaatgtgctatcatcgtttagatttgctgcgaaggtggctccaactatcatttttatagatgaggcagatagcatgcatgggcagagcgctccattgtggagagcaggattctgattccttatgaacttatttatgcaattttttcgattccatttttcgatttgtattgattcgtgcttaaattctccctgctcgaaagttaattccttttttt

SEQ ID NO: 4966 - DNA, 132 bp, Triticum aestivum
  Clone ID: LIB3281-019-P1-K1-C2
cggacgcgtgggctgagggatgccaagatggacaagagcactatccatgatgttgtgcttgttggcaggtccaccataatccccagagttcatcagctgctgcacgacttcttcaacgtgaaggagctgtgc

SEQ ID NO: 4967 - DNA, 407 bp, Triticum aestivum
  Clone ID: LIB3281-019-P1-K1-C3
atccttgaggaggatgagctgaaaggtgcggttgtccttgtatatgcaaataaacaggaccttccaggtgcacttaatgatgctgccataactgaatcattagaacttcacaagattaagagccgccaatgggcaattttcaaaacatctgctataaaaggggaggggctttttgaaggcttgaactggctcagtaatgcactcaagtccggaggcagctaatgtaggaggcccagcctccattccgtgaatcattgcttgatggtaaggaacagggacgatgacagccttctcgctagtctgcgtgaaaatgagaatctctttatttttactccggaagttatacacaatcagttttctgtagagtgcttgttgaagtttccagatacaacactaggtgtaccatg

SEQ ID NO: 4968 - DNA, 193 bp, Triticum aestivum
  Clone ID: LIB3281-019-P1-K1-C4
ggctccaaaaaaagcaaaaatccacccacgagccttaaggactatgtgaccaaaaagaaagaagaacagaacgagatctactacatcactgaagagagcaaaaaagctgcggaaaactctcccttccttgagaaactgaaaaaaaagggctatgaggtcaactacaaggatgacaccaatgaagagtatgcca

SEQ ID NO: 4969 - DNA, 393 bp, Triticum aestivum
  Clone ID: LIB3281-019-P1-K1-C5
gaaggcgtcaaggaacactgggcctaacccgcaggcatggctagctcgctagccgggccttgtgttgcaaagctatttaatccacacgactctcggcaacggatatctgggttctggcatggatgaagaatgtagcgaaatgcgatacctggtgtgaattgcagaatcccgcgaaccatcgagtctttgaacgcaagttgcgcccgaggccactcggccgagggcacgcctgcctgggcgtcacgccaaaacacgctcccaaccaccctcatcgggaatcgggacgcggcatctggtccctcggatcgcaaggggcggtggaccgaagatcgggctgccggtgtaccgcgccggacacagcgcatggtgggcgtcctcgctttatcaacgcag

SEQ ID NO: 4970 - DNA, 265 bp, Triticum aestivum
  Clone ID: LIB3281-019-P1-K1-C6
gccacaccgcgagtcgcgtgtttgtaatatccgatcgctcctgttacctagctggctggctatgacgtatgagacctcctacagtacgcaccagcctgcaagggcctgcccttccgtggccggccacctacttcaaaggcccaccaacagcactatgggcgcgcagaccgaacattccttattctgatcttcctacagtggacactgatcaagacaatgttgactcggcgggctacatatactccaaaatgcttgaggaggatcc

SEQ ID NO: 4971 - DNA, 331 bp, Triticum aestivum
  Clone ID: LIB3281-019-P1-K1-C8
cggacgcgtgggccggggatcaagttccgcaccgacaacgagcctttcaagacggagatgcagcggttcacggagaaggtggtggcgacgatgaagggcgcggggctgtacgcgtcgcagggcgggcccatcatcctgtcgcagatcgagaacgagtacggcaacatcgacgcgtcctacggcgcgcccggcaagtcgtacatccgctgggccgccgggatggccgtcgcgctcgacaccggcgtgccctgggtcatgtgccagcaggccgacgcgccggcgcccctgatcaacacgtgcaacgggttctactgcgaccagttcacgccga

SEQ ID NO: 4972 - DNA, 392 bp, Triticum aestivum
  unsure (1)...(392): unsure at all n locations
  Clone ID: LIB3281-019-P1-K1-C9
ccaccaccgccgccgctgccataccagcctcgcatcaacgagccatcgtcgtaccagccccgtatcagcgagccatcgccgtaccagtctcgcgtcaacgagccacagctgtaccagcctcgtcgcacggacgcgccgccaatgttcaacatgcagccgccgtaccagcctcgccagagtgacgcgctgccgtccttcaacatgcagccaccgtaccagcctcgccacagcgacgggccgctcgcgctccctggacagccgncgntgccgccgtaccctcctcgtgccggttttcccggacagcagtactctttccgctctgacgacatgccgccggttcactttgacaacaacgccttgcccgtgtgaagaggggggagaaggagttcaac

SEQ ID NO: 4973 - DNA, 400 bp, Triticum aestivum
  Clone ID: LIB3281-019-P1-K1-D1
cggacgcgtgggcggacgcgtgggcacggctcctctcccactcccatcctgctctccaatggcgctcgcctccaccaccgcctcccgcctcatcagccgacgcctcgtcgctcccctcccgcctcctccttcctcttcctgcgccgcgccgcgaggaggagccaggccagggccgcgccggttcgcggtgcgctgggagggcaggccgagagcgctgttgggaggattctcggacgccgacgaagatgtcagcgacgacgaggacgaggaggacggccccggcgcgctcagcggtgggccgccgcggcagcagcaggggtgcgaggacgtcatcgagctcgccgccgctgccttctccgggcccgagcgctgggacgtgctcggactcggccaggccatg

SEQ ID NO: 4974 - DNA, 357 bp, Triticum aestivum
  unsure (1)...(357): unsure at all n locations
  Clone ID: LIB3281-019-P1-K1-D10
tgatcgnnnntttcgcccgcatttagcactgcagaattgaagctttactttgcttttgcaaaatnnnngaagccttagttgagggctgaagcaaagaaagttctgaccaaatcatatgttgtcctccgtagaggtgacagtacttctggtactagggtagcttacaggatgacagataggcaactggaggctctaatcaggctgtcagaagctattgccagaagttgngtggaaagaattgttctccctgctcatgtccgcatggcagttaaattactcaaaacatccataataagtgtggatataagtgaagttgaccttatctgattttcaagatgcacctcttgatcatgatga

SEQ ID NO: 4975 - DNA, 396 bp, Triticum aestivum
  Clone ID: LIB3281-019-P1-K1-D11
acacccttccagatcacacaacggcaccatctagaaaaaaatcacacaccggcgggctcgccgccggccgcctcctctgtcctcttcctgcggcttctcctgttgcccccacctcccccggcggcctgactcttgactcggccagtagcgaaactccgtctccaagttgtttgccgtacgtccatcctgcgccgcgcgacggcgcgccttttcctccccgcttcttcccatcagacagcgtctcctacgcctcctccggtctgcttctctccatagtatttgtcaatcatggtgttcagcaaggtggaagtgaacttgagaaggctgcttgaggcggccccccgccagcagaatcaggctaagcttgtccattacataaccacagccagagagctg

SEQ ID NO: 4976 - DNA, 392 bp, Triticum aestivum
  Clone ID: LIB3281-019-P1-K1-D12
acacccttttagataaaacagctgttctatctagaaaaaaataacagaccggcgggctccgcgacagccgggtcctcagtcctcttcctgcgatttctgctggtgagagcacctatcgcgtcagcctgactcttgactcgctcagtaacgaaactccacctccaagttgtttgtcgaacgttcatcctgcgccgagcgacggcgcgccttttcctcctcagatctttccatcagacaggactttctacgcctactaggggctgcatctgttcataagattcgtcaatcatggtgttcaccaagggggaagggagcactataaggcttcttgatgctgtccccccccaatacaataacgcatagcttgttcattacataatcacacacagaga

SEQ ID NO: 4977 - DNA, 123 bp, Triticum aestivum
  Clone ID: LIB3281-019-P1-K1-D2
cccaccaccaaaaccctagcgccgccaccgccagcacaaccgttgtacttgcaaaccgagcgacagctgcaatggccggcaagggcgagggtcccgccatcgggatcgatctcggcacgacct

SEQ ID NO: 4978 - DNA, 402 bp, Triticum aestivum
  Clone ID: LIB3281-019-P1-K1-D3
cccgcattaagcactgcaaaatggaaccgttcctttgttttgcaaaggctttggaaccttaattgagttctgaagcaaagaaagttctggtcgaatcatatgttgtcctccgtagaggtgacagtactcctggtactagggttgcttacaggatgacagttaggcaactggaggcgctaatcaggctgtcagaagctattgccagaagccatttggaaagaattgttctccctgctcatgtccgcatggcagttaaattactcaaaacatccataataagtgtggaatcaagtgaagttgacctatctgattttcaagatgcacctcttgatcatgatgatgaacagccaatacaaggagatgctactcaacaagatggtgcagatgaaccagcagaggtga

SEQ ID NO: 4979 - DNA, 382 bp, Triticum aestivum
  unsure (1)...(382): unsure at all n locations
  Clone ID: LIB3281-019-P1-K1-D4
ctcttcaccaggtgnnnccagacagtggacgacgaggtgtcagggcttgcggcaggctcgtcgacggagagccccggtcagacccgatcgccgcggagaacgtaggctccacggcggttgcagtggtagtgtgctcctctcatgtagtggtcgccaattgcggcgattctcgcatcgtgctctcgcgcgggaaggagcctgttgctctctcaattgatcagaatcctgacaggaaggatgagcgcgccaggattgaggctgcgggaggcaaggtcatccaatggaatggacaccgagtgttcggcatacttgctatggcacgatccattggtgaccgatacttgaagccatacattatcttaaaaccagaagttacggttgt

SEQ ID NO: 4980 - DNA, 395 bp, Triticum aestivum
  Clone ID: LIB3281-019-P1-K1-D5
cggacgcgtgggcaagaagtcgcgcgtcaaggtgttcctcaagctcgtcaacttcacccacctcatgcccacccgctacaccctcgacgtcgacctcaaggaggtggcctccggggcgcccgactccctcacctccaaggacaagaaggtgggcgccgccaaggccgccaaggccaagctcgaggagaggttcaagaccggcaagaacaggtggttcttcaccaagctccgcttctaggcctgcaggccgaccgcgcagggcgtttctctgccgttactacctgaacccgtttacatttttagctgcttgctcttggtatccgtccctgttttggtaattgcccatgaagactctgtgtttagcgtggatcttatgagatatgatggtgtttcat

SEQ ID NO: 4981 - DNA, 400 bp, Triticum aestivum
  Clone ID: LIB3281-019-P1-K1-D6
cggacgcgtgggcggacgcgtggggggcgtgcgtctcccaggcccgaccggcaggcgcgccagcaggttcaccgtgagggcgtcgtcggcggaggcggaggccgccggccgccgcgcggtccttggtctcatggccagcggagtcgtcggcagcgcgttcgctcaggtggtgcacgccggcaccgtcgcggccatcaaggttggcccaccgccgccgctctccggtggactccccggcacggacaactccgacgaggcaagggacttcgacctgcccctgaagaaccggttctacctgcagccgctgccaccggcggaggcggcggtccgggccaaggagtcggcccaggacatcctcaacctcaagccgctcatcgacaagaagcaatggccgtacgtt

SEQ ID NO: 4982 - DNA, 400 bp, Triticum aestivum
  Clone ID: LIB3281-019-P1-K1-D8
cccacgcgtacgaagctatgaagtctatccatgagccagttcctgaatccgttgcaaaactgtcacgtgaagtacttgatgcagcaccaccacaattaactgatctgataaaacctttcgtgaacttgatcacatcaaccaacagtagccaatctgctgggcatgctgagagttcacctggctcctccaggggtgtgcagcaagcacgggttgatctcaaagctgatggtcagcctaaagttgaggcaagtttgggttcacgacctttgaatgaacgaaaccctgtatcatctgagacaggaggtcttaagagtgtgttggttgaagttcccgctgcagtcatcactgaagcctctcaaggccaccaaggatcggtatattcttctggtgaggatttgct

SEQ ID NO: 4983 - DNA, 241 bp, Triticum aestivum
  Clone ID: LIB3281-019-P1-K1-D9
tcccgcagcaccggtaccgattcccgggtggggcacgcgccacgcctgctttaagactgcagaactgaagcgcttctttgcttttgcaaactcggggacgcctcaattgagtgctgaagcaaactaaagttcatggaccgaatacatagtgtatgtgcctccgatagaggtcacagctgctctagtgctagggttgctcacatgatgaccgttatggcactgcaggcgttcatcaggctcc

SEQ ID NO: 4984 - DNA, 52 bp, Triticum aestivum
  Clone ID: LIB3281-019-P1-K1-E10
cgcaacttatagttgaccccttgagcggcaccacatcgatttctctataatc

SEQ ID NO: 4985 - DNA, 396 bp, Triticum aestivum
  Clone ID: LIB3281-019-P1-K1-E11
gtttcccctccgtcggctgctgaccggattcgcctcacaggctcgggatccgggcgttccgcgcgatgggcggcggcggcggcggcggcgcggaggaggaggagctgacggcgcaggagacagcgctctacgaccgccagatccgcgtctggggcgtcgatgcccagaagaggctaagtaaggcgcatgtgcttgtgtgcggcgtgaacggtactactattgagttctgcaagaatattgttctagcaggagttggcagtttatccttgatggacgatcacatagtcacagaggatgatctcaattcaaacttcctaattcctcatgatgagagtgtgtatggtggtaaatcacgggcagaggtttgctgcgagtccttaaaagatttcaatccaa

SEQ ID NO: 4986 - DNA, 205 bp, Triticum aestivum
  Clone ID: LIB3281-019-P1-K1-E12
gtttcccgtccgtcggctgatgaccgatactgcctcacaggctcgggatggggtcgttccgagcgacgggcgtgagatcatcaccattccacccaggaggaggagttgactgcgcagcagacagccttctaagtccgatagattcgcgtgtggagctcccatcctcagaagaggctgacgaaggcgcataaaccattgtgcgggg

SEQ ID NO: 4987 - DNA, 396 bp, Triticum aestivum
  unsure (1)...(396): unsure at all n locations
  Clone ID: LIB3281-019-P1-K1-E2
cccacgcgtccgcccacgcgtccgcccacgcgtccgcggacgcgtgggcgaggcgagcgagcaacggacggaagcaaacgcaaagggggagggagggaggtcggacgcgccccgccggtttccgtctctccgttcatcccgctcgccgtcgtcgggcggcggcaccgccaccaccatggccatgtccaagccgcagcagggcgaccccgccggcttcctcgacctcgtcggcccggacctctccgcctgcgtcttcgcccgcctccaagaccccgccgacctcgcccgcgccgncaccgtctcccgcccctggcgcagattcgtcgaggggaacggcttcctcaagaaggtgtgcgtccgcaagttcccggagctggccgtcctcacggccgcggt

SEQ ID NO: 4988 - DNA, 173 bp, Triticum aestivum
  unsure (1)...(173): unsure at all n locations
  Clone ID: LIB3281-019-P1-K1-E3
gccacagagcgggagacgccgacgaagaggcacccaagcgaaccgacgcgggcgggggagaacaaagcacggaaacagacgcacaaaaagagaacacaagggccgcccaccacaacgacaacgaccggaaaaacaacgccggcacccaacgnaaggggggggcacaacaacca

SEQ ID NO: 4989 - DNA, 239 bp, Triticum aestivum
  Clone ID: LIB3281-019-P1-K1-E4
gcggcttaaagttcatattttgtgaggcatgaatggatatctagaatctgatgcgatctgctatatctaccctatggacaaaaaacccgtgttttaggattttctagatgaacttgttatctctgctatcgacactgtgatgagggagagggagactgaaagttgtgttataagtttggctttcaacttgtctgtcttaattttgcagatcatatacttgttgatttttatgctttttt

SEQ ID NO: 4990 - DNA, 92 bp, Triticum aestivum
  Clone ID: LIB3281-019-P1-K1-E5
agattgcttgctgtgcaggcatgctgtgatatagggcacgagccgaggggtgcattaccaagtactgtgggatgagaacaacatgactgctg

SEQ ID NO: 4991 - DNA, 401 bp, Triticum aestivum
  Clone ID: LIB3281-019-P1-K1-E6
cggacgcgtgggccgatggcctagccaccattcccacacacagcccgcccgccggcgccgccatgccgccgttccggcgctgggcggatctgccggcggacctcctctgccgcatcggcgacagcctcgacctcaagtgctacgccagcgcgcggggcgcctgcacggcctggcgatgcgcgctctcgccgccctccccgtcgctcctcgtcgtcctcgacgacgccaggtgctgcccctccgccgcgtcgctccccacccaccgctccttcgagctcaagaacatcctctcggggggccgatgcgtcggctccagcaacggctggctcgccctctccgtctgcctctacggcggccagagcatgttcagcctcttcaaccccatcaccgccacggagatc

SEQ ID NO: 4992 - DNA, 191 bp, Triticum aestivum
  Clone ID: LIB3281-019-P1-K1-E7
tttacgcgtgggccgatgtcttattcactattccaacacacagtcggggggggagctacgttgggccgcctaccctactctgagcggatctgtcatcatgaccttcgttgacgtataggggacaggctctactctaagtgctactccagtgcgcggtgcgcctgcatggcactggcgattcgcgcttttgt

SEQ ID NO: 4993 - DNA, 398 bp, Triticum aestivum
  Clone ID: LIB3281-019-P1-K1-E8
gtgggatgccaagaacatgatgtgcgccgctgatcctcgccatggccgttacctcaccgcctctgccatgttccgtggaaagatgagcacaaaggaggtggacgagcagatgatcaacgtccagaacaagaactcgtcctactttgttgagtggatccccaacaacgtgaagtccagtgtctgtgacatcccgccgacggggctctccatggcgtccacctttgttggcaactcgacctccatccaggagatgttccggagggtgagcgagcagttcactgccatgttcaggaggaaggctttcttgcattggtacactggtgaaggcatggacgagatggagttcaccgaggcggagagcaacatgaacgaccttgtctcggagtaccagcagtacc

SEQ ID NO: 4994 - DNA, 303 bp, Triticum aestivum
  Clone ID: LIB3281-019-P1-K1-E9
gcggagcgccgatggccacagcgcgactactgctccgaagcgcctccctgctccccctccgccgctcgcccctgcactcgtcccgcttccagccccgagccgccatggcctccgatgccgccagccagttccagaagatccagatccagcgcgaggacacgacgtttgatgcctatgttgttggcaaagaaaacgctcctggagttgtagtgttgcaagagtggtggggtgttgactatgaggtcaagaatcatgccatccatatttcccagatcggcgatggatacagagcacttattccag

SEQ ID NO: 4995 - DNA, 403 bp, Triticum aestivum
  unsure (1)...(403): unsure at all n locations
  Clone ID: LIB3281-019-P1-K1-F1
ggtggcctcacctccacccaaagtaaagttggcccaaggggcctctcggatgtctgagattgcaaagaaattattcccggcgaagactgagcgaaaagggaatggacagaagaatgattttgacaaacccaacacggctctggctatggtagtagcgggtaccattggggtagaggctgataaaagactggagaacttggataggagcatcgagactttgaagaagcaaaagaatgaaaactcccaccgcaagacaagcgtggggcaggagggagagagcggngaacaatttgtcacaaccttagaagcggngctgcatgtacagccctgcaaagatcaatgaaagtggtagcgtggaattgccgggggcttgggaaccagcccgcagttcaaggtcttttgg

SEQ ID NO: 4996 - DNA, 327 bp, Triticum aestivum
  Clone ID: LIB3281-019-P1-K1-F10
aaaaaaggggggggggttttttttttttttttttttaaaaattttttttttttttttatttttttttttttttttctttttttttttttttaaaaaaaaaaaaaaaattttaaaaaaattacctccccccaaaaaaatttaataaaaaaaaacaaatcttttcccaaaaattactttttttaatacaacgaaaaaacaaaggtttttacacaatgtgaaataacccagctccacccttattcctttttttgaccctacgcaaccgcttcccaatttaaaaaaaatgtatgacctcgcgcacctaaaaaagcaacttttttactaccc

SEQ ID NO: 4997 - DNA, 397 bp, Triticum aestivum
  Clone ID: LIB3281-019-P1-K1-F11
cggacgcgtgggtttgatacatcaactcacaatgccataactgaacagttattctgcttgatagtacaaatgtagttacagtatgatgatttcttcaatttagcatcaaactcagaattaatcataatctagttgtagtaatcttgttgtttattcgattcaatactcattttagaacttagtaaggcaataaattagagtctctggtgcgcttcttattagcgtaattcagcgctgtacgttgccaagaggaaacttgggctatgattctggcagaagccattttttgagatggcttttgcattcaacttgtccatacatatcttagcaatgaactgaattttgtttgtataggtgttttagggatgccatgaggtatctgatgcttggtcttttt

SEQ ID NO: 4998 - DNA, 291 bp, Triticum aestivum
  Clone ID: LIB3281-019-P1-K1-F12
cggacgcgtgggtttgatcaatcacttccaagggcctttctgggggagggggttgcttgatagtacaaatgtagttacagtatgatgattactttaatttgagcatcaaactcagaattaatcatagtctagttgtagtcatcttgctgtctattcgattcaatactcactttagaactaagtcaggcaatgaattagatactctggggcgctatttattagcgaaattcagcgctgtacgttggcaagaggaaacttgggctatgattctggcaggagccattttttgag

SEQ ID NO: 4999 - DNA, 343 bp, Triticum aestivum
  Clone ID: LIB3281-019-P1-K1-F3
ggccaaagccgcagacaggacgcacgcacaggccaccggtggcgcttcaaaagttggccggtcggccggcggttttcggcggcatggacgccggcttcttggttatgggggggcccttcttcggcgacgcccccaacggcggggagaaccggatgggcaccaccattgtcggggtattctacccccgggggggggttcttgccgccgacttcaagaccagcaccggaatgtatgtggcaaaccgcgcttctgaccaaaatagtcaactcaccgataaaggctatgtctggcggtctggatctggcgctgatacacaaggtattttaaaatatgtgcgctattt

SEQ ID NO: 5000 - DNA, 326 bp, Triticum aestivum
  Clone ID: LIB3281-019-P1-K1-F5
cacaggcattgccgcacacactcaccgtctcgccacgtgagaggagaagcccgcagcgccggtgcttgagcggatcgggaaaggatggccggcggcgcggacgcggacggggagcgccggatcggggtggccatggactactcggccagcagcaagcgcgcgctggagtgggccgtccgcaacctgctccgccggggcgacaccgtcgtcgtcctccacgtccagcgccacggcggggaggacgccaagcacgccgtctgggccaagtccggatccccgctgatccctctgtcggagtaccgggagccggaggtgatgaagaacta

SEQ ID NO: 5001 - DNA, 151 bp, Triticum aestivum
  Clone ID: LIB3281-019-P1-K1-F6
aggtccagtccaatccccatccacaatcgcagcccctcgctctcgccgccggcgtggggattccctgcttgccccccgtagcctgcgatctttttgcctcggagtcgctcggattccgtgctgcggctggttgggattccctttctgcacc

SEQ ID NO: 5002 - DNA, 140 bp, Triticum aestivum
  Clone ID: LIB3281-019-P1-K1-F7
cccacgcgtccgctgactcttgatcggaatcgtgggaggaccagtgaaggggggattgacaattgtagcctgtcattatatacatcgttttggggatttttaatttatgttgtagcctggattttgaatggaattttttt

SEQ ID NO: 5003 - DNA, 397 bp, Triticum aestivum
  Clone ID: LIB3281-019-P1-K1-F8
gcggggcgggggacgcatgggtccttggtccggcggcgtcggcaggatgctgtgcgccggtcttgctttcttgctagataagtatttaggaaaaatctacaatactccttcaaggtttatacatcaattgcaaagggttttaggaatgcatcactacattgttttgggtttatacatgaatctcgaagagttttataaatgtatcattatattgttttaggtttatatatgaactgcaaaagaatttaggcatgtgaaaatcagagctcaggaggcatgtgatattctttttctgtggtggcgtgtatgtattctgtgattttacttcctgtttggtttctctacctaggtaaatgactgattttgtcgataacttcattttggtccattaggtagt

SEQ ID NO: 5004 - DNA, 385 bp, Triticum aestivum
  Clone ID: LIB3281-019-P1-K1-F9
tcgcggacgcgtgggtttttttaatacaaatgatgcaaaccttatgggggattgtggtacaatattggctcaatttggggacaccatgctatataaaggttacgaatgcaccttttctaggggtttgggggccttaaggtaccccaaaaccccccaaaaaatttggatctttggctaaatttaaagcccgtaaagggttatatattcctatggtttaaagtgggtaaaagccctttcatgtttaaaatgtataaagggttccggacaaaccccacctttaaaaaaaaaaaaaaaggccccctaaccctttattttcaataaacattggtttgccgttggggggccccaatgactttttttgggggggggagagcattgccctttc

SEQ ID NO: 5005 - DNA, 403 bp, Triticum aestivum
  Clone ID: LIB3281-019-P1-K1-G1
cccggcaactggtgggcgtcgtcctcctcttgtgcgcaccaggttcctcctcctctctctctctcctccattcccgcaccctccgtcgcgacacatcgccccagccagaattcccccttgctgtcatctcctcccccaaaagccgcaccgatccagcagcttcctcacaacccaacccaggaacatatcaaaatcaatttatgggaaagacgcaacgcttgtccacaattcttgatgaggaggtgtgatctgagacagtctcacaacagcagggtttctggaggaatgtcatcctctttacctattctgccaaattctctgaaagaaaccttccatgggccttacaatccgcagctcactccgatgcaaaggcaactgacgagtgatcttgtgcccttacatc

SEQ ID NO: 5006 - DNA, 268 bp, Triticum aestivum
  Clone ID: LIB3281-019-P1-K1-G11
actgcgtcagtgtatacatacactttgcaatgctgcgcgccaactatccttgggcattatatgtcatgatcacttgatgctatcgtccttggttggttaatcttatcagtgtccaattcgagatccaactttagccgacatcatgcgaatgaccatttgcgtcatcccagtgtagacaagtatgggatagggcaagggaaccatgagtttggtctgcacaccattaatgggaattgtagtctgtcaagatgttcctgcatcacttgca

SEQ ID NO: 5007 - DNA, 384 bp, Triticum aestivum
  Clone ID: LIB3281-019-P1-K1-G12
ccggcggttcggcagcatcgtcgtcgttgtgccattcccatcatcatcggtaccgttggttctcgcgcttgctcaggctcccgtcctccatcgagctggatctgtccgtcgtcgcatcccttcggggcttcctgtcgtcgcggtggtttaggtcctccatctccagcatgtggatcacatgccccattttaggccgcttatggccatcggggtcgacgcagcgaagggcgaccagaagagcccgcttcagtgctttcgaggaaggcctctcgggaagcttggggtcgactacgtcctctgctttcctctctgccaccatgttcttcagccattcgatcaagttcacctctccagctggcctagtataatctacaggggatctac

SEQ ID NO: 5008 - DNA, 400 bp, Triticum aestivum
  Clone ID: LIB3281-019-P1-K1-G3
aaatatcttcagatataactgacatcccagcagcgcgtgggagccggtgtcttcggccagagctgggtctccttgccggcgaccttgccatcaccagcctatctgcagttttgcagggatggacatatggattgaatggtaccctcctgaaatctacacagatgtcagatcggagaaagaagagatgaagaacaattttaattgaagagttgaagaagactaagcacgagtccccctgaagtgcttgaccaccggccggttgcagtggaggtcagcatcacctcgctgtggccatcctgggcgccgagagaattagctgaaaattcttgctgagatccaggtcacgggccatccccattcaggtggctatgaaacttgttcctaacgaaagataatttat

SEQ ID NO: 5009 - DNA, 310 bp, Triticum aestivum
  Clone ID: LIB3281-019-P1-K1-G4
cggacgcgtggggcaccagaaccccctccccctccctcctcagcctcccggcgcatcgagccatggcccgcaccaagcagacggcgaggaagtccaccggcggcaaggcgccgaggaagcagctggccaccaaggccgcccgcaagtccgccccggccaccggcggcgtcaagaagccccaccgctttcgccccggcaccgtcgcgctccgcgagatccgcaagtaccagaagagcacggagctgctcatccgcaagctccccttccagcgcctcgtccgcgagatcgcccaggacttcaagaccgacct

SEQ ID NO: 5010 - DNA, 394 bp, Triticum aestivum
  Clone ID: LIB3281-019-P1-K1-G6
gcgtttccttctcgtcgtcggtcttcttcttatctcatccccgactccgacgagccccggcgaccgaccggcgagggatggcggcgacggcgacgaagctgagcagcggccacgagatgccggccgtggggctcggcgtctggcggatggactccgccgccgtccgcggcctcatccactccgccctccgcgccggctaccgccacttcgactgcgccgctgactacaaaaacgaggctgaggttggcgatgcgctcgcggaggcattcaaaactgggcttgtcaagagggaggatcttttcatcactaccaagttgtggaactcagatcacggccatgtggtcgaagcctgcaggatagcctgaagaagctgcgaatggattatctagatctc

SEQ ID NO: 5011 - DNA, 284 bp, Triticum aestivum
  Clone ID: LIB3281-019-P1-K1-G7
acattctcccatcactcagccataaccataacgatcttgatgagagcagggcatactaagaccactaaaaaagatagaacaagcaaactatgggagattagctgtacaacatttccttccagggagcccctatggtgccactgcagctgcagggtgtttgctatacagaagggccttctttcatcggcacaagctagcatctgttgctgaagatgcaaacagcaggctaagtctgatacacgaggcatccccatgacaagcaaagaacactctgaatccttaac

SEQ ID NO: 5012 - DNA, 337 bp, Triticum aestivum
  Clone ID: LIB3281-019-P1-K1-G8
caaaatatgaaccaatgaagcctttctttggggacaaaaggccaccaaactactggtggtttgtaaaaggaactgcagggtggacaggtattgtcatggtagtgctcatgtcaatagcttttgtattagcccagccatggttccgacgtaacaagctcaaggacactaatccactcaagaagatgactggtttcaatgccttttggtttacgcaccacctatttgctattgtgtatgcactgctcatcgtccatggaacaagtttgtatctgacgaaggagtggtacaagaaatcgacatggatgtacatcgcttatcctgtcttcttatattcatg

SEQ ID NO: 5013 - DNA, 366 bp, Triticum aestivum
  Clone ID: LIB3281-019-P1-K1-G9
gtcgtcgccgccgccgccggagagatggactcccggggcttagattccacgggccgcgagttttccagcgccacggagatgtgggcccaggagatcggcgccaccgcctccggctgcgcctgggcctccgaagtccctccgggcgccgccgacgacgccgccgtctgaagcaatggggacgccggcgaggaggcgggcggagaagggaagcgtgaggagtggtactccaaaggaatcgtctactggcagggcgtggaggcgttgaccgagggcgaactgggaggctacgggtgcgtcaacgacgccgacgtcaagggcagagccgtcttcctgcgcgccatgctcgtcgagcgattcggcgccgag

SEQ ID NO: 5014 - DNA, 403 bp, Triticum aestivum
  Clone ID: LIB3281-019-P1-K1-H1
cggacgcgtgggcggcgctccctctgccgctcgccgggaagctagctagacttgcgcgcaccgccggaggcgatggcgatggcgatggccgtgcaagccagctggcttggtggccttgcgtgcatcttctccaccagccttctcttccaaatcctggtacggccctgcagcaatggaggaggactcttcttctgcccacagtctccaaatgccccctccatcctcagcagcaaggacaggactgcctaccacttccagcctcccaaaaactggatcaacgatccatgtggaccaatgtactacaatggcatctaccatgaattctaccaatataaccccgatggctccttcaatcccaatacctcctataacatagtttggggccattctgtttcaacagacc

SEQ ID NO: 5015 - DNA, 336 bp, Triticum aestivum
  unsure (1)...(336): unsure at all n locations
  Clone ID: LIB3281-019-P1-K1-H10
cggacgcgtgggcggacgcgtgggccagcgcggccatgccgaggctccacctttgctccggatcgtaagcccgaagctcgggctctcatccgtggctgcttgcttgcttggagcggtgggctcggtgcggagcactacaaggaccatgagcaactcgtcgtggacggcgccggggtcgtcggcgctggagacggtggagaccaagatcagccccagcatcctcttcatcgtggcggtgctggcgatcgtcttcttcgtctgcggcctgctgcacctgctggcgcgccacctgctgcggctgcngcgccggcgccgggcggcccgcgacgacgccga

SEQ ID NO: 5016 - DNA, 234 bp, Triticum aestivum
  Clone ID: LIB3281-019-P1-K1-H11
ctctcccaaacccctgtgccgatcctcgatctgttctcaaccctacagtgcgaagtcaaggtggccctgtcccactcattatggcttcgatcaagatcactcatcaattctgtttgccccctcggcaggctctcgggatggtgatctgcttgtagccccattatggaacgcaactggaactgcaactgcttattcaccactagctgcatggcctagctgttcaatgtggacact

SEQ ID NO: 5017 - DNA, 372 bp, Triticum aestivum
  Clone ID: LIB3281-019-P1-K1-H12
cggacgcgtgggctgtcccgatcctcgatctgttctcaaccctccctccgtccgtcgcagctccagatttccttccccatggctccgatcaagatcggcatcaatggtttcggccggatcggcaggcttgtggccagggttgcgctccagagccccgatgtcgagctcgtcggcgattacgacccctttatcaccaccgactacatgacctacatggtcaagtatgacactgtccacggacaggggaagcaccatgaagttaaagtgaaggactccaagacccttctcttcggtgagaaggaggttgcggtgtttggcttgtggaacccagaggagatcccatgggctgctgttggagctgagtacgttttt

SEQ ID NO: 5018 - DNA, 402 bp, Triticum aestivum
  Clone ID: LIB3281-019-P1-K1-H2
tgctaggtttccttccgctccgccgtgagagcacgccaaacagcagagcacaatctgtttcttggctgctgtccagccccgtccacagtggccaaaagcccgccacctcagccaaatccttcttcccaaatcttaggttttgacttggggaggctctgcccaaattttcttccccggtcgtccatttccaggggaggttctgccaaaaaattctcccctcatcatccatttcccagggaaggctctgccaaaaattccttcactgatcatccatttcccaggggaggctctgccaaaaattccttcgccgatcatccatttccaggggaggctctgccaaaattccatctgaacttcattcaatttccaaggggaggttctgccgaaatttgatctgcgacc

SEQ ID NO: 5019 - DNA, 280 bp, Triticum aestivum
  Clone ID: LIB3281-019-P1-K1-H3
cgcacgcgtgggctcctccgctcaatgcgaggacctggagccttgtactacatgccatattttgaaggatgtacaccatggctcgcatgcacccgattgatgcaggggcccagcgaaatcctccttttaaagaaaaaggtaccactggatcattgacgtgccacagagggatctcgggagcaatatatgctgggggggggcgtccatagaattctccgctgataacacatagacgagtattggccatgcctaaagtcaactcctgaagatgcactttcga

SEQ ID NO: 5020 - DNA, 429 bp, Triticum aestivum
  Clone ID: LIB3281-019-P1-K1-H4
aatctccaggtgtccgacccagagcgtccgcggacgcgtgggctcgtccgttcaattcgaggttctggggccttgtcctcgatgccatattggaaagtaggtagaccatggctgtgtgcaccgcttgatgcaggggccctgggtaatcctccttttcgagaaaaaggtaccagtggatcattgacgtggtacggagggatctcggtagcaatagatgctggttgctggtgtctattgatttcgttgctgtgaacaataagagatttattggccaggcttttgttcaactccggaagtgggacttttgagttatctgttcctagagatattagaagttgcgttaatacaatattaagagattattagtggctgtttgaattggagatgctagtgcagtgatgttttgttttagagttttgaatggcaaat

SEQ ID NO: 5021 - DNA, 424 bp, Triticum aestivum
  Clone ID: LIB3281-019-P1-K1-H5
gtttcggcctcaggcgtaccgctctcccaaaccctcccgccgccgccgccgccgcccgccaccgaacagcagccatgccgcccaagctcgacccgtcgcaggtggtggaggtctacgtccgggtgaccggaggcgaggtcggcgcggcgtcttcgcttgcccccaagatcggccccctcggtctctcccccaagaagatcggtgaggacatcgccaaggagacggccaaggactggaagggccttcgcgtcaccgtcaagctcaccgtccagaaccgtcaggccaaggtctccgtcgtcccttccgccgcggcgctcgttatcaagtccctcaaggagcccgagagggacaggaagaaagtgaagaacattaagcacaacgggaacatcagccttgacgacgttattgagatcgccaagatcat

SEQ ID NO: 5022 - DNA, 273 bp, Triticum aestivum
  Clone ID: LIB3281-019-P1-K1-H6
cggacgcgtggggcgttttagttggagcagagaaggagaggtgcgaagtaaaggtggcgctgtcaaactcattcggattcggtgggcataactcatcaattctgtttgcccccttcaagtaaactcgggatggtgatctgcttgttgtccgattatggaatggaactggaactggaactgcatatacaagactagtggagtagctaggcggcttctttgaatattacatggaggtctgagctgagaagatcatcgtattacttacaggtgagc

SEQ ID NO: 5023 - DNA, 387 bp, Triticum aestivum
  Clone ID: LIB3281-019-P1-K1-H7
ggtgccctatgacccaactctttttgctgaacttgacgcacatcaattgtcctcgtttgctttcgaaacatattcaggccctctctatctgtctctgactggtactgcatccatcatatacgaaccgctactgttgtgtaatattttttgctcgatatgttatctaccgctgctcatctaggccttatgttgccgcacgatctgtcgctgatctagggttaggatacgctattggattggcgactgccgcgagccgataacatatcaggttactagctagccatagacagtatttgcttaatctgctgatgtgcaggagtagaactttgcttaccggtctcctaactaatctgcataagtatttattagtattttgtgctaaaatgt

SEQ ID NO: 5024 - DNA, 353 bp, Triticum aestivum
  Clone ID: LIB3281-019-P1-K1-H8
ggtgcgcatggacccaactctgtttgatgaacttgacgcagataaatggccgagtatggcttgggaaacatatacaagaccctctctatatatatctgactgttactgcatggataatataggaacctgtactgttgagtaatatttaatgctcgaggtggtatctaccgctgcttacataagcattatgtcgctgctcgatttgaagctggcctagggtatggatcagatatgggatagatgactgacgtgagtcgataacatattaggtttctaggtagctaatgacagaatactgcttaatcggatgatgtgaagtaatttgaacttccttcccggtctggtcactaatc

SEQ ID NO: 5025 - DNA, 322 bp, Triticum aestivum
  Clone ID: LIB3281-019-P1-K1-H9
attcagaatgaagattttccagctttaccaggatataaaggcaattcgtcagattatggtatggatttgcatcacaaggaccaccttcatgagaatgcaaatattatgcagggacaacattttcctatgggtagatcatctggctttaatttgggaggtagctatccagcccgccaacaacagcagcagagcactacttcggttcaaaatggtcttgataatattggactaaggccgataaattctccaagtccgtcttctaattcggggtcttacgagcaactcatccagcaataccatcaaccgcagactcagaattcac

SEQ ID NO: 5026 - DNA, 395 bp, Triticum aestivum
  Clone ID: LIB3281-020-P1-K1-A1
cggacgcgtgggcttttgcttcttttctttttcttttagctagcaaaagtattttgtccaaagtgggactgggctagataaatacctcgcatttactagcactaccacaaaaagtttgggaggctttcgagtttcttgaaatttttcataagtggaaaggcatttaaatgattgtttaagccactgttatattaaaaaaagggatttaaacacttcacaaaagtgtcgggtcaccaccataatttgttatggaatattggcaacactttgaacattttagtttgcatgtttgagaaatttgaattttggactttagtttgaacttgaatttgaattatgatttggatcaagcgaggattggcaacagtattgtgatgacaaggcaccattagcag

SEQ ID NO: 5027 - DNA, 367 bp, Triticum aestivum
  Clone ID: LIB3281-020-P1-K1-A10
cggacgcgtgggctcctcctcaacccgccgccgcttcttctcctccggaagaaaaccctagagagcttcaagttctccggagcgcgagagatggccgcgaagggcgatgggccggcgatcggcatcgacctcggcacgacgtactcgtgcgtcggcgtgtggcagcacgacagagtcgaaatcattgccaatgaccagggcaaccgcaccacgccgtcgtacgtcgccttcaccgactccgagcgcctcatcggtgacgccgccaagaaccaggtggccatgaaccccatcaacaccgtcttcgatgccaagcgtctcattggccggagatttaccgattctactgtccagagtgatattaaagctg

SEQ ID NO: 5028 - DNA, 265 bp, Triticum aestivum
  Clone ID: LIB3281-020-P1-K1-A11
cccacgcgtgcgcggacgcgtgggcgacgaacgagagtgacaccgcgacgggcatctccctcgccgactgcgcgcggtccccacatacacgttccctctatacaaaagaagcagtagcactcccgtgcgcgtcacttccacgaccgatcgatcccacctggggcatccggatacgcatccacccttcagcgcagatcggatccacacccatggccgggcgcttggaccttcaaggcaggcacggcaagtcctcggtacgggtctc

SEQ ID NO: 5029 - DNA, 372 bp, Triticum aestivum
  Clone ID: LIB3281-020-P1-K1-A12
gctcacacaaagtcacaagaatgatgaacccaaagagccgtgtccaagagtgggtggccgaccacatcgagctcatcccggggatgcccgacgacgtcgccgtcgactgcctggcgcgcgtcccgcacgggtcctaccgctcgatgcgccgcgtgtgccgcggctggcggagcgccgccgccgccccggagttcgccctggcgcgcgccgaggccggtgccaacgaggatctggtctttctcatgcagtttggcaacccggtggccggtgacgacggggcgcccgagaacaccccggcgtacggtggggccgtgtacaacgtcaccaccggggagtggcaccgcgagagctcggcgcccgcggggccgatgt

SEQ ID NO: 5030 - DNA, 287 bp, Triticum aestivum
  Clone ID: LIB3281-020-P1-K1-A2
cgtacacatcgactgatgatctttttcatgcattcgaaacaaacaaaacgttttgagttcaatcttgggctggtctacataaatcacctttcattgactggcgggacgccacagggacaaggcggcttccgattttattaaaattggtcatacttggaactgcatttaaaccattgcttctgccactgcggtcttagaaacccaggatgtaaactcttgccagtcaatgttaggctcaccaccatacttcagtacctaatatctacctacatctatgaacattgtag

SEQ ID NO: 5031 - DNA, 323 bp, Triticum aestivum
  Clone ID: LIB3281-020-P1-K1-A3
attgcaatgccacaacatatgtgggacaagttatcagaagatacagcaaatcttgtcagaaacttggtaaatgctccgagcagtcttctattgggcaaaggggccttttttgttcatgccaataacacaatatttcaagtattgaaagatggagcaacattgatgagtaccagattagaggtacaagcccccaggatccattgtgttcatccaacatggtttgaagcaggaaagcctattgaactactcctttgtggaagttctcttgatcagcctaaattcagatcacttctatcgtttgatggagagtacttgaagcatga

SEQ ID NO: 5032 - DNA, 366 bp, Triticum aestivum
  Clone ID: LIB3281-020-P1-K1-A4
accacgcgtccgctctacctgcagatctcgctcgccatggacctcctcgacgcgggccaccgccactcgtcggaacttcccgccgtcggagccgacatggaaggcgcttcagtgcttgcgctctacggagctgtctaccagccctacgtttgcgagctccttttcttctccatcgagcgcctacacaaggagccggagcttctgcgggtggacagaaagcgggtgccgcggcagatgcatgaagtggcggtggagaactacgccgtctttatagccgacttcgaggcgctcttcttcgtgcgggcacagctcgaggggtttgacaagcaccttgaggcacttgttgaggagatacccaatttaaca

SEQ ID NO: 5033 - DNA, 372 bp, Triticum aestivum
  unsure (1)...(372): unsure at all n locations
  Clone ID: LIB3281-020-P1-K1-A5
cggacgcgtgggcggacgcgtgggcagagcaccaccaacctcccgattccaggccacgcaccgccaagtggacgagctagctacctcctgatcttcgccatggacgccgggccatcatcctcgccgctgcgcatcgtgatcgtcccgtggctcgcgctgggccacctgctcccgtgcctggagctcgccgagcggctcgcgtcccggggccaccgcgtgtgctacgtctccacgccgcgcaacctcgcgcgcctcccgccgncggcgccacgcgtggacctcgtggcgctcccgctgccgcgcgtggacggcctccccgacggcgccgagtacaccaacgacgtcccggaaggacagcgggagctacactgg

SEQ ID NO: 5034 - DNA, 342 bp, Triticum aestivum
  Clone ID: LIB3281-020-P1-K1-A6
cggacgcgtgggcggacgcgtgggcagagcaccaccaacctcccgattccaggggacgcaccgccaagtggacgagctagctacctcctgatcttcatcatggacgcctggccatcatccttgccgctgcgcatcgtgatcgtccaggggctcgcgctggtccacctgctcacgtgcctggagctcgccgagcggatcgcgttccggggccaccgagtgtcctacgtatgcacgccgcgcaacctcgcgcgccttccgacgtcggcgccacgcgtggacctcgtggcgctcccgttgccgcgcgtggacggccttccggacggctccgagttcaccaacgac

SEQ ID NO: 5035 - DNA, 175 bp, Triticum aestivum
  Clone ID: LIB3281-020-P1-K1-A8
cggacgcgtgggttccgatccagcaccgtcgtcgcaaacaccacacctcgggagccctcttcgccggtgaagtagcaagcaagatggctggaaagaaaggaggcgacaggaagaaggcggtgacccgctccgtcaaggccgggctccagttccccgtcggccgcatcgggcgcta

SEQ ID NO: 5036 - DNA, 319 bp, Triticum aestivum
  Clone ID: LIB3281-020-P1-K1-A9
cggacgcgtgggcaaggcttcccccggcccttccttttttgaaggctgggtttggcttggtaggaaggccggggcggccgccccttccggtcgccaccggcggagtgggacggaaactcctccgtcggcaccgtatccacagcccccggcgcgcgcggaggcccggccagccccagcaggctcgcctctctcggtcgctgctgcgccgtcggaggatcccgcgaggatgtcgtggtgcaccatcgagtctgatcccggtgttttcaccgagttgattcaggagatgcaagtaaaaggtgtacaggtggaggagctttac

SEQ ID NO: 5037 - DNA, 406 bp, Triticum aestivum
  Clone ID: LIB3281-020-P1-K1-B1
cggacgcgtgggcggacgcgtgggcttctctgagtgccatcgcatgcccgtccggacttcttccggattcccgaacgccaaatcccacccccacccctaactgctgcccttttgtcaactccacttctccccaccgccgccctccgtgctgacgcctctcgctccccggagccaccgcgacaagctcgccgcgccgccgccatggatgaggagtacgacgtcatcgtgctgggcacggggctcaaggagtgcatcctcagcggcctcctctccgtcgacggcctcaaggttttgcacatggatagaaatgactattatggcggagattccacttctctcaaccttaatcagctctggaagaaatttagaggggaagacaagcccccggcacatctaggctcaagca

SEQ ID NO: 5038 - DNA, 328 bp, Triticum aestivum
  Clone ID: LIB3281-020-P1-K1-B10
gcgacccaccacctgagagcagcggcaatggcgtccttcggttccatggcggtggcgctcgtggtgtgcgcaatgctgctgcagacctgcgccgccacgaggaggctccaggcgctggtgcaggagcagcccatcaccatgaagtaccacaagggcgcgctcctctccggccgcatcgccgtcaacctcgtctggtacggcaacttctccgcgccgcagcgcgccatcgtcaccgacttcgtctcgtcgctggcctccgcgtccccggcgccgcagccggagccgtccgtggccacgtggttcaagacggcgcagaagtactacgcca

SEQ ID NO: 5039 - DNA, 223 bp, Triticum aestivum
  Clone ID: LIB3281-020-P1-K1-B12
actactcgtagacagaggacgccctgtatggggacgtcaagcctaatccagccttctttctgaggatgccaactgtcgtttctatcacgatggctatcaacgtgtctaccttaccaacgaccgttcatactatggcaatggcaacggcaaccgttactacaacaacaacaacggcaactgtggtggctacaaccaggcccctgactctaactaccgcaatggt

SEQ ID NO: 5040 - DNA, 192 bp, Triticum aestivum
  Clone ID: LIB3281-020-P1-K1-B2
gctttataacgattgatgagctctcgcaagcatgcgagaaatttggcctttctgacgttcatcttgaggatatgatcaaggatgtggatcaaaataatgatggacaaattgattacagtgagtttgcggctatgatgagaaagggtaatgctggtggctccagtggaaccagtggggctgttgggccaggaa

SEQ ID NO: 5041 - DNA, 401 bp, Triticum aestivum
  Clone ID: LIB3281-020-P1-K1-B3
cggacgcgtgggcggacgcgtgggctcgagccgcacacctcatctcatctcatctcatcatcgtcttccccccattgccattccctccttgcgagtagtagcagcagcaatggccagcctcgccgacctcgtcaacctcgacctcagcgactgcaccgacaagatcatcgtcgagtacctctgggttggaggatccggtatcgacatcaggagcaaagcaaggacggtgaacggccccatcaccgacgcgagccagctgcccaagtggaactacgacggctccagcaccggccaggctcccggagaggacagcgaagtcatcctctacccccaggccattttcaaggacccgttcaggaggggtgacaacctccttgttatgtgcgactgctacacaccac

SEQ ID NO: 5042 - DNA, 307 bp, Triticum aestivum
  Clone ID: LIB3281-020-P1-K1-B4
cccacgcgtccgctgactctttagatcaagctagacacataatctgatctcatgggataatacttttggaatgatcttcatttcctccttgcgagcataggcagcacttatgggcatcctcagtacccagtttaacatgaaccttaagaactggagctacttgattattccatagtacatctgcatagggagatgatgcatttgcatcatgaccaaaagatggaccgtggacagactcatgaactacgcgagtcaaattaccatgtttatataccaaaattcaaggaactgtcattctttcggagag

SEQ ID NO: 5043 - DNA, 287 bp, Triticum aestivum
  Clone ID: LIB3281-020-P1-K1-B5
cggacgcgtgggcggacgcgtgggcggacgcgtgggcggacgcgtgggatccggccttttttcccctgccaagccgccaccgcggttgtctcctcccgccgccgccgatgaagcccatcgtcgtccacgccgtctccgtggaccgacggtggctgctccctctggccgtcagctccgcgctgtcgctcttacttcctggtcctcctcaccaccgtccctgttcgcttcttgccctcctcctcgacctccccggcgctcttcgtcgagcacaagctcgacccgacccc

SEQ ID NO: 5044 - DNA, 247 bp, Triticum aestivum
  Clone ID: LIB3281-020-P1-K1-B6
gggccaatggcccaacatttgggagggcttgaaccgagggggaggggcccgcggggaaggggacggtattgccaccgctaccattattgtgctcggcgatacttgcacgcgccgttgtcgattctgcgccgtgaagaccagaaacaagccttcggcgtcggatcccatggaacctctgaacacggcctttgccgttgcaagttggggagtagactatgttgtgctgacaagtgttgatagagatgac

SEQ ID NO: 5045 - DNA, 266 bp, Triticum aestivum
  Clone ID: LIB3281-020-P1-K1-B7
cccacgcgtccgggcgattcgactgcttggggagacatacgagcgcgtggagtcctcaaaaggggagcatgagctcctgatggagccgaacccccttgattccccaacccaacctgaaggaccagcttgtccagttcttcctcaagatgcaaatggagatctcgaaggccaacaatggtgctccactcgctgtcccacttgctgccgttgccatggtcggtaattcagcctctacagcagaagatggcgactcgccagctactgtt

SEQ ID NO: 5046 - DNA, 363 bp, Triticum aestivum
  Clone ID: LIB3281-020-P1-K1-B8
ggaggttgatcgtgtaacagaagctggaggtgatgttggaaggctaaatgttgttggtggtgctgagattggcccccttagatgctggcctgggggtttgtgcctgtcaaggacaatcggagatcaggacgtgggtgaatttatcgttcctgttcctctcgtcaagcaagtaaagttatctactgctggaggccggcttattatttcaagcgatggtgtttgggatgctttgactgcagaacaggctctgaactgttcaagaggacttcctcctgaagctgcagccgagcaaattgttaaagacgcagtgcactcaaagggactgagggatgacaccacttgtatagtcgttgacctagtacc

SEQ ID NO: 5047 - DNA, 396 bp, Triticum aestivum
  Clone ID: LIB3281-020-P1-K1-B9
gcttgttgcaataaccgtcaaatcttgattgtattatattgatcagaccaagcactttttggataaattagcatgaagtgatcaggagcagagaaatatatatgtcttgaagaaatggatatatatggttttaaggttacatgaagatatatatgtctggatcaagttgtaagttctcttccagaattacttaagattagtgattccgttagctacatagctgtcctttatttatgtggatcacatgtccttgacgatcatattatgatttggacacacattaattcataaaaccatttgttactttcaagacatgtttatttcgtaggtgcatatccatacaattcataaaaccatttgttacattcaagacatgtttatttcgtaggtgcatag

SEQ ID NO: 5048 - DNA, 401 bp, Triticum aestivum
  Clone ID: LIB3281-020-P1-K1-C1
cggacgcgtgggcgatcgatggcgtcggagaaagacgcggcgctcgcccccgtgcccaacgacaaccccaccatatttgacaagatcatcaaaaaggagataccttctacggtggtgtatgaggatgagaaggtcctcgctttcagagacataaatcctcaagctccgacccacattgtaatcattcccaaagtcaaggatggattaaccggcctttcaaaggcagaagagaggcatgtagagatacttggctgcctcctctacgctgcaaaagttatcgctaagcaggaaggacttgaagatggctaccgtattgtcatcaatgatggccctagtggatgtcaatctgtttaccacatccatgtccatctccttggagggaggcagatgaactggccccc

SEQ ID NO: 5049 - DNA, 367 bp, Triticum aestivum
  Clone ID: LIB3281-020-P1-K1-C11
gccgccgccacccacgaccaccaccggagccggaggaagagaggaagggagaagccaacaggtaacgatggtgtccggctccggtgtgtccgcgcgtcgcgtggtggtggatgcgcgccaccacatgctgggtcgccttgcgtcgatcgtggccaaggagctgctcaacgggcagcgcgtggtggtggtccggtgcgaggagatgtgcatctccggcgggctggtccgtcagaagatgaagtacctccgctttctccgcaagcggatgaacaccaagccctcgcacggtcccatccactttcgcgccccctcgcgcattttctggcgcaccgtgcgcggcatgatcccgcacaagacgccccgcggc

SEQ ID NO: 5050 - DNA, 396 bp, Triticum aestivum
  Clone ID: LIB3281-020-P1-K1-C12
cggacgcgtgggcaggagctccctcctcgcaggcgagatggtgtacatcaagaaccagaagacaagggcgtactccaagcgtttccaagtcaagttcaagagaaggcgccagggcaagactgactacagggccaggctgaggctcacaaaccaggacaagaacaagtacaacactcctaagtaccgttttgttgtgcgatttaccaacaaggatgtcactgcacaaattgtttatgctaccattgctggtgatattgtgatggccgctgcctactcccatgagttgcctcgctatggtcttgaagttggcctcaccaactatgctgcagcttactgcactggtctgcttttggctcgtcgtgtgcttaagaaccgtgatcttgatgaggagtatga

SEQ ID NO: 5051 - DNA, 392 bp, Triticum aestivum
  Clone ID: LIB3281-020-P1-K1-C2
cggacgcgtgggcgatcgatggcttcacagaaagacacgttactcgccctcgtgcccaacaacaacggcagcatatttgacaagatcatcaaaaaggagatacctcctacagaggactatgaggatgagaaggtcctcgctttcagagacataaatgctgacgctccgacccacattgtaatcattcccagagtgaaggatacgattaaccggcctttgaaaggcaaatgagaggcatagtagagatactgggctgcctcctatacgctgcaaaagctatcgctagggcaggaaggacttgaagaaggataccgcattgccatcaatgagggccctagttcatgtcaatctgtctaccacatccatgttcatctgctttgagggaggcatat

SEQ ID NO: 5052 - DNA, 400 bp, Triticum aestivum
  Clone ID: LIB3281-020-P1-K1-C3
cggacgcgtgggtgaagctgtaaacacgtttgtgtatgaggtgttggcgtttcatgagcgccagaagccatcaagaaatcccaaatacgtacttgttcattgtactcatgggcataaccgtactggctttatgattgttcattacctaatgcgcacacaactgtctagtgttactgaggctttaaatatatttgctcaaagacggcctccaggaatatataaaaccgactacattcaagcactgtatacattttatcatgaaattcctgaaagtatcacatgtccaccgacaccggaatggaagaggccttctgatcttgatttgaatggtgaagctaagcaggacgacgatgacgacaatggcgagcctgcaccatcaccagatcccgtagatgacaag

SEQ ID NO: 5053 - DNA, 205 bp, Triticum aestivum
  Clone ID: LIB3281-020-P1-K1-C4
cggacgcgtgggtgaagctgtaaacacgtgtgtgtatgaggtgttggcgttttgtgagcgccagaagcgatcaagaaatcccaaatacgtacttgttcattgtactcatgggcataaccgcactggctttatgattgtgcattacctaatgcgcacacaacagtcttgtgttacttggggttttaatttattttggtaaaagacg

SEQ ID NO: 5054 - DNA, 346 bp, Triticum aestivum
  Clone ID: LIB3281-020-P1-K1-C5
gatctccagggattccttgtattcaacgctgttggaggtggaactggctctggccttggctcgcttctcctggagcgcctctctgttgactatggaaagaagtccaagcttgggttcacggtgtacccatttacccaggtctccacctctgttgctgagccatacaacagtgtcctgtccacccactcactccttgagcacactgatgtcattatccttcttgacaatgaggccatttatgacatctgccgccgctcccttgacattgagcgcccaacatacaccaacctcaacaggctggtttttcaggtcatttcatcactgacagcttccctgaggtttgatg

SEQ ID NO: 5055 - DNA, 123 bp, Triticum aestivum
  Clone ID: LIB3281-020-P1-K1-C6
cccacgcgtccgattggcagatcgctcctccctccgccgggatctctccgtccccatggccgcgatgtgtagggccgccgcgaagcagctcgtcgaccgggccgcggatccaggccgcgcata

SEQ ID NO: 5056 - DNA, 392 bp, Triticum aestivum
  Clone ID: LIB3281-020-P1-K1-C7
cggacgcgtgggtacgagtccatcacgtcacgcacgcacgcacgccccgcgcgcggccaggctgtgctggtgctgggagcttcgtccccctccactctcgccagctccccgggcctgccccgccccgcccccactccgccgccgacgtaagcacacccagcaccctcccctcccctcaagatccaaggcacgctcgctcgccccccacccgccccgcgcaatgccccgctcctgaccatgtcctcgctctcgatcccgcctccgctcctgcgctcctcgcactccccatctccgccggcggcggcagcggcgaaggcgaattggaggaagcgcgcggcgcgcgtgcgcgtgcgcgctccggtggcggcgctggccggcgactgcgggtgcgc

SEQ ID NO: 5057 - DNA, 289 bp, Triticum aestivum
  Clone ID: LIB3281-020-P1-K1-C8
gtttcctgctagggttttggtcctttgttttcggcggcgcaagatgggggagagggtcaagggaaccgtgaagtggttcaacgtcaccaaggggttcggcttcatctccccggacgacggcggcgaggaccttttcgtccaccagtccttcatcaagtccgacggctaccgcagcctcaacgagaacgtacgccgttgagttcgagatcatcaccggcgaccacggacgcaccaaggccaacgacgttacccgaccgggaggaggggcgctcttcggcggcttccgccc

SEQ ID NO: 5058 - DNA, 394 bp, Triticum aestivum
  Clone ID: LIB3281-020-P1-K1-C9
cggacgcgtggggcttcccactgatccgccccaagtcgaccccgtctccggtcgatgccggcgctcctgcaagccgtcgccgacctcctatgccggtcagccgcgcccaactccctcctcttttcttttctcctctccttactaatctttggtctctcttcgttcccacgatgtagaacgccatggccatggaccgaagctccgctggtcccttcctcacgactggcagtctttctcccgaccagatcgacgacggcgatgaccggatctgccccgctgccgtccgtttccaagggacgtcaacggatggggtttcttcctctcagcctccaccacccgcgggctcaccggtgatggacctgctcagcatgtaggattgcgtgctttctggcga

SEQ ID NO: 5059 - DNA, 405 bp, Triticum aestivum
  Clone ID: LIB3281-020-P1-K1-D1
cccacgcgtacgcggacagagaagcctggaaagccaaaaaagaattcaccagcgcaaaggggaaaggagagagagagaggctaggctagggtttcgttcaattccgccatggattccggcgactcgtggggccgctcctcctccacctcctcctccggcggcgtcgagaggcgcctgcagtcccgctacgatctgtacatggggttcgacgacgcggacgccggcggggaccacgtggaggcgcgcggcgcgtaggcatacaactgccccttctgcggcgaggacttcgacttcgtccggctctgctgccacatcgacgacgagcacgccatcgaggccaacagcggcgtatgccccatgtgtgctacaagggttgggacggacttaataggccacttgacaatg

SEQ ID NO: 5060 - DNA, 237 bp, Triticum aestivum
  Clone ID: LIB3281-020-P1-K1-D10
cggacgcgtgggcggacgcgtgggctggaaacaaggtcaaatgctaaattgtcaagaatatcttcgatggaatcttttaagaatatggacagtagatattcaaagaaaaacaagaagttcgaatttaacagcaatcgcgtgtcccctggtccaaatggcggttcaagatccttcaaatctgtgtttggatcttcaaaaaaggttttatcaacatctgtccctggatccagaattatt

SEQ ID NO: 5061 - DNA, 261 bp, Triticum aestivum
  Clone ID: LIB3281-020-P1-K1-D11
ccgcgccatgggcgtccagggccaccccgagtacagcaaggacatcctcatgagcatcgccgaccgcctcctccgccagaacctcctcctggactgccaggtggacgtggccaaggcgagcttcgacgtgcggcagccggacaaagagttctggaagaaggtgtgcagggggttcctcaagggcaggctccagccgcagcagcagaagcagcaacataagctgcagctataggagtcggaggagtcggagccggcggcgag

SEQ ID NO: 5062 - DNA, 387 bp, Triticum aestivum
  Clone ID: LIB3281-020-P1-K1-D12
cccacgcgtgcgatatcctgtgatcaaatacatcccatttcctgagtcaaggcctttctcccgagacaaggaagaatctgacgctcctcaatattttcgagatgtggcctgctgcaataatatgatcaagtttgtccacatagaatctcatgacccttgctgcactggaaataaagattggaaagccaccacatggaataggaagctttcttggggatattggcgtcagcgattcacagttaaaggtgatgatatctccgccgaccaaagtattctgctttattgcctgagctgtgggacagcgaaacaggaaagttagatctgaagaaactaaatttctacacccccaccctcagcatgtgcgatgatgattttctttacgtcatg

SEQ ID NO: 5063 - DNA, 336 bp, Triticum aestivum
  Clone ID: LIB3281-020-P1-K1-D2
ggacgcttcatgaggtggtgaatggcttcttttggaaaggaagcccggtccgtgctctcgatcgagggcctgatcacttgacggcacttggtctcatcccacttggaactggctcagactttgctaggacatttggatggtcaaatgatccccgtcaggcgattgatcgaattgtgagaggagttaaatcaaaattagacattggcatgatggaaggtccaaatggagacccacatttcttcataaatgttgctgacatccatctgagtgccaaggcaggttattttgcttctatgtacaagaggtttggcaacttatgttatgttctgggagctt

SEQ ID NO: 5064 - DNA, 402 bp, Triticum aestivum
  Clone ID: LIB3281-020-P1-K1-D3
caaagacaagtgaacctgaccggagagaaaggtgaagcgaagatgtcggcgcgcggcaagggaggcaagggtctgggcaagggcggcgccaagcgccaccggaaggtgctgcgggacaacatccagggcatcaccaagccggcgatccggcgcctggcgcggatgtgcggcgtgaagcgcatctcggggctcatctacgaggagacccgcggcgtgctcaagatcttcctcgagaacgttatccgcgacgccgtcacctacaccgagcacgcccgccgcaagaccgttaccgtcatggacgtcgtctacgccctcaagcgccagggacgcaccctctacggattcgggggctaggctccggcgaggcgaatcgagctcgcaccacttgatcagatgttcaga

SEQ ID NO: 5065 - DNA, 277 bp, Triticum aestivum
  Clone ID: LIB3281-020-P1-K1-D4
caaagacatgttaacctgaccggtgagaaaggtgaagcgaaaatgtcatggcgcgtcaagggaagcatgggtctgagcatggtcggcgccaagcgccaccgtatggtgctgcgtttacaacattcagtgcatcaccaagccgtccatacgttgcctgcctcgcctaggcgctttgaagcgcattttggggctaatttacaaggagacccgcggtgtgctcatgatcttcctggaaaactttattcccgacgcctactctttaaccaagctctcctac

SEQ ID NO: 5066 - DNA, 195 bp, Triticum aestivum
  Clone ID: LIB3281-020-P1-K1-D5
cgtacgcgtgggcgaatccaagataggagcagggcgaaaggaggccgtcggcgatgtcttagaagaagcgcgcccccgacccgcgcaaggactaggtgtttacccttgattacactcatcatctatacaatcatccttcatgtatgcacctttaataagaaggcaccttattccatttagcatatctgtaagttt

SEQ ID NO: 5067 - DNA, 398 bp, Triticum aestivum
  Clone ID: LIB3281-020-P1-K1-D6
cggacgcgtgggcggacgcgtgggcggacgcgtgggcggacgcgtggggaagagcagagtccccttgatgatcatttcagtcttgcggatttgtctggatgcccaaatcaagatgatggatatgtacgtcaggctggccctatcatgtttagtgacccatcaaatggtgatcaggcatattatcctatgagaacttatggtaatcgaaaccatgcctatcgggctcttagtgctgaggagttctccgacacaggaaatggtaccaatgcgtattcaggacagcagcaagcttgtccttcagatgaccagaacttgtattctgggctgcagcaagcttgtccttcagatgagcagaacttgtatttgccaaccaatggtctgccatttccacagcaatt

SEQ ID NO: 5068 - DNA, 60 bp, Triticum aestivum
  Clone ID: LIB3281-020-P1-K1-D7
gatgacagcaaggaggtgacatcagtaactgaaatgaaaatgttttttagaacagataac

SEQ ID NO: 5069 - DNA, 225 bp, Triticum aestivum
  Clone ID: LIB3281-020-P1-K1-D8
aggagccacccccctccccattcctacccacccagcatctcggcagtaactctcctccctcccacgcggcgcgcccgctcgccgcgcgcgcgaatctcggtcgcaactggtgtactgttgaaggaaggaaaaatcatcctatttgtcatggcgggaactgactcctcggcgtcatctagacaaaacaagttcaactcattaaccaaggacctaaaactttctttg

SEQ ID NO: 5070 - DNA, 381 bp, Triticum aestivum
  Clone ID: LIB3281-020-P1-K1-D9
cggacgcgtgggcggacgcgtgggctggaaacaaggtcaaatgctaaattgtcaagaatatcttcgatggaatcttttaagaatatggacagtagatattcaaagaaaaacaagaagttcgaatttaacagcaatcgcgtgtcccctgttccaaatggcggttcaagatccttcaatcctgtgtttggatcttcaaaaaagtttttatcagcatctgtccctggatccagaattatttctagggccacatcacctgtttcaagaaggtcaagtcctccacgttctataacaccaacacctactttgaggagtctaacttctcctggaggtgtcatcaatggcaccaagatgacaaatgatagccaaactcaagaagttcta

SEQ ID NO: 5071 - DNA, 82 bp, Triticum aestivum
  Clone ID: LIB3281-020-P1-K1-E1
cccacgcgtgcgcggacgcttgttctttttcatgtgaaatccaatgccctgtggacttaaaactggtgcgggagtgcaaaaa

SEQ ID NO: 5072 - DNA, 372 bp, Triticum aestivum
  Clone ID: LIB3281-020-P1-K1-E10
gccgcgtggtggtgcggtgctggtggtgcggggctgatggcggcggggttgagcgcgcgaggtcctgctggtccggtgtctcggggcggctcgtcatgactctgtggtgggcgctggctggaggaggagaggcccggcgcagctggctggtgatggcgtgtcgctgcgaagcgcgcaggccggtggcggcttggtgctcctcaccgcggaggcgctcgtgccaggccagatctgcgttgcctggaggtgagggctcatggccggcgcacggcaggtgaggtggtgatgcggagggcctgacggtgtgtggcaaaagagatcgtgctcgatctgatgggggtggcgccagcgcaaggcagagctgtgttctca

SEQ ID NO: 5073 - DNA, 387 bp, Triticum aestivum
  Clone ID: LIB3281-020-P1-K1-E11
cccacgcgtccggcccacccgatcccggatccccgatcccccccggcgcgatggcggccagcctgtggcgcgcggtcatgggctcctcctcctcctcctcgtcgggcggcgtcgacgacccggcggctggcggcgtggagttctggcacggggcggagcgcgcggggtggctgaccaagcagggcgagtacatcaagacgtggcggcggcgctggttcgtgctcaagcagggccggctcttctggttcaaggacgccgtcgtcacgcgcggctccgtgccccgcgggatcatccccgtcttcttctgcctcaccgtcaagggcgccgaggacgtgctcaaccgccagttcgcctttgagctctccaccccggccgagaccatgtact

SEQ ID NO: 5074 - DNA, 363 bp, Triticum aestivum
  Clone ID: LIB3281-020-P1-K1-E12
cggacgcgtgggcgccaaaacttcaccggaacgggctagctcccggcattttcttcacagcccttgtgggggacgaaggcagtatattcggcggacggcgggccggcgcattttcttgcctgggaaggtgcatagtttgctggcttgtgttagctcgggggaccagcaaagttactgaaaatggtgggtcttgctggttccatcatcttaaaatctggaaaagcacttgtttcgagacagtatgttgacatgtctcgaattaggatcgaaggattacttgcagcattcccaaaacttgttggaactgggaagcagcacacttatcttgagactgaaagtgtccggtatgtttattaacctatt

SEQ ID NO: 5075 - DNA, 355 bp, Triticum aestivum
  Clone ID: LIB3281-020-P1-K1-E2
cccacgcgttcgcggacgcgtgggcacgccacctggaaggtgttcttcctgctgcgctctactgtgctgccgtggcgtggagatccaaccggagctggaccgactccttttgctgaaccggtgtgctagctacggaagcggccatggaagtggtttcttccagtcactcttgcttggcatttcatcaaacccctaccagtgcgcggaggtctctgggcactggtcttggtccgcggcataccaagcttgctcggccaagaaaaagctcagttctctgtgttgggagagcttcaaatcctggtgattcaggaaaagctaatgtcagccgcagcttcggtgtaagcgatgtcgatgc

SEQ ID NO: 5076 - DNA, 357 bp, Triticum aestivum
  Clone ID: LIB3281-020-P1-K1-E5
ttatgactgatgcattcaggaaatctgttcgccacgaagggtttggtgctctggacaagggtcttgtgcccaactcggttaaggtggtgccttccatcgacatctcgtttgtgacgtacgactccgtgaaggatgtcctagtactatagatgaggatagactgaagattcggacctagctctctccgtggtatctacttttatttatgtaggtgtcgagatccctttttttgcgaggcatggcttagtagatggacactatgtcccttcgcttcattcagggttaggccttctcagaccttgtctatatatcctactagtggctccgcaacccttattttgttttgatttcgaaagt

SEQ ID NO: 5077 - DNA, 391 bp, Triticum aestivum
  Clone ID: LIB3281-020-P1-K1-E7
ggaggaagggaagatgccggcggggcacgggctgcggtcgcggacgcgcgacctgttcgcgcggcccttccgcaagaaggggtacatcccgctcaccacctacctgcgcacctacaaggtcggcgagcatgtcgacgtcaaggtgaacggcgccgtccacaagggtatgccgcacaagttctaccacggccgcaccggtcgcgtctggaacgtcaccaagcgcgccatcggcgtcgagatcaacaagcaggttggcaacaggatcatcaagaagaggatccatgtgcgtgtggagcacgtgcagccatccaggtgcaacgaggagttcctccagaggaagctcaacaacgacaagctgaaggcggaggccaaggtgcgtggtgaggtcatc

SEQ ID NO: 5078 - DNA, 352 bp, Triticum aestivum
  Clone ID: LIB3281-020-P1-K1-E8
tgtccttcttgacaatgaggccatctatgacatctgccgccgctcccttgacattgagcgcccaacatacaccaacctcaacaggctcgtttctcaggtcatctcatccctgactgcttccctgaggtttgatggtgctctgaatgttgatgtgaacgaattccagaccaacctggtgccctacccaaggatccacttcatgctttgctcctacgccccagtcatctcagctgagaaggcttaccatgagcagctctctgtcgctgagatcaccaacagcgccttcgagccatcctccatgatggccaagtgtgacccccgccacggcaagtacatggcctgctgtctcatg

SEQ ID NO: 5079 - DNA, 333 bp, Triticum aestivum
  Clone ID: LIB3281-020-P1-K1-E9
cccacgcgtccgcccacgcgtccggaaacttgttcaggaccactcgacaattgaagctgcccttaggacatcatccaagctggttgtgagctctaatgggaaaagggtcagaaggttacatcccttaccatgcaatgaattgaaagacgtgaagaaaaggactgttgtgatggaaaatctacctctggattttgccctggagagtgtacaggaaaaatttggatcagttggcaagattatgaaaataaccatccatgatccacattcagttggtgaatctggagcatcgaagaagcctgactttatgttgagtaataaggcacatgccattgt

SEQ ID NO: 5080 - DNA, 349 bp, Triticum aestivum
  Clone ID: LIB3281-020-P1-K1-F1
cggacgcgtggggaagctccccggcgtccgtgagctatttgacaagccacctgaggtccgcaagcgccgcacccgctacgagatccacaagcgcatcaatgccgggtactacggatactatgacgacgaggacggtgtgcttgaaccccttgaggctgctgccgagaagcgcatgcgggatgaggttgtcacggagtggcaccgtgtggagcgtgtgcggcgggaggccatgaacaatgtggtgagtggcgaggtggctgcagcaggtgggcgtggtggggaagctgctagggaggtgctgttcgaagaggtggaggaggaagttgacgatgagaggaggcttgaggaa

SEQ ID NO: 5081 - DNA, 291 bp, Triticum aestivum
  Clone ID: LIB3281-020-P1-K1-F10
agcggaagaggatgtgatcgggggtcaccatcaagagagtgcttccttggctcggtaccaaagtaaaatggtttagtgactggttaggttaggttatggtcttctttccagatacttcttcagtttctaatgcttctcataattcatttttgcacattgatggaattgcaccgattgctttcatcagttgagtacacaccaaacactttcctctcagatctacctttaaatgatagttctctatatttcataaagttaaatgcagcaaatcctcatggtgttctcaaaaac

SEQ ID NO: 5082 - DNA, 384 bp, Triticum aestivum
  Clone ID: LIB3281-020-P1-K1-F11
cggacgcgtgggcggactcgtgggcccatatcgagtgggtgccagctcggctgggaaccaacgtgaagtgctttagggactgcttaggctaggttatggccttctttccagatacttcttcagtttctaatgcttctcataattcatttttgcacattgatggaattgcacctattgctttcatcagttgagtacacaccaaacactttcctctcagatctacctttaattgatagttctctatatttcataaagttaaatgcagcaaatcctcatggtgttctcaaaaactatgttttatcaatttcatatagtttagtactccctccgtccctacatataagacgtttttgcagtttgattcgaactgaataatgtcttata

SEQ ID NO: 5083 - DNA, 360 bp, Triticum aestivum
  Clone ID: LIB3281-020-P1-K1-F12
gcgatctcgtcctgaaccaccggccgcgactgctgctccgcttgctctcccccgtcggagatccgcccggagcgactttcgtctttctgggtagtgccgacgctacagaaagcccaaacccggaaacagagaagacgacgccacatctacatttgcactcccacgcttaaagccggaggcggcgtaggaagcagcgatagccatggcgtcgtcgttggcaacggcaccggctgctgtacgtgaaatgcagagcgaccttgagtcccaggccaacgccctcagcaagatccagaaagacatctccaagaaccacgaggtccgcaagcagttcaccatccaggtcggcgagaatgaactcgt

SEQ ID NO: 5084 - DNA, 324 bp, Triticum aestivum
  Clone ID: LIB3281-020-P1-K1-F2
ctcgtcgcctttcacaccgaggtggagcaaatatgtctctgtacagccctcatgctcgcaggggccttgcgagaagtggaaggtagaggtcgtacgccagccggagcaacaggagcaaggatctggcgtcatctgcctcccggttgcacaacaccactgcatctccttcctgttgttgttggcggcatccgcctctcagttgcatgctgccactgcatctccttcctgttttatttttagattttacatgttcagctataggttggcttgatctcttgtgtcagggaggtgcgaggttaggcatttaggcaatggcaggcacag

SEQ ID NO: 5085 - DNA, 371 bp, Triticum aestivum
  Clone ID: LIB3281-020-P1-K1-F3
aactcacttgttgagctccacactccagctccagcgcagccgcaaagtgcagagtgagtgagtgggcatgggcgaggaggccaattgcgacgccgtgatggaggacggcaacggcaacggcaacggcaaggccaaggagaacggccacgccacagccgttgtggccatgccggacgtcaaggccaaggccgaggacgccgtggtggcgccgggtgacccccgcctgcagggcatctccgacgccatccgggtcgtcccgcacttccccaagcaaggcattatgttcaacgacatcacgacgctcctgctgcggaccggggtggtcaaggaacgccctgacatgttcgtggagcgctaccggggcatgggca

SEQ ID NO: 5086 - DNA, 371 bp, Triticum aestivum
  Clone ID: LIB3281-020-P1-K1-F4
aactcacttgttgagctccacactccatctccagcgcagtcgcaaagtgcagagtgagtgagtgggcatgggcgaggaggccaattgcgacgccgtgatggaggacggcaacggcaacggcaacggcaaggccaaggtgaacggccacgccacagccgttgtggccatgccggacgtcaaggccaaggccgaggacgccgtggtggcgccgggtgacccccgtctgcagggcatctccgacgccatccgcgtcgtcccgtactttcccaagcaaggcattatgttcaacgacatcacgacgctcctgctgcggaccggggtgttcaaggacgccctggacatgttcgtggagcgctaccgttggatggtca

SEQ ID NO: 5087 - DNA, 62 bp, Triticum aestivum
  Clone ID: LIB3281-020-P1-K1-F5
cggacgcgtggggtgtagtagtggggaagaggaggaagaatggcggacgtcgagggccgttg

SEQ ID NO: 5088 - DNA, 400 bp, Triticum aestivum
  unsure (1)...(400): unsure at all n locations
  Clone ID: LIB3281-020-P1-K1-F6
tcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaagaagaatgttgagtccgccacanagtatcttcttagcaagctcaaggaccttc

SEQ ID NO: 5089 - DNA, 395 bp, Triticum aestivum
  Clone ID: LIB3281-020-P1-K1-F7
cggacgcgtgggtcaccccgtcgccatcaggcacggcggcgggggcaccgccgcacggccatcgatctggcagcaccggaacggaactgctctactgcagtgatgtgcggcccacaatctcttgtacagctcgcgtttggaggcggaggcaagggggaggaggcgctcgcggacaagtcgaggaacggcccacggcgcgagcggcggccggcggcgagactaaggtgcagaaactcttcgtccgacgggaaggcgactccttccccatccccattgattaaccgcccgaccatgactagatttgaagatcaatccacgtcggtgactctgcttgccggtcaaggtaggggaggtcactgcatgtcgcacggactgcaaccccatggctcacaacc

SEQ ID NO: 5090 - DNA, 399 bp, Triticum aestivum
  Clone ID: LIB3281-020-P1-K1-F9
ggcatcactcaggaccaagtgattctcatggctgctagggcgtctcgaacagaaaaccaagatgctattgatacagcaattgtggggatgctagctgatccgaaagaggcacgtgctggtattcaagaagttcattttctgccattcaatcctactgacaagaggacggcgctgacatacattgacgctgatggcaaaatgcaccgtgttagtaagggtgcaccggagcagattcttcacctcgctcacaacacatcggagatagagcggagggtccatgctgtgattgacaaatttgcagagcgtggacttcgatcgcttgctgtagcgtatcaggaagtaccagatgggaggaaagaaagccctggtggcccatggcattttgctggtctgatgcca

SEQ ID NO: 5091 - DNA, 401 bp, Triticum aestivum
  unsure (1)...(401): unsure at all n locations
  Clone ID: LIB3281-020-P1-K1-G1
ttctcttggtaattttctttgcccgcttctcttgcttcagtgcatttgctctttgcttcatataaacaagatttttgaggtaggaatatcagagcatctggcaaataagttgcaacatatgagcattgacttggttgaaaaggcaaattcttcaattacagcagagctggattatgtatcgaatctggtgattggtgtcattgacgtacaacggagtaaggaaaaaggctatgaaacattggtgaaagaaaatttatgtgatgagttggatgaactgaggatggtgtatgaaggattacctgactttctggagcaggtttcagctaatgaaaatgcctncttccctttctcgctcgaatgcagaaaagctccgctaattgtctatgtacaccaaataggat

SEQ ID NO: 5092 - DNA, 286 bp, Triticum aestivum
  Clone ID: LIB3281-020-P1-K1-G10
gacacgcgttcgggcacgcgttcgtaaactcgggccagttggtcttgcgtgatcccgctgtacgattccttgttcctcgccctcatcctctggagcaagggtcgaggacagcaatgggggagactgctagagagcgcgccctgagccgcatccacagcgtgagggagcgcacttgtgattccttgtctgcgcacacaaatgaactttgttgtcgtgtttttaaggcttggtaaccaaagaaagggggtgcttcagtcccattacatcactgtttgaatacaaatgc

SEQ ID NO: 5093 - DNA, 365 bp, Triticum aestivum
  Clone ID: LIB3281-020-P1-K1-G11
ggaaagagaacattcatccacacaggagaaactggatatggagctgcaagatctggataaaagacttcagcaaaaggaggcggagatgaaacaatttgatactgttcgcaagcaacattatgagacgaagttagacgagatggtacaagaaaagagggctttacagaaagaaattgtggatctccgtcatgcagtagcgaatacatctaactcaactgataagtggtcaaactatcttgagaagctgaacatgattgaaactcaggtctctcagcatgagaaaaagcgggaggctcatgaacagttgctacgacataaacaaaaaagtgatgatgaagctatgcgtttacaaggagaaattcaac

SEQ ID NO: 5094 - DNA, 387 bp, Triticum aestivum
  Clone ID: LIB3281-020-P1-K1-G12
cggacgcgtgggcttccagcgcatggctggaatttgattaattttaggccattaattgttggcaatgctacaaaggcatcatctccatgcagcccctgcccgaaaggagcaactacattttgtctttaatgcatgcatgtttggctgaattccccccttctatattttgcagttatattgctctcacaaatcaaacaacctatgaagtggccagaaggaagcggatattctacttaaggggaattcctgatagagttcatccgttcagtaaaggcatatgcagaaacatctatgacttctgcttcactagagagaatggatttgttctcgaggccgcgcccccaattgaggagctggaagccagagcagccccgtacacatgccgag

SEQ ID NO: 5095 - DNA, 397 bp, Triticum aestivum
  Clone ID: LIB3281-020-P1-K1-G2
gatggaccctgcacagagcctacttgtgaaactgctgttcatgtgcacgaattcaatgtggacgttgctatttctgaggatggtcatggcacaatggcccttggcagcgtccaagcgtctacgacggaactaaaggatttggagagtggaagatgtctagaacatggaacaggtacttctttatctgcttgcaatgttcatcaaagcccactgaaagaacttagttatggtatttcagtaatccctgaccctgttgagcatgatggcacaggaacccctgtggctcttcaggagggaactgctgtcgctgcagaaccagaagcaaagaaagaggtcgacgaacctaaagatgttgagccggctgccataaagccagaggcggtggagcatgatggta

SEQ ID NO: 5096 - DNA, 398 bp, Triticum aestivum
  Clone ID: LIB3281-020-P1-K1-G3
cccggacgagctcatcaaggacgccctctcggccataaaggagaccctccaaggtgagaagctgacgagctccaactgcaccattgccattgtcggcagaaaggaggacggcaccgtcgagcccttctccatgatcgactccaagaggatccaggagatcattgactccatggaggccgccgacgaggcgccagcggccgatgtgccagctgaatcaagctcgatgcaggaggacaggggcgatgcgcctgcggcaagggatgccccggcggcggacgagcccgctgcaccagatgccccagcgccgatggacatctaggcgtcgtctgatcgatacatgtcatgtccgtccacccccttgtcgcaacactattcagaatttccaaaaagactagact

SEQ ID NO: 5097 - DNA, 404 bp, Triticum aestivum
  Clone ID: LIB3281-020-P1-K1-G4
cccggacgtgctcatcaaggacgccctctcggccataaaggagaccctccaaggtgagaagctgacgagctccaactgcaccattgccattgtcggcagaaaggaggacggcaccgtcgagcccttctccatgatcgactccaagaggatccaggagatcattgactccatggaggccgccgacgaggcgccagcggccgatgtgccagctgaatcaagctcgatgcatgaggacaggggcgatgcgcctgcggcaagggatgccccggcggcggacgagcccgctgcaccagatgccccagcgccgatggacatctaggcgtcgtctgatcgatacatgtcatgtccgtccacccccttgtcgcaacactattcagaatttccaaaaagactagactgttgtt

SEQ ID NO: 5098 - DNA, 372 bp, Triticum aestivum
  Clone ID: LIB3281-020-P1-K1-G5
cgcgtccggcgacgacgagctcacccagttttggttggcagagtgaagcggcggccggcgacgatgcgcaagtgggcgctctcctgcgcgctcctcctcgtccttctactcaccaccctccccgatccagctaagaagctccaagtcaatgccgaggagagcagcgacgaggtgggtgactttcccaaggtagaggagaagcttggggccgtcccccatggcttgtccaccgactccgaggtttgccagagggagtccgagtcgatctcgaggaagaccctcaggaactcggctgaaaagttcgagttccaggcagtggtgttcaggctcatggacatcatcatcaacttactttacagcaacaaggacatc

SEQ ID NO: 5099 - DNA, 397 bp, Triticum aestivum
  Clone ID: LIB3281-020-P1-K1-G6
cccacgcgtccgcgcatttccaagaacacctctcccttcccttgctctgccctctccatctccatctccggctccgggaagaagaagaagaggtagccatgtctccgctcgccgaccttctcagcctcgacctgtccggctgcaccggcaagatcatcgccgagtacatatgggtcggcggcacagggatggacgtcaggagcaaagccaggacgctgcccgggcccgtggaggaccccagcaagcttccaaaatggaattttgacggctccagcaccggccaagccacgggtgacgacagcgaagtcatcctctgccctcaagccatcttcaaggacccattcaggagggggaacaacatcctggtcatctgtgactgctatgcgcctaacggaga

SEQ ID NO: 5100 - DNA, 415 bp, Triticum aestivum
  Clone ID: LIB3281-020-P1-K1-G7
gtgacggtgccgtccaatggccagctcccacagcagaagcttgtcttccggaagacgaacgaggaatccaagccggctgctgctcaagatgagaagttcctgccgacagtttgatgctccatatttttgcagaggatctataaataagtgtagatacatataagggtggcgaactggtagtgtatctctttgggcatatcatagcagggttatgcagccagaattctttgctccaaaattacattagcagtagcacaaccctataaaaacagaggttgccaaagagcctggcacgcctctgcttccagatgtccagcatgctaaggttgtctggccatttgaaaatgttgttttgcttctgctttgagccaagtagaaatgcattcactgcatttccatgttcgttgacgatctc

SEQ ID NO: 5101 - DNA, 250 bp, Triticum aestivum
  Clone ID: LIB3281-020-P1-K1-G8
gttgttggagccggaccccgcgcccgcgttatatctgctggagcgcgagcccgatcccgtcagtgtcccggtggtggctactcagagtgggagccaagctagagcggccagatcccactcacccacccaatgcgcgcgcgcccctcgtgagctaccagagccgaccgacacactcaccagagcaccgccgaacggacgaacgccatggtgaaggcgaagctcctcgctgtgctggccctcgtggccgttt

SEQ ID NO: 5102 - DNA, 314 bp, Triticum aestivum
  Clone ID: LIB3281-020-P1-K1-G9
cccacgcgtccgcccacgcgtccgcaaacccgggccagttcgcctcgcgtttccccggtgacgtttccttgttcctcgccctcctcctctggagcaaggtttgaggacagcaatgggggagactgctggagagcgcgccctgagccgcatccacagcgtgagggagcgcatcggtgattccctctctgcgcacaccaatgagctcgtcgccgtcttctcaaggcttgttaaccaaggaaaggggatgctgcagccccatcagatcactgctgagtacaatgccgcgatccctgaggccgagcgcgagaagctta

SEQ ID NO: 5103 - DNA, 348 bp, Triticum aestivum
  Clone ID: LIB3281-020-P1-K1-H1
cggacgcgtgggcggacgcgtgggggatgtgtgaagatatatacttcagctgcgacactatcgttgcctgggaaaaaaagaagctgcaacactatcgtttgctcacctgtgtgtttttactagcactataccaaccgtttttgattttaaaaaggtgtagcacccctatgaagtaatgaactttgctgatttggtgctaccacccccaaaatctcaagaaatgaatagctccacttgcactgcaatgttcttttggaagctacacgctccagagcttcatagcattcctgttccagccttattcattctgtgaatacgtcagagatggctccgttgttagctgtaaga

SEQ ID NO: 5104 - DNA, 403 bp, Triticum aestivum
  Clone ID: LIB3281-020-P1-K1-H10
gacctgacctagggtttgctctcctttcctcccccgtcctggtcttacccgatccgccttacaccccctcgatctcctcccccagccgccgtaggcggaggcgggggcgggggcgagcagcgacgacaagctcgtccaacgcctgcccgcctcggcgaaaagcctgtcgccatgtctgacatggagtccgtggctacccttatggagtcgacaagcttgaagatacagcagcttcagcgagcatttgctgagcttgagagccagagcgctgttaccatgaactttaagtggaagcagctcgaggaccatttccggggccttgagcagtccctcaagaaaaagtttgatgagctgaaaaaacaggagaaggagttgcaggagacagtcgcaaaatcggagaagg

SEQ ID NO: 5105 - DNA, 355 bp, Triticum aestivum
  Clone ID: LIB3281-020-P1-K1-H11
tctgcctcctccaccgcgtgcgtgctggtcgcagctccggggggagaccagaccagactacctcgcccgcccgcccgtccgccggcggagggagcccgccccgcctgccgtcctcctcctcccgtacagcggccggcattgggatctcgcggctcgcccccgcgccaccccgtgcaaaccctagccgcccgcaggggtgggtcgcgtcgcggcagcaggatccaacgttactcaacattgattatgcttggtggatgaggatgccacactaaagaacgtgggggtttgataaggctcttgaagctcgccagtgagggtctagaagctgtgcctttgaagactataacccatgtta

SEQ ID NO: 5106 - DNA, 403 bp, Triticum aestivum
  Clone ID: LIB3281-020-P1-K1-H12
tcgcggacgcgtgggcaaatcccaaatcaccaaccaaatcccccctcccgcgtgccgacgagcaccagccgccagacatggacgcctcagccaccggagcgggagcgaaggcgaagaagggcgcggccgggcgcaaggccggcggccccaggaagaagtcggtgacgcggtccgtcaaggccgggctccagttccccgtcggccgcatcgggcgctacctcaagaacggccggtacgcgaagcgcgtcggcacgggcgcccccgtctacctcgcggccgtcctcgagtacctggccgcggagctgctggagctcgccgggaacgccgccaaggacaacaagaagtcgcgcatcgtgcccaggcaccttgtgctggccgtgaggaacgaccaggagctcgggag

SEQ ID NO: 5107 - DNA, 389 bp, Triticum aestivum
  Clone ID: LIB3281-020-P1-K1-H2
cccacgcgtccgcccacgcgtccgctttttttttttttttttgagatgaactattatcacaagacgatccggagaatgtacactaagaataatctaatcttataccttgccgctatcagtacactagtaaccaggttgaatctaaaaggtttttttttcttgcgagaacgcacaggaaacgcgctacacttgaccgtggctgctgctcttgtcttcttctccatttcttttctggccttcgtgtcttcttgactccagtgaaaggctaggaacctgagaatggagcaagggaatttgctgggagggcaacgccgccacctcgcagagaaactgtgggacggctccaggcatccatggctatggcattcgaatcgaaaaataccacaacg

SEQ ID NO: 5108 - DNA, 71 bp, Triticum aestivum
  Clone ID: LIB3281-020-P1-K1-H3
cccacgcgtcctcccacgcgaccgctttttgttcttaatggagacattaccaggtttaacatgacgatccg

SEQ ID NO: 5109 - DNA, 383 bp, Triticum aestivum
  Clone ID: LIB3281-020-P1-K1-H4
gatgaacttgcactaactggccacctgttcttctctatgtgtgaggatggctggctggtggcaaggttaagctctctggttccattagcagtcaatacctgagtcccttgctgatggctgctcctttggctcttgaagacgtcgagattgaaatcattgataaactgatctccgttccttacgttggaccgacattgaacttgatggagcgtcttgacgtcactgccggccacttctgatagttgtgacagatcatacatcaagggaggacaaaaatacaagtccccaggcaatgcctatgttgcacgtgatgcctcaagtgcgagctatttcctggctggagctgccatcaccggagggactgagactgtcgaatgttgcgg

SEQ ID NO: 5110 - DNA, 276 bp, Triticum aestivum
  Clone ID: LIB3281-020-P1-K1-H5
tcccgtggcccttgtgcgtcccaaaggctaaggtggtgcggtgaaggtgctgagcctgggcgacgtctacggcgcctacaccttcgacgactcgagaatggaggacagcgcctgcgctcacagctacttcaaggtgggcgctcgcaccgtcggctcactcgctcgtctacgtctccaccaaggagccggtgacgaggctccctactccgtggaccgtggtgtacaggaccaacctttccgacggcattaccgtgcgccttaccccgccaggccagt

SEQ ID NO: 5111 - DNA, 255 bp, Triticum aestivum
  Clone ID: LIB3281-020-P1-K1-H6
cggacgcgtgggcaaatcccaaatcaccaaccaaatcccccctgccgcgtgccgacgagaaccatacggcagacatcgacttctgaggctacgcggatggaggacagcgcctacatcggcgccggcttcaaggtgggcgctcgcaccagtaagcactcgctcgtctacgtctccaccaaggagctcttgacgaggcgccgcacgccgtgtaccgtggtgtacatgaccaatcctcgaagcgcgttgacacgggcg

SEQ ID NO: 5112 - DNA, 300 bp, Triticum aestivum
  Clone ID: LIB3281-020-P1-K1-H7
cggacgcgtgggttccggtgttcttcgttcaggcccttcttgtgtttgttgggcctacatttgttaaggaggagaacagtgcacagggaaggagagtgtttgctaaatacttcattcagacgtccatgccagttggggacaccaatgtttgcacctatccgttgtttggcaccatttttctgggacttatcgatgccgtcctgatgagctatgtctcctatgttggatctcgggtgttatccttggtcatcaacaaggcgctgcgaaagagggtttcctggctggtaatgtcggtgcttt

SEQ ID NO: 5113 - DNA, 309 bp, Triticum aestivum
  Clone ID: LIB3281-020-P1-K1-H8
gttggttcacacacacagcctggattgcttcttgcttcttgtataaaaaaacacatttttaatccaacgtaacctgaaaggtggcttggtctggataaagaaaaaagagtttcatggggtgccatcccatggaacattggaatctttttccaccttttaagttttgttttttctttttgcgagggctttccacatcttagttgaccccgaaaggttctatgcctaaatctaaaaataaaataaaacatgtcaattcgtcatgtatgggaaattagacctgtattaatatattttgagcctgtcttacga

SEQ ID NO: 5114 - DNA, 365 bp, Triticum aestivum
  Clone ID: LIB3281-020-P1-K1-H9
cgcacgcttggtgctgcaaagttgaaggggtctcagagcatgctgcacgagcttcacctaatctagctgcacatggagacaacaacgacaataatgctgctgttggccaggaaccaggtgctcttgaagctttggtgcaactaacacattctcccagtgaaggcggtagacaagaagctgctggcgctttgtggaacttgtcatttgatgatagaaatcgggaatccatagcttctgctggtggtgttcaagctctggtctcactctgtcaagaatgtttaaatgctccggacggtcttcaggagagagctgcgggtgctctctggggactatctgtttcaaaagcctacagcattgctattgga

SEQ ID NO: 5115 - DNA, 146 bp, Triticum aestivum
  Clone ID: LIB3281-021-P1-K1-A1
aaaaaaaggaagaggaaaaagatcataccggtcgcgcagaacctaatcctgcggctgatggaggacccggagcaccgcgactaggcgcaaagggcgcaccactacaaccagtaagaaggagcggcacgagcccaaaaagggggggg

SEQ ID NO: 5116 - DNA, 333 bp, Triticum aestivum
  Clone ID: LIB3281-021-P1-K1-A10
ctgcaggcagcctcgggtcggttcgagcagccgacacctgccacccgcgccgccgccgccgccgccgctagggcttcctccctccacgccgcccgcgatcgccgccgccgccggcggagatggcggaccggctcacgcggatcgccatcgtcaacgacgaccgctgcaagcccaagaagtgccgccaggagtgcaagaagagctgccccgtcgtcaagaccgggaagttgtgcattgaagttggtccggcgtccaaggtttccttcatctctgaagagctgtgcattggttgtggtatttgtgtcaagaaatgcccatttgatgccatcgaga

SEQ ID NO: 5117 - DNA, 312 bp, Triticum aestivum
  Clone ID: LIB3281-021-P1-K1-A11
cggacgcgtgggcggacgcgtgggcggacgcgtgggcggacgcgtgggttcatgtcatacgttatgctgtttaggattgtttttttccagaaattttatcgtcatgtatatatttggtaccactggttcttgcatatgtcacataccagcaattattttctcaaattcttttgggtaacattgttgtatcttgtattgtagtcatggttttcttagataattgaaaggccacaaagttgtgtccaaagttaatggctggccagacccaaggtacatggacatgtattcgtgtggtgacacgtacagcaccga

SEQ ID NO: 5118 - DNA, 305 bp, Triticum aestivum
  unsure (1)...(305): unsure at all n locations
  Clone ID: LIB3281-021-P1-K1-A12
aagatctgagagccaactttcacattgctgatggcaacaagagggtaacatcagacagtacactagaacataacacggccaagctaccacgaacgagggaccttcctaccacgatacaagatcagacacatgctatgatgaagctaacatctctacacctccagatcagacaaatacgaggcaacctacgccctctcgccacggatgcggcgggcgagctggatgtccttgggcatgatggtgacgcgcttggcgtggatggcgcanaggttggtgtcctcgaacagccccacgaggtaggcctc

SEQ ID NO: 5119 - DNA, 334 bp, Triticum aestivum
  unsure (1)...(334): unsure at all n locations
  Clone ID: LIB3281-021-P1-K1-A4
cccacgcgtccgcggacgcgtgggtccgtacctgtctgctccgtccgcctccgaagctttgcggctccagggtttagctagggttctacccacgaccaccgncgccgcccgccccgccgccgncgcagccatggccggcgccggcgccggaaaggaagacgccgcgtgggagcgccccatcagcgcgggcggcaagagggcgccggtcttccccttcttcggccccaaaaccctaacccttgacggggccggcaaggtcttcaacggccggcttcccttggcggggctctttgaacggttccccttgctcgaggagctcttcggcgggggcgcc

SEQ ID NO: 5120 - DNA, 185 bp, Triticum aestivum
  Clone ID: LIB3281-021-P1-K1-A5
ctgcaggcagcctggggtcggttcgagcagccgacacctgccacccgcgccggagtttacggggtcgaggggacaattagggttcaacccaaatatttatcggcatggatatatctggcaccactgggtcttggatatgtcacataccagcaattattttctcaaattcttttgggtaacattgg

SEQ ID NO: 5121 - DNA, 333 bp, Triticum aestivum
  Clone ID: LIB3281-021-P1-K1-A6
cgaggtcgcggccgtcatactcggcggtggcaccgggactcagctcttccctctcacaagcacaagggccacacctgctgttcctattggaggatgttacaggctcatcgatattcccatgagcaactgcttcaatagtggcatcaacaagatattcgtcatgacgcagttcaactcggcctctcttaatcgtcacattcaccgcacctacctcggcgggggaatcaatttcactgatggatctgttgaggtattggccgcgacgcaaatgcccggggaggctgctggatggttccgcggaacagcggatgccgtcagaaaatttatctgggt

SEQ ID NO: 5122 - DNA, 211 bp, Triticum aestivum
  Clone ID: LIB3281-021-P1-K1-A7
aaaaaaaggaagaggaaaaaggagaaacccggaagccggaatcccaatcgagcgaaggaagcagaactgggggatcgccgacgaggcggagggcggccgcgggagaaccatgaaggagccgtgcaagcaccacaagggcatctgggccctatgtgtgcgtcgggcctcgcccagcgcgccgtcgccggtcttctcggacccgccggcgcga

SEQ ID NO: 5123 - DNA, 147 bp, Triticum aestivum
  Clone ID: LIB3281-021-P1-K1-A8
tataaccccgccgggccgaaccggttccctggcggcggcttgacgggcgggccccggcaatcgggggtacccaacgccgggtggcggcgccttcccggcggtgtgcaccggagccaccctcgcccgaaaggaccccggcggcccccg

SEQ ID NO: 5124 - DNA, 263 bp, Triticum aestivum
  Clone ID: LIB3281-021-P1-K1-A9
ctgctggtctgagctatgtcacgctggggtcattcagctgggaccaggacaatgagaagatcagggtctacgtattccttgagaatgtcgaccaagagaaggtggagactactttcaagccaatgtcagcggacatcaagtttcatgatggtaaaggcaagaactataggggtgccaacccaaaactgaacaaaaaaaaaagtcccgaaaaaaggcaaggtgggggcaaagccaacaaaaatggccatcaccctgtggaaagc

SEQ ID NO: 5125 - DNA, 331 bp, Triticum aestivum
  Clone ID: LIB3281-021-P1-K1-B10
cggacgcgtgggcggacgcgtgggcgccacagcactaggctcccgtgtcagatccgcacggcatggcacctctccagacggggctccagcgaccaccgaattgaggtcggcgtggcctcgctgagcctgtggccttcgcatcctccggtggtgcggaccgttcatgcgtgcaatccgctagctgtggatgtgcagtgtgtgtgtgcaattcggcgtgagctcaaacaaagacacagatcagtccactatgttctctaatgcagaaaaatggaggaaaaaccaattataaaaaaggaaacacaagatgcagttttgctctctcgcggtggac

SEQ ID NO: 5126 - DNA, 330 bp, Triticum aestivum
  Clone ID: LIB3281-021-P1-K1-B11
ctcaatcaaatggctgacggtgaggacatccagccccttgtctgcgacaatggaactggcatggtcaaggctggttttgcaggggatgatgcacccagggccgtcttcccaagtatcgttgggcgcccccgccacactggtgtgatggtggggatggggcagaaagatgcatatgttggtgacgaggcccaatccaagaggggtatcctcaccttgaagtacccgatcgagcatggtatcgtcagcaactgggacgacatggagaagatctggcatcacactttctacaacgagctccgtgttgcacctgaggagcacccagtactgctg

SEQ ID NO: 5127 - DNA, 331 bp, Triticum aestivum
  Clone ID: LIB3281-021-P1-K1-B12
cgcaagcaaatggcggagggagaggacaaccaggccctagtccggggggggggaacaggcaaggggagggccggcagagcgggggacgacgcacccagggccggggccccaaggagcgcggggcgcccgcgccacacgggcgcgacggtggggagggggcagaaagaggcaaaagcgggagacgaggcccaacccaagaggggcaccctcaccggggagcacccgaacgagcacgggacagtcagcaacggggacgacagggagaagatgggggaagacacaatcaacaacgaggaacgagaagcaccagaggagcacccaggacgggggg

SEQ ID NO: 5128 - DNA, 323 bp, Triticum aestivum
  Clone ID: LIB3281-021-P1-K1-B3
cccagccgcaccgcacgcccgacgcgcagccgaaaccctagccccgcccggccggttccacccccgagcagggaggcggcaacggcgccctcctgccatggccgaaggaccgcacccaaaccacaccacgccagcaaggtgccccccgccgtataagggacgccaaaagcaaacgtcaaggtcaagatcacctgtagcccaatcccagtctagatctccatcgcctgaacctagagctcaggcgaggtcaagatctcgaatccctgcgagggaacaggagcctgaagctgtaaatcatggaaatactctagacattactggac

SEQ ID NO: 5129 - DNA, 219 bp, Triticum aestivum
  Clone ID: LIB3281-021-P1-K1-B4
gtgacgacgtgtaaatcagcccgaggttttgaatgggactttacaccaccaaattagaatgtgtgtatatatatctcattgtacacagctaaacaccatttttttgactaaaggagattatgtttactatcatatgtacttgcccacaagaggtcttttatcgtcggggcttgttacaggcatgatcagttcatgattttagaatatttttatacatgt

SEQ ID NO: 5130 - DNA, 329 bp, Triticum aestivum
  Clone ID: LIB3281-021-P1-K1-B5
cggacgcgtgggatataatcctagtgagagagagagagaataaagagagaagcgttgaataagaagaagtggagtgttgtgttcacggagttcttgcactcgatgcgggggcattgctccgtgtgatgcttaaatagcagattagtcatcttcagcgcagcactgcatgaggagatctttctgcatcgcttcctgtgccaatgttgattgatcaaacctgcatatgctggtggtagctgagaaaggagaaccactttttccatctttcggatagttgatggttatggaccgtacgggttggctctggaggcgcaagccttctgataata

SEQ ID NO: 5131 - DNA, 333 bp, Triticum aestivum
  Clone ID: LIB3281-021-P1-K1-B6
cccacgcgtccgcccacgcgtccgcccacgcgtccgggaccagattagcacaagaagctgcggcgagaatggagccaacccaatggtggtttcaatttggaggggatcttcctgcattgcagaagtgtgcaatgagagtttgctcacaatgtgtctcatctagtgggtgtgagaggaactagagcgcctttgctttggtgcacacaaagcaaagaaatcgccttttatatgacaagctccacaagctagtttctgtccgctacaacctaaagatacgtgctgaagaagatcaagagaaagagagagatatagataaagaggttgatccaagtg

SEQ ID NO: 5132 - DNA, 332 bp, Triticum aestivum
  Clone ID: LIB3281-021-P1-K1-B9
accagtcgtcctatggcgtgagcgtggtggacggcttcaacgtggggctgtcggtcaccccgcacgagggacgcggcaactgccccgtcctcgcctgccgcaaggacctcacgcagacctgccccggcgagctgcaggtgcccggcggcggcggcggcgtggccgcgagcaagagcggctgcctggcgttcggcaccgacgagctgtgctgccgcggcgcgtacaacagccccgccgcctgccgcccctccaggtactcggacttcttcaagagcgagtgcccgcaggccttcacctacgcgcacgacagccccttcctcacccaccagtgc

SEQ ID NO: 5133 - DNA, 335 bp, Triticum aestivum
  Clone ID: LIB3281-021-P1-K1-C1
ctcaaaccctctcgccggagcccccagcaaggagcaagcaagcaagatggacggcagcaaggcgaagaaggtggcggcgaagaagttcggcgggccgaggaagaagtcggtgaccaagtccatcaaggctgggctccagttccccgtcggccgcatcgggcgctacctcaagaagggccgctacgcccagcgcgtcggctccggcgcccccgtctacctcgccgccgtcctcgagtacctcgcagccgaggtgctggagctggccgggaacgccgccaaggacaacaagaagacccggatcgtgcccaggcacctgctgctggccatccgcaacg

SEQ ID NO: 5134 - DNA, 292 bp, Triticum aestivum
  Clone ID: LIB3281-021-P1-K1-C10
gttgcacagccttcactagatcacggcggtgtcatattatgtactggttgcttccctaacacgagtactgactttacaaaaactggcactagctacaaaacatggatcatactcatgaactagatacacatatatctagggtggagcacctaaggtaccacatatacatgacctagggagaggtgttcaaattgttattgggacaccagcccactttatcgatatgatctaagctcttgacacaaacatacgccttgttacataccgagtcatggtttaagtagacgatctt

SEQ ID NO: 5135 - DNA, 212 bp, Triticum aestivum
  Clone ID: LIB3281-021-P1-K1-C11
cttcaaattgtgtctgttatctgtatctgatgacataatcttgtgcttcggttgtaagtattgtagtttactagttttacatttctacgcctttcatggttgaagtttcaattgtttgagcttggccagtgcagaacacaactactgtgtgtacttaagaattaagatgtgtttgtattgctactacttcgcttacctctatccagtaattg

SEQ ID NO: 5136 - DNA, 329 bp, Triticum aestivum
  Clone ID: LIB3281-021-P1-K1-C12
gttctgcctcatctatcactatctgcgggcttgctttgattatgtgtctgccaactttctgtaactaaaaagcagcctgtaaatgtagcttgaataaaaatggtacctttctgttttgtgcaagttcaaagcattagtagtttcagtttatccaatttttgcagggatattgtgtgaggtctggtacaaactttaagacaatcacttaatacattcatgggatcacaaacttttggcatttgttgatactagctaggtggggccatgaattcctagaagattgtggcaattatcctgcttcgcttgcaatattggtttctaaaaatatc

SEQ ID NO: 5137 - DNA, 294 bp, Triticum aestivum
  Clone ID: LIB3281-021-P1-K1-C2
aaacgggggggaacagcggcgaacacgcgtcgcccaacacaaaacggagcaggaccccaaaagggggggcaaggaagaggacgccggcaaacaaaaaggggccggaagaaagcggggccaaggaagaaggcgggaccaggaccgcaaggcggcacaggccccgcggacgagggccgcccccaaaagggcgtacgcccacgcgcagctccggcgcccccgcacccgcgacgccagagtaccacgaccgaagcgccggagctgccggaaacgccccaagaaaaagaagagccgacg

SEQ ID NO: 5138 - DNA, 270 bp, Triticum aestivum
  Clone ID: LIB3281-021-P1-K1-C3
gcctgcagtaccggcggattcggtcgacacgctccgggacctggcgccgggttccctcggaggaagagcaaaatcatcgtcgtatcatcattataatccctcggggaaggcgcgcacatctgagagctgtatttacgcgggcggcgatctgggcgctgcggccctggcgcggcgccggctctaggctcccatgaccctatcgtctgctgtcaggagcggccgcgcccgcttaccaggaccctaccctaagggaccttacacgacctggct

SEQ ID NO: 5139 - DNA, 237 bp, Triticum aestivum
  Clone ID: LIB3281-021-P1-K1-C4
cccacgcgtccgcggacgcgtggggaacatacaagattagatacaggcaaggaaagagtttcattactaagagatcatgcatgttcaattcttgttacttcagaggtaacctgcttcaaatactttaattccaagtagaaactgtgacctgctccaaaggctactgctttgtgctctgttttatttactgtgtgctctggaaaacaaacaaaacaaagactcataggcccggaacac

SEQ ID NO: 5140 - DNA, 332 bp, Triticum aestivum
  Clone ID: LIB3281-021-P1-K1-C5
aaagcaactccagagtgagaccaatataaagccattgtgggggactgcacagcttttcatgcatccacgttacatgcacggagctgctactagcccagaggtcaaggtgtatgcttatgctgctgctcaagtgaagaaagctttggaggttactcactacctaggcggtgagaactatgtattctggggtggaagagagggttaccaaactcttctcaacaccgatatgaagagagaacttgaacatttggctaactttcttcaagctgctgttaaccacaagaagaagattggctttaatggaacattgttgatagagcctaaaccacaag

SEQ ID NO: 5141 - DNA, 333 bp, Triticum aestivum
  Clone ID: LIB3281-021-P1-K1-C6
cggacgcgtgggatcggcaaaaagaactggagagaccgacctgaaattggtgaaacaaagtggcgttcagctgggcctcaaccggccagacatggagctccagcaagcacgtgtgcctacccttcttgcccatgagttcctgcaacaacagcagatcgtgtgtgtgtggtaccagccagataaatactacacaaatcatgttcatggtgtatttgttgggttcctgttggcgtgttgaacaaaaattggcgttcagcgttgctatttaaagatggtttgatcaatactagggaaaacacatagatggaaggaaattattgttgggatcaaggg

SEQ ID NO: 5142 - DNA, 266 bp, Triticum aestivum
  Clone ID: LIB3281-021-P1-K1-C7
aaccggggggacgaacgacgcggccgacaacgcgtacgcccaacaacaacaacggacgacggagccacaacaaggagcaagcaaggaaaaaagacgccggcaaacaaaagaaggcggccgagaagaaaatcggcgagcaaaaaaagaaagcggggaccagaaccggcaaggccgggcaacagaccccaggcggacgaagcgggcgcaaccacaagaaaggccgctacgcccaagcgcgtagctccggcgcccccggaaaccaagac

SEQ ID NO: 5143 - DNA, 334 bp, Triticum aestivum
  Clone ID: LIB3281-021-P1-K1-C8
cccacgcgtccgggaagaagagagagaaaaaaaatggcatcgtcggcccgcgccgccgcctacgccgcgagatcggccctccgccgggcgcccctcgccgactcgtcctcctcttccgccgccggagtcctccgcaggtcggcggcggcgggtctggagacgcggatgcccctccacagcgcggcgtcggcggcgcgcctcggatcctgcatcacccgagatggcaacaatgctttctcatggaactccaggcgcatgttcagttcaaatgagaaacatctgcctgcaatatctgacccgaaaatggagactgcatttaaggatatgatggctg

SEQ ID NO: 5144 - DNA, 314 bp, Triticum aestivum
  Clone ID: LIB3281-021-P1-K1-C9
cggacgcgtgggccgcaattaaggaaggaggcggtggagacggcaggagccgactagtgccgcgtacagcctgcttgcagcgacgcctcatcggatgctcccgtctccgataccaaatagttcggtggttgcggcggcggtctaggtgtgctcgcgggagtcgttggccccttcccggagtgacgcagagcacatggccgaggccctcctacaccaccttccccgccggttcggtgctagcaccaccgactcatcttcgccgccctaacaaggagtactctcacacgttctgcgcgcccaactgcgtgacacgc

SEQ ID NO: 5145 - DNA, 327 bp, Triticum aestivum
  Clone ID: LIB3281-021-P1-K1-D1
cccccgcgacccacccctccgccgacacgggcccagctccacccccccccatccccccgtagcggccgcaacacagaggacagagacagagcgagaaccccaactctctgcgccccaagccggacaaaccgctcccaaccctccggcagaaaatcgcagagccctactacgacaagaaggaggccgccaagcaaaccgcacacgccgccgcccacaagacccccacgctccccgaccgcgtgcacccaacatacgaggagaccctcgccgccgccgcagccgccgcccccagccgaacctcgaccatggaggctgacggaccaagca

SEQ ID NO: 5146 - DNA, 330 bp, Triticum aestivum
  Clone ID: LIB3281-021-P1-K1-D10
atctccaaaaggcagaggtagtcaagaagctggagtcaggtctccgtgagatttcctctatctctatccaccctggtggcgataatgttattgtgggaagtaaagatggtaaattgtgctggtttgacactgatctgtctacaaggccgtacaagatgttaaagaaccactcgaaggatataaccagtgttactttccaccggagataccctctttttgcctcatcgtcggaggattgtacagcccatgtgttccatgggatggtttatgctgatctcaaccagaacccacttattgtgccattggagattcttcgtggccatttaagtt

SEQ ID NO: 5147 - DNA, 330 bp, Triticum aestivum
  Clone ID: LIB3281-021-P1-K1-D11
cggacgcgtgggcggacgcgtgggattcactctctccttcgtcttcagcctgatccacccccgaaacccgcgtcgtccgtcgccgcgtccaccaccatgtgtgggattttggccgtcctcggctgcgccgactggtcgcaggccaagagggctcgcgtcctctcctgctcccgcaggctgaagcaccgggggccggactggtccgggctgttccagtgcgagggcaacttcctggcgcagcagcggctctccgtcgtctccccgctctccggcgaccagcccctctacaacgaggaccggaccgtcgtcgtcgtggccaatggagagatc

SEQ ID NO: 5148 - DNA, 304 bp, Triticum aestivum
  Clone ID: LIB3281-021-P1-K1-D12
agggcgagagggcgaagacaaggaacacactgtaaccagggatgacagcgggggccaccagcgaaaggcgcgcggtgcgaaggcgggtacacgagcaagggaagggaaggcggacgagctcggacgcgccgacaggagacaagacaagaggacaagcggccgaacaagcaaccgaaggcagaagcaccgggggccggacagggccgggaagccccagagggagggcacacagagggcgcagcagcggaagcacgccaggggcccgatcacaggcgaccagcccggggacaacgaggaccggacc

SEQ ID NO: 5149 - DNA, 185 bp, Triticum aestivum
  Clone ID: LIB3281-021-P1-K1-D2
cccacgcgtccgcccacgcgtccggttgtagtagcactactaaaaacttgtgggatgatttagtagtaatgagctggatttgagacgtgagatgatgtcgcgcatatatttctagatatatgtattgaacagattatgtcatcggaagtacttctatatgcatggatgatgcaactatgccggtt

SEQ ID NO: 5150 - DNA, 140 bp, Triticum aestivum
  Clone ID: LIB3281-021-P1-K1-D4
gttaggcttcggttcaagagagaggccaagtatctagcctagtctacggttagagcggagaggaaggcagatccatggcggagacggagaaccgatgattagcgggcggccttaactgggccaccgacaacaacaacctg

SEQ ID NO: 5151 - DNA, 334 bp, Triticum aestivum
  Clone ID: LIB3281-021-P1-K1-D5
cggacgcgtgggccgccgccgccgcagccgcccgccgcattccgagcggttcgagttcgccggagagggaggagagatggccaggaagggcggagagaggaagaaggcggtgacccggtccaccaaggccggcctccagttccccgtcggccgcatcgggcgcttcctcaagaagggccgctacgcgcagcgcgtcggctccggcgcccccgtctacctcgccgccgtcctcgagtacctcgccgccgaggtgctggagctcgccggcaacgccgccaaggacaacaagaagacccgcatcgtgccgcgccacctgctcctcgccatccgcaac

SEQ ID NO: 5152 - DNA, 335 bp, Triticum aestivum
  Clone ID: LIB3281-021-P1-K1-D6
cccacgcgtccgcccacgcgtccgcagagatgaacaaaaagatttacaagatgggcaagtctggacaggagtctcacgaggcctgcactgagtttgacaggactgagaaggacatcaccccgatgggtggcttccctcactatggtgtggtgaagggtgactacctcatgatcaagggctgctgtgtgggccccaagaagagagtggtgaccctccgccagtccctgttaaagcagacgtcgcggttggcccttgaggagatcaagctcaagttcatcgacacctcatcaaagtttgggcatggccggttccagaccaccgacgagaagcagaag

SEQ ID NO: 5153 - DNA, 334 bp, Triticum aestivum
  Clone ID: LIB3281-021-P1-K1-D9
cctcttcgtcctcccgtccgccgcagtgcaggtaagaaggggtcgaaatggtgaagcacaacaatgttatccctaacggccacttcaagaagcattggcagaactatgtcaagacctggttcaaccagcctgcccgcaagcagaggcgccgcattgctcgtcaaaagaaggctgtgaagatcttccctcgcccaacatctggtcctcttcgtcccatcgtgcaatgccagactcggaagtacaacatgaaggcaagggctgggagaggctttacccttgaggagctgaagtcagcgggcatcccgaagaagctagctcctaccattggcatttc

SEQ ID NO: 5154 - DNA, 327 bp, Triticum aestivum
  Clone ID: LIB3281-021-P1-K1-E10
ctgggattcgcaagaagacaaggccttctccttaagcttgcatgactctgcctcccctcatcatggtgcgctgtttgctagcgttggtctgaaagtgtcgacgcctgctccggcagtgtcaaccagtccggcggagcaggagttcaagatcccttttgctgatcattgcataaagtttgtctcgtcagcagtcgggtttccggttgttggggccgtggatgggtccgtggaggaggaggtggtggtggatggtaaggttattaggaagaaggccaagaagcgtgggctgaaactgaaaattaagattggtaacccgcatttgaggcg

SEQ ID NO: 5155 - DNA, 266 bp, Triticum aestivum
  Clone ID: LIB3281-021-P1-K1-E11
gcgcgccaccaccagcaacacacacacagcagccaagcgaagctcgccgcagatcgaaatgtcgggccgggcaagggcggaaggggctggcaagggtgctctcgcaggtacagtcgcggacagattaagatctttgtgatattgataaagttgctcgcagcagcggtatcggtgtggggccgggatgggcctggggagaggggggtgaggtaggtataggagaagccagagcgggctgaactgaaataagatggtacccgattgag

SEQ ID NO: 5156 - DNA, 283 bp, Triticum aestivum
  Clone ID: LIB3281-021-P1-K1-E12
cgggggttcacctgcagatatagacagacactttctaattccaaggttgaagctgttctaatactacctcctcgcctagttcggtaggaacttttgcacgggtgcctgttacgtcaagaacatcctgtactcaggtggtgccgaggctgatgaataaaagtttgcattgcttctggctgaactcaaaggcagtgacatcacagattggattgcatttggatgggagaagttagtcggtgtgcctttaggtgggggtgccattgctgtaggagctccagctgct

SEQ ID NO: 5157 - DNA, 335 bp, Triticum aestivum
  Clone ID: LIB3281-021-P1-K1-E2
cggacgcgtgggcgccgacgcaagccgtccgcctcgctcttctcccgagcctgggcctcatcctgtcgcctctcctccccaacacagatttaacaatctagagttagcgcctccgtccgtctcgtagctgctcagatggcgatcaagaggaccaaggccgagaagaagatcgcgtacgaccagaagctctgccagctgctcgaggagtacaccaaggtgctcatcgccgtcgccgacaatgtcggctccaagcagctccaggagatccgcaagggtcttcgcggtgacttcatcgtgctaatgggcaagttattaactgtgctaaaactagcatg

SEQ ID NO: 5158 - DNA, 335 bp, Triticum aestivum
  Clone ID: LIB3281-021-P1-K1-E3
cccgaattccaagcactacaagtataatatgcaacttggaatcattcttaaacgagaacacctagggataattgagaagaaggaaggtgatattgtcattaaaacccgcccagctttggagtggtttgattattatgataatgatactctagatgataaggggcggactgctgcagatcgtgtgaaggaagttttttggaacttgtttgagatccacgtgaaagatgatgaagatctagacaaggtggaggatgatgctgatcgtgtgttggacaactacgcaatgaaaaaagtgagagacacgatgtatcaactttgtgtggatgctgtgaagt

SEQ ID NO: 5159 - DNA, 347 bp, Triticum aestivum
  Clone ID: LIB3281-021-P1-K1-E4
cgggggggaccaacgcgtccgcgatctcgggcctctggaagattcggagccgctattcatgggagataatcctgacagcggacagagcgggtcctcggatgcgacggccggaagcgaaggcccagtcacatgcactttcatgggggagcttgtcgtgaaggacagagcgccgcctaggccggccatcttcaacagggagcagtgcagtgacgattaagaggactacctcatggccacgcagcagactcgggccaatatgcctagggcgtctaacagcgagcagggtcagtcgcagcagaccgacaggaagaacaccgaggacccggcatatatcttggacggctccc

SEQ ID NO: 5160 - DNA, 243 bp, Triticum aestivum
  Clone ID: LIB3281-021-P1-K1-E5
gaagtaaagaacatatcgcatggatgcttgttggcatgtgtaaaatcatcagaccaagacagaagaaccatgattatcatatgtactggaactaaaattaacataggggcagccattgatctagttactcaagggtagtgctactgttaaacaacaactctaaagaaaagttactgaatctactaaagtagaagagaattcagttatttacctgggaagcaacatcacttcatttccaataga

SEQ ID NO: 5161 - DNA, 245 bp, Triticum aestivum
  Clone ID: LIB3281-021-P1-K1-E6
gaagaaaagaacatatcgcatggatgcttgtgggcatgtgtaaaatgataagaccaagacagaagaaccaggattataatatgtactggaactaaaatttacataggggcagccattgaacaagctactaaaggggggggctactgttaaaaaacaactctaaaaaaaagtaactgaatctactaaagaagaagagaattcagttatttacactgggaagcaacatcacttcattaccaataaaa

SEQ ID NO: 5162 - DNA, 351 bp, Triticum aestivum
  Clone ID: LIB3281-021-P1-K1-E7
gggacgaaccacgcgtccgacctgtggatgttggacttgagtgtgaagcacaagctgttcgtgtttggagaagaccacgagtgttgaataggaaaacagtgctccattcaagcccagcgattagatatcgtcatatatatgagtgcaaaagcttctctattggaatatattgcataccagcatcatccatcattccactgcacaaccatccaggcatgactgtgctcagcaaacttctgtatggtaaagtgcatgtcaaagcgtatgattggattgatatagaggaacccggtaacttatcaaaagtcagaccagccaaggttgtgagggatggtgaaatatctgcgcctt

SEQ ID NO: 5163 - DNA, 332 bp, Triticum aestivum
  Clone ID: LIB3281-021-P1-K1-E8
cccacgcgtccggtgatgtcacgatcaccaacgacggggccaccattttgaggatgctggaggtcgagcatccggccgccaaggttctcgtggagctggccgagctccaggaccgggaggttggagatgggactacctctgtcgtcatcattgctgcagagttgctcaagagagccaatgaacttgtgaggaataagattcacccgacctctattattagtggctacaggcttgctatgcgtgaagcttgcaagtatgttgaggaaaggctgtctgtcaaggtggatagacttggaaaagactcccttattaactgtgctaaaactagcatg

SEQ ID NO: 5164 - DNA, 329 bp, Triticum aestivum
  Clone ID: LIB3281-021-P1-K1-E9
tacgcctgcggtacggtccggattcggtcgcccacgcgtcgacttgctgaaggagatatctaccagatttttcggtcatatcactgcttttgtaacatgcagagaagctgcaagctggattcaggaaggcatgttcctccagcacctgccgaccaggaactggcgcaccacgagcttgagatggtcctctgagggcgtcatggcacacgatgtaagagctcgcccagccattcgcactaggagactatgcgtgtgatcatgcctggagcaggtggcgggcagtccacttcgtgtaatgtaactacatataccctcgggagcaacatggg

SEQ ID NO: 5165 - DNA, 188 bp, Triticum aestivum
  Clone ID: LIB3281-021-P1-K1-F1
agaaaccaagtgagaaagcacacgacgccacagacaggagacaacaagccaggaggcatcttgatcccaattgacagcaacaggcgaatcacggcctttgatatgaacagaaaagacacacctgataaaacaaacagcaactcggcccgatggcaaaaaaaaaaaaggcggcgtctagaggaccaagc

SEQ ID NO: 5166 - DNA, 331 bp, Triticum aestivum
  Clone ID: LIB3281-021-P1-K1-F11
cgccggactcgcaatcgttccggctaatccacatcgccgaacagctccaggccaaaccctagcccagcacagggaccacgacgccgccgctgcttccccgtctgcatcgccctcctcctccggtgcctccccctcgccgcgctccaagcgtcgccgcaccgaccgctatgcgctcggcttcgagttcgctccacgctctgcgccctcagctccggccccgcgcacgacgcctgagtggacggaggagtccaccttcgcgctcctcgacgcctggggcgaacgcttcgcctgcgacggccgccgcagcctcagcgccgacgagtggctcgag

SEQ ID NO: 5167 - DNA, 282 bp, Triticum aestivum
  Clone ID: LIB3281-021-P1-K1-F12
ggggggacccacgcgtccgcggaggcgtgggagcgccgccgcctacaccgcacccccaaaacgctagggcgggaaccgccccagcagaggggcggagcgcaggagccccgcgtgtacgccggcgtgaggcgcggccacaacgacgtggtcacggccatggcgacggccatggacaaccggccgttaagcgcctgctcctcccgcgacaagacgctgcgcgcctgggacctcaccaacccgaaccaggccagccaggacggcagagccgagtacggcggcccc

SEQ ID NO: 5168 - DNA, 362 bp, Triticum aestivum
  Clone ID: LIB3281-021-P1-K1-F2
cctttcttccctggtccacccactcctcctctcaagggcattcccaggatcctctacagggctagctcctaattgacccacaaggaggtgcaatgccgcgagatgcttctatcagcctacaaggagatggtctgtgccatgtccgacttgtttaaagcttctcatgccatgcggtgtttctccaaagtatcttctggtagcccactactccgatttactgatcggcaggatgatttgaatgatttatggtatggtttaggagctccagtatacatattgatctccatttcttaatttcaaatcctttcccaagttcttttttagattttttttttcttacttctatttattactcttttttt

SEQ ID NO: 5169 - DNA, 288 bp, Triticum aestivum
  Clone ID: LIB3281-021-P1-K1-F4
aaaccctagctagctcccttccgactgggggaagacacaaacatcagatgagacccagcccaggccatggaggacgaccacgcacatcctagcgggcgacgacctgatgatgggggacgggatgggtgactacggcggagccgaagggacggggatgaaggtggacgaggagaaagagatcgggaagcaggggcttaagaagaagcagctcaaggagggcgaagggtggaacacccccgaggtcggcgacaaggtggaagaccatcacaatggtaccatcagagatgg

SEQ ID NO: 5170 - DNA, 263 bp, Triticum aestivum
  Clone ID: LIB3281-021-P1-K1-F6
tgggccagaataagccggtttttttcagccaggaggcgagcataagcaacatcaagcctgaccagaccatgtggtaccccgcttgcaccacctgtaacaagaaggtgactgaagcacttggatcaccgattcttgtgtgaagggtgccagaaaaactatgagcatgtgctcattgaggtacatcatcctgaacaaggtctttgatgccactgaggaggcctctctgtctttctttaatcaccaaacaaagaaatttctctttt

SEQ ID NO: 5171 - DNA, 333 bp, Triticum aestivum
  Clone ID: LIB3281-021-P1-K1-F8
cggacgcgtggcgtcccaacaaccaaaccaccccccactgccaaatccaccaacacggagcccaaaggcccggagacgccatcatcagcacccacgacggcgaccccgatgggcgcctccgcctccgacctctctctccccgtggccgcctccttccctggcgcggccaccgatatcgcgggcgccgccggctgcttcgccctaggctacttcctcgccctcgcccgcttccccatccacgcctccgccgcccccgactctggcgacgacgataccgaggacgactcggacgaagatgatgacaaaaattcaggccgcgcccggccggcgaag

SEQ ID NO: 5172 - DNA, 197 bp, Triticum aestivum
  Clone ID: LIB3281-021-P1-K1-G1
cccgtcgaccagctccgcgacctgggcgacctggctgcaggggccccaatttatctgcactgcagctccagcctggactccaccccaccacacatccatgtctccgatcccccatccagcaaaccccgctcataaatcataacacatatacacttacgcaacctcggagcaaggcacgcttctccaagggctaacgg

SEQ ID NO: 5173 - DNA, 333 bp, Triticum aestivum
  Clone ID: LIB3281-021-P1-K1-G11
cccacgcgtccgcccacgcgtccgcccacgcgtccggtttgacattttccgcccaccaccgccggagggagctccagccatggccgccaagtgctacccgacggtcagcgacgagtacctggccgccgtcgccaaggccaagcgcaagctccgcggcttcatcgccgagaagaactgcgcgccccttatgctccgcctcgcgtggcactcggccgggaccttcgacgtggccaccaagaccggcgggcccttcggcaccatgaagtgccccgcggagctcgcgcacggcgccaacgccggcctcgacatcgccgtcaggctgctcgagcccat

SEQ ID NO: 5174 - DNA, 320 bp, Triticum aestivum
  Clone ID: LIB3281-021-P1-K1-G2
cggacgcgtggggcaagctgaaggtcgtctacaagaagtactcgagcgagaagctcggaggagtcgccctgcgcccacctgcgaccgacttgtgcaaatgagctgcccgcctgtttgttactttgggtttggatttgggagtgcgattggaaggattgtctgacatttcgccgtgttggttggttaagaagctgtttgcttgttgtttcgtcgcaagtcaggcatattatccgacttgttgacaactattattaggatttgtgtgataaaaatacatctcttctgaatgttatctacgacagttattcaattatttgaat

SEQ ID NO: 5175 - DNA, 95 bp, Triticum aestivum
  Clone ID: LIB3281-021-P1-K1-G3
tcgaggacgcgtagttcaagctgaacgttcatatacaataactacgttcaatgaggaagggggagtgattctatagtgggcacataaattcaatt

SEQ ID NO: 5176 - DNA, 344 bp, Triticum aestivum
  Clone ID: LIB3281-021-P1-K1-G4
aacccggggggacccacgcgtccgcccgacgctgaagcaagcagacaccggaccacaacaactccacccgcaacagaaaccatggaggtcggcaagaacaagcgcatatccaaggggaggaagggaagcaaaaagaaggccgtcaatccgttcaccaagaagcaagggcaagacataaaagcgccgcagatgatcaccagccgcaacgtcgaaaaaaccctcgggtccaggacacagggtaccaaaatcgcatcagagggactgaagcacaaggagtacgaagaatcgctagataaaaataaaaacgatgagaaccagacctacaagaagaacagaatcacggc

SEQ ID NO: 5177 - DNA, 189 bp, Triticum aestivum
  Clone ID: LIB3281-021-P1-K1-G5
cggacgcgtgggctccagccgcagctgcaggggacgtgcacgaccaccgaggatgaggtggcgcacatgcgcgccgacgcgctgctgctgctgctgtccagcgccgcccaggccgcggtggtcacggtggccatcttcgcgttcgatgactggggcagggtattgtcctggaccttcgatggctttata

SEQ ID NO: 5178 - DNA, 335 bp, Triticum aestivum
  Clone ID: LIB3281-021-P1-K1-G6
cggacgcgtgggtcttcgtcctcccgtccgccgcagtgcaggtaagaaggggtcgaaatggtgaagcacaacaatgttatccctaacggccacttcaagaagcattggcagaactatgtcaagacctggttcaaccagcctgcccgcaagcagaggcgccgcattgctcgtcaaaagaaggctgtgaagatcttccctcgcccaacatctggtcctcttcgtcccatcgtgcaatgccagactcggaagtacaacatgaaggcaagggctgggagaggctttacccttgaggagctgaagtcagcgggcatcccgaagaagctagctcctaccat

SEQ ID NO: 5179 - DNA, 252 bp, Triticum aestivum
  Clone ID: LIB3281-021-P1-K1-H10
gcacgcgtggggttgactctattatttgaattgatggacggaacatcgagggtcagatgcaccaacggcatggacgacgacatgaaagatgccaggcagtggcttgaggatgtactgagaggccaaggcagtatatgacaggtattgacatagtgaaaggttatggcctgaggaacggtccggacagagacgacagccacattgggtgggggtgcatgaagcacattgtcaagagaggcgaccaggactttg

SEQ ID NO: 5180 - DNA, 330 bp, Triticum aestivum
  Clone ID: LIB3281-021-P1-K1-H11
tgttagccctggccaccgatttctttccccctcctggccagatctgtggtcggcctccggcgaaatcgaccttggagcctccagtctgtggtggatccattcatccagttgtagatttggctgctgttgactagcaagagtactccgtgctagtatagtacgagtatatctgaactgttgaattagaaagatgaagaataattgtgtattcatgattgctgcttgttctattgttgcacgtactggatgttactccacatgccgtgttgcatgaagttagcattctgttgacctcaaagttgtatttgtcctgtttattcaagcaaaagg

SEQ ID NO: 5181 - DNA, 331 bp, Triticum aestivum
  Clone ID: LIB3281-021-P1-K1-H12
cggacgcgtgggcgaggccggtcgcggcgaggagaagccggggcgcctggattcgcagaccgaggaggtcgagcttagcctcggcctgtcgctcggggggcgattcgggcaggagaggaggaggggcgaggggctcgccaggtcctcgtccgtcgcctgcatccagcaggtgacgccggcgccgcccgcgctcgccaggacaagctccctgccgcctatggcggaggcggaggcggggaacagcgccgcttcccttaggagcggcgtcgaggtccaaccgcaggggagtggtgccggtgccgctcttaacggcgtcgtggtggagcccgca

SEQ ID NO: 5182 - DNA, 334 bp, Triticum aestivum
  Clone ID: LIB3281-021-P1-K1-H2
cgagcgagagaagcacgtcctggcccgatccccaatcttccccggcggcgatgccggctggaggagagaagggagaggagcacggaggagctatgtatatattaagtctaagttgagtcttgcccctgtggcgtctggcgctatgccgaggtggagcgtaccgccgccgcgttcgagcagcggccggtggttagcggtggctgcagtcctggctgcgctggtgtgccagttgcttgtgaggagtgggttgccggcgactccacgaataagctcgtttggtccgctgatctggaggaggtccttattttcctctgcttccaaggttaccatggtg

SEQ ID NO: 5183 - DNA, 334 bp, Triticum aestivum
  Clone ID: LIB3281-021-P1-K1-H3
caagcaggtcgtcgcctcaaccccgagccccccacccccacccgccagccccgagggcccgcacgaagcagacggcgaggaactccaccggcggcaaggcgccgcggaagcagctcgcgaccaaggcggcgcgcaagtccgccccggccaccggcggcgtgaagaagccgcaccgcttccgccccggcaccgtcgcgctccgggagatccgcaagtaccagaagagcaccgagctgctcatccgcaagctgcccttccagcgcctggtgcgggagatcgcgcaggacttcaagaccgacctccgcttccagagctccgccgtctccgcgctcca

SEQ ID NO: 5184 - DNA, 309 bp, Triticum aestivum
  Clone ID: LIB3281-021-P1-K1-H6
tttccctctcatttacaacaacatggccgggaccaagcagacggcgaggaagtccaccgacggcaaggcgccaaggaagcatctggccaccaaggccgcccgcaagtccgccccggacaccggcggcgtaaagaagccccaccgcttccgccccggcaccgtcgcgctccgcgagatccgcaagtaccagaagagtaccgagctgctcatccgcaagctccccttccagcgcctggtgagggagatcgcccaggacttcaagaccgacctccgcttacagtccttcgccgtctccgcgctgcaagaggc

SEQ ID NO: 5185 - DNA, 285 bp, Triticum aestivum
  Clone ID: LIB3281-021-P1-K1-H8
aagatacggaccgaatccgggacgacccagcgacgccagcgacgtgaagcaactgaggcatgacgaggaagcacaagaagagctcaggagcgacggcctgctgactactgggagttgcttgcccaaactggggtgcactgtgctcgtcaacccggaccaggataatgcacaagaccgacggggtgtagacagcacaggctaaagtcacaaacaaagacgacaccagaaagaaataaggacatgtggcagatgccaaccactatagtgtgaacctgacttgggtct

SEQ ID NO: 5186 - DNA, 332 bp, Triticum aestivum
  Clone ID: LIB3281-021-P1-K1-H9
gccgcgtcggtgggggctctaggcgcggcagtgatgtacggaagagcgaggaacagtggcaccaacgacatgggggaggacatgaaagcggccaggcagtggcttgtggatttcctgagagggcaaggagttctgacagggatggacatagcgcagaggtttggcctgtggcgcgttcggtacagagacgacggccacattgggtgggtctgcaggaagcacatcgccgcgagaggcgacgaggtcttcgagctgccgctctgaaccatccactccagcgtgcccgacggcccacgaccacaggtgcctccctctcacgtcactctgccgat

SEQ ID NO: 5187 - DNA, 341 bp, Triticum aestivum
  Clone ID: LIB3281-022-P1-K1-A1
tgaaagtgcacattcccttggagggcttggcccaagccattaaaaaaaaggttcgaaagattaaaggggtggcattttgaaacccaaaccttaaagcgtttgaagtgaccgtgaaaggcgtgtttgaggaggttaaacttgccgagtacgtgcacaagcgcaccggcaggcatgcggccattattaaattcgagccggtcgccccggccgagaaagccggcgaaggcgacgccaaggattagaaaaaggcacccgaaggcggcgaatagaaaaaagactccaaggaggagaagaaggacgacaaggatggcgccccataggaaaagaaagaggagaaagac

SEQ ID NO: 5188 - DNA, 372 bp, Triticum aestivum
  Clone ID: LIB3281-022-P1-K1-A10
gtggccgcccgcccgcgccgccgccgacttctccatccgcaggagctccctcctcgcaggcgcgatggtgtacatcaagaaccagaagacaagggcgtactccaagcgtttccaagtcaagttcaagagaaggcgccaggggaagaccgactacagggccaggctgaggctcacaaaccaggacaagaacaaatacaatacccccaagtaccgttttgttgtgcgatttaccaacaaggatgtcactgcacaaattgtgtatgctaccattgctggtgatatcgtgatggccgctgcttactcccatgagttgcctcgctatggtcttgaagttggcctcaccaactatgctgcaacctactgcactggtct

SEQ ID NO: 5189 - DNA, 168 bp, Triticum aestivum
  Clone ID: LIB3281-022-P1-K1-A11
ttctatatcttgcactattaggcacgggtgcattccagcaaaggactcttctattagaatgagctaacttcaattaagcgtgagggtgtatcgtccacaagcaccatcaccggtgttgacataagcatgaatacttatcttaagacctaaagctcacaatgaaaggga

SEQ ID NO: 5190 - DNA, 345 bp, Triticum aestivum
  Clone ID: LIB3281-022-P1-K1-A12
gtttttctgtctcacatcacaagtgaccctaacttgggccaggataagcctgttttcttcagcctgtatgccaacataagcaacatcaagcctgaccagaccatgtggtaccgcgcttgcaccacctgtaacaagaaggtgactgaggcacttggatcaggattctggtgtgaagggtgccagaagaactatgagcagtgctcattgaggtacatcatggtgatcaaggtctctgatcccactggtgaggcctggctgtctcttttcaatgaccaagcagagagaatcgtcggctgcagcgcaaatgagcttgatcggatcaggaaagaggagggcgatgacatg

SEQ ID NO: 5191 - DNA, 410 bp, Triticum aestivum
  Clone ID: LIB3281-022-P1-K1-A2
ggaaccaacaaatcccccagccgatctcgtctccggtcgactccagctccccctcctccggtcctcccccaccgccccaagatgcagatctttgtgaagacattgacaggcaagaccatcacccttgaggtggagtcgtctgacaccattgacaacgtcaaggcaaaaatccaggacaaggagggcattcccccggaccagcagcgccttatcttcgctggcaagcagctggaggacggcaggacccttgctgactacaacatccagaaggagtccaccctccaccttgtcctccgccttcggggaggcatgcagatctttgtcaagaccctcactggcaagacaattacacttgaggtggagtcgtctgacaccatcgacaatgtcaaggcgaagatccaggacaagga

SEQ ID NO: 5192 - DNA, 417 bp, Triticum aestivum
  Clone ID: LIB3281-022-P1-K1-A3
cacactctctgatcagtcaccacagtctcggtctatcacggtagcactagcttcagctagccaccctcttcctctccgggcatcttcttgcatcaaccacggcaatggccaccgctgacgtacgtatagcttgtctagatcgactttcctttttcgcatgctcgcatcgatgatcgtttcgatcggttctttaccttttgatctgcttatgtgtgtgatctgacgaacggccgggtccagaacccatcggccgcgctgacggaggaggcgcccgcggcggagacgccagtggccgccgaggaggccgcgaagacggaggaagtccccgcgccggcggaggccgaagtcgaggcgcctgcccccgtcgaggttgaggagaccaaagaggaggcaccggcagccgctgagacggaggag

SEQ ID NO: 5193 - DNA, 226 bp, Triticum aestivum
  Clone ID: LIB3281-022-P1-K1-A4
gggcgaccacgcgtccgacactatctgatcagtcaccatatttcttttctagcacggtaccactaggggtaggtagctaccctcgtagtgtccgaacatctagattgttttaaccaccgttgtgggcaccgactgacttacgtatagcttgactagatcgactcttttcttcgcatgctcgcatcgacgattgatgggagcgattccctaccttctagaactgctt

SEQ ID NO: 5194 - DNA, 399 bp, Triticum aestivum
  Clone ID: LIB3281-022-P1-K1-A5
cgattccgcccgcctccgttcctccgcatcttcccggccgccgccaagatgaagctcgtcaggttcttgatgaagctgaacaacgagacggtcaccatcgagctcaagaacggcactaccgtccacggcaccatcaccggtgttgacataagcatgaatactcatctgaagaccgtaaagctcacaatgaaagggaagaatcctgtaacccttgatcacatcagtgtgagaggaaacaacattcggtactacatcctccctgatagcttaaacctggaaacgttgctggttgaggatacccccagggtcaagtctaagaagccaactacagggaagcctatgggtcggagtcgcggacgcggccgtgggcgtggtcggggccgggggcgctgagcttta

SEQ ID NO: 5195 - DNA, 226 bp, Triticum aestivum
  Clone ID: LIB3281-022-P1-K1-A7
cccacgcgtccggccatgcgcttgctcttcacagggacgatcgctacctaagcgagccagcaattgatactgttaaaagaatgaaactctattctgagtctcttgcacggttccaaggaggctcaccttatatttacccattgtatgggttgggtgagctgccacaggcttttgcacgtctaagtgctgtttatgggggcacttatatgttaaataagccaaagtg

SEQ ID NO: 5196 - DNA, 242 bp, Triticum aestivum
  Clone ID: LIB3281-022-P1-K1-A8
actttctgatcagtcaccacagtttttgtttattacaggggcactaggggtagaggggcaccctcattggtacggacatataattgattacacacgagcgggcaccgctgactacgtatagcttgtttagatcaaccttttttttgcatgctggcataaaatgtttgagcggttctttatcctagactgctatttgttgaataacaacagtcgaggcagaacctatctgagtgctaaattag

SEQ ID NO: 5197 - DNA, 385 bp, Triticum aestivum
  Clone ID: LIB3281-022-P1-K1-B1
ctcattaattgtgagaaccaagccaatgaaaatgggcatgaatcggtcttgtcaaaaggctactattcagggcttgcatatgtcaaattgctgatgttcacaaaactgcatgtaccttttgccaacaaaattgtcgatgaattgcagatttagaaaattagtttggcatagctcagaactatttgccttgactcaaatcaaggttgttcgatatcatgaaataagcaacatgcctgttgtgaaaccatattttaaatttgcaatttgcaaactgggtttttgtttctcgcactttttcttttaaaacatcaccagaacttagggtcacaattaatagtcaggtgccatctcagtccttaagtgacatacttgagtttagactttg

SEQ ID NO: 5198 - DNA, 421 bp, Triticum aestivum
  Clone ID: LIB3281-022-P1-K1-B11
ctcttgcttcttcctagactatccctagattgatcaaatgtatgtgcaacaaatgaatcaaccaatgcaaatggcatatggggcaaaaaatgtatcggatcttccggcatattgttgaacaacatgtgggcatgccctgcgttttccacttggagttgcgacgagtcgtacactgtctcctcaacggcggcatcttttggaaagctattcaggatgcccggacactggaggacggaacggagtcgggttctgtcgacgagttctttcttgccacggccacaacggacggatcagtcgcagttgccataccgaacgcgcccaagcccatcttcttagcggtcatctccacaccggccctctctgcagctacctttcccatcacttcacactcgcattgcttcctacgagctaccactgggca

SEQ ID NO: 5199 - DNA, 313 bp, Triticum aestivum
  Clone ID: LIB3281-022-P1-K1-B12
gcggcagctaccgatgtttaatattagcaatccaagctgcgtgcaggcaaagaggtttaagaaccggtgagggaaagggtcccaatcctctgacccattgtgcagtgactgatgcatgcatctaccattttatagccggacattacattccatgttgttttcttctagctaattatgggcaatatgtcaccgcgatgtagttttttgtgatttgctgcgatttgatctatgacggcacgtggacagtttgatgcccacactggccaattagcctcttaggcacttgcaagaactatgagagatttgctttggc

SEQ ID NO: 5200 - DNA, 338 bp, Triticum aestivum
  unsure (1)...(338): unsure at all n locations
  Clone ID: LIB3281-022-P1-K1-B2
cggacgcgtgggggagaatcagaatcattcggtggcgggggcggtgctgtactttttgcgagagagtgcttctgaagttggacatttgcatcgctagccctccttcccttgctgcagggaatctttggagtttggagcacacgtatagaatttacgcggaagaacggtggttgaatgtaaaatatccaccgccgtcgaggggggattcgttctcgctctcctccgccgttgccgccgtttccatggcaatctcgaggccccggagccgcgccgtcccctanatcccgctcctgctcctggtcctcctngncccgtaaatctactccgtttccaggcta

SEQ ID NO: 5201 - DNA, 330 bp, Triticum aestivum
  Clone ID: LIB3281-022-P1-K1-B3
cggacgcgtgggtgagaatcataatcattttgcggcgggggcctcgctggactaagggctaaagagggcttttgaggttgtacattttaatggctagacttccttgcctcgctgaagggaatctctggagttcgcaactcacttatagaatttacccggaagaacggtggttgaatgtaaaatatccaccgctgggaaggggggattcgatctcactctgctgcaacgctgccgccgttatcatggagatctagaggccccatagccgggccgtcctattaattcgacttctgttcttttaacacctcgtccttttaattaattcagttt

SEQ ID NO: 5202 - DNA, 132 bp, Triticum aestivum
  Clone ID: LIB3281-022-P1-K1-B4
tcgccgacgagtgggtgcacgcactccgtcgagtaccgggtggactacccgttcgggtacctggccgagtaggggttcccggaactggtcgtggacgaggccattgagctgatggggttcgacgacaacgac

SEQ ID NO: 5203 - DNA, 310 bp, Triticum aestivum
  Clone ID: LIB3281-022-P1-K1-B6
cccacgcgtccgcctcgctgcctttttcttcagttacccctcgccttctcccccgcctgatcggagtctcggccgcggcagccatggcgaagacctaccccgtcgtcagcgccgagtaccaggaggccgtcgagaaggcccggcaaaagctccgcgccctcatcgccgagaagaactgctccccgctcatagctccgcctcgcgtggcactcggctgggaccttcgacgtgtcgttcaagaccggcggcccgttcgggacgatgaaaaaaccggcggagcaagcgcacgcccgcaacgcgggcctggaca

SEQ ID NO: 5204 - DNA, 64 bp, Triticum aestivum
  Clone ID: LIB3281-022-P1-K1-B7
ctcgaagccagccgagatgccgcaccgcggcgccatgctcctgtaggtactcgccctcagcggg

SEQ ID NO: 5205 - DNA, 175 bp, Triticum aestivum
  Clone ID: LIB3281-022-P1-K1-B8
cggacgcgtgggcggacgcgtggggccgcggtggcgctcttccgttccccccttcctcattcggcttctcagctcgaaaacgcgagcgccaaaaatcccccgcgccgccaaagcggcggttggggttccggtcttcgtcttccccgcggccccggcccacggtagccccgccgtc

SEQ ID NO: 5206 - DNA, 367 bp, Triticum aestivum
  Clone ID: LIB3281-022-P1-K1-B9
cggacgcgtgggcggacgcgtgggcgccgcctcattccctcccaccacaggacccctcctcgtgctggtccgatccgcccttccggaagcacctgggaggggcagcgccagcgctccggccgccatggcgctcgccttcgacgagtacggccggcccttcatcatcctccgggagcaggagaagaagtcgcgcctgcaggggctcgacgcgcagaaggccaacatcgccggcggcaagtccgtcgcgcgcattctccgcacgttcctcgggcccaagggcatggacaagatgctccaatcccccgacggcgacgttaccatcaccaacgatggggcgacgatcctggagctgatggatgttgacaac

SEQ ID NO: 5207 - DNA, 403 bp, Triticum aestivum
  Clone ID: LIB3281-022-P1-K1-C10
gctgtttcagctgaaacacccaagggcaacaatgttgggccttccctttcgacaccgaccagcgcctttatcgaccaaagccccacaagaggagttaaaagagcccgtgccgaatcaaccgagccctctgtccgtgtagtctacaacaacttgacaagggaaagcaaaaggaagctcatggaactgatgcaacaatggtccgagtggcaagctagaaagcagcacgcctcgacggaaactgtggaacaagtcttggactgtggtgaagagacttattatccagcattacatgttggttcagagagatcctgtgctgtgtcattctgggtggatagccaagcacgaggaaatgctgctgtggatgatggtgcggtgccactgtatgatcgagaatttacattgg

SEQ ID NO: 5208 - DNA, 423 bp, Triticum aestivum
  Clone ID: LIB3281-022-P1-K1-C11
gaacaagctcgcctagcgcagcgccatctcctctctctctctgctcctccgccggagcttatcattcttcgctgaaccgccggcgacgtacggccagctagccgtggttctttgcctgctagagctgcgcgcggcgaggtggcgtgcctacgcccgcaccgggaagatcgacccttggatgctcttcttgtcgattcatcggatagcgaggtcaatcccgcccggccctcggagatcctagtagcctcgccatcgaagcagactgctggatctctccgacacttgcgaccatgatgcagcacctggacttctcccaggccagcacctccaagaagtggacggccaacagcagcaagaggcagccgggccaagggttcgatgcttcgaggaacagcatggagttcgccatggaggcgccccaca

SEQ ID NO: 5209 - DNA, 365 bp, Triticum aestivum
  Clone ID: LIB3281-022-P1-K1-C12
gaacaagctcgtctagcgcagcgccatctcctctctctctctgctggtccggcggagcttatcattgttagctgaaccgccggcgacgtacgggcagctagccgtggatctttgtctgctagagctgcgcgcggggaggtggcgtacctacgtccgtaccgggaagatcgaccctagtatgctcttcttggcaattcatcagatagcgaggttaatcccgtccggcccttgcagattctagtagacttgccatcgaatcagactgctggatctttgcggcacttgcgaccatttttcagtatgtgttcttgtcggaggccagaaccttcaaaaagtggtcggccaacaagctcaagaggtagccg

SEQ ID NO: 5210 - DNA, 369 bp, Triticum aestivum
  Clone ID: LIB3281-022-P1-K1-C2
cccacgcgtccgcccacgcgttcggcagcttatctaagatcggtgtgcaaagaaaacttcaattggatcgtcaggcaccacagaagagtacacggcccactgagagtaacaccaaacaaactactagtcgagtaccggcaaggaatagcccatggaacgcgaacccgttattaaggcattcacgcagtttacctgaaactggccgtgcaacggttcagaaggttctaagtatgaccgaaaagcttattcatatgaatgcgacctatagaacacacacggctgagaagccccctgtccctatactaaaggctgggcatcttaagtcagactttctcgggaaatctgacgaaattccttcggccaagagat

SEQ ID NO: 5211 - DNA, 415 bp, Triticum aestivum
  Clone ID: LIB3281-022-P1-K1-C3
cccagccgctccttcccccccacccccgccgtccgttaaagccccaccgcccgcgggcgccgacgccgggacccacccgttccggcaagatgaacaaggagaggctcatgaagatggccggggccgtccgcaccggcggaaagggcaccgtgcgccggaagaaaaaggcggtgcacaaaacggtgaccacggacgacaagcggttgcagagcacgctcaagagggtgggcgtcaacaccatcccggccattgaggaggtcaacatcttcaaggacgacctcgtcatccagttcctcaaccccaaagtgcaagccttcatcgccgcaaacacatgggtggtcagtgggactccccagaccaagaagctacaagatgttcttccttcgatcatcaaccaattgggccctgacaacat

SEQ ID NO: 5212 - DNA, 99 bp, Triticum aestivum
  Clone ID: LIB3281-022-P1-K1-C4
cccacgcgttcagtccacccacacttccatttatcaatcaagccccaccccaggcaagggccttttgatcgagggaggggatacttcattattcacttc

SEQ ID NO: 5213 - DNA, 381 bp, Triticum aestivum
  Clone ID: LIB3281-022-P1-K1-C5
tcggaaatccccaaaccagcgcaagcaaagcaaccaacctcgaaatccaacatcgccggtggtcggtagagggcaatcttgtcgattgtgcttcggatggcgggtaaggaggaggagctttctatggaggcggcggggaagtggatgctgatgccgtgcaccgcccccaaatccaaatctatggaggccagcgagcatggtccggcgacgcggttcccctccaagaggaaggcagccgccggatccagctacaaggagggtgatcagctgcctgagggttggatcgatcttccttccgcggcgggacaagatgacccagaggcgtacaatctgttcaagttcgagaggagggaggcagcgattgacaagatgctgggggag

SEQ ID NO: 5214 - DNA, 392 bp, Triticum aestivum
  Clone ID: LIB3281-022-P1-K1-C6
cggacgcgtgggctggtgtgctctccggctacgatcagctccagatcctcttcttcggcaagaagtacggctcaggcggtgcctagaggggaagaaatgatgacgaacaagagaagtctgttcccagtcctgcccttcaaggatctggcgaacttttatctttttaacgttggaaggcaataatttctgtagagggtggattttcccaacattcgtttttggtggaggcatcgaactccagaggttgtcgtaggttggcggcagcgttctcaaaacatttactatcataggggttgagtttgagttcgagtatgtgccctgaatcgttactgggcaattttccttaaatacattgtcctccaatcctactgagattattatggtccaagttt

SEQ ID NO: 5215 - DNA, 351 bp, Triticum aestivum
  Clone ID: LIB3281-022-P1-K1-C7
atagttaaaaccatctccatcaacattccacctattgctggttcgtttggaaaacaaaatttcaatacaccacggggtaccaaatttcaaattacaggttacaacattgtgcacaacaagatgactaaaccaagattgattatgacgtgctcgtcgtgttgtaagccatgtcggcagaggacgtgtccatgtcattcaagcccagctcctcgttttgctcccagctcctctcatactcctcaattgttagctgtttgtcatcttctagcgaatctgtcgctggagcaataaacgaagccgccaatgcatcatcaagtattaaagtccatggctcttctaggtttagaagct

SEQ ID NO: 5216 - DNA, 414 bp, Triticum aestivum
  Clone ID: LIB3281-022-P1-K1-C8
cggacgcgtgggccagagatgaatgcctttcgtgctagccttgcagaagggcttcctgctgtcactcctcacatcccaggagaacaagcgattgttccagaacctgttcgcgaacctcccgttgaactgagtgttcaggagctgcttgcccttgacccatttgacaacttgaagaaacagtttatcgtcaaggttactatcacaggcttgggctctgacaaccgctggtggttcctctcatgccggaaatgccataaaacagcctacacctccggaaggcagtaccgttgctcagactatggttgttcttctatcatagcagatccttcatactgcgtgtgcactttcggaagcgatggcgcaaatgaagcagaatttatgttctttgatagggctgcaaaacaagttattggc

SEQ ID NO: 5217 - DNA, 413 bp, Triticum aestivum
  Clone ID: LIB3281-022-P1-K1-C9
cggacgcgtgggctctctctcacctccggcgaataacacaccagagctcacctctcccctcgcttccccgcgaaaatgtcgactgacgtggctgccgctgacatcccggtgcctcaggtggaggtagccgccgacgctgccgttgacacaccggcggcgaagccggccaaggcgcccaaggcggccaaggccaagaagtccactggcccgaagaagccccgcgtcaccccggcccacccgtcctacgccgagatggtgtcggaggcgatcgccgccctgaaggagaggagcgggtcgagcaccatcgcgatcggcaagttcatcgaggacaagcacaaggcgcacctcccggccaactttcgcaagatcctgctgacccagatcaagaagctcgtcgccgccggcaagctgac

SEQ ID NO: 5218 - DNA, 424 bp, Triticum aestivum
  Clone ID: LIB3281-022-P1-K1-D1
cccacgcgtccggcccaggaagttgctggtgatgttcgcatgactgatacacgtgcagatgaggcagagcgcggtatcacaatcaaatccaccggtatctctcttttctatcagatgactcctgaatcactcgagatgtacaagggcgatcgcgatggggatgaatacctgatcaaccttattgattcacctggtcacgttgacttttcttcggaagtcacagctgctcttcgtatcactgatggagctttggtggttgttgactgtattgagggtgtgtgtgtgcagactgaaactgtgctgcgccaagctcttggtgagaggattaggccagtccttactgtgaacaagatggacagatgcttccttgagcttcaggtggaaggtgaggaagcatatcagactttctcccgtgttatcgaaa

SEQ ID NO: 5219 - DNA, 343 bp, Triticum aestivum
  Clone ID: LIB3281-022-P1-K1-D10
ggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgggcttgtgaggactcaaacccttgtcaaaaatgccatt

SEQ ID NO: 5220 - DNA, 345 bp, Triticum aestivum
  Clone ID: LIB3281-022-P1-K1-D11
cccgaattcgagccacgccccacgcgtcccgtggaagagaatgaacatcatagttctttgtcagccgctctttactgtgcgtgcgcttgatcacaacaaccaccccaaccactattgagaatgttacaacactgtggctgaaacaagcgaaaaggctcaatcccccactcgacagagagtaacttccaacggccaccgcatttcttgaatttacaccctcatcacaggaacctgtagtcaactattctctttatctgcagagattaagtattccggctccccagtggtgggtcttgtaatacttgcatatgcgggcaggcacccaccattttagatctttttttt

SEQ ID NO: 5221 - DNA, 419 bp, Triticum aestivum
  Clone ID: LIB3281-022-P1-K1-D12
cggacgcgtgggcataagttcacaatgtctatattgaggaataacacgcggagaaaccattggcgtattaagacatatcttgctataagccacatggatgctggaaaaattggtataattgttgcagacatgaggaaagtgttggccaagaatcatcatatagaacaacagaagctgcataggagagtattctttgaaaaaattgatccaaaaactcaagctcttatgatatacatatcctgctttgtgaagacatcgcattttgaagagtatctaaatgtccaggaagctgttatgttggatcttcttacgatagttgggcaccacaaggcaaggcttgctacacagatccgaacagttcagaaatcatatggcaacgcagacattgacaacattccttttagagaggatacatatag

SEQ ID NO: 5222 - DNA, 414 bp, Triticum aestivum
  Clone ID: LIB3281-022-P1-K1-D2
ctcggttccttctccttcctcggagctccagccatgggtaaggagaagactcacatcaacatcgtggtcattggccatgtcgactctggcaagtcgacaaccactggccatctgatctacaagcttggaggtattgacaagcgtgtgatcgagaggtttgagaaggaagccgctgagatgaacaagaggtctttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtaccttccaggctgactgtgctgtgctcatcattgactccaccactggtggttttgaggctggtatc

SEQ ID NO: 5223 - DNA, 80 bp, Triticum aestivum
  Clone ID: LIB3281-022-P1-K1-D3
aaaccgggggttatggcaaaccaggaggcaattaaggggttggttcttcggtaatcccaccctttttagaaaacccgttt

SEQ ID NO: 5224 - DNA, 430 bp, Triticum aestivum
  Clone ID: LIB3281-022-P1-K1-D4
cggacgcgtggggaggtctggcgattcgaccctcgagaggcggccgaaccgagcagacgccatggaccgcgagtggggctccaagcccggcagcggcggcgccgccaccgcccagaatgaggccattgaccggcgggagcgcctgcgccgcctcgcgctcgagaccatcgacctcgccaaggacccgtacttcatgcgaaaccatctcggcagctatgagtgcaagctctgcctgacgctccacaacaacgaggggaactacctcgcgcacacgcaggggaagcggcaccagaccaacctcgccaagcgtgccgtccgcgaggccaaggacgcgcccgcgcagccccagccaaacaagcgcaagctcgcgccccgcaagtctgttaagattggcagacctggatatacagtaactaaacagtatgatcct

SEQ ID NO: 5225 - DNA, 284 bp, Triticum aestivum
  Clone ID: LIB3281-022-P1-K1-D5
cggacgcgtggggtgcctgctgcagataagaccatgtctaccagctaggcttctcgtgtttcagaagacacctgaccattggctgtagtttagcacttgcttgctatttgttcgctatttgatgacgaaaatttgccccttgatttctatgtctacccacttcgtggttttagcatgtgaccttagtgcaatacatgttggcagaaactcgttacactagcgtcggtgcctgcataaagatggcgatagaacctgttatgctttgatgagcagtacaaattgac

SEQ ID NO: 5226 - DNA, 384 bp, Triticum aestivum
  Clone ID: LIB3281-022-P1-K1-D6
cggacgcgtgggggagaatgatcatcatgtgatttccagcaggcttcacgtgctgtccttgataacaccaaccaccccaaagaatattgagcatgttacaacaaagtggctgaaaaaagcgaaaaggtgcaaacacaaactgtaaagagagaaaaggaaatcggcaaccgcatttcttcaatatacacctgaatcacatgatcctgttgccaactattcacttcagctgaagagattagggatgcaggctcccgagtcggggttctgctgctccttccagatgcggccagtcacccgcagtttcagctctttcctctccccgccggagaagaagagtgccatgttccgctggattatgaggccatcatggctgtcacgcacttt

SEQ ID NO: 5227 - DNA, 356 bp, Triticum aestivum
  Clone ID: LIB3281-022-P1-K1-D7
aaggccagtaaaaccctaaccctaagcatcccaattcccccaatcccgaatcccccacccccgtcgcccccaaaccctatccctgacctgccccccgcctcgccgccgcgacgatggcaggctcctccggcgccgccggcgtctccttccggagccagctcaaaggcgaccgcttttactacccgccccaccggcggcagagccagcagcaccagcagcagggcctgcagagccgccgccccccgacgttgccctcgctctgcccgtccccctcccccaggcggaagacggccgcggcggcggcagcggcagtcgcgtccgtctacgccgacagtcgtgcggattccgacgacttc

SEQ ID NO: 5228 - DNA, 414 bp, Triticum aestivum
  Clone ID: LIB3281-022-P1-K1-D8
gcccgtagggtttccggatcggaggagcccaagccgccgcagccatggttcgcggatcgctcgggaggttggcgtcgcgcaccctctccgtcgccggcaaatggcagcaccagcagctccgccgtctcaacatccacgagtaccagggcgcggagttgatggggaagttcgggatcaacgtgcccaagggcgccgtggtggggtcagtgcaggaggtcaaggaagttttgaagaacgtcttccccagtgagaaagagatagttgtgaaaagccaaatccttgccggtggccgtggattgggaactttcaaaagtggactaaagggtggtgttcatattgttaaggctgaggaggctgaaagccttgcagctaaaatgcttaaccaggtcctggtaacaaaacaaactggtccac

SEQ ID NO: 5229 - DNA, 327 bp, Triticum aestivum
  Clone ID: LIB3281-022-P1-K1-D9
ctacgcttacaagttgatagtaccatccttggtccttagctggattacaatttcacctctagtcaggagaaaacgggggatgatgctaaacatgaggtcaaataacggttgggtactcgggaataccaaccatttcacaaaagccgtttgcagtgtagtaacatacggcgccacctgtaataattatcccttttttttaagtacaagccagctaggcagtcatcctgaagtttgggcttagaaactcctaggaagatgttgtttgggaaacccatacagcatttttttttaagacctagctaataaatcactacccacttggttgcc

SEQ ID NO: 5230 - DNA, 221 bp, Triticum aestivum
  Clone ID: LIB3281-022-P1-K1-E1
gataggctgtcgctgttccgtctgtggactttgttctgactaagtttgtcgtttggttactgggaaacaactggccaggctattgctactccgaaaaaaccattaactctaagggggttgctgcgtctggcacaatgaggcgtcttttggggaaaaagttgctcaaaccggaaaaaaagctttttttttttaaaaccaagggcactttgttatcatattca

SEQ ID NO: 5231 - DNA, 411 bp, Triticum aestivum
  Clone ID: LIB3281-022-P1-K1-E10
gtcgtggaaggcggtgaagtcgtctcttcctcctcgccaccgcctccctacggaaccgtcgtcggaaaagcgtacgtaagatgataatacctactccaactagtaatacatggagggaagtagcaaagtatgcagctgcacaagaatctgcatgcatggtgctgcccttgatatgttgatctatccgtgtgagtgtgggttcacatagcttgcaacagaacgaccgcagagttggctgcattatccatcgggacatgagaccaaacaacattcttgtcacacatgattttgaacctctggttggagattctggtctagcacgatggccacccgattgagacatgggtgttgaaacaagagtcatcggcacatttggttttctggcaccagagtttgcgcagagtggacaaa

SEQ ID NO: 5232 - DNA, 271 bp, Triticum aestivum
  Clone ID: LIB3281-022-P1-K1-E11
aatacagttgagggatagaaagataaagttttttgagaggcgaaagattgagaggatgataaggcgtcttgacaaacagcaacggataaatgctgatgaggccagcaacaagctggcaacattgcgagaagatcttgaatatgttagatttttcccaaaggaagaaaaatatttccctttattcaccgggggtaataccccagatattgtggagaaaaggaatacatggcgtaaacagatcaaggagaatctcatcgctgctgcagcaaat

SEQ ID NO: 5233 - DNA, 355 bp, Triticum aestivum
  Clone ID: LIB3281-022-P1-K1-E12
cccacgcgtccgacctaagccatggcgctccgcacgttggccgcgaagaaaaccctaggcctggcgctcggcggcgccaggggcgtggccacgttcacgctccccgacctcccctacgactacggcgcgctggagccggccgtctccggcgagatcatgcgcctgcaccaccagaagcaccacgccacctacgtcgccaactacaacaaggcgctcgagcagctcgacgccgccgtcgccaagggggacgcgttcgccgtcgtccaccttcagagcgccatcaagttcaacggcggcggtcatgttaaccattcaatcttctggaagaacctcaagcctatcaaggagggggggg

SEQ ID NO: 5234 - DNA, 248 bp, Triticum aestivum
  Clone ID: LIB3281-022-P1-K1-E2
gcattggctgtcgctggtccgtctgtggactttgttctgactaagtttgtggtttgggtactgtgaagcaggtgcccacgctattgctactccgaataaactattaactctaggcggtttgctgccgtctgccacaaagagcgaacttctgaggagaagttgtctcaaactgataaataagcattggtcttctaaaaccagtgtcactttggtatcatattcatgatctgtaatcgcaactcctttac

SEQ ID NO: 5235 - DNA, 66 bp, Triticum aestivum
  Clone ID: LIB3281-022-P1-K1-E4
cggacgcgtggggccgtagctggcatttggatcttaatcttaatccgttcgtctggcacccttcgt

SEQ ID NO: 5236 - DNA, 253 bp, Triticum aestivum
  Clone ID: LIB3281-022-P1-K1-E5
tagaagcttaagattgaggggatttttaaagcgggttggcaaacacctcctgagttaattcctttgaggcctccaacaagctcgcgacacttcgagaagagcttggatatattatatatttcccaaaaaaaaaaaaaaattttccttttttcaccccgggtgataccccccatattttggagaaaaaaaatacacggggtgaacacaataaggagaatctcatttctgctgtaccaaaatgaaaggacttata

SEQ ID NO: 5237 - DNA, 221 bp, Triticum aestivum
  Clone ID: LIB3281-022-P1-K1-E7
gcggtgttgcaggttcgtgactagacctttttctaactaaattttttggttgggtactggggaacaagtggccaggctattggttcttcgaataaaccattaacttttaggggtttgctgcggttggcacaaagagggtacttctggggagaaggtggcttaaaacgagaaaaaaaccttttttttttaaaaacaagggcactttggtatcaaaatccagg

SEQ ID NO: 5238 - DNA, 370 bp, Triticum aestivum
  Clone ID: LIB3281-022-P1-K1-E8
gtctcccgtctcgctgtgcctcctcctcccctccgctctcctagggttcgctcgctcgtcgccaggttcgctcgcgatggaccagggcgacgtcgccgtggccgtgccccccgccgccccctcctcctcctgcgccggcgccggctgcaagaagggcaagcgcttcgagatcaaaaagtggaacgccgtcgcgctctgggcctgggatattgtggtcgacaactgcgccatctgccgcaatcacatcatggacctctgcatcgagtgccaggcgaaccaggccagcgccaccagcgaggagtgcaccgtggcttggggagtttgcaaccatgcattccacttccactgcatcagccggtggctcaagacc

SEQ ID NO: 5239 - DNA, 331 bp, Triticum aestivum
  Clone ID: LIB3281-022-P1-K1-E9
cggacgcgtggggcctccccccgatcgccacactcgccgaccccgccgcgcggccaccgcgcccgcgccataaatcaagctagccagcgctgcttcacttgaacaacgccgcacctgaccttaccgacaccgaacacctcccctgccgcgccgccgtgacagagtaggaaggaaggcgcagaggcggcggccggcacggcaagatgatcacgggcacggacttctaccacgtcatgacggccatggtgccgctgtacgtggcgatgatgctcgcgtacggctccgtcaagtggtggcgcatcttcacgccggaccagtgctccgggatcaa

SEQ ID NO: 5240 - DNA, 67 bp, Triticum aestivum
  Clone ID: LIB3281-022-P1-K1-F11
tcgggcaaggccggcggggactagttgggttcctgaatacgccctctctgtagtgttcaagagatgc

SEQ ID NO: 5241 - DNA, 429 bp, Triticum aestivum
  Clone ID: LIB3281-022-P1-K1-F12
ggacaacaagaagacccgcatcatcccgcgccacctgctgctcgccgtccgcaacgaccaggagctcggcaggctgcttgccggcgtcaccatcgcccacggcggcgtcatccccaacatcaactccgtgctgctgcccaagaagtcccccgccgcggccgagaaggaggccaagtcgcccaagaagaagacctccaccaagtcccccaagaagaaggtcgccgtcaaggagtagaattccccatagcatagccattgttgcttagatccatttctcatggacaagatgagcagtcttttggttagttagatgagtagtggttctgcccttagattcgctgagaaagggtggcattatgtctgtgatttctgtaggaatggctaaatatgcaatcgctcagaaaaaaaaaaaaaaaaaaaaagggcggg

SEQ ID NO: 5242 - DNA, 428 bp, Triticum aestivum
  Clone ID: LIB3281-022-P1-K1-F2
cggacgcgtgggcggacgcgtggggcaaaaatcaacaaatcctttctttttcgtcataagcaacgaacgcccttattcattcatggagcccacggcaaagcttcaagcgcaagccaaaggctgcaaaaggggggaacagagagggaaaccttagctggatgtgcgctgggactccttggcaaagcggcaaagccatggacggagacggagagataacatgggccttttatttctgctccttcaagattagccacatttcacttccaacattatcatctatcatctcgcttgctacaaacagctaacacatctctctcgtctccggaagcaccccacttattgtttctaacaaaccgactactagacatggatttcttgtttcttcatccatctccaccgcttatcgccggcaccccaaaaccaatgtg

SEQ ID NO: 5243 - DNA, 427 bp, Triticum aestivum
  Clone ID: LIB3281-022-P1-K1-F3
attcaccacttccctcttgaggccttagattcacaaggttgctcatttgtgcattccttatttctcaccagtatttctattaagccacactcaggaatatccggctttacaatactcagaaggcttgttctgaaatttgttgagatattaggagattttccaggcttgctagcaaaatgttcagaacttgaggacttagtgatcatctggtgctatggtgtgcatgacttaatcataccacacaaactcgataaacttcaacatttgcggatttccggaacggacgtccagatggttgagtttcatgctcctgatctttctcattttgagtacaacgggcaagtgatccctatagtgcttcatggctgcacaaaattagagaaggcaacaataaagtttaatggcactcaagcactggcacatgcat

SEQ ID NO: 5244 - DNA, 156 bp, Triticum aestivum
  Clone ID: LIB3281-022-P1-K1-F4
tccctcacaaattagatggtgcttttccttgaaaaatacgcagaacctctatttgtacatttttctaaaaacattcaaatatttatccgatcaagaaacaaatacccttataaatgctttaattttattaaaaaatgaagactttgacttcccaac

SEQ ID NO: 5245 - DNA, 365 bp, Triticum aestivum
  Clone ID: LIB3281-022-P1-K1-F5
cccacgcgttcagccacgcgttccttggaagggcgcgccgaccgccgtacacggtcgggaggttacgcagaggaagctatcttctttactgacgcgcgttgtcacaaccatgcacactattactaactgtgtccataaatccacatcgaatataggggccgtcgcggctgtccgtctatacatggaaaaacgatcggctttaacaatatttcaacctccattttatcaaactatgaacactccctctttaggtgggacttttaggacaaatttttgcagaacccctatttatttatttttttaaacacattcaaatctatattccctcatgtgacaattacctcgataaattcttaaagaatatt

SEQ ID NO: 5246 - DNA, 433 bp, Triticum aestivum
  Clone ID: LIB3281-022-P1-K1-F6
ctcctccctgcgttagggttccactcccgttcctcctccggccgccacctgcgcatcgacctcctcggttgccatggtgatggatgacaacaaactccgggtgctccagatccctccgcctatccaccccgacgatccggattctcctctcccggagaccatcctcatcgactcgttcggctacctcagcgaccgcaccaacgccaccaccgtcaggggccgcatgagcaggaccaagaagaagggcaagcgcatcctggtcaccttctggccggttgccccgccgcgcgtctcctgcttcactgtccactgcccagatctgaagcccgatgcattcgctggaatccccaagatctcctatacggaggacgaccttgtcctgctcagcatcaccatctgccccgagcggcctgacatgtacggcaagaacatt

SEQ ID NO: 5247 - DNA, 403 bp, Triticum aestivum
  Clone ID: LIB3281-022-P1-K1-F8
cctgacccgacgcctggcgcaaaaattaacaaagtctttctctttagggggagggctcgaacgggcgtacttattcatgcgtcccacggaaaatctttaagtgcaagccaaaggctgtaaaagggtgaaacagagagggataccttaactggatctgcgctgggtcttccttgcaaagtggctaagccatggacggagacggagagataacatgggccttttatttctgctccttcaagaatagccacatttcacttccaacattatcatctatcatctgggtgggtacaaacagctaacacatttctttcgttttcggaagcaccccacttattgtttttaacaaaccaactactaaacaaggattgtttgtttttttattcaacttcacacgcttattggc

SEQ ID NO: 5248 - DNA, 423 bp, Triticum aestivum
  Clone ID: LIB3281-022-P1-K1-F9
cggacgcgtgggcggacgcgtggggacttcttgaactggactagagttgaccatccgctgtattcatccaatgcctccattatgttagagtgcctggatttcttcgcagtattgccgggaagtaacaatggactggacatgtcttcagcaatcccaaatggcgccaagcatgtcctcaaaatgggcctgaatttcggtgaagacgtgtacgtgataggggtttatgatctcaaacgtgatgtctttgtgccagatactgatgacagtcggctatggccgaggatcgattatggcaatttctatgcttcaaaaacgttctttgactctaaacatggaaggaggatcatatgggcttggactactgagactgacagttcttcagatgatgttgcaaaaggctgggcaggaattcattcattcccc

SEQ ID NO: 5249 - DNA, 393 bp, Triticum aestivum
  Clone ID: LIB3281-022-P1-K1-G1
aagataaaatgctacagttacattggaccaaaccaagtctgtttctctaaatcaaaaaaggaacaaaaagaattgagctaaaagttaaaatcaggcctggagcttcacatgccgatcagcctaccatcggctgcaaagctaaattagaacatcacatttccccatggacataatttacaagcctttttacatcttaagttacagaagccaagggagtataaatccaagtagctctcaaaacattaacaacccattttagtgcctagtgttcatgcttgacacgccctttcagtatccctggaataggaggtgaggttcgtagcctaattccatttggccttgcaggttgtggtgatcgacgcccataaacatttgatgcacttgagcattcaa

SEQ ID NO: 5250 - DNA, 429 bp, Triticum aestivum
  Clone ID: LIB3281-022-P1-K1-G10
ctcacgcgtacggggggagccgccaccgtcccttccccttccaaagcttgcgctcttgctctattccccgccccaacgcgccggtggccgtcagcccggctactttttatgcttcaggaagcaccgccttgttttctgatcagcggcggccgcagtcgagctcgagcccgggtgcggtggcgcgtttttgagcatggctgcggtccaaagcggtggtagtagaagcacagggcgaggaacacccaccggaggcgctcgatgtggctcccccagcaccctttatacgctgactgtaaatgcttacccagggcccctccttgtcctgcattggcagggttaggatttgctataggattggtgactgccgtgagctgataacatatcaggtcactatgatctcccgtgcctatagatcgaggatgctttggt

SEQ ID NO: 5251 - DNA, 378 bp, Triticum aestivum
  Clone ID: LIB3281-022-P1-K1-G11
cggagatcatcctttgcgtaaacgcggccacgacgaggaatggcgagattgaccgaacctgccgacggtgctccttgacgatatcgctggtcggcttctcctctacgacgtggccgagtacatccgcctccgtgctgcgtgcaaggagtggaggaactgcaccgatgatccacgcgcgggaggcggcctggactgccgcttccgcccccgacgctggatcatgctgtccaaccgcaccgagggcgacggccgtcgctttctcaacgactccaccggtgccagcgcatgtgtcgatctcccggagctctcccgccaccaccttgagaccagcaccgagggccttctgctcctgcgcggcaaggcgagccacgctgtgcg

SEQ ID NO: 5252 - DNA, 422 bp, Triticum aestivum
  Clone ID: LIB3281-022-P1-K1-G12
ggacaaccagtacctgtgtatactcctagaccatctaattggtcggcgccgcatgctcaagtacacaccagagcatatgcattgctttactatgttttgggggcgactgattccacaaaaaaactgcgttctagtactccagagtctttccgtcgataaggtaccatttgacaattctgccaagaggtagagttcaggaatttaacactactagacggtttatgaagaagattaagcttacaggtacactatgcattatatttaagaaacctgtcttaatgaaaggaggagctcacatctgatttataggttgcgtagtgggtatgtgcttaaattcggacagaaagggtgatccgaggtcaggttaacaaggcagcatagctcgaaccacgatgtgctttaaggagaaaaagggaaaatac

SEQ ID NO: 5253 - DNA, 203 bp, Triticum aestivum
  Clone ID: LIB3281-022-P1-K1-G2
gactagttttaggcggcgcccatccgttctttatctaaaacaaaaagcttgagagacattggaccaaaccaaagctgtttctttcaatgactatcggaacactcagggtggggctaccagcttaaattaaacttgaagctgcacaagcacttcaccctaccatttgttgctaagcgaaaaaagaacattacattgtacaaggg

SEQ ID NO: 5254 - DNA, 387 bp, Triticum aestivum
  Clone ID: LIB3281-022-P1-K1-G3
gccgggctcgccggacgccggcagccggagcagcggcagcggccggagctcgtcggagtactcagggtgggtctaccacctcggcgtcaactccatcggccacgagtactgccacctccgcttcctcgtcatccgcggcaagtgcgtcgccatgtacaagcgcgacccgcacgacaacccgggactcgaacctatccgaaagggttttgtcagtcacactcttgtggtggaggaggttggtcgcaaaaaggtcaatcacggggatgtttatgtcttgaggttgtacagtagattggatcaaacgaagaaaggagagattgcgtgtgcaactcctggtgaagctcaaaaatggactgaagcatttgagcaggctaaacaacaggctga

SEQ ID NO: 5255 - DNA, 409 bp, Triticum aestivum
  Clone ID: LIB3281-022-P1-K1-G4
ctaaaaggtgacatgttcaacaattaggtgtagtggaaatgcgcatgttgagatggatgtgtggccacacaggaaaggaccgggtccggaatgatgatatacatgagtgagttggggtagcaccgattgaagagaagcctgtccaacatcatgtaagatggtttggacatatacaactcatgtgcatagcggacggttaaagcgtgctgataatgtgaagagaggtcgggggtaaccaaacttgacacaggaggagtccgtaaagagagttctgaagcgctggaatatcaccaaagaactagccatggacaagggcgcgtggaagttagctatccacgtgccagaaccatgagctggttttgagatcttatgggtttcagctctagcctaccccaacttgtttggaact

SEQ ID NO: 5256 - DNA, 187 bp, Triticum aestivum
  Clone ID: LIB3281-022-P1-K1-G5
cggacgcgtggaccgacccatgggtggagacggtcgccatgagaagaggaggtagaggcaggctcctgctccgcgttctcaaactatgctctggggcgcttattatggtagtaggtgaggcagtccatgccgctgcggactgcgtacatcgtgtgggagaactgcagcactaatccacccgctggag

SEQ ID NO: 5257 - DNA, 407 bp, Triticum aestivum
  unsure (1)...(407): unsure at all n locations
  Clone ID: LIB3281-022-P1-K1-G6
gagacgtttccaaacaacgcctgtatatgcaatagaggatcgaaatggccggcaccgcatgctcaagtacacaccagagcatatgcattgctttgctatgttttgggggccactggctccaccaaaaagcggtgtactagcagtccagagtctttccagcaataaggtaccatttagaattactgcaactggttgggttcaggaattcaacaatactgcccgaattatgaagaagatcaagctcacaggcgcaccatgcaagatatttaagaaaactgccttaattaaaggggatgttcacatctgatttagaggttgctaggtttgaaggtgcancaattcggacagtaagtggaatccgaggacaagttaagaaggcagcaaagatcgaaccaggagatgcttta

SEQ ID NO: 5258 - DNA, 435 bp, Triticum aestivum
  Clone ID: LIB3281-022-P1-K1-G7
gttgctcatcggcgcatgtcaacaaagaaggaaaagccacgaatcctaattcttggtggtgcacttgaatatcagcgtgtatcgaatttgctttcaagttttgatactttactgcagcaggaaacggattatctgaaaatggcagttgtaaagatcaaagcgcaccaaccaagtgttgtattggtagagaaatctgtgtctcgttatgctcaggatttgtttctggagaaaaacatttcacttgttttgaatatcaaaagaccacttctggaacggatatcccgttgcactggtgctcagatagttccctcgattgattatctgtcatcccaaaagctcgggaattgtgacttattccatgtggagaagtatgttgaagagcatgggactgctggagaaggtgggaagaaaatgctgaagacccttatgtttttt

SEQ ID NO: 5259 - DNA, 282 bp, Triticum aestivum
  Clone ID: LIB3281-022-P1-K1-G8
ttgtttttttttttttttttttttttttttttttgggagggcaaaattagcggaaaaggggaccgttttttccttcaaatattttgtcgttgcaaatcaatacagtttttttcaacaggacaccaactcacatacattttaataatggctgggtacagggatacttttggcaatcaaccaccaaatttattaaatgttttttgggtttattttattcattcgggtttggtgggcatttgctgaatccgggggggcttattaaggggattgagttttttattt

SEQ ID NO: 5260 - DNA, 392 bp, Triticum aestivum
  unsure (1)...(392): unsure at all n locations
  Clone ID: LIB3281-022-P1-K1-H10
cccacgcgtccgctctcgcctagctttaccatcgggttagttgcgagcggcggcggcagcgatggcggcggaagacgtggagttcgtggactacgagcgggacgacggcgacgacgggatggaagacgaggaggaggacggggaggttttntcccaagcgctaacaaggaccgatataatctatctagcctgtgggagtaacagcatgaagacttttatttgtagaaagctttatgtccgagcctatattgagatgatgtggatactgagttcttcaacagctattggttgcatggataaaatgattcattttaaagagaaatgactgtaggcgggttaagaaaataatggagtggcacatttgaaggccccgggtctaatggcttctgaca

SEQ ID NO: 5261 - DNA, 423 bp, Triticum aestivum
  Clone ID: LIB3281-022-P1-K1-H11
cccacgcgtccgccgaggctttctcccgcggcgaaaccctagcgaccggagcgctcggcggcggcagccatggcggacgacgactataatgaagttgacatggggtacgaggatgagcctccagaggctgatattgaggaaggggttgaagaagatcctgagaacaacgaggatgcccctgatgacgtggtagggggtgaaggtgaagaaaaggaacaggaaaagactgtccgtccacgcaatacaacaaaatatatgaccaagtatgagcgggcacgcatccttggcacacgtgctttgcagataagcatgaatgccccagttatggttgagcttgagggtgaaactgatccttttgagattgccatgaaagaactgagagcacgtaagatccccttcacgattaggcgctacttacctgat

SEQ ID NO: 5262 - DNA, 334 bp, Triticum aestivum
  Clone ID: LIB3281-022-P1-K1-H12
cccacgcgtccggcaagcagtcactcacacattagccaggagcaagagcaccagttcaggagcaggctagcgatggagaagtcgaccaagatggcggcgatgctcgtcctcgccgtgctggccagggcgaccagcgccgaggcgaggaacatcaagacgacggaggcggcagccgccagcaaggacgcggtcctgcagccgacgaccttcccgcccttcgaccgcctcggcagcgggtcaccggcattcagcggcggcagcagcatgccgggattcagccttcccggcagcagcggcgccacctcgggcttcggcggcatcggcagcatgccct

SEQ ID NO: 5263 - DNA, 393 bp, Triticum aestivum
  Clone ID: LIB3281-022-P1-K1-H2
cggacgcgtggggcgactacgacccgcgcaccggctgcctcaagaagttcaacagcgtggccctctaccacaacgccatgctccgcatcgccctcgaccagctccagcgccgccgcccggacgcccgcatcatctacgccgactactacaccccctacatccagttcgcccgcacgcctcacctctacgggtacaagaggggagccctaagggcgtgctgcggcggcggaggcccgtacaactacaacatgagctcgtcgtgcgggctgcccggtgccacggtgtgcgacgatcccgacgcgcacgtcagctgggacggcatccacctcaccgaggcgccctaccgcttcatcgccaacacctggctcaagggcccttacgcgtacccgcccc

SEQ ID NO: 5264 - DNA, 429 bp, Triticum aestivum
  Clone ID: LIB3281-022-P1-K1-H3
cggacgcgtgggtaacctgctaccagtctctcgtctctccccctttctctctctgaggacacagcggcgacccgcaacagagcccaaccacctgcggcgcgacctagccggcgagcggcggcaaccacaggtccggcgaggggcggcgttcaggtcgtcaaccatggttttccttcaggaagagatgtcttggaacgtgctgatctcaccggaccagctgagccccaagggcctgctgctccgcaagtccatcatcgtgcgtcttctggaggacgtcaccaacaggaaggcctccaaggagcatggctactacattgctgtaaacgagctgaagacaatctctgaagggaaggttcgtgagctgaccggagacgttcttttcccggtcacattcacctgcatcacccagaggcctatgaagggggagat

SEQ ID NO: 5265 - DNA, 390 bp, Triticum aestivum
  Clone ID: LIB3281-022-P1-K1-H4
aaggccagcaaaaccctaaccctaagcatcccaattcccccaatcccgaatcccccacccccgtcgcccccaaaccctatccctgacctgccccccgcctcgccgccgcgacgatggcaggctcctccggcgccgccgccgcctcctcccgcagccagctcaaaggcgaccgcttttactacccgccccaccgccgccagagccagcagcaccagcagcagggcctgcagagccgccgccccccgacgtcgcccttgctctccccgttcccctcccccaggcggaagacagccgctgcggccgcagctgtagtcgttttcgttgaccccgactgccgggctggttccgacgacttcttgttcaccttcttcaaagcctttctggcctcca

SEQ ID NO: 5266 - DNA, 421 bp, Triticum aestivum
  Clone ID: LIB3281-022-P1-K1-H5
agtagtttctggggtacagccaacaggaatggtgcaccttggaaattatattggcgctattaagaactgggttgcacttcaggatttgtatgagacattctttttcattgtggacctgcatgcgattactttgccatatgatgcaccagagctatctaaagctacaagaagcaccgctgcaatttatctagcatgcggcattgatagctccaaggcttctatttttgtacagtctcatgtccgtgcccatattgagctgatgtggctgctgagttcttcaactcctattggttggctgaataaaatgattcaattcaaagagaaatcacggaaggcgggtaatgaaaatgttggagtggcacttttgacgtaccctgttctaatggcttctgacatccttctgtaccagtctgatttggta

SEQ ID NO: 5267 - DNA, 397 bp, Triticum aestivum
  Clone ID: LIB3281-022-P1-K1-H6
actacgcgttggggtacagccaacatgaatggagcaccttggcaataatatgggcactattaagaactgggttgcacttcagagatctgctgagacattctttcttattgtggacctgcatgcgattactttgccatatgatgcaccagagctatctaaagctacaagaagcaccgctgcaatttatctagcatgcgggattgatagctccaaggcttctatttatgtacagtgtcatgttcgcgcccatattaagctgatgtgactgctgagttcttcaactcctattggtggggtgaataaaatgattcaatttaaagagaaatcacggaaggcgttttatgaaaatgttggagtggcacttttgacgtaccctgttctaatggcttttgacatt

SEQ ID NO: 5268 - DNA, 236 bp, Triticum aestivum
  Clone ID: LIB3281-022-P1-K1-H7
cccacgcgtccgtaaactggtactagtttgttgtgtctaactcgtgatctgtctgtggacacagaggggacaattaacagagttccaaccacctggtgcatgacctaaccattgagcggcggaaaatacatgtccggtgaggggcggcgttcatgtagttaaccatggcgtctcttcattaagagttctcgtgggacgtgctgatcttacccgtccagttgagccccaagggcctg

SEQ ID NO: 5269 - DNA, 421 bp, Triticum aestivum
  Clone ID: LIB3281-022-P1-K1-H8
gaactaaagcgacaaattgaccatgatttgttgtgtgtaaatgctcatatcccattaagttcatgtgtataaatcaagtgggttgaagtgtgctgtgaatttcctaaagaattttacttgagatattatatgcatggtgtggattgttgagtttgcgggctccttcaggtattcaagggaaaaacataatatgtttaactaattttctatattgcttatttatgcatttgtgaccatagctttccactttagctcataaactggatggcaaaatagagtttgttttatagctgatgcttaatatgttttattgactggtgaatgctcaactttagctcataaactggatggcaaatgctaattctgatggggcttttgccacttattgatttatggttgtgtagacagctgatggcatgct

SEQ ID NO: 5270 - DNA, 400 bp, Triticum aestivum
  Clone ID: LIB3281-022-P1-K1-H9
gccaaaagagccctaagaccagatggtgcatcgcgtcgtaatgatcgtagccgattcagtggatgtggatagattaacagctattgaactatgatctgaactatcctgaaacaacttgtacttgaagatattatatgcagacgggcggattgttgagtttgcgcgcttctttcggtatttaagggaaaaacattaatatgcgtaactaattgtttatattgtttatttatacatttgtgaccatagcttttcactttagcttataaactggatggcaaaatatagtttgttttatagctgatgcttaatatgttttattgactggtgaatgcttaactttagcttataaactgggaggcacatgctaattttgatggggcttttgtcacttattggatta

SEQ ID NO: 5271 - DNA, 277 bp, Triticum aestivum
  unsure (1)...(277): unsure at all n locations
  Clone ID: LIB3281-025-P1-K1-A1
cgcatatacatgaggctcagagttgntttcgccgtgcaacgctaaatatggccctgaccatgctcgggggttccatcaaccaatgaaaactattccaaatgtactggggatatatggcgcctcagatgcaggaaagagagcttaatcgaggcgtggaaggacacctgattgagatgaagcgatttgggacaacaacgtgattatgtacacgaggtgtacgatatcagcaagggagctcagagggcttttccaacgaaagacaaggatggttaaatac

SEQ ID NO: 5272 - DNA, 244 bp, Triticum aestivum
  Clone ID: LIB3281-025-P1-K1-A10
aatgggcttgctttagatgatcctcctccttgtgacgcatgtgtggcaatggtactagcttctctggtgaagtaatctttgaacatggagctgtttatacatgcattttcccaaatggcatgtgcaatcttcagatcattcatcctgatgattcatgcattgtggatgtgttaactgtatgagttctctcgagaccctagaccaaaatgtcttctggagttcattcgagttggttggtgccttt

SEQ ID NO: 5273 - DNA, 405 bp, Triticum aestivum
  Clone ID: LIB3281-025-P1-K1-A11
cgcatagtcatccaggttccgggctccagctcagccgccacaccgccgcatctccaccgcttccccccctaaacccccgccgccgaccatggcgtcctcctccgctaaaccctactgctgctcctccctaaaccccgccccctccacccccctcgccaggcgcgctgccctctccgtcctccccgccgccaagccccgccgcttctcccatggcctcgccgccgtcgccgcgaaccctagggcctcccgctccgccgtactccgccccgtccgtgcgtgcctggcggcaccgcggcggccggagtacgtaccggaccgaatcgacgaccccaactacgttcgcatcttcgacaccacgctccgcgacggggagcaatccccgggggccaccatgaccagcgcgga

SEQ ID NO: 5274 - DNA, 373 bp, Triticum aestivum
  Clone ID: LIB3281-025-P1-K1-A12
gaaaaaagagcaaagggtgagccaagggccgctgcctccgcccaccaaccgccgacgccccctcgggccgcgcttcgccgccgcagctcccctacttcatcggcctccggagcatcctgccgctctctccaccccgtctcactccctgcggactgattgggtctccttccttccagttggacatggcatcagctgttaccatgacttcagttagtgctcaggccgctttggtttcaaggccaaggagccatggcatcacaagctatggtggcttaaaggcatcgtcgtcatcagttaactttgaattgggatcctcattcctcggcaagaccgcacctgttcgggcatctgtcaccacatgggttgtgccaaa

SEQ ID NO: 5275 - DNA, 372 bp, Triticum aestivum
  Clone ID: LIB3281-025-P1-K1-A2
cggacgcgtgggtccggcgtcttcacaaacgccggctcgctctcgctccgtctcgctccctactcccccgctccgcgccctccgacgccagatcccgtcgagccccccgcgcccccgcgtcgaagatgagggagtgcatctcgatccacatcgggcaggccggcatccaggtcggcaacgcgtgctgggaactttactgcctcgagcacggcatccagcctgatggccagacgaacggcgacaagaccatcggaggtggtgatgacgccttcaacaccttcttcagcgagaccggagccggcaagtacgtgccccgtgcggtcttcgtcgatcttgagcccaccgtgattgacgaggtccgcaccagcgcct

SEQ ID NO: 5276 - DNA, 275 bp, Triticum aestivum
  Clone ID: LIB3281-025-P1-K1-A3
ggtgcgagggcgacaaccagcgctggaagatccttccctggtaaacgtgtcatgctgctgaagctgagttgatcgccaccgtgacccggagttggtagagatcggcctgtgatctgttgccgtgtcgttagaataaaagtcgtgtgcggttggtgatgtgtccgtgagtgtgtgtttagtttctgtcctgtcgttgtgtcctgctatggcgagctatccgatgtaataagcatttggcacttgtgcttgtttttcaaaccatggatcgtgatgag

SEQ ID NO: 5277 - DNA, 307 bp, Triticum aestivum
  Clone ID: LIB3281-025-P1-K1-A4
atccctcccacagaaaaatccccaattccttcgtcttcctcttcgcggacgcacacagcagagcacacagcgagaagatgtccgggcgcggcaagggcggcaaggggctgggcaagggcggggcgaagcggcacaggaaggtgctgcgggacaacatccaggggatcaccaagccggcgatccggcggctggcgcggaggggcggcgtgaagcgcatctccgggctcatctatgaggagacccgcggcgtgctcaagatcttcctcgagaacgtcatccgcgacgccggcacctacaccgagcacgc

SEQ ID NO: 5278 - DNA, 376 bp, Triticum aestivum
  Clone ID: LIB3281-025-P1-K1-A6
gaagaaagaagatcgagcgagcgagaaatccccaatccccaccaaaccctaacccaaaccctaaccctgattgaaacgaccaggagaggagaggagaggagcggatccggcgatggccgtcgagaagatgcacttgtccatgccgttgcccgccggcttggagggtttccccttcaccacgttccaggcggagctggaggccttcaccgtcaagttgagggcggaggcgaagaaggccaaggccaagccggaggtcaaggaggccaaggccaaggaggagaaggccaagccggaggtcaaggccaaggtgaagaaggccaaggcgaatgaggccaagccggaggtcgaggccaaggcaaaggaagccaaggcaaag

SEQ ID NO: 5279 - DNA, 405 bp, Triticum aestivum
  Clone ID: LIB3281-025-P1-K1-A7
cttcagacagaggacctgcgctaccaccaccagctctccagacacatcgcccaactaggtcgaatcgaagcgatggcgtctcgtctgcttgcggcggcctcctcctcctccgcctcctcctcccctctcgcccgcctcatctccagccgccgtatggccggcgccgcagatcaccacggatcgaccaaggtgaacatgtggcaggagcccttgaaccccggcaactggaaggaagagcactttgtgctagccagcttagctatgtggggcgctattatatatggtggattgaaggcatttggtgggaaaaaagaagtgaaaacagaggtatttacttatctgtacgaaacattgacactgttattgtacatagttcatcgtgcaagaatttttcaaggattattt

SEQ ID NO: 5280 - DNA, 353 bp, Triticum aestivum
  Clone ID: LIB3281-025-P1-K1-A8
gtcggaactgtggagtctgggaagatgaccaaggaccttgcactccttgttcatggatcctcaaaagttacaagaggcgattacctgaacactgaagagttcattgacgcagttgctgctgagctcaaatcaagactgtgaaagacctctccctcttcaatgcttgaatagtcattactcatcgattcaagtcattttggttatgtcgccattatctgtcatgctttcatcctgaacagaacgagcttttactgcacaatcgcatattattgtcaaaaatgcaatcgattctgtagatgctgatgttatctaagtggggctcacaataaaggacatatagaaccgttattccc

SEQ ID NO: 5281 - DNA, 405 bp, Triticum aestivum
  Clone ID: LIB3281-025-P1-K1-A9
cggacgcgtgggcgggtccttggccgtatgcaccacctgcagcagctgctcgacaggttccttgcctgccgccccacaggtggcgcgaagcagagcaggatggtgctggttgcactgtatcagatggcgagggagagcttccagctctacgccgatatctgcgaggtacttgcggtgctgctggacaggttctttgacatggaatacgctgattgtgtcaaggccttcgaggcatatgccagtgcggcaaagcagattgatgagctttgctcattttatgcttggtgtaaggacaccggggtagcgagatcatcggagtacccagaggtgcagcgggtcactgataagttactggagacattggaggagtttatgagggaccgggcaaagcgccccaagagccca

SEQ ID NO: 5282 - DNA, 343 bp, Triticum aestivum
  Clone ID: LIB3281-025-P1-K1-B1
cgaaaagtaaaaatccatcaccacttggtctcggaatgattaaacctataaaaatcaggtgcaaagtattggcccggtcaaactactagttaaatgagagcacatgataatttggatgtttactacgaccgggaagttaggcacccggatcgcaacaaaccaattctatgtacactgtatgaacaacaccacccaagaagcagagcttgctttccccacagatccgcacgatctcaccgaaatgttgccacaatcaggggtgccaaaccgcacgaactggacccctcacctcacattcagcacaattccactagcatagtgtaacaacagggaatgcaactac

SEQ ID NO: 5283 - DNA, 400 bp, Triticum aestivum
  unsure (1)...(400): unsure at all n locations
  Clone ID: LIB3281-025-P1-K1-B11
gtgagtgagctcgccacactccccccagcttagccgagctacctcactcaagaaagcatggatccctgcaagttccggccgtcgagcagcttcgacaccaagacgacgaccaccaacgccggccagccggtgtggaacgacaacgaggcgctcaccgtcggcccgcgcggccccatcctgctggaggactaccacctgctggagaagatcgcccacttcgcgcgcgagcgcatcccggagcgcgtcgtccacgccaggggcgcctccgccaagggcttcttcgagtgcacccacgacgtcaccggcctcacctgcgccgacttcctccgcgcgcccggngcgcgcacccncgtcatcgtccgcttctccaccgtcatccacgagcgcggctcgcccgaga

SEQ ID NO: 5284 - DNA, 321 bp, Triticum aestivum
  Clone ID: LIB3281-025-P1-K1-B12
ctcacactctctgatcagatcagccacagagtcacagtagcactagcttgagctagccaccttctgccactccgggcattttcttgcatccacgaaggcaatggccactgctgatgtccagaacccggcggtcgcgctgacggaggaggcgcccgcggtggagacacccctggtcgccgaggaggtcgcgaagacggaagaggcccccacgccggcggtggccgaagtcgaagcgcctgctgcccccgtcgaggttgaagagactaaagaggaggcgccggccgccgctgaaacggatgagaccaaggagcccgagcccgc

SEQ ID NO: 5285 - DNA, 391 bp, Triticum aestivum
  Clone ID: LIB3281-025-P1-K1-B2
gcggaggaggcctacaggctggtgctgcaccaggtggtgcgctggctggacggcaacgtggaccccaagaagtcccgggtcttcttcgtcacggcgtcgtccacgcacgccagcggccagctctggggcgacgaggcggagggcagcaactgccacggccagaccaagcccatcgccgacgcgtcctactggggcagcacgagcaaggcgatgctgcgggtgaccggcgaggtgctgggcgcgtccgcgagggtgccggtgggcgtggtgaatgtcacgcagatgtccgagtaccgccgggacgcgcacacgcaggtgtaccgggagcagtgggcgccgccgaccaaggagcagctcgccgaccccaagagctacgccgactgcacccact

SEQ ID NO: 5286 - DNA, 409 bp, Triticum aestivum
  Clone ID: LIB3281-025-P1-K1-B3
ggccaagatccaggacaaggagggaatccctccggaccagcagcgcctcatctttgctggcaagcagctagaggatggccgcaccctggctgactacaacatccagaaggagtccaccctccacctggtgctccgcctccgcggaggcatgcagatctttgtcaagaccctcaccggcaagaccatcaccttggaggtggagtcctcggacaccatcgacaatgtgaaggcgaagatccaggacaaggagggcattcccccggaccagcagcgtctgatttttgccggcaagcagctcgaggatggccgcacactggctgactacaacatccagaaggagtccaccctccacctggtgctcaagctccgtggaggcatgcaaatcttcgtcaagaccctgacgggcaag

SEQ ID NO: 5287 - DNA, 273 bp, Triticum aestivum
  unsure (1)...(273): unsure at all n locations
  Clone ID: LIB3281-025-P1-K1-B4
attcgtccacgcgtacgcccacgcgttcgtggacgcgtgggccgccggccataccgatggcggcgccaccggcggagccgccgatccttcgaacccacgacgagctcctcgaggagatcttactccttctccccactgatgctgacttaacccgcgcctacctggcgcgcgccttctttcgccgtcttataacaggtcacgccttactacgacgctaccgaaccctncacccgccccctatgatcggcgtgctcgaagtcgacgacaatgcct

SEQ ID NO: 5288 - DNA, 315 bp, Triticum aestivum
  Clone ID: LIB3281-025-P1-K1-B6
ccgaaacggacatggcgctcatcttggatgtcgtgcgcttcaaatacactcttaattggcatacattgacgcttatgtgggatgccatgaacaccactgatgaagcaacatgacttctcatgaggatcatgctaggatcaaggcgcaggtcaagtacttcattgctatacacaacgtgttgcgggcatacaagatggaaaagcatggcaacatattgtgtggaagatgtacccaatctactgacggatgagaatggagacactgttacaactactttgtgccggctagtggaatctctgccaggtaatgctggat

SEQ ID NO: 5289 - DNA, 398 bp, Triticum aestivum
  Clone ID: LIB3281-025-P1-K1-B7
aacgagcccaagaggccctcagacaagcccctccgtcttcccctacaggatgtttacaagattggtggcattggaactgtgcctgttggccgtgttgagactggtgtcatcaagcctggtatggttgttacctttggtcccactggtctgacaactgaggtcaagtccgttgagatgcaccatgagtctctcctggaggcgcttcctggtgacaacgttggcttcaacgtcaagaacgttgccgtgaaggatctgaagcgtgggtttgttgcatccaactccaaggatgaccctgccaaggaggcagccaacttcacctgccaggtcatcatcatgaaccaccctggtcagattggcaacggctacgccccagtgctggactgccacacctcacacat

SEQ ID NO: 5290 - DNA, 404 bp, Triticum aestivum
  Clone ID: LIB3281-025-P1-K1-B8
gctggtcaccaagagggagagggagaagcaggagctggagagggaactggagctgtgtaagcagaaggtgctgcactacgaggacagggagatgaggaggatgccagccttcaaggacaatgcgcgtagtaccaacggcaacggcacctccgagtcgtccagcggcgaggatagcgatgagaattccgatgactcctgcgagctgggcgagtctccgagcggcaatcttcagagctcgccggacgctgttcttagccccagggcggatcaagagaacgccggtcatcttgtggcgctggatgattccttgacgtacatggagatggagaggctgtctatcttggaggagctcaaggcacttgaagagaggctcttcacgctggaagacgacgatatcaacggca

SEQ ID NO: 5291 - DNA, 406 bp, Triticum aestivum
  Clone ID: LIB3281-025-P1-K1-B9
cggacgcgtgggcggacgcgtgggcggacgcgtggggaatgatgctgaggttcaggctgagggtgtattaaattctagattacagcatttaactcatacacttgataaggtaaggtatgttatgagatgtatattcggggaccccaagaatgccccccctcctctggtgaggcttaccgggagaagtctagtgtctgccatctggaaaggggaaggctcattagttgatgagctccttcagtcaattgaacatcatgttgacgaagatgtacttaccgatctcaaggacaaaattcggcttcgtgatccatctgattctgaagacatcgagggagacatccgaaattctctgttatggttgcgtgatgagttgcgaactctttcatgcacatacaagtgccggcat

SEQ ID NO: 5292 - DNA, 338 bp, Triticum aestivum
  Clone ID: LIB3281-025-P1-K1-C1
caagaaaaggaaggcttcagctttgaatgtgtgatgacttacagcttgggacacacagcgcaaaaaaacacattcaaatgcacaaaatggaaattcctgcacaaaccaccagcacctaattatgtacacccatacaattccccgggaggaaaaaggaaggaaaattttgctctccctacattttacatttacattacaaaggcggaggacgccggtcgagctgaaacctgcggtcagcgtatatggttggcggccttttttcacgcagaccgtctccgaaaagttgctgaacaaaatgccggacgtgcgtcccggctccaagagctttacaccttttt

SEQ ID NO: 5293 - DNA, 408 bp, Triticum aestivum
  unsure (1)...(408): unsure at all n locations
  Clone ID: LIB3281-025-P1-K1-C10
cgtctccgcactctgccgccgcagccgcagccgcagccatgggcgcgtacaagttcgtgtcggagctatggaggaggaagcagtcggacgtgatgaggttcgtgcagcgcgtgcgttgctgggagtacaggcagcagccggccatcgtgcgcatcaccaggcccacccgccccgacagggctcgccgtctcggcttcaaggccaagcaggggtatgtggtctaccgtatccgtgtcaggcgtggtggcaggaagaggccagtgcccaagggtattgtctatggtaagcccaagcaccagggtattacccagctcaagttccagaggaacaagaggtctgttgctgaagaaagagctgggcgcangctgggtggtcttcgtgtgctcaactnctactgggtgaatgagg

SEQ ID NO: 5294 - DNA, 384 bp, Triticum aestivum
  Clone ID: LIB3281-025-P1-K1-C11
gtcaggaaggctgtccgccagcaatccattccgctggagtcctcagaatgccgaagcattgtaaaaggagatcttgtcctctgtttcaaggagagcaatgatgaagcactgcacttcgatgcacacgttctggatgtccagcggaaacagcatgatataaggggatgcagatgcctcttccatgttgaatatgatcatgatcagagccaggagatggtgaacctcaagagaatctcccggcgaccaagatacctttgacggcctctgctgccgtggatctgcttcctgctgctatccgagcttgtgtcgtactaacgggagccctcgaatcttagttgagaccgccgcactcttattgtttgttcttattgatgtaatgtgtct

SEQ ID NO: 5295 - DNA, 412 bp, Triticum aestivum
  unsure (1)...(412): unsure at all n locations
  Clone ID: LIB3281-025-P1-K1-C12
gcacgggtcgccctcgccttccccttttcctctgctcccccgtgcgccctctccctcccctggttggtgtggtggctgctgcgcgcatcatcgtcagagcctccctccctcgcccaccaaccgcaccaccacaggagcgcgcgacgcagagatttgattcagggagaagagaatggcggcgccgtcgtccctcgcctcctcccacctctcccgcctcgccgctgccgcaccggccccgcagcaccaccaccagaaccaccagctccgcctcggctgctcccgccgccgcgcgcagcgcctngtcgccatggccggatccggaaagttcttcgtcggaggcaactggaagtgcaatggaacaaaggaatccattagcaagcttgtctctgatttgaatgctgccacactcgaa

SEQ ID NO: 5296 - DNA, 342 bp, Triticum aestivum
  Clone ID: LIB3281-025-P1-K1-C2
cccacgcgtccgcccacgcgtccgcccacgcgtccggtcttcctcaccaccggccggcagctacctagcggttgcttcctcaaccctcgatcacgtcggagcgggcggagatcgggccgcggcgatgacggtgatcgacatcctgacgcgggtggacgccatctgccagaagtacgacaagtacgacgccgagaagctcaacggcgccaacgtcgccggcgaggaccccttcgcccgcctctacggctccgtcgacgcggagatctcgcagtgcgtcgagaaagcggaggcggcgaggcaagagaagaaccgggccacggtcgtcgcgctcaacgccgagat

SEQ ID NO: 5297 - DNA, 404 bp, Triticum aestivum
  Clone ID: LIB3281-025-P1-K1-C3
cggacgcgtgggcggacgcgtgggcggacgcgtgggctcgtccccagctcttccgaatcgcgtcgccggcggccgagaggccattggattcgtggcgttggcgagcgtggtcgccaggagaggaggggtgccggcggcggcggcgactgttcgcgggatgagcttcggcggcgccagctccgttgcggccggtgggaagcggccgttcgagtacgggaggacgcatgtggtgaggcccaagggcgcgcacaaggccaccatcgtctggctccacggcctcggcgacaatggagccagctggtctcaactgttggaaactcttccccttcctaatataaaatggatctgcccaactgcacctacgaggcctgtggcaatttttgggggattcccatctactgcat

SEQ ID NO: 5298 - DNA, 411 bp, Triticum aestivum
  Clone ID: LIB3281-025-P1-K1-C4
cggacgcgtgggaaaccagatgtctttcagacagaggggaatatcaggtttgtggcaactgaactagcgacggatattgttatcactgttggagatgtcaagttttatcttcacaagttcccacttttgtccaagagttcccgcttgcaaacgttggttgcctccacagacgaggaaggcaacgatgaagtagacatttctgacatccccggtggaccttcagcatttgaaatctgtgcaaagttctgctatggtatgaccgtcacgctgaacgcgtacaacgtccttgcggcccgctgcgcggccgagtttctcgaaatgttcgagacgatcgacaaagggaacctcatctacaagattgatgtgttcctctcctcgagcatattccgcacctggaaggactccatcatc

SEQ ID NO: 5299 - DNA, 406 bp, Triticum aestivum
  Clone ID: LIB3281-025-P1-K1-C5
cggacgcgtgggcggacgcgtgggcggatggaccccttccttcgccggcgtcgtgcagtcgtccttcctttgggggtatctggtatcacctataatcggtggagcgcttgttgactactatggcgggaagcgagtcatggcgtatggtgtggctttatggtccttcgctacattcctttccccttgggcggctgcgcgctcactttggttgttcatctcaacgagaattctgctcggtgttgcagaaggagtggcattgccatgtatgaacaatatggtgctgaggtgggttcctcgtactgaacgatctagtgctgtggggatcgcgaaggctggctttcagcttggaaataccatcggcttacttttttcccctattataatgtcacgaactggaacatttgga

SEQ ID NO: 5300 - DNA, 355 bp, Triticum aestivum
  Clone ID: LIB3281-025-P1-K1-C6
cccaccccacccccctacccgtcagcctagggttttgagtccgacgcctccgcctccgccgcgcaccatgggccccgacgagctccccaaggccgccgccgccggtgccgacgagatttccccgttctccttcagcatctggccgccgacgcagcggacgcgggacgccgtggtgcggcgcctggtggacaccctggccggcgacaccctcctctgcaagcgctacggcgccgtgccggccgccgacgccgagcccgccgcgcgcgccatcgaggccgaggccttcgacgccgccgccgtcaccggcggggccgccgcctccgtcgaggagggcatcgaggcgctgcaactctac

SEQ ID NO: 5301 - DNA, 333 bp, Triticum aestivum
  Clone ID: LIB3281-025-P1-K1-C7
cggacgcgtgggcgagaattcagtgagcccgctagctagctagctagccaccgccatggcttcccctaagcttctcctcctgctggccaccctcctcccgagctgcggcctcctcgtcgccgacttcgcgccgatgaccctcaccgtggtgaacaactgcgcgtacccgatctggccgggcatccaggggagcgccggcagcgaggtcctggaggggggcggcttcttcctcccgtcgctctcccaccgctccttcccggcgcccgcccacgcctggtccggccgcgtctgggcgcgcaccggctgcgcgccctccggcgccggggcccggcc

SEQ ID NO: 5302 - DNA, 408 bp, Triticum aestivum
  Clone ID: LIB3281-025-P1-K1-C8
cggacgcgtgggcccgacccaggtgctccgcctacctagggcatccgcatgctcccctctagcccccgcgatcgggacaccccccgccggcgagcgatgttgccccctccgcgccgcggcccggcgtacaagaccaagatgtgcgcgttgtggcagaacggcaactgcgaccgcgagctctgcagcttcgcccacggcacggccgagctccgccggcccccctcctcccggcccaccttcccgccccaccacgccgggagaagagattatagaggtggtgatttcagaggcaggattgaaaggaggttctcacctcgcaggaggcattcccctggaagagatttcaggggtcatcgttccctacacgatcgaaggccaacttctcgagaagggagtctagcttttcac

SEQ ID NO: 5303 - DNA, 391 bp, Triticum aestivum
  Clone ID: LIB3281-025-P1-K1-D1
cggacgcgtgggcgcaggcagaggggatcgagaatatcccagcttcccaaacccgactctagctagacccgtgccgattgatttccggctgaaattctgcggaagatgagctccgagtccagggagctgctcggaatcgaccccaacgagctccgcttcgccttcgagctaaagaagcagatctcgtgttcactgcatctgacaaacaggacagaccaatacatcgccttcaaggtgatcgaatcattctgattgctgtttatttgtttcgctcaaaatctgagcaaatttacagtcatcttccatctaagaaacaatatggtcagatggtaccgaaatgagcccgctccccccgcgttgcccccgctcgggcgacttgggcgggaatcgc

SEQ ID NO: 5304 - DNA, 325 bp, Triticum aestivum
  Clone ID: LIB3281-025-P1-K1-D11
atccatctattaagagcattcaacacaggcagacaaaaccacaaatgggataagagcacaataatggaatcgaaatagagtatttaaacgacacatcatagctcgcacacaggtgcaggagtcggaagtgcaacaacgcccaggaacaccacttaacatacactaagattctccaaaaaagacttgacactaaaacttctgctagataactcgatggcagacaccagagcactcatttcttcttgatggcagccttggtaaccttggcgccggtggggtccttcttctcaacgcccttgatgacaccaacagcaaccgtttgtct

SEQ ID NO: 5305 - DNA, 235 bp, Triticum aestivum
  Clone ID: LIB3281-025-P1-K1-D12
cccacgcgtgcgcggacgcgtggtcggacgcgtggattgttactaggtgggaagtacggatgtgatagtttgaaacgagttcaaccttaggatacaatatggacagtgccatgcactattggtaaccatcgtgtctttgaaaaatactgtaatcgttataattgaactatatacgattgaatggtcatttattgtatgatcggtcgtacggacatacgattgctgaacttgaaat

SEQ ID NO: 5306 - DNA, 220 bp, Triticum aestivum
  Clone ID: LIB3281-025-P1-K1-D3
aaaaacaacaaaataaaaaaaaaaaaacaaaaggtttaaaaaaaacaggcaacataaaaaaaagccgcgaaaaaaagaggggcggaccagaaaaaaaaaaaaattaaaacaaaatataaaaaaaaaacaaaaaaaaaaatcattaaaaataacaatcaatacatagaaaataaaaaaaaaaaaaaatacaaaaaataaaacaaaatacaaaataataatt

SEQ ID NO: 5307 - DNA, 277 bp, Triticum aestivum
  Clone ID: LIB3281-025-P1-K1-D4
gtcatccatcctgtgactcgagtaaagggctggatgacacaccgtgcgcgtacgtgttggcaactgataaatgatgcgtgtaggggccagcggcactggtactggactggtgtggtgcccttcctcctctgatgctgggcgcctctgagagccattcatggcctctggctctgcttctggtttggatgtgtcgttgttgctagcttggcgagctagatgataagtagctagctattcagattgccgtctatcttctttttattaggagtgctagccc

SEQ ID NO: 5308 - DNA, 413 bp, Triticum aestivum
  Clone ID: LIB3281-025-P1-K1-D6
cggacgcgtgggtcttcttcctctgctcctgctcggatcccctaccctgctcctcaccccaaccccccctctcgcggcgcggcacggcagagaggagtcggcggagatgtcgggcgtgacggcggacgaggacaagaagcccgcgggcgacggcggaggcgcccacatcaacctcaaggtcaaggggcaggatggcaatgaggttttcttccgcatcaagagatccacacagctgaagaagctgatgaacgcctactgcgaccgtcagtctgtggatctcaactccattgctttcctttttgatggtcgtaggctccgtggtgagcagacccctgatgagcttgagatggaggaaggcgacgagattgacgccatgcttcaccagaccggagggggctttcctcgcccttaga

SEQ ID NO: 5309 - DNA, 370 bp, Triticum aestivum
  Clone ID: LIB3281-025-P1-K1-D7
cccacgcgtccgtgttatgttctgtagcataatatggaatgctatactgctagtgctacggtccaaagatgacttgtctttgacatcataagttgtgttgcctagcggtggagtgcaattacaagaagcttcattgtgtctatcaagtgggttttgagtgctcgtgactggcgtatacatgtatgtagaacaaaatgtccagcaacagtggcggtggtgcgaaggagaagggtccccgaattgctacgccgcttgtgccacctcccttagtccagaattctatgcctactgcttcagatggccctaccactgatctgagattagcacaacagtcctggcctggacatgtagtcctgcgtccatgcacatc

SEQ ID NO: 5310 - DNA, 399 bp, Triticum aestivum
  unsure (1)...(399): unsure at all n locations
  Clone ID: LIB3281-025-P1-K1-D8
cgaatcgagcccaaccgcatcgtgcgtgcgcacccccactccccccctagggtttcgaggttctccgacgatgtcgctgcggcccaacgagcgggccgaggtgcggcgcanccgctacaaggcgtccgtcgacgccgaggacgggcgccgccggcgggaggatcagatggtggagatccggaagaatcagcgcgacgcgaacctccagaagaagcgccgcgacgggttcccggccggcgccgcgtccgctgccggtggcgcgccgcagatgggccactcctcggctctccagcagaagctggagggcttacccgcgatggtgcaagcggttctctcggacgacaacgccgtgcagctcgaggccaccacccagttccggaagctgctctccatcgagcg

SEQ ID NO: 5311 - DNA, 398 bp, Triticum aestivum
  Clone ID: LIB3281-025-P1-K1-D9
agcagcggcaagtcgagcgtcctcgaggcgctcgttggccgcgacttcctgccacgcggctccgacatctgcacgcgccgcccgctcatgctccagctcgtgcaccagctgcgccgccccgccgacgccaagagggatgagtgggccgagttcctgcaccaccccggctgccgcttctatgagttccccgacatccgacgcgagatccaggtgctggagcagttgagaggacagtgaccggtgttctccaaggcgaggtacactgtcaggtcgttcggtatcaggctatgtttataaagcggtaaagcgaagcgaggcgacgctttacacagactctgaacctgatgggcagtataatagagcaccatgtagtgagacatatatatgttgattctaat

SEQ ID NO: 5312 - DNA, 398 bp, Triticum aestivum
  Clone ID: LIB3281-025-P1-K1-E1
ctttttcatgtacaggcctacttataaagatctcacatctccgtcgtatgaagaaagtgagacaacacgacggagatgtgagatctttttcatgtacaggcctacttataaagtggcataaaactggtacgcctgttattctgacttcggccagtttggttagaagtcgggttgatgaaaatgagattgatgagaaactgaagattaaggtacttctcccaccgaaacaggtcgttgatgggacactggaactgtaccattcagattataacattgctgtcatcagtcttcagaagcctctatatggtattcggccagagtatattttccgcacggcgaaaaggcctccaagagtagtagctatagggcgtggggctcaagatggattattgatgggg

SEQ ID NO: 5313 - DNA, 405 bp, Triticum aestivum
  unsure (1)...(405): unsure at all n locations
  Clone ID: LIB3281-025-P1-K1-E11
cccacgcgtccgcggacgcgtgggctagctattttatgattagtaaattgtttgcagtaatgtactacctgcttactcttgggagtgtggatgactatgattttctttatgcttattatgtgcaagcatagtgttctttgcacaagcatgatgatgatcgaataaattatagttctctgaatgcatccttttgtcattaggtgatgttttaggaaaagatccttgtgtgttgttgaattgtttacaagaaaacaactattcgggagtacatagagatagagtgctttttagtagaagcaagatagagttgatgtcgattagacttaaccgggtttcttcaaatgtaatgggttgtcgtatgaaaactatngaactaaaaataatctagcgagcaataataaaatg

SEQ ID NO: 5314 - DNA, 408 bp, Triticum aestivum
  Clone ID: LIB3281-025-P1-K1-E12
cggacgcgtgggcgagatcgagctccgccacgtcgacttttcctacccgtcgcgcccggacgtgatggtcttcaaggagttcagcctgaggatccgagctggccagagccaggcgctcgtgggagcgagcgggtcggggaagagcactgtcatcgctctcatcgagcgtttctacgatcccatggccgggaaggtcatgatcgacggcaaggacatccgtcggctcaacttgaagtctctccgtctcaagatcggcctggtgcagcaggagcccgtcctgttcgccaccagcatcctggagaacatcgcctacggcaaggacggcgtgacggaggaggaggtcgtcgaggcggccaaagtggccaacgtgcacggcttcgtcagcgcgctccccgacggctacaggac

SEQ ID NO: 5315 - DNA, 414 bp, Triticum aestivum
  Clone ID: LIB3281-025-P1-K1-E2
gtttgagaagttggccgatctcgatgctgccccagcagcactggccagactcttctcaatagattggtacagagagaggatcaatggcaagcaggaggtcatgattgggtattcagactcaggcaaggatgcaggccgtctctcagcagcttggcagatgtacaaggctcaggaggacctcgtcaaggtcgctaagcaatttggagtgaaattgacgatgttccatggacgaggtgggactgttggaaggggtggtggccccactcatcttgctatcttgtctcagccaccggacacgatcaatggatcactccgggtcactgttcaaggtgaagttatcgagcagagctttggggaagaacacttgtgcttcaagacgctccagcgtttcacagctgctactcttgagcatgg

SEQ ID NO: 5316 - DNA, 262 bp, Triticum aestivum
  Clone ID: LIB3281-025-P1-K1-E4
cggacgcgtggggtagttctgatcatgtacaacggcacactttccagcgtcgacctgagcaaacgatgatgcaaggctgctcctcctcctactgcatgtcttcattgacttgattcttcgacatggagatatttaaagtcttcacttgttcattgtgtcatctgctgattacttctatgttttttgcaaagcatgtaatggttttgagtagttgatcatggcctgatggaatgttttgagtagttgcaaagcatgtcaaggt

SEQ ID NO: 5317 - DNA, 348 bp, Triticum aestivum
  Clone ID: LIB3281-025-P1-K1-E5
cggacgcgtgggtcctgtttggtgctgccttcaaactgttactttgttagtgccttcttccatcgtatactgactatatttgttcttccagggtgacctactgacctttgctgggattttcctgtgtttgtttggcggagcagctgattaatagctattcagaggaagtaatcgataggtagaggcgttgtggttcctgtttcttcaggatgtttgtgttccactcttcatatgtccactcttcatatgtccactcttcatacgtgaggtagccggcgatggttccatactcgaggggtggagattgaagttgcggttgtccagcaaggagcaagcctaagaggcttt

SEQ ID NO: 5318 - DNA, 346 bp, Triticum aestivum
  unsure (1)...(346): unsure at all n locations
  Clone ID: LIB3281-025-P1-K1-E6
gtagagggttcttggtttctgtggacttggtgctccaatttttcgttcagagatattagctttgattctgaattctctgtttctctgtggggttattggttcttgtgaggggcttggattcttgttcagacatactagctcttattccgaatttttccaaaataattgttgaagaacaggacatggaggacctgaaacctcttcaggaaggtgtcccttgtcgtatttggtttgtcccttcgtgctttagctattgtggtttcaatgtggtaggggagcaggagtgtgctcaaggttgcctttactggagctgtctgtttgattagcgtgaatggngagaactgac

SEQ ID NO: 5319 - DNA, 386 bp, Triticum aestivum
  Clone ID: LIB3281-025-P1-K1-E7
gctgcatctcctagcactagcaggccccgtcgccgccgccgcctgtcctcgccgaggagaaggcgtcaggtcgatctccgcgaggacttcctctctcgttctcccttgcatctggaccagcagcttgaactggagtgagctgatggaagctgaaagaagccagcttagtccaatcgacccaagaagagctcggtttccttgttgcatagtgtggactcccatacccttcatcacatggctgatgccatttatcggtcacattggcatttgcagagaagatggtgtaatcttggactttgccggtccaaatttcgtgtcagttgacaactttgcctttggagctgttacacgctacatccaattaaatggtgatgagtgctataaac

SEQ ID NO: 5320 - DNA, 401 bp, Triticum aestivum
  Clone ID: LIB3281-025-P1-K1-E8
cggacgcgtggggctttgtcctgagtgacatgtttcagaacctgcgcagtgaggacaggggagctcttctccatgaaggtgctggacactcagttgtatctgcttttgtcgagataatttttgataattcagacaaccgtattccagttgataaagaagaggtacgcttgcgaaggacagttgcttcaaagaaggatgaatactacttggatgggaaacatgtcagtaaaactgaagtcatgaatctgctggagagcgctggtttctctcgatctaatccatactatgttgtccagcaaggaaagattgcatcccttactctaatgaaagattctgaacgactggatcttctcaaagagattggtggtacgcgtgtttatgaagatagacgtcgggagagc

SEQ ID NO: 5321 - DNA, 369 bp, Triticum aestivum
  Clone ID: LIB3281-025-P1-K1-E9
cccaaccccgacccagccggaaaggccagccaaaccctccccagtccccattccccacccccctccgagctcgccatggcgccggtggatccgcactcctacaccgacggcgcgcacccggtgaccgcccacgccgcgctcgccttctacctcgacttcgccgcctccaccatccacgcctccgcgctcgtcaccctctcggcgccgcacaccggggacctgctcctcgacacgcgcgccctcgccgtccactccgccgccaccgcccccgcccccgacgcggcccccttccccatccccttctccctcgccgccgacgccgacccggtcctgggcaccgcgctcacgctcgccctgccccccgacact

SEQ ID NO: 5322 - DNA, 391 bp, Triticum aestivum
  Clone ID: LIB3281-025-P1-K1-F10
gtaaagaagaagcttcaagactgggaagctaagcaaaatctatctgagcaacagaattgctctgcttctgagcatgtccagcctagtaatagtaaggggcagaaaagatcaatgaggcaccaggaagtgccatctcaaggacctctgagaattgatgctgacaaacctgacctggcagaagagcgtcctgggagcatgctggtaaacaaccccattgttggccaaacctcagttgttccaccaagcacagatgatgacatggtggccctgcgtgaacatctgatcaagcaattccttgaaatcgacaaatacggcgggcggatcatcgggataaaggaaatgggcaaactgaatgtgaaggcatttgagattgcttgcgctgagaagttcc

SEQ ID NO: 5323 - DNA, 375 bp, Triticum aestivum
  Clone ID: LIB3281-025-P1-K1-F11
cccacgcgtacgcggacgcgtgggcggacgcgtgggttttttttgaaggggaaaaatacattgtttagatattttttttcgggaaatacattctttagacattgcaagggttctacccgttcttgtctatagatgtagctgtgatgtttcagttaggaaattagataacgcatggcatgctggatgcggacactttctattaccggaatattgtaagcgactattgtaaggcgcattgtgcggccgaacagaacgcttcaatcagccggtggtaaagaatagttgaccaaaaaatatcatcttaatttttcatggaagtccttcatttttgttaaggtattaaccttgcttttaaaacgattacatctactttta

SEQ ID NO: 5324 - DNA, 217 bp, Triticum aestivum
  Clone ID: LIB3281-025-P1-K1-F12
cccacgcgtacgcccacgcgtctttccacgcgtccgcccacgcgtacggggacgcgttcgaggactcgttttcaaacgcgtggaactcagcataccagctgctcatagccagcctctagtgggaactagagggtctttgaagaacactgttatcgttttcatagagcggttatacgattcaatgggtgggaaggtcatgatagacggaaatgacata

SEQ ID NO: 5325 - DNA, 355 bp, Triticum aestivum
  Clone ID: LIB3281-025-P1-K1-F2
gtagctacaggtttatatggtatttggcatttcaccaaccagtacaacatttataactatcaactccagaaatttgtcacagtttctatcattactgacatataaaaatgggaggtacagaacaggaccgattcggtacaaatacccgataactcatatactataaagcaagcacatttgtatgaaaatcgaatgaaaggtgggaatctaccgagagggatggcctcctctcgctgtctgtctgtctgtctgtccggatagtaaaaatttcaacatacaaaatctcacaacaagcatatatatagctaggacacgcatctgatgactatatatatatatatatatggaagctaat

SEQ ID NO: 5326 - DNA, 210 bp, Triticum aestivum
  Clone ID: LIB3281-025-P1-K1-F3
acaaaaccgggcccaaaaaaatccaaagcgggctggagggccatgtttttaaggaaaattgcccagcaacgattaagggaacatactgggcctacaactgcacccatatgataccaaatggtttgagaaccgtggcaccaacctaaaacaaacggggggatgcgctaccatgaccaaaaactagtggcgggaaacaaacccccgcgcaca

SEQ ID NO: 5327 - DNA, 427 bp, Triticum aestivum
  Clone ID: LIB3281-025-P1-K1-F4
aattcccgggggcggacgcgtccgctgaagcaaggagggaaagggctttacactcactcgagagatatatgcactactgtgaacgctgggcatctaatcagacatcgaggcagaaggcaatagcagatctgcaaaaggcggaaaaggaacaacttgcaaagttaactgatatttatggaataccggagacacaactgaagttcattattgaagcttggtcacagattatagaatgcaggcgagtgcttcaatggacgtatgcgtatggctattatctcgaggacaaggtcaagagtggattttttgagtatctgcaaggtgaagctgagtctggtttggaacgtctccatcagtgtgctgagaaagacctgctagcgtttttgccattctcaaaacatgatactactgaagatcatccttcaccagc

SEQ ID NO: 5328 - DNA, 387 bp, Triticum aestivum
  Clone ID: LIB3281-025-P1-K1-F7
acacgagcatgggcggctacatgtcgagcaagaagacgatggagatcaacccggagaacgccatcatggaggagttgcgcaagcgcgccgacgctgacaagaacgacaagtctgtcaaggacctggtgatgctgctgttcgagacctccctgctcacctctggattcagcctcgacgaccccaacaccttcggcaccaggatccaccgcatgctcaagctgggcctgagcatcgacgaggacgaggaggctgctgaggctgacacggacatgccgccgctggaggaggacgccggcgagagcaagatggaggaggtcgactaggcgtgtgcgttcgcttgctatccgagtcgtagagctagcttatcttttgggttactgtcgcgtg

SEQ ID NO: 5329 - DNA, 404 bp, Triticum aestivum
  Clone ID: LIB3281-025-P1-K1-F9
cccacgcgtccgctcgtttgtgggtgttgtgagcaggactaggagctggtgcaacttaagcgtgaggcccggatgaagggtgggttctatgtcagtcccgaggcaaagctgctgtttgtcatccgtatccgtgggtaaggcatcacttggcacttgatcattgctatctgcattgatttaggtttgtgtgcacatgttttgatgctaattttttgaaatgtttactatagtatcaatgctatgcacccaaagaccaagaagatcttgcagcttttgcgtttgaggcaggtgggttgatcaattatttggttctgtgaatgcacatgttgcttgatacatatacttttgaaaatgattactgatgctcactgctaaaatttacttctacatatttgtaatgatga

SEQ ID NO: 5330 - DNA, 356 bp, Triticum aestivum
  Clone ID: LIB3281-025-P1-K1-G1
gactagttctatctcgccacaccgccgaccaccaccagcaacacacacacagcagccaagcgaagctcgccgcagatcgaagatgtcgggccgcggcaagggcgggaaggggctgggcaagggtggcgccaagcgccaccgaaaggttctccgcgacaacatccagggcatcaccaagccggccatccgtcggctggcgcggcggggcggcgtgaagcgcatctcggggctcatctacgaggagacccgcggtgtgctcaagatcttcctggagaacgtcatccgcgacgccgtcacctacaccgagcacgcccgccgcaagaccgtcaccgacatggacgttgtctacgccctta

SEQ ID NO: 5331 - DNA, 405 bp, Triticum aestivum
  Clone ID: LIB3281-025-P1-K1-G10
cccacgcgtccgcggacgcgtgggggctcggcgcacgcagtcacacactagcagtagcagacaggggcagtggaaagagaggagtgagaagcagaagaacaagaacagcaaggaaggcccggaggagagagatagagggtgaaaggaagaagagaagttgagtgagtgcgcaaggatctggtgagggatctcatcatgcagaactcaaaaaccagtaggaatggctcttcagatgctccgcagaggacgtctccagcaactccgcggtcgtctcgtgtggctaaaactggagggaatgaaactgactccgcagggatcacaccgacaagaacacctacagagaggagcccaaaggtcattgagcgccgttcaccacggagcccagttacggagaagaagcgccca

SEQ ID NO: 5332 - DNA, 408 bp, Triticum aestivum
  unsure (1)...(408): unsure at all n locations
  Clone ID: LIB3281-025-P1-K1-G11
cctcctcctcccctagggttttgctgcccccctccacacccgtgccgccggcgccgtcgccgcccgcgtccccccatggcgctgccgaaccagaacaccgtcgattaccccagcttcaagctcgtcatcgtcggcgatggcgggactggcaaaaccacttttgtgaagaggcatctcactggagagtttgagaagaaatacgagcccaccattggtgttgaagttcacccattggatttcaccactaactgcggaaagatccgtttctactgctgggacactgctgggcaagagaagtttggtggccttagagatggatactatatccatggtcagtgtgcgattatcatgtttgatgtcacttcaaggctgacctacaagaatgttcctacgtggcacanggacctg

SEQ ID NO: 5333 - DNA, 286 bp, Triticum aestivum
  Clone ID: LIB3281-025-P1-K1-G12
cccacccaaaacaaccatcccctcgccgtccgagcgcctccgcgtgcccgtgacgccgacgcctcctccctcgccgggccgctccgccgacggcggcctccctccctcacccaccaccgacccatcgcccctcgccgccagatccgtccgccctccgcgccccctgccgctcgggcctaggcagatctgcgcgggcggatgcccaccacaaccgggaaggtgaagatggtccattggagaataccacttactgcggaaagaaccgtttctaccgtcggcgcgctgc

SEQ ID NO: 5334 - DNA, 413 bp, Triticum aestivum
  Clone ID: LIB3281-025-P1-K1-G2
cggacgcgtgggtcaaatgcccgagcagcgaaaccatatgccgtcaagctcgccggtggcgccggagcgatcctcgcgagcacaaaatcattcggcgagcagtccatcaccagcccgcatgtccaccccgccacggctgtgtcatttgtcgacgccgagaagatcttcaagtacatacgcgtgcaaacatcccctaccgcgacgatcgtcttccgcggcaccgtggtcggcccgacgcctccatcccctagaatggcgtccttctcgagccgcgggccaaacttccgcgcgccggagatcttcaagccggacgtgaccgcgcccggcgtggacatcctcgccgcttggacaggcgccaactcacccacggagctcgagagcgacacgaggcgggtgaagtacaacatcatatc

SEQ ID NO: 5335 - DNA, 414 bp, Triticum aestivum
  Clone ID: LIB3281-025-P1-K1-G3
ctgagaaaaaacgtagaaggttgaaaacggtgaacacaggggtttgtttgtcatgcttcatctcagagactgaacaacttgagtactatggtgtcattgaggaaattatcaaagtatccttcacagctcgtagaaaaattgagatggtactcttcaaatgccgttggtttgaccccatcaagggtgtgaagccaaatgcaaaattaggtttggtggagataaagtggtcttcaaggctaagtaattttgaaccatttgccatggctcaccaagctacgcaagcttattacttgcattacgcatcctccaggagagatcttcgtgattggagggttgtttacactattcagccaagtaccagcttgagtaactttgatgactgcgcaaatgacccatctactacagatgaatatt

SEQ ID NO: 5336 - DNA, 374 bp, Triticum aestivum
  Clone ID: LIB3281-025-P1-K1-G4
gtgcaatgagaatttgctcacaatgtgtctcatcaagtgggtgtgagaggaattggagcgcctttgctttggtgcacacaaagcaaagaaatcgtcttttatatgacaagctccacaagctagtttctgtacgctacaacctaaagatacgtgctgaagaagatcaagagaaagatatagataatgaagttgatccaagtgcactgctgatggacacaacaatgtttgatgaagcaaatccaataatggagtggctgaatgatgatgaagaggatccaattgtggatggagctaatgaagccagtgctgtttttgagaaaataaggcgtctcaactcaggcaggaaggattcttatgttggtacaaggggtaat

SEQ ID NO: 5337 - DNA, 407 bp, Triticum aestivum
  Clone ID: LIB3281-025-P1-K1-G5
ggcacgtcgaccgacaagaacagttactacgccgtgctggctggcaccctcgccggcctgagcgccctgggctggtacctcctgtccaagcccaagaagacggaggaggtcgtcgactgatcggccggtctccgtcccgccctggtttttacttccttactgcacatggacctgcctgtggttggtgtggtatgatgatgatgatgataataagtttccgacgtcgccgaacagccttgcctttgccttgttagctgcctgcttcgacagaatctgagacttgagatgatgatggtctgtagcgcaagttgttttgctacctgtgggtggtgtggtatggtggtggttaacgagagaggcgtcttggatgatgcgggttggccttttcaaaagatgcaatgcatggt

SEQ ID NO: 5338 - DNA, 396 bp, Triticum aestivum
  Clone ID: LIB3281-025-P1-K1-G7
agattttgaactcgagcagagctctcggcgagggtttgggcggcggagggaggcgggcatggccgggaagaagcaagcggcggtgagcgccgcgccttccgagggcgaggagggcgccgtcgtccccagctccactgccaagcgcggggccggcagacctaagaaggaccccgtccccgccgccgccagccccggctccgctgccaagcgcgggcctgggaagcctaagaaggatcccgtccccgccgccgctgccaagcgcgggtccgggaggcctaagaagggcgccgcccccgccgagtccggcgagggctctgctccggagcccgggaagagcgagatgggggagggggagaagggggcgaccccgaagaacaggggaagggggagaaggag

SEQ ID NO: 5339 - DNA, 396 bp, Triticum aestivum
  Clone ID: LIB3281-025-P1-K1-G8
gcagttttcttcgatagttttgttttgccattgctaccagtcatcagattttggtaagttatctaacactgctattagagtccagatgcgccttttaggtttaggagcaccgctgtctagctcagcaggcgagagctctaagtgttgttatgtctgaaattccatggacaaccttgttttgttggcatagttattactagccatgctcggcagtatgacacacattgtggccgatggatttcggttttccttgtggtgtaaaaagaaatatgtattagtgtttttcctatttaattgataactacttggatcgtggagggtggtgttgaacgtgtatgagtgtttgatttacttattcctctcacagatgaggagagtagaaagtagcagttggta

SEQ ID NO: 5340 - DNA, 387 bp, Triticum aestivum
  unsure (1)...(387): unsure at all n locations
  Clone ID: LIB3281-025-P1-K1-G9
ggcgatgcccaacaacgggtcggtgcgagggttcgaggtcatcgacgccatcaaggtggccgtcgagaatatctgcccgggcgtcgtctcctgcgccgacgtgctcgccatcgccgccagggacagcgtcgtcgccctgggcgggccgaactgggcagtgaaggtcgggcggagggactcgacgacggcgagcttcagcggcgccaacaacaacatccccccgccgacgtcggggctcgccaacctcacgtcgctcttcgcggcgcanggactctcccagaaggacatggtcgcgctctccggatctcacaccataggccaagctcgctgcacgaacttccgagcacacatctacaacgagactgacatcgacagcggcttcgccgg

SEQ ID NO: 5341 - DNA, 405 bp, Triticum aestivum
  Clone ID: LIB3281-025-P1-K1-H10
agcagccgccgccagcagctgcgcaaaggctccacaaaccctaaccctagctccaagcttagcttccatcttctcgatctagctagagccatggcgccgaccaagggcgaggggccggccatcggcatcgacctcggcaccacctactcgtgcgtcggcgtgtggcagcacgaccgggtcgagatcatcgccaacgaccagggcaaccgcaccacgccctcgtacgtcgccttcaccgactcggagcgcctcatcggcgatgccgccaagaaccaggtcgccatgaaccccatcaacaccgtcttcgatgcgaagcgtcttatcggcagaaggtttgctgatgctcctgtccagagtgatattaagatgtggccgtacaaggttattcctggcccagcagacaag

SEQ ID NO: 5342 - DNA, 396 bp, Triticum aestivum
  Clone ID: LIB3281-025-P1-K1-H11
cggacgcgtgggcggacgcgtggggccgcggctcacccccatgcgaccctagcttcgctcgctctccggcgtagcttctcccttttccctgccgcggcggatctgcgtcggcatttgacggcggggagctgacattacaggcctggtctgcaccaatggaggcaatgcgcaaaaaggaggcaacagcaacggcttgttctgaagacaaccgtaaaggtgtacatggtgtatccatgaatgggctatacgatccttggaatcctgcctaccctccacgtgatcctagtccatgcgatgctgacatggctgctcatatcgcatcagtcaaggagtggatggacaaaacacaggctatacttgctaactccagagcaaccaatataatcataccagatc

SEQ ID NO: 5343 - DNA, 374 bp, Triticum aestivum
  Clone ID: LIB3281-025-P1-K1-H12
cggacgcgtgggagctcacgcatctctccctcagctccggcaagcaacaccagctctcctcttccctcgcttacctgctgcaatgtcgaccgacgtggccgccgatgtcccggcccctgaggtggaggtgaccgccgaccccgtcgtggagaccacaggcgaggccgccgccggcgacgcgaagccggccaaggagaccaaggccaaagcggccaaggccaacaagcccttcgccccgaggaagccccgcgctacccccgtccacccgacctacgacgagatggtttcggaggccatcaccgccctgaaggagcggacggggtcgagccagaacgccatcgccaagttcgtcggggacaagcacaaggcgcacc

SEQ ID NO: 5344 - DNA, 106 bp, Triticum aestivum
  Clone ID: LIB3281-025-P1-K1-H2
aagatgccgttgtcaaacgtccgaggtggtaaaccttatttcgaagctctcggcggctaaccactagcgatccattaaaacacaaaaaaattggacgagcagtgca

SEQ ID NO: 5345 - DNA, 390 bp, Triticum aestivum
  Clone ID: LIB3281-025-P1-K1-H3
atcggggactcgttgcatcgcgagcgggccccactgtatttcaagctatctgcagcttacctccagggatttatcagtacaagttcaatgtggacgggcagtggaggcatgacgaggggcaacctactataacgggagagtatggggtggtaaacactttgtacttgacaagggaatttgaccacataaatactgtactgagccccactacacctgggagcaggatggatgtggacaatgatagttttcaacgaatgggttcgttgttggatggtgcccttcaggaaggttctccaagaatttcagaggctgctatacagatctctaggtgtcgtgttgctgagtatctgaatgcgcatacaggccatgacctactaccagattctggaa

SEQ ID NO: 5346 - DNA, 408 bp, Triticum aestivum
  Clone ID: LIB3281-025-P1-K1-H4
ggggccgctgcggggccgtgccccgtggtcaggttcgacatggccgacttcactgtcgccgaccgcgtcagcgtcgggctccacggacggtccgatgagatgatattcgaggccacggtgcgcgatcctagcagtgagctgtacgggtcgacggtggtgttgcggcagctgactagctcacaggcgaagcggaggggccgccgcgcgctagaggtgctgaagaagctggcccgtcgccagatgatgtaccactcttacgcgatgcaggtccatggctacgtcactccgagcaaggccatggaagagggtgatagtccgcttgtcttggtgcacgggtaccatgggagttactccttgcgtcactggttgcaactctcggattggcttccaaccttggaagcaacatta

SEQ ID NO: 5347 - DNA, 406 bp, Triticum aestivum
  Clone ID: LIB3281-025-P1-K1-H6
cggacgcgtgggcgcagggacggctcatcttcgttccgtcgcggggatcgtgagtggtggacgattcgcctctccaaatacatgtctatcccttaagcgaagggattttgtggccttccgtttgtgacggctgaatcggttgatgcgtcagatccgtcagtttatgccatctgcttcctgttcgcatgcccctgtggatgtttatctccgtggaacgccactcctgctggttcatcttcactggtttatgatgcccacggccaacgccactgaaatcttctcagacgatggttggtggttaagctgaagaatgctttcttgaggctttcttgtctccgcaaggcgccagaaggaaactggccatccgatatatggtttctgtttgccgatcaaatgatgtacgtgt

SEQ ID NO: 5348 - DNA, 407 bp, Triticum aestivum
  Clone ID: LIB3281-025-P1-K1-H7
atctctctgtccccatacgcctcgcctcttgagcgcgctcttgaaggaaggctcgacacctctgccttctgctctcctcggctctgcatccgtgagagctgttgcattgctgcagctcgcgagcgcccgggtcgttagtagttctttcaccacagcccggatcatggagttcgacgagcgctgcctcaaggtccaggaccccaaatttgattgcctcctctttgacctggacgacactctgtacccgctgagctcggggatctcatcacacgtcaagactaacattgaagcttacatggttgagaagctgggtattgaggagagcaagatcgaaaaccttggcaacctgctgtacaagaactatggcaccacgatggcgggcctcaaggcaattggctacaacttcg

SEQ ID NO: 5349 - DNA, 406 bp, Triticum aestivum
  Clone ID: LIB3281-025-P1-K1-H8
ggcggagcgaagtgggagccaacgccaagccagccgagccgactcctctcctcctcgcagcagttcgttcccgattcgcccccaaatccagcgccctccccgccggaatccggcgccgaatcgagcagagagcttgaactgagctatggacaacttgtggcatctcggagatgagttccgtgggcaatcaaaggtggtggaggaccgccaatggtctctcatgacatcaaagctggctgagatcacaaagtcaaaggctgagaggatgaatgactttgagtatgcaaggatgaacaccgtccctgatgtgaagcaatgggataagcaatcctaccaccaagaagacaacaagatggaccacctcaatcttggcctcatgaacctggatcttaggatgaacgatctc

SEQ ID NO: 5350 - DNA, 337 bp, Triticum aestivum
  Clone ID: LIB3281-025-P1-K1-H9
attatctgggaatgaatattctaatgggaatggaatttcataatactgaaagagaagagctagcaattcggaacgcaaattgcgttttaatacgtctcactattctaattttttagaagaaatggcctttattatttcttttttatggggttaataaatattaaccaaatttaatttaagaaatgagagaattcagaatagctacgagaaagactagtccaatccataatgatgtaccggaaaatacaacatttttattatttgaccaaccatcaggagaagcaaatacaaggggtacactaattactaagactgaggaagtcgcaattaatgcaaa

SEQ ID NO: 5351 - DNA, 107 bp, Triticum aestivum
  Clone ID: LIB3281-026-P1-K1-A1
acggggaagaaagcaatgaggcgagcttaagtgttacttaaaacagaaccaaataaagaaatgctcgggcccttggtgagtaaacaaactttatcacgcgtgcatgc

SEQ ID NO: 5352 - DNA, 389 bp, Triticum aestivum
  Clone ID: LIB3281-026-P1-K1-A10
ttaaactccacgagacgaaaccaaaccgtgacaccggagcagcccagccccaaatcccccttttcggccggccacgacctcttcctccacaaaatcctccccggaattccgccgagtccccggtagccggccgccgatcggtcgattcgcggggggcgggatgagcttccaggacctggaggccgggaacggcgtccgtgggacgccgcggaggaacggccgggcggcgggggccggcgccggctcgtcgcaggccgtcgcgtcgggcgtcttccagatcaacacggcggtggcaacctttcagcgcctcgtcaacacgctcggcacccccaaggacacgcccgacctccgtgataggatacacaagacacgagcacacataacacaac

SEQ ID NO: 5353 - DNA, 386 bp, Triticum aestivum
  Clone ID: LIB3281-026-P1-K1-A11
agctgggactgtcatatctgaaacatgggaggatggtcaggcaataaaggaccttaatgcgcatcttaaatcattgctggaaactaaagaggctgttgaaagacatcgtaaatctctaaagaaacgacaatcatctgataagggtgatggaagtgatgctgaaactagcatgtccgaggaagatttcctcttacaggacgagatatgtaaatctcggttaacaagtatcaagcgggaggaagaacagtatctgcgagaaagagatcgatatgaattagaaaagggtaggcttatacgtgaaatgaagcgtctcagagatgaggatggatcccgctttaataacttccaaattcttcaccatcgatatgctctgttaaatcttcttg

SEQ ID NO: 5354 - DNA, 369 bp, Triticum aestivum
  Clone ID: LIB3281-026-P1-K1-A12
agctgggactgtcgtatccgcaacatgggaggatggtcaggcaataaaggagcttaatgcgcatgggaaatcattgatggaaactaaagaggctgttgaaagacatcggaaatctgtaaagaaacgacaatcatctgataagggtgatggaagtgatgctgaaactagcatgtccgaggaagatttcctcttacaggacgagatatgtaaatctcagttaacaagtatcaagcgggaggaagaacagtatctgcgagaaagagatcgatatgaattataaaagggtaggcttatacgtgaaatgaagcgtctcaaagatgaggatggatcccgctataataacttccaaattctttaccatcgatatgc

SEQ ID NO: 5355 - DNA, 394 bp, Triticum aestivum
  Clone ID: LIB3281-026-P1-K1-A3
cccacgcgtacgtccacgcgtccgcccacgcgtccgcctccttcttcctcccccaccccccgccccccgaccctggatccaaatcccgaccctccccagaaccggaaccgaggcaagcaaaagcttggcgcaattattggccggagataggtagagaagcgaggcagctcgctcgcggtgaggcgagatcatgaagcgcgagtaccaggacgccggcgggagcggtggcgggggcggcatgggctcgtctgaggacaagatgatggtgtcggcggcggcgggggagggggaggaggtggactagctgctggcggcgctcgggtacaaggtgcgggccttcgacatggcggacgtggggcagaagctggagcaagtggagatggccatggggatg

SEQ ID NO: 5356 - DNA, 383 bp, Triticum aestivum
  Clone ID: LIB3281-026-P1-K1-A4
ttctttctttctttctttctttcttggaggttccttggattcatccgttcatcgggcgggcgtgcgggctcgatcgggatgggcgggggctgctgctgctgggttgggctcgcgtccaattccccaccaccacaactagtacgcttcttttttattgttccaggagtgggatttgcctttgcgctgtgagagagagggagctatttccgcgattctcattagggctcctccctcttcgccttcgtcttctcccccacgctttactctttcgttatcctcctttgcgcccccccgaatccaatcctcccccctccgccgctccccgtccggatccggggcgctcgttctcgatttcgcccgcccgcaccgtcggcccccgattc

SEQ ID NO: 5357 - DNA, 391 bp, Triticum aestivum
  Clone ID: LIB3281-026-P1-K1-A5
ggtgaaaccctcggcggatggtcgcttgggagccaagcatttgattcgatcttaagtggtccaggcgattggaggagctgctggctgctgctgttcccggggagtggattttcttgaggtgcagtgaatctgtcctgctgtcataggtttaaaaaaaacaattcaaattgcctggccttggatcaagtccattttcctatagagattgccatctgtcttaagtcaaagcagctgtatttctggcaaacacaacgagctagtttcatatgcagcgttcagttgatggctgctcatcctgttgaatcagaagcaagcagtgaaacagacaatcaccctttactgatagaccacatggaaaatactgctcatcttgagattgcaattgagagcc

SEQ ID NO: 5358 - DNA, 392 bp, Triticum aestivum
  Clone ID: LIB3281-026-P1-K1-A6
ctcttcctctccctcaccccttcctctccaccaccggccgccgccgcggccaggccggcgtagcggtgcgccacccagccatccatccattccatctccacaacgcacctccagcaccatctccttctcctccccgaatccatccatctatccatccaccacgccatcacatcaccagcacccctcaccaccagcgccattactccacttcctctgcttcccttcttttctgaacctcaacgccttctgctgctgctccctctctcaacgcctcctgctgctgctcctttcttctttcacccctccctgctgcccttctactcttcctgctgctgctcttcttgcgaccctgctgctgctccttcctcccttacgtcgctgctgttcttctc

SEQ ID NO: 5359 - DNA, 299 bp, Triticum aestivum
  Clone ID: LIB3281-026-P1-K1-A8
cggacgcgtgggcgccgccgccacctcttcctcgcgccgccaccagcaccactcctttcgagcgcgtgccgcccatcgtcctcctatcctcctatctcgccgcccattcatccgagcccgacgacgccagatccgcgcgcagcccatcgttctgcacctcccgcagcagatccagggcactgccgaatctcactgtcgacagatgcaccgccgccctgcagcctcggcgtcgcggtcggctggctcgccaccgcgcgcgtgcttcattgcgcgccgctccgtcgagcttgatccttgga

SEQ ID NO: 5360 - DNA, 71 bp, Triticum aestivum
  unsure (1)...(71): unsure at all n locations
  Clone ID: LIB3281-026-P1-K1-B1
ntcggacccaaacgcgtctgctctcacgtcgtcctgactaccagtctccggcccgccctccagcttgccca

SEQ ID NO: 5361 - DNA, 307 bp, Triticum aestivum
  Clone ID: LIB3281-026-P1-K1-B10
gaaagtcgtaggcgcacctatagagacagaaaggcagctgaacaaaaaggagttgaaaaagaaggaactggctgaacttgatgctgtgttagctgagttgggaatttttgaaaacacatgcgatgctgcacaagatggaaacaacactgctgataagaaaggtgcgagccaagctcgtgatggagagagaaaggaagactcacctgccccttcagagagcaagaatgccaagaagaagaagaacaagaaggacaagagcgcgaaggaggcaaaggaagcttgtgtggtcgaagaggctaccagtgca

SEQ ID NO: 5362 - DNA, 379 bp, Triticum aestivum
  Clone ID: LIB3281-026-P1-K1-B11
cggacgcgtgggcgcgttcgcaggaggtggaggtggcggaggtgccgatgccgtcgcgtcgtggtggagagaagggatttcccaaggcagcaccgccgcgtcgtggtggcgacaagggatcgtcgcgtcgtggtaaagagaagcgatttcccaagggcggttcgcaggaggatgcagtgatcaagaccgggcgtcttgatcggaaaaaggggttcaggaaggccggttcggaggaggagaagaagaagaagaggctgcctgaagagatggtgaacgacatcctgtcctgggaaaagcctccccgcttcacaatgttcaagttcggcggcttcttcaacatattgagggatgaactcttcgagtatcaacaggagatcaa

SEQ ID NO: 5363 - DNA, 212 bp, Triticum aestivum
  Clone ID: LIB3281-026-P1-K1-B12
cggacgcgtgggcgcattcgtattaagtggaggtggcgtaggtaccggtgccgtcaaatagcggtacagagaactctttatccaaggtaaaaccaacttgtaatttttgcaacaagaaatcatattgtaaaggtaaaatagaagctatttcccataatactggtatcatcacgattccttgatcaagaccgaaactgtattcatctaaaaat

SEQ ID NO: 5364 - DNA, 310 bp, Triticum aestivum
  Clone ID: LIB3281-026-P1-K1-B2
cggacgcgtgggtttttttttttttttatgattttagtcaaatcaaatcataggatttattcatgatacccgggtatcaatgtggcagcatggcagaaacttttctgattacagtgtgaatgtgtgactaatcagcacattcatcgcagttgaacaaaaacggaaccagttttggttggatcatgaaattttggcttgaattctgcaaagacaaataacctttttatacatggggaatgcccaaaatcatggtccgagactggttggctataaaatctatgaagatgaacaatgggcttagaatctaaga

SEQ ID NO: 5365 - DNA, 353 bp, Triticum aestivum
  unsure (1)...(353): unsure at all n locations
  Clone ID: LIB3281-026-P1-K1-B3
cacacctntactcgacggcaccggcggcgccgccgccgccacgcgcggntggtgttcctcaccgacttgccgccgccctgttgctcttcccctccccgtccgcccccaatcttctccggcgccaccacagcctcctctacctccaacctcctgctgccgtctatctccaatttgcatcgaagtcggtgtccgtgttcgtgcgggacaacttctccaagacggagtgcccagcccgaactccacagggatttggatgccataagaccgagcccttgacggaaatccccagtaaatcacctcgcatcacaactttcgaagaaccgtccaatatcgcgccgaattagccggaagaa

SEQ ID NO: 5366 - DNA, 381 bp, Triticum aestivum
  Clone ID: LIB3281-026-P1-K1-B4
cggacgcgtggggggcacacgccccgctgcaagaaactaaggctccttcaatggtgccttctcctttccaggggagcctctccaaggataaagcgtcatccagcagtgccagtgttgctgaatcaaaccaaaggaagcaacctccagctcttgaagcgcagcagtcctctcccatgccaccaaacatgatgcaagcgccaacattcatctttccattcaaccaacatgctgcagcagtagcagctgcaactgccgctgccaatcgaatgggagatacaaaatcttctggcaccagcagtgcgatgccatcatctgccactgcccacgcttcagcagcacaccctggtgcaccggccatgaacttgagctttgccaacatgc

SEQ ID NO: 5367 - DNA, 273 bp, Triticum aestivum
  Clone ID: LIB3281-026-P1-K1-B5
ggaaccaaaaagggtgctgcttcattagatgactacaggaagcttgttgttccagtaattgaggagtattttagtacaggagatgtggaactgtcagtttccgagctaaggagtcttggatccgatcagtttcacaattactttgtgaagaagctcatatccatggcaatggaccgccatgataaagaaaaagaaatggcgtcaattctgcctgtctgccttgtatgctgatctattggactcctccaagatgagtgaaggttttatgatgct

SEQ ID NO: 5368 - DNA, 351 bp, Triticum aestivum
  Clone ID: LIB3281-026-P1-K1-B6
ggaaaatgaacgatggcgcggtttacctgtggactatgccgatgttccactgcagtggctggtgctatacatggacgctggctgctatctgtagaacacgtatatgtcttcgtcaggtcacagcgaaggctatcttctgagggatcgccaaccaaggagtgactcacttctgtggggcgccagctgtgctcaacatccttatgaacggccgtcgagctgacaccattgttccgatgcctcgcgttgtggatggcatgactgctggtgctgttccaccggcgtaagtacttgggtgaatgtgaacgctcggctgccatggatgctacacgtgtggcctctcggagacatatt

SEQ ID NO: 5369 - DNA, 394 bp, Triticum aestivum
  Clone ID: LIB3281-026-P1-K1-B7
gaagaactccaagccacagtgtttcaccttgcaattgcggaaaaaacctacctttgacctgccaaattgcagcagccatgttcctctgctgccgccgccacctcaccttctcaccgctcaccgccgtgccctctcccagtggacaccgccctctcaagccaagaacgctcagagccccaatcctagcatccaagaaccccccaccacggccatggccactgccaaggcggcaatggcggtggcggtgcagcaacaccgatgccgcccaaccgccacccgtcgtcgaggccagtgtgtccggcgacggcgagaagaagagcttctgggcggcggtgagccttatcatcggcacggcggtcgggccaggcatgcttgcgctgccgtcgggcaccat

SEQ ID NO: 5370 - DNA, 379 bp, Triticum aestivum
  Clone ID: LIB3281-026-P1-K1-B8
cggacgcgtgggcgcgcagccaagggggaaagaaagaaagaaaaggaaaaccaaccagaagaaaagctcgggcgtttcttagcgtgggaggagaataggggagcgtgggggagggagcatggcggagcacaaggaggagccggtggcggagtccatgatggacaagatctccgacaagttccacggcggcggggactcctcgtcgtcatcctcggactcggacgacgagaagaaggggtcggcggcgggcgtcaaggccaagatctaccgcctcttcggccgcgagaagcccgtccacgccgtcctcggcggcggcaagcctgctgatcttgttctatggaggaacaagaagatctcaggaggggtgcttgctggcgct

SEQ ID NO: 5371 - DNA, 395 bp, Triticum aestivum
  Clone ID: LIB3281-026-P1-K1-B9
ccgcacgcttctcctccgcctcgagcagctcagggacgcgcgcagccatggcgacggagaccgagaccttcgccttccaggccgagatcaaccagctcctctcgctcatcatcaacaccttctactccaacaaggagatcttcctccgcgagctcatctccaactcctccgatgccttggacaagatcaggttcgagagcctcacggacaagagcaagctcgatgcgcagcccgagctcttcatccacatcatccccgacaaggcgaccagcacgctcacgatcgtcgacagcggcattggcatgaccaagtcggacctcgtcaacaacctcgggaccatcgccaggtcggggaccaaggagttcatggaggcactcgctgccggcgctgacgtg

SEQ ID NO: 5372 - DNA, 398 bp, Triticum aestivum
  Clone ID: LIB3281-026-P1-K1-C1
gcagaacaaacagataagctaggtagcaagctgctccaaggctccaggacaccatggccacaaaccccggcctcttcagcgagtggccatggaagatgctcggcagcttcaagtacgtggtgctggcgccatgggtggcgcacggcatccaacaggtggcgaccaaggggtggcgcgaggccgatctggggtacctggtgatcctcccgtcgatgattctccgggggctccacaaccaggcctggatcacggtgtcccgcctccagaacgcgcgcggcaagcggcagatcgtcgaccgcggcatcgagttcgagcagatcgaccgcgagcgcaactgggacgaccagatcatcctgagcgccatcctcttgttcctgggcgcgctgcacctgccgggc

SEQ ID NO: 5373 - DNA, 313 bp, Triticum aestivum
  Clone ID: LIB3281-026-P1-K1-C10
cccacgcgtccgcccacgcgtccgcgcaaagtcgaagcaggcatcctctgcccaacgcggccacacaccctcgatctccgctataaagcccggtctccggtccccgatgccttctcgccccgccccgctcgtccaccgcctccgcctcctgagaagcgccgtcgtctccccttcttcggcgctgctgccgtgcagccgcccgcgcctcgctatccccttcgcgcagccgccgctccgcgccgccgccttcgccgccgcctcgtcgccgctgctccgcccggtcggcgccagattctcgctgttcagcagcatg

SEQ ID NO: 5374 - DNA, 384 bp, Triticum aestivum
  Clone ID: LIB3281-026-P1-K1-C11
caaaagggcttttttttattctctcattaagctcctatgtgctacatggtttacctgccctttcgagatttgcctctagatttctccttcttttcaatttttttttgcccgatacccaagagctgcagcatcagcaatacccgaagaacaatgcttatagagtgccatcaatttcctccactccggcgatcctctgggctgggcggccatgtatgctagttcgggtcttatttcctccaattccgtgagtgataaagatggctttgctgaaggtactgccttggatccaccaaacatatccaaggctgaattcagtgcaagtgcagactgagctttccaagcaggaaaattaaacaactttctcacagcgggtcgacgcataac

SEQ ID NO: 5375 - DNA, 344 bp, Triticum aestivum
  Clone ID: LIB3281-026-P1-K1-C12
tccaccaaaaactagggttagggttagggcggcggcggcggctttatttccgatcgcgatcgccatggccaccggaggcgccccaaagccggaggaggagaccgtcgtcttccccgattgggtgatgctggaacgcatctttcgcaaacggtgccacgacgacctagacgctgctggtgaggccggcaacaagaacaagaccgccgctccagtcaagattgacagcggccactcctgcttcgtctacttcaccctagcagctcctccagggtcctgctactataacctccattggccggggagacaaggcttagaagaacttcttgctcttgtccgggcagtcg

SEQ ID NO: 5376 - DNA, 363 bp, Triticum aestivum
  Clone ID: LIB3281-026-P1-K1-C2
gcagaacaaacagataagctaggtagcaagctgctccaaggctccaggacaccatggccacaaaccccggcctcttcagcgagtggccatggaagatgctcggcagcttcaagtacgtggtgctggcgccatgggtggcgcacggcatccaacaggtggcgaccaaggggtggcgcgaggccgatctggggtacctggtgatcctcccgtcgatgattctccgggggctccacaaccaggcctggatcacggtgtcccgccttcagaacgcgcgcggtaagcggtagatcgtcgaccgcggtatttagtttgagcagatcgaccgcgagcgcaactgggacgaccagatcatccttagcgcca

SEQ ID NO: 5377 - DNA, 389 bp, Triticum aestivum
  Clone ID: LIB3281-026-P1-K1-C3
cggacgcgtgggagttctttgagcttgcagcagagttctttggtggtgcaagtaatgatgagggtgatggaaatcaccccacactttgcaaagcgttaatcatgagtgtcacttccatgcttaaagctgaggagctaaacaattctcccttgatggattctgatgttaaaaaaggtgttgacgatgctcagcacagctggcaagctattaccttcaatctggccctcggcttcagtcgcctctgatcaggctgaggccaacatctttctgttccttcataccttctactcctaccaactccttgacaggatggacaccagcgcacatcctcagcagctccaactcgtcaagaactttgcttcctctaaagcatgcacgccgtgccatct

SEQ ID NO: 5378 - DNA, 391 bp, Triticum aestivum
  Clone ID: LIB3281-026-P1-K1-C4
gagcccgcccccgcgtcgcccgatccggcgccccgctccccggcgccgtcgccggccaagaggtccgcctggaagcagccctccccctccgccgccgcagccaacggcgccccgcacgccgacgcgccgtcgtcgccggccgtcatggacgccgaccactggcccgcgctcgccgacgccgccaggaccaagaccctgctcccggcccccgcgcccccctccgactcccccaagcctcccccggaccccgccaacgccgccgccgcctcatcggccatggcgaaccagtccaactcgccccggcacggcggcttcgggacgcaccacggccgccacaagacggctaggcgcgggggctcccgcggcagcggcggcggtggggaccactccc

SEQ ID NO: 5379 - DNA, 365 bp, Triticum aestivum
  Clone ID: LIB3281-026-P1-K1-C5
aacctttccccgcccaagcatccccatccgcatcctcatccatggcccccaaggcagccgagaagaagccggtggagaagaccccggcggggaagaagcccaaggcggagaagaaggtgccggcgtccaaggagggcggcggggacaagaagggcaagaagaaggccaagaagagcgtggagacgtacaagatctacatcttcaaggtgctgaagcaggtgcacccggacatcggcatctcctccaaggccatgtccatcatgaactccttcatcaacgacatcttcgagaagctggccggcgagtcggccaagctggcgcgctacaacaagaagcccaccatcacgtcccgcgagatccagacc

SEQ ID NO: 5380 - DNA, 379 bp, Triticum aestivum
  Clone ID: LIB3281-026-P1-K1-C6
cacctttccccgtccaagcattctcatccgcatccttatccatggcccccaggggagccgtgaagaagccggtggagaatactcctgcggggaagaagcccaaggctggtgaagaaggtgccggcgtccaaggagggcggctgtgacaagaagggcatgtttgaaggccaagaagagcgttgagactttcaagatctacatctttaaggtgctgttgcaggtgcaccctgacatttgttttttcttcatggttatttctcattatgaacttcttttattaacgacattttttagtaagcttttcttttgttttatctatcttgccgccttacaactatgttgtccattttcacttttctttgtgattttagtatctttt

SEQ ID NO: 5381 - DNA, 377 bp, Triticum aestivum
  Clone ID: LIB3281-026-P1-K1-C8
gctcaagcaggtgcaccccgacatcggcatctcctccaaggccatgtccatcatgaactccttcatcaacgacatctttgagaagctcgccggcgagtccgccaagctcgcgcggtacaacaagaagcccaccatcacgtcccgggagatccagacctccgtccgcctcgtcctccccggcgagctcgccaagcatgctgtctccgagggcaccaaggccgtcaccaagttcacctcatcctaggctcctcttgtgttgattcttgtgtttctttcctctttctcgtctgatgaattctgtagctagctgtgtgtgttctgacagtgtcatctttgtacaatggtgctgcctgaattaatagtcgtgttgctgcttg

SEQ ID NO: 5382 - DNA, 51 bp, Triticum aestivum
  Clone ID: LIB3281-026-P1-K1-C9
gcttaagcgggtgcaccgccactttttactagacttctacgacatgggggg

SEQ ID NO: 5383 - DNA, 392 bp, Triticum aestivum
  Clone ID: LIB3281-026-P1-K1-D1
gaggaggtatctgacccaaaggcactcctagaggatcgtacgaaggctaagtgtgtctaccagtggtatgaatatcagaaatgcgttaagagaattgaaggtgacgagaccgggcagaagcactgtactggccagtacttcgattactggaaatgcattgacaagcatgttgctgagaagctctttgatagcttaaaatgacaaggaaattgttctctctagctacttttcactcaacagtggtaataaatagcatcacttgcacgccttattgacaattcaggtctttatcatcatatatgtaaaagaaggttttgcctgtcgggtaacacgacagtttttctgcggccactttacattttgtttgtcagaggcgttgctggctcacgata

SEQ ID NO: 5384 - DNA, 391 bp, Triticum aestivum
  Clone ID: LIB3281-026-P1-K1-D10
cctcctccccatccctcgcggtccgccgccgtacatcacatgtcctcctgccgcggcagctgagtagctagctcagctcagctgagagtggggggagggccggcgatagtgcaagggggcagcggccatgagctggaggagagggggaggggacggggccgtggccaggcggtgggtgctcctgctctgcgccgggagcttctccctcggcctgctcttcacctccgggatgtggacattgcccgaggcaaccgaggttgccaagccaaacgaaacaagagggaaagaggccgagctcgccgccgtagactgtgattctactaaggtcggacggaaacatgatttcagagatacgctacaggccttggacactcacaacgctgtacagaca

SEQ ID NO: 5385 - DNA, 349 bp, Triticum aestivum
  Clone ID: LIB3281-026-P1-K1-D11
cgtactcgtgattcctaccaagctattcaaaatctttataatgttgatggctgagagaacatgaaggctagctgatttgatcaagaagcgttgggagagatacatgatgagaatggtggtaatgaacattacaacgatggaaggtgctatgaaaattctcaaactgatgctgatgtgactgctcgaattttggttccaggcaatcaagttggctgcctgatgggaaaaggtggctctattatacaacaatcgcgaaatgatactggtgcagggatacgagtgtaaccatccgaaaaccttcctcagtgctcacttaagagtgatgaattgctgcaaaattatggtgcac

SEQ ID NO: 5386 - DNA, 162 bp, Triticum aestivum
  Clone ID: LIB3281-026-P1-K1-D12
gggagaggtgagacctagccttccttcggcgaacattacattttacgacggcgcgtgcaacagagtagctagctcagctcaacaaatagtggggggagggccacattattgagcttggtggcatctggccattagctagatgagagggtgagggaacagttc

SEQ ID NO: 5387 - DNA, 64 bp, Triticum aestivum
  Clone ID: LIB3281-026-P1-K1-D2
gtggaggttgctgatggatgaggttgttgagccgtcatagatacggtgggggtgaatacgtggc

SEQ ID NO: 5388 - DNA, 386 bp, Triticum aestivum
  Clone ID: LIB3281-026-P1-K1-D3
cccacgcgtccgcagagaacacacaatggccgtagcgatgccagctgcgcgctcgcttctcctgcttctcctcctggttgcgccgctggcgccgggctcgtcggaggcggcagtccggccgaaccccaagatcgtcaactgggtcgcagacaatgcccgcgcctccacgcccgacagcttcggcgccctcgtcttcgacctctccgtcggcacgccgcggcagaccctctccttcgtcatggacatcaccgagcagctcgtctgggcgcagtgcggccaacatgggttcacgcagtcgcaggcgcccaccttcaggcccggcagctccttcgccccgattggctgcaaggacacggcatgccagagcctggcccccgacgacaact

SEQ ID NO: 5389 - DNA, 377 bp, Triticum aestivum
  Clone ID: LIB3281-026-P1-K1-D4
tatggatctgaagctggtgatgagggttgtgcggatctatcagaaggctgggaatgaggtgaagtcttccgtgtttgatgctgttatcaagtcgctgagaagcgtagaaaggcttggtgagagtggcagggtgttgaaggccatggagcacggtggttttgcaccagacagcactgtacatggaaaagctgttcttgcaatgtgtgatgctgggaatctggaaacagcgcacaaacatttggctcgtgtggaaaaatcagggcataagttggatccacctgtatggtctgctttggttcagaagtattcccttggtgatgatgttgatatggcagtttcatgcttccccgaaatgctggaaagaagaagtggcaatc

SEQ ID NO: 5390 - DNA, 395 bp, Triticum aestivum
  Clone ID: LIB3281-026-P1-K1-D5
caggaaccgagcacaccatcactcactccccaccgccactcgtcagatccacacgccacagcgcgcggcatgggctccctccccctcccctccctcgccgtgctcgcggcgcttctctgcttcctcgccgtcggcggcgccgtggacctcaacaccaccgacccctcccccttcgacgtcgacctgaacgccaccgacgccaccaagtactggggcccctggaccccggccagggcgacttggtacggccagcccaacggcgccggccccgacgacaacggcggtgcctgcggcttcaagcacaccaaccagtacccgttcgcgtccatgacctcctgcggcaaccagccattgttcaaggacggcaaggggtgcggctcatgctacaagatcag

SEQ ID NO: 5391 - DNA, 228 bp, Triticum aestivum
  Clone ID: LIB3281-026-P1-K1-D6
ccggagcggctgcagcagtagccggaggcgccggcggccatggacgcgatgcggaagcagctggacgtgctcatgggggccaacctcaacggctacgtgcggtaggtcaaccgcaagtacttcgaccgcgacgtttgccgcctttttctagcatgactctgcccctacgacctgtttcagatcatgaaaatggatctcgcaccctgtcctaaggtccacttgcttcag

SEQ ID NO: 5392 - DNA, 375 bp, Triticum aestivum
  Clone ID: LIB3281-026-P1-K1-D8
cggacgcgtgggcgatggggaaggcggggttcggggtggcggcgggttgcgcggcggtgacgtgcgcgatcgccgcggtgatggtggcgcagcgggtggcggccagggcgcgctggcggcgggcggtggcgctgctgcgggagttcgaggagggctgcgccacgccgccggcgcgccttgcgccaggtggtggacgccatggtttttgagatgcacgcggggcttcgccttcgacggttgcagtaagcttaagattcttcttaattttcttcgacgcgctcttttacggtgttttaagaagtgtgtatatttttgccaatttgatcttgggagttaacatatcttttatagtttttgagaggtttaaaattattt

SEQ ID NO: 5393 - DNA, 346 bp, Triticum aestivum
  Clone ID: LIB3281-026-P1-K1-D9
cggacgcgtgggcgatgggtaatgcgttgttcggggtggccgcaggtggcgcggtggtcacgtgcgcgatcgactctgctatggtggatcagctcaagtttggtcagtgcactctatttttcgtcgtttgctctttatactgattttgttgtttgttactgatttattgttgggtgctttttgtcctatatatatattgtttactgtttttaaattgtttaatatttttttttctttttttcctcgctttgtgggattatttttctttgtttttttttttttttttattggtacttttttttatttttattgatattattgctatttaattaggtttttattattt

SEQ ID NO: 5394 - DNA, 393 bp, Triticum aestivum
  Clone ID: LIB3281-026-P1-K1-E1
gaagaagggctatgaggtcatctacatggttgacgccattgatgagtatgccattggtcagctcaaggagtttgagggcaagaagcttgtctctgccaccaaggagggtctgaagcttgatgagagcgaggacgagaagaagaagcaggaggagctcaaggagaagtttgaggggctgtgcaaggtcatcaaggaggtgctgggcgacaaggttgagaaggttatcgtctctgaccgtgtggtggactccccttgctgtctggtgactggcgaatatgggtggaccgccaacatggagaggatcatgaaggcccaggccttaagggactcgagcatggctggctacatgtcgagcaagaagaccatggagatcaaccctgagaacgccatcat

SEQ ID NO: 5395 - DNA, 191 bp, Triticum aestivum
  Clone ID: LIB3281-026-P1-K1-E11
cggacgcgtggggcagctactacccaccttcaccgtcaaccggcactgacccgaacactcctggtggcggcggcaacccgccatccccgaccactcctggtgtcgccgactgtccgacagccccgtccacctgcacctcgccgagcacccctggtggtggtggcttctacctattcttgtcttccattgtt

SEQ ID NO: 5396 - DNA, 387 bp, Triticum aestivum
  Clone ID: LIB3281-026-P1-K1-E12
cccacgcgtccgtgtcaagctcggggttgggcgaatccccaccgccctcggaaaatcgggggaaacgcagctctaaaaccccgagattttggccccggttctctcccagccgttgcagctgctgttcgcctaggagctggcggtaacccgggatccggccggcgagccattctccccccgcgagccattcttccgcagctccgagctccgtccttccttccgccgcgacatcgcaatccttcgccattgggttgtgaggataaaccataatggccgtcaaggggggtcctgcggacaacaggactagaagcactgtgtctatatgcatagtgattggcttgtgctgcttcttctacatccttggggcgtggcagaagagtggctttt

SEQ ID NO: 5397 - DNA, 390 bp, Triticum aestivum
  Clone ID: LIB3281-026-P1-K1-E2
gttcaccgaggccgagagcaacatgaacgacctggtcgccgagtaccagcagtaccaggacgccaccgccgacgaggaggaggagctgtactaggacgaggacgacgccgacctccaggagtaggggcgtgcgaggtctgggttcttctgtgatcgcgtgcgtgctcagtcgggggctatttctgatggctccatgttgctgctactagtagtgtgtgtgtgtgtgttttgcgcttgctggcccccatcttcggggtgtcgtggacttgttgcttgtgtagttcgtctgtgtcgggttaattcattagtgagtttgctgcgcgtgcgttacggtgaactagatgtcttagtagcaggtttgcaatatggctggctcattgaatcttcaca

SEQ ID NO: 5398 - DNA, 387 bp, Triticum aestivum
  Clone ID: LIB3281-026-P1-K1-E3
acactccccactctcccacgccacgccgactagcttcctccattaccctccgcctttgcttgcccagacctaggcgaggctccggctagagagcgagagcgaaagctcccttccgctgctgcaatggcggttcctctggtgctcatgctcttggtcgccatgttcaccggctcagatgcgatgtactgcgtgtgcaagtcggacgcgaacccggtggcgatgcataaggccatcgactacgcgtgcggcaagggcgccgactgcacccagatcacctccagcgggccctgcttccagcccttctccgtcgtcgcccactgctcctacgcctgcaacagctactaccagaagaacgccggcatgggcgccacctgcgatttcatgggc

SEQ ID NO: 5399 - DNA, 350 bp, Triticum aestivum
  Clone ID: LIB3281-026-P1-K1-E4
acaatgcgtactcgtggtcaccatgatcgttcgcttcgtccattactatccgctctagctcgccaagaccttcgtgaggctccagctagagagcgagagcgaaagctcccttctgctggtgcagtggcggtccctgtggtgctcatgctctgggccgccatgttcaccggctgagatgctatgtactgtctgtgcatttctgactctaaccctgtggcgatgcataaggccttctacttctcgtgcggcatgggcgccttctgcactcagatcacctgcagtgggccctgtttccattcttttctcgttgtagtccactgctcttacttctgccacagcttctaccataa

SEQ ID NO: 5400 - DNA, 172 bp, Triticum aestivum
  Clone ID: LIB3281-026-P1-K1-E6
gaatggcgaccatactcgcgggccgtcgcctgctcctcctgcggcgatgcgcggccgggcggcggctgctgggcacggcggctgaggcgtcttcgggcggggaggaggcggtgggcgaggcgatctatttgtggaagcccttttttttttttgattcttggacttgtacttt

SEQ ID NO: 5401 - DNA, 312 bp, Triticum aestivum
  Clone ID: LIB3281-026-P1-K1-E7
cccacgcgtccgtggacgcgtgggctttatattttggaactgatggaatattaagtttggtaggtaggggagatgatagagtttttttattttttttataattattgttttttttatattttattatttgtattttataatttttattttttttattttttttatttgggtatttatagtttttaagtgttttttttaaattattttttaattttttttttttttgattttttaaatttttgttttttattatttattttttttttagttttgttattatttttttaattttttttttttatttttttttta

SEQ ID NO: 5402 - DNA, 371 bp, Triticum aestivum
  unsure (1)...(371): unsure at all n locations
  Clone ID: LIB3281-026-P1-K1-E8
ctccacgtcgtcttgatgcaaccttttatntacatgaattgtatgtcatgttcttacaggaggttatgatgttcatatttcctactttacttataaatgtatctaatttttatgattcctttttatccttataactaattgtcttcatcattattttttttttttacttattttttttttttttttttttttaatattttttttttatttttttttttattttttattttaaataatttatattacattttttttttttaaatttttatttttcttttttttttttatattttatttttttcattttaaattattttattattttttttttttacattttttttttttattttttatttttttttaatatt

SEQ ID NO: 5403 - DNA, 227 bp, Triticum aestivum
  Clone ID: LIB3281-026-P1-K1-E9
gaacctttctccttctgtcccgcaaacccccgagagatcacaccatgtgcggcttcggtcaccacggccaccatggccagaaccccccggcccacgctccggccgccgccggcggcaaccagcccaccttcaagatcttctgcaaggctgacgagggctactgcctctccgtccgcgacggcaacgttttttttgtcctcttcaacctttgcgacgagcaccagtac

SEQ ID NO: 5404 - DNA, 390 bp, Triticum aestivum
  Clone ID: LIB3281-026-P1-K1-F1
ggaggagaagaacattgctgtggttgttggtacaatcacagatgacatgcggatccaagaggtcccagcaatgaaggttaccgctctgaggttcacagagacagcgagggcaaggattgtcaatgctggtggggagtgcctcacttttgaccagcttgcactccgtgctccaactggggagaacacgatcctgttgaggggacccaagaatgcccgtgaggcggtgaggcacttcggcaaggcgcctggtgtgccgcacagccacaccaagccctatgtgcgctccaagggtaggaagtttgagaaggctcgtggtaggaggaacagccgtggcttcaaggtttaagtcgccctttctgtgtagtcgctgtttgcggggagcgactggtg

SEQ ID NO: 5405 - DNA, 392 bp, Triticum aestivum
  Clone ID: LIB3281-026-P1-K1-F2
cccacgcgtccgggcggtggaggttgtcgagccggccatcgtcacggtcgaggagactacggtggcagcggtggcgattgtcgagccggccgtcgacacagttgaggtggcaacggctgaggctgtggagccggccgttgtcgccgccgaggaggccgcgaaggaggaagctgttgcaccggccgtgaccgagctggcgaaagaaccggaggcagctccagcggagaccaaggaggccgagacagaggccaaagagaccgagcccgaggctgtccaaccggcggcagccgccgaggaggcgcctgctgtgccggcagtgactgagaccaaagagccggaagctgcccctgccgagggaacagagaccaaagtagtggagcgtgaggcagcac

SEQ ID NO: 5406 - DNA, 284 bp, Triticum aestivum
  Clone ID: LIB3281-026-P1-K1-F3
aaaagctcgagctcttgcttgggtggacgagcgagcagagcgcccatcgcagcagtcgcagcaggaggaagatgtcgtcggtgttcagcggcgatgagaccgcccccttcttccgctttctcggcgccgccgcggcgctcgtcttctcatgtatggcagcggcctacgggacggccaacagcggcgtacgcatctcgtccatgggcgtcatgcacccgcagctcgtactgaagtccatcgggcccatggccatgggtccagtgctcggtatctacaaccttatt

SEQ ID NO: 5407 - DNA, 131 bp, Triticum aestivum
  Clone ID: LIB3281-026-P1-K1-F4
acaagccgtacatattgctggggatgtctagccagccaagcacacgtcgcaggagaatacgcaggcggaagatgtaatcgacgatcacgcgctgatgagcacaccaggtggtaacgcctgatgcgcacaaa

SEQ ID NO: 5408 - DNA, 169 bp, Triticum aestivum
  Clone ID: LIB3281-026-P1-K1-F5
cggacgcgtggatccaaatgtcaattttatgtttgtccaagcctgcaatgggcagcttctatgccgatgatggaaggcgaccactcatcccaagataatggatcatgtggtgtgcaatcccactactcagaaatgggtggccatgtctgccactgactggttcagaatg

SEQ ID NO: 5409 - DNA, 189 bp, Triticum aestivum
  Clone ID: LIB3281-026-P1-K1-F6
catggagctactgtagtgttgatgtgtgtgtgggttgcagtgacaagttgctgatagcctactggggatggctctgctgttttgctccgacatggataccttccgtaaatgaacttgttctagcgaaaatgtttctgggctaggatgattgcaataagtaacttcagtgtgtttctgatgtcattttaa

SEQ ID NO: 5410 - DNA, 87 bp, Triticum aestivum
  Clone ID: LIB3281-026-P1-K1-F9
cggacgcgtgggcggacgcgtgggcggacgcgtgggcttcccatggagggcgacgccgcccaaaattgtaaccccttcccccccatt

SEQ ID NO: 5411 - DNA, 340 bp, Triticum aestivum
  Clone ID: LIB3281-026-P1-K1-G1
cggacgcgtggggagaaagaatggatggatctatggaaaattggttgccatttttaaaggacattttgtcattcctacttgagacttggttggattaagtttaccggattaaatggaaggatgggtttttgaaaggggtattggagggcattaaataactggccgtgatgatctaagacaaggacctattcatttgtgttctttcctaggctatacttgggctatccgcttgttttctgtgtgcggattctccttggatttccgcgattcttctgggtggactgctttacactgggctgcataccacggaagggaaaaaatggttgctgctctgttatct

SEQ ID NO: 5412 - DNA, 355 bp, Triticum aestivum
  Clone ID: LIB3281-026-P1-K1-G11
gagatggccggggcagcgtcgtcggtagcgcccgttctcgtcatctgcttgctttctcttgctctcttcctccacaggttggccgcacttgttctacatttactcctctagtgaacctttggggatctcgtgtgctgaattaattgctgcagaggggatggcttcttagcctttctttgtcatgaacatgttagatttgctggattagcatgcctgccgtggcagatctgagcaagatttcgctcataaatcagccccggcggcatcctcgggccaccgcgtcgctcgcttaattgagataatttgggtgggcatgactatattaaacgttcttggggctaccatagttgttact

SEQ ID NO: 5413 - DNA, 375 bp, Triticum aestivum
  Clone ID: LIB3281-026-P1-K1-G12
cggacgcgtgggcttccactcctctccccctacccctcgccccatcgccccgtcgccgtcgccgtcaccggcgacggcgaccccgatgggcgccaccgtctccgtcctctgtctccccgtggccgccttcttccctggcgcggccaccgctatcgcgggcgccgccgggtgctttgccctcggctacttacttgccctaggccgcctaaccattcacgccgtcgccgaccttgactccggcgaagacgattacgaggcagactcggacgaagatgatgacgaaaattccggccgcgcttggccggctaagcgagccgtcagtctgaagctgaccgggcttaggctgctttttttggttccggaacggggtgacca

SEQ ID NO: 5414 - DNA, 313 bp, Triticum aestivum
  Clone ID: LIB3281-026-P1-K1-G2
cggacgcgtggggagaaggaatggatggatctatggaaaattgctggcgattctgaaggcacatctgttcatgctactgaagacttgcttgaattagttttacggaatagattgcaagaatggcttctggaaagagtaattggaggccataaatcaactggccgtgatgatctaggacaaggacctatccatctgtgttctttcctaggctatacttgcgctatccgcttgttttctgcgtccggattctccttggatttccgagattcttctggttggactgctttacactgggctgcataccacggatggg

SEQ ID NO: 5415 - DNA, 363 bp, Triticum aestivum
  Clone ID: LIB3281-026-P1-K1-G3
gatcccctccttcccaccttcttcctcctgcacagcctcctcccacctcccctccaccttccactgccggcgacgccaggggctcgtgcctccgatgccagagccgtactgccgcctgtctatctcttttgccctgccaacccaccaccccggagcgagatgcgcgcggctcccccgtgcccggcgaccttcccccgccggcgccgccctcccccgatccactttctttccccgctggcgccgccctgccccaatccaccttcttccctcgccggtgtcgccctcccccgatccatctatttccccttccctaggcatcgccgaacttcccctcgcctcgatctgcagcgacgcagacgattg

SEQ ID NO: 5416 - DNA, 123 bp, Triticum aestivum
  Clone ID: LIB3281-026-P1-K1-G4
ctccatcttgaacctgaggctgcgtccgatccgaggcaagcaaatatctgcgtggagcgcaaattgtaagacccttcctcaaaactttgagagttattaacactaggtccatgacaagactat

SEQ ID NO: 5417 - DNA, 318 bp, Triticum aestivum
  unsure (1)...(318): unsure at all n locations
  Clone ID: LIB3281-026-P1-K1-G7
tccgtggtaggtggaggtgtacaatncgttgtgtggtgtgtgtatcaatagtttcttttagggggggggttctatcctattatttggtattatatttttttattataatttttttattatatttttattattatatttttttattattaattttttcttatttttatatatttttgattttatttttatttttcttattttttttatttctttttttttttatttttttttttttcattttttctttttttttttttttttattttttttttttttttttatttttttttttttttttattatttttatttttttttt

SEQ ID NO: 5418 - DNA, 275 bp, Triticum aestivum
  Clone ID: LIB3281-026-P1-K1-G8
cagtcgtcctgccccttctactgctcctacttcggctttcaagatgagctggtttgggccttggcggggctttaccgggcgaccaaggacggcaagtacctcgacttcctgcgccagaaccagggcttcagcaacccggtcaacgagttcagctgggacaacaagcaggttggagcccagatgctcgcaacacaggagtatttgaaaggaaggagagagctagacaggtacaaggtcaacctggactccttcgtatgcgccctcatgcctgacag

SEQ ID NO: 5419 - DNA, 265 bp, Triticum aestivum
  Clone ID: LIB3281-026-P1-K1-G9
gcgacacgctccgcacgcgatctccactcgctccgttcgtacggatcccctttctccctccccagccatgtcgtcgtcgtcggacaaccccaacacggtcaccgaccgcggcctcttgcagcaagagcagcaaggacgacgccgtctacatgaagaagaagcacgaggagaagacagaggaggaggagggcggaggcgggttcatcgacagggtcaaggacttcatccacgacatcggcgagaagatctaggtggctgtggggtt

SEQ ID NO: 5420 - DNA, 394 bp, Triticum aestivum
  Clone ID: LIB3281-026-P1-K1-H1
gtgatacttcaactgaaagaacactgtatattgatggtactgcagagcaaattgaaatagcaaagcagcttgtgagtgaggtcaccagtgagaatcgtgccagaaatccaatgtcaggtggctattctcagcagggctaccgacctcctcgtcctcaggcaaactggggtgcgcctggtgcaccaacaacacaacagcctggttatggttatatgcagcctggaccttatcctggtgcgccaccacagtatggccagcaaccttatggcagctaccctccagcatctggaggttatcagacagggtgggatcagtcttcaaaccagcaatcacagcaggccccccctggcgctggctatgactactataaccaacagcagcaaccccaacagct

SEQ ID NO: 5421 - DNA, 233 bp, Triticum aestivum
  Clone ID: LIB3281-026-P1-K1-H10
cccacctcacctcctccttgcctcttgccgacgtttcgtcaaggttccggcggcgatggcggcgaggctcgcgcagctgcggaccaaggcggcgcaggcggcggaattcgcctcgaagcacggcggcgcctactacaaggaggcgatggagaagaacaagcagtacgtcgtgcagccttcctccgtggagaagtgccaggagctcttcaagcagctctttctacacgcgcctt

SEQ ID NO: 5422 - DNA, 119 bp, Triticum aestivum
  Clone ID: LIB3281-026-P1-K1-H11
ggtcgatccgtgccggagaagagcagctccagttatggtggagtgcatgtgagccaaatatgaagggggtcctcatccctttatcaccgcctttctgtgtcctttattcttctttaaat

SEQ ID NO: 5423 - DNA, 400 bp, Triticum aestivum
  Clone ID: LIB3281-026-P1-K1-H12
cgcctgcgcgccgccacacgaacccccacccaacccgagcgagcgccggccgaggaggaagagaaggtgagatggctcgcggcgcggcggcggcggcagcggccgcgaagggcaagaagaaggggtccgtctccttcgtgatcgactgcaccaagcccgtggaggacaagatcatggagatcgcgtcgctggagaagttcctccaggagcgcatcaaggtcgccggcggcaaggccgggaacctcggcgactccgtcaccgtcacgcgcgacaagagcaaggtcaccgtcaccttcgacggcgccttctccaagaggtacctcaagtacttgaccaagaagtacttgaagaagcacaacgtgcgggactggcttcgtgtgatcgcagccaacaaggagcg

SEQ ID NO: 5424 - DNA, 396 bp, Triticum aestivum
  Clone ID: LIB3281-026-P1-K1-H2
cccctccctccagcaaactcacgcattccaccaccgaagctcccaaccccacccgaagcggcagccatggcccccaaggcagacaagaagccggccgccgagaacaaggtcgagaaggcggcggagaagacccccgcgggcaagaagcccaaggccgagaagcggctgccggcgggcaagacggcgtccaaggaggccggcggcgagggcaagacccggggccgcaagaagggcagcaaggccaagaagggcgtggagacgtacaagatctacatcttcaaggtgctgaagcaggtgcaccccgacatcggcatctcctccaaggccatgtccatcatgaactccttcatcaacgacatcttcgagaagctcgccggggagtcggccaagctcgcc

SEQ ID NO: 5425 - DNA, 274 bp, Triticum aestivum
  Clone ID: LIB3281-026-P1-K1-H3
atctgatctgatcctttggacatggcgtaagccatgctctccacagccatggcgccactccaggggggcatgctagagttctccaggctgaggagctcgtcgtcaatgccgatccggcggaatgccacctccgacgactccatgtccgcggtctccttcaagacatacgcggtgagcaccagcgtcaaatcatgaaaggcgccagactgaagccaagctcaaggtagatgagcaacaaacgccagcctcatcgggcacacattcttgtggtact

SEQ ID NO: 5426 - DNA, 404 bp, Triticum aestivum
  Clone ID: LIB3281-026-P1-K1-H6
gtccgccaaggacagcaagcaagactgcaggcaaaacatcaccatccaaaggttccaaggaaaaggagagccctgatgagagtgcaaaggtcttctctaggaagaagaaacccatcatatcaaagcatactccaagctctgaaaaggtgatagaagaaaataagtcatcaggtaaagaggcaatgaagagcaaaggcgaatcagcagaagggggtctgcccagtaaggctgagttgaagaagaccattatcggaatccttaaaaaagttgacttcaacacgtctacttttagcgacattcttaagaagctcgatgaccattacaagattgatctgaccgcaagaaaaggagctatcaaaattatgattcaagaagagctgtcaaagttatcggagcaggaagac

SEQ ID NO: 5427 - DNA, 186 bp, Triticum aestivum
  Clone ID: LIB3281-026-P1-K1-H8
cccacgcgtccgcccacgcgttcggctcaagtccaacggcgagcgtgagtggatgttctaccgcaacccgtcggccgacatgctcctgaccgaggccgtgctcaacctggacctgatccgtcgcgcccgtatctttcactacggctccatctcgctcattcaccgagccctgccgctcggcgcacg

SEQ ID NO: 5428 - DNA, 288 bp, Triticum aestivum
  Clone ID: LIB3281-026-P1-K1-H9
atctccaatcgccacatctccccacttcccgaatccttttcccttcaagcgcagtagatcgccatggatgcctcagccaccgtagccgccggaaaggcgaagaagggcgcggccgggctcaaggcgggtggccccaggaagaagtctgttgttgtggtccagcaaggccggactccatttcccccttagacaaatggggcgcttccttcagaagggcctatacgcccatcgcgtttgtaccggtgctcccgtccaccctgtggtagttcttgagtactctttttggcg

SEQ ID NO: 5429 - DNA, 391 bp, Triticum aestivum
  Clone ID: LIB3281-027-P1-K1-A1
cccacgcgtccgcggacgcgtgggccgcgagctacccctaaaaaaaaacccaccgcacatcactcccctctctccccgcgcagcgaaccctagcgctctcaccctctcagccccgcacaccactcctccttctggatccaccgccgccgccctctggatctcgaagcgccgctactccctccctccagatcgagagagagctcgccgccgtcctcctgctctcgcccctgcccttccctccccttaaccccgaggcggcaacgcagacggccatcgacctcgcccacctaaccctagcaagaggagagcggccatggatccgtcgaagctgagcgagctgcactccttcgtggaggagtgcaagaaggacccggcgctcctcgccgacccc

SEQ ID NO: 5430 - DNA, 382 bp, Triticum aestivum
  Clone ID: LIB3281-027-P1-K1-A12
ggaggacctcaccattaacctccttcccgggaacaacacgaggagcgaccggtccatggtggtcgacgacgacggagcgtcccgggccgaccaagacaggaacggcaggaacaccggcgagctggcggtgatacaggccgagctgagccgcatgaacgaggagaaccagcggctgcgagggatgttgacccaggtcaacaacagctaccatgcgctgcagatgcatctcgtcgcgctcatgcagcaaaggacccagatgcctccggtccagccgcaacaaccttcgacccacgaggatggcaagaacgagagtgccatcgtgccgaggcagttcctgggtctgggcccgtcgggagccagcgcttgcgtggcggaagagccc

SEQ ID NO: 5431 - DNA, 394 bp, Triticum aestivum
  Clone ID: LIB3281-027-P1-K1-A2
cccacgcgtccgtggacacgtgggccgcgagctacccctaaaaaaaaacccaccgcgcatcactcccctctctccccgcgcagcgaaccctagcgctctcaccctctcagccccgcacaccactcctccttctggatccaccgccgccgccctctggatctcgaagcgccgctactccctccctccagatcgagagagagctcgccgccgttctcctgctctcgcccctgcccttccctccccttaaccccgaggcggcaacgcatacggccatcgacctcgcccacctaaccctagcaagaggagagcggccatggatccgtcgaagctgagcgagctgcactccttcgtggaggagtgcaagaaggacccggcgcttctcgtcgaccccgcc

SEQ ID NO: 5432 - DNA, 252 bp, Triticum aestivum
  Clone ID: LIB3281-027-P1-K1-A3
cccacgcgtccgaggacgcgtgtgacgcgatctacccgtaaaaaaaaacccggcgcacatcaagcccttgtctccccggacacagaaccctaacgctctcaccctgtaagtcgggcacaccacggatgattgtggagccaccgtcctcgaccgccggacctcaaagcgccgttactcccttcggtcacatcgagagagaggtccgcgacgttctccagctctgttccctggccttccctttcctaaaccccg

SEQ ID NO: 5433 - DNA, 228 bp, Triticum aestivum
  Clone ID: LIB3281-027-P1-K1-A6
ttccgccgcgattatttcccgggcccagccaatttctcgagcaccgccgccgcgcgatcgcccggccatgtccggctacccctacggcggcgccggaggaggaggcggctacggggcccctccgccctacggctcctcgcccgccctctcggcccctccctacggtgacaagccttccaaggaaggcaaggccttcttcccctactacgctttcccgccccagcccta

SEQ ID NO: 5434 - DNA, 315 bp, Triticum aestivum
  Clone ID: LIB3281-027-P1-K1-A8
cagctgttcaacttcaacatggagtcctcttcttccatctttgtccagagatggagtaatggcggtccggtgatcccaagtggccacgttcccggtgatggccggactggatctacgctggagttgagtattggacccgattgtaatcttaatcatcaggatggggtcctccttgttagtttcagggactatgatgtaatttccttttcttttgagtcctggtatgagctctgtactgcagacgctgatagttaatgggtgctctgggtccttccctgtcccttttcttttagcgctggatgttttggtagtttt

SEQ ID NO: 5435 - DNA, 78 bp, Triticum aestivum
  Clone ID: LIB3281-027-P1-K1-A9
cagacgcgtaagctcaacatggatttcaatccttccatcttggggcatagatggtgttacggcggtcattcgattcta

SEQ ID NO: 5436 - DNA, 101 bp, Triticum aestivum
  Clone ID: LIB3281-027-P1-K1-B1
gccgcagtctgccactccccagctcgcctctccatctcctgctcctactcttcctcccactccgcgcctgcgcgcccgatgcacgtggtcgtggtgggcgg

SEQ ID NO: 5437 - DNA, 148 bp, Triticum aestivum
  Clone ID: LIB3281-027-P1-K1-B10
tcgcccacgcgtgcgcctagttgcctatctcttcagttacccctcgccttctcgggcgcctgatcggaggcttggttcgtgcagtcatggcgaagacctaccccgtcgttagtgtcgagtactatgaggccgtctagaaggcccggca

SEQ ID NO: 5438 - DNA, 220 bp, Triticum aestivum
  Clone ID: LIB3281-027-P1-K1-B11
cggacgcgtgggatgctctccccgtctcactgacggtggtccccaccgcctcccccccgccccgctccgcccatatctcgtcggcgacccgcgcccccttccctccccgtccctcacacgtctccggcggcgagggcacccggccgtctccggtgttctgggagccgcccgtggctggcgccgggatggagccggtcggggcgcgccggtcgcccggatc

SEQ ID NO: 5439 - DNA, 375 bp, Triticum aestivum
  Clone ID: LIB3281-027-P1-K1-B12
gtcaccgcccgctgccttcccatttacccctcgccgtccaccgccgcctcctcctcctccgccgccgttccaagccgctgcctcctcctcctcgaccacctcctcccctccatctgcctctagcgccgccagcccgcccacccgctcgcctgccactcctgtcagccgctgcgaggaggagaccatgaagctcgacgtgaacgccctccgctacctctccaaggatgacttccgcgtcctcaccgcctgcgagatgggcatgcgcaaccacgagatcgtgcccgcggagctcgtcgaccgcatcgccggattgaagcatggaggcacatataaagtgctgcggaatctgttgaagaacaaactggtgcaccatga

SEQ ID NO: 5440 - DNA, 388 bp, Triticum aestivum
  Clone ID: LIB3281-027-P1-K1-B2
acctcgacgagtccgtgatgtggacggagagcggcgacgtcggcaagggcttccgctgcattcgcatggtgaacaacatccgcctcaactttgacgccctcaacggcgacaaggaccacggcggcgtgcacgacggcaccaccgtcgtcctctgggagtgggccaagggcgacaaccagagctggaagatcctcccctggggcgaagaggcctacgccggaggcagcgccaacgccccccgcggcggctccacagagcccaccgtgcgcatcttctgcaaggccgacgacggcttcagcgccaccgttcgcaacggcgctgtggtcctcgcgcccaccaacccccgcgacgagtaccagcactggttcaaggacatgaggcacagcaa

SEQ ID NO: 5441 - DNA, 373 bp, Triticum aestivum
  Clone ID: LIB3281-027-P1-K1-B3
ctcagctccaagccacgccgctcagaaccctagccctctcccgccgccggcggggctccggcgcggcggcgcggccgagggcgggctccgtgcggtgctccgccgcggccaggagctacagcattacgctcctccccggcgacggcatcggccccgaggtcgtcgccgtcgccaaggacgtcctcttcgccgccggctccaaggaaggcgtggagctccggttccgggagatgctgatgggcggcgcggcgctagacgcggccggcgtgcctctccccgacgagacgctcgcggcggcgcgggcctttgacgctattcttcttggcgccataggatgggttaagtgggatagcattgagaagcatttaaagcc

SEQ ID NO: 5442 - DNA, 173 bp, Triticum aestivum
  Clone ID: LIB3281-027-P1-K1-B6
cggacgcgtgggcgcgagagtacttcctagtatacatgatggacccatcgaccgcatacctgctcgatgagcttaccgacgactgctgcagcgactaccgcaacctgatggcctcggccgagcacgtcgacttccacacctgctgcctgtacgccagccagcttaagcggcgc

SEQ ID NO: 5443 - DNA, 227 bp, Triticum aestivum
  Clone ID: LIB3281-027-P1-K1-B7
gtgtggcggtggtagcgcttcttcttcttgcgcgggttgctgttgtcggggtcgagctcgtcggctgaggcaccctactcattctactctccgactagctccttttattaatttctttgtacactactttaaccacccaacattatttgaatgttattgatattaacaataccactgtgtacatcatgctgctttacaaaaacccttttccttaccttaataattat

SEQ ID NO: 5444 - DNA, 343 bp, Triticum aestivum
  unsure (1)...(343): unsure at all n locations
  Clone ID: LIB3281-027-P1-K1-B9
cggacgcgtgggtggaagcccaatccaaatcccaaagcgacaacagaaaagctcgagctcttgcttgggtggacgagcgagcagagcgccgatcgcagcattagcagcaggaggaagatgtcgtcggtgtttatcggcgatgagaccgcccccttcttcggctttatcggcgccgacgcggcgctcgttttctcatgtatgggagcggcctacgggacggccaagagcggcgtcggcgtggcgtccatgggagtcatgcgcccggagctcgtcatgaagtccattgtgcccgttgtcatggctggagtgctcggtatctacgggcttattatcgccgtnatga

SEQ ID NO: 5445 - DNA, 392 bp, Triticum aestivum
  Clone ID: LIB3281-027-P1-K1-C1
gggggccaccaacgcctccgccattgaggtgcagtgcatcgccacccccgccgaccccaacgaccccttcctccgccgctggaccaagcaccccgccaaccccgtcatctggtcgccgccggggatcggcaccaaggattttcgagacccgatgaccgcttggtacgatgaatctgatgacacatggcgcaccctcctcgggtccaaggacgaccaggacggccaccacgatgggatcgccatgatgtacaagaccaaggacttccttaactatgagctcatcccgggcatcttgcatcgagtcgagcgcaccggcgagtgggagtgcatcgacttctaccctgtcggtcgccgtagcagcgacaactcatcggagatgttgcacgtgttga

SEQ ID NO: 5446 - DNA, 226 bp, Triticum aestivum
  Clone ID: LIB3281-027-P1-K1-C10
cggacgcgtgggctggtgtacttttcgcctaccatcagctccatatcctgtgttctggtatgaaggacgggtcaggccatgcctacaggggaagaaatcatgacgaacaagtcaagtcggttcccagtcctgccctctaaggatctggcgaacttctatctttataacgttggaaggcaataatttcttgggattggtggtttatcccaacattcgttttttgtgg

SEQ ID NO: 5447 - DNA, 362 bp, Triticum aestivum
  Clone ID: LIB3281-027-P1-K1-C11
gtgcagggagaggaagggggtggctccggcggcggatggagtttcgctgggctgatcaagacgctcgcggaggacttgcctcctcgggacgagcaggaagcctcggaggatgaggacgactagcaagaagtcctgtctaacggatgtggaggccttttatgatttttacatttgaatgcaataatttctgtagagtgtggattttcctaacattcgtttttagtggttgcattgtacttcattagatgttcgttcgttggctttattgttttttaaaacttttactatcatttatgttgtttttttgtttttaatttttttctcttaattttttattggtttattttttttttaaattcatt

SEQ ID NO: 5448 - DNA, 384 bp, Triticum aestivum
  Clone ID: LIB3281-027-P1-K1-C12
attggctcatcggcccatcagaggctgtcaatgctgagaagcgaacttggaaatcagctcgctaacaagagtcggaatttgaatctgagaagcacaaccctcttgatccaactaggaacatcaaaaccaaatgggaaatcattgagtggacttcagatggccatgcttacgacaaggaggcggggtggggggagggggtcggtcgtggagggaggctcgcctgccggagcagcaggaacaaggaggcggggtcggccgtggaatatttagctggatgtgcgatctcttctgccgctacgtcttcgttcgactcgccaaggtttgttgttctcctttttacatgtgtgtgtgtattactttcactatcttctatatcatgctatt

SEQ ID NO: 5449 - DNA, 387 bp, Triticum aestivum
  Clone ID: LIB3281-027-P1-K1-C2
cggacgcgtgggcgctctcgaaccttccgaagtccaaaccctagcgagctcccttcctcctcccccaagacacaaacctcagatctcacccatcccacgccatggacgacgacttcgacatccccgcgggcgacgacatgatgatgggagacgggatgggtgacttcggcggcgccgaagggccggggatgaaggtgggcgaggagaaggagattgggaagcaggggcttaagaagaagctgctcaaggagggcgaagggtgggacacacccgaggtcggcgacgaggtcgaagtccattacactggcaccctccttgatggtaaaaagtttgactccagccgtgatcgtgatgacactttcaagttcaagttgggacaaggtcaag

SEQ ID NO: 5450 - DNA, 388 bp, Triticum aestivum
  Clone ID: LIB3281-027-P1-K1-C3
cggacgcgtgggttttttttgagggcactagtaccagtgatcccagatcgtctatgagttaacataacctgtgcactcgttaccgtgcacaatgtccacaacaacagaagcaaagccacgcgaccaaactacagattccatgacggcaaaaaagacccggtaccgatcttaagggcataagatactgcgtcgcgatgtgtcgaaagacacggagctcactccgtctgagccaccttgggcaaggggatcgagcagcagcaatggtagtatccacccttgttaaacttgaacctctgcaataggtgcaccgccggtactgggtactcgacccaatcctgttccccgttttgcctgaatatattccgagcatcgaacgaatagttttttt

SEQ ID NO: 5451 - DNA, 385 bp, Triticum aestivum
  Clone ID: LIB3281-027-P1-K1-C6
cggacgcgtgggcggacgcgtgggtttttttttgcattgtagaaaacaacatcatttactaacctttctccttaaaaaacattcgaaatcaacaataaaaactcttgcagcaacccaatctaagttaatttgtctggtagagaagtacatgttgccggggacaggagtgacgccacacccagcagagcggctagatgggcgcccagcaactacagctcggcgtaaccactttggcgaacggggttgttcagggcgagcgtttgactttgatcgggcaccactaatgtgctgatgatttaaggcagcacccattcatcattcatatacttgcatctactccaacatatgacatgtgttcaggcttgcactgctagggcatatgata

SEQ ID NO: 5452 - DNA, 313 bp, Triticum aestivum
  Clone ID: LIB3281-027-P1-K1-C7
attggctcatcggcccatcagaggctgtcaatgctgagaagcgggcttggaaatcagctcgctaacaagagtaggaatttgaatctgagaagcacaacctttttgatccaactaggaacatcaaaaccaaatgggaaatcattgtgtggacttcagatggccatgcttacgacaaggaggcctcgctgctggagggggacgtctaccaggacaggcatctactgtcggatctgcatgatctatatgaccaaggacttcccttatattatatacttatgtaggggcgttttttttttttgtatttttagcttat

SEQ ID NO: 5453 - DNA, 269 bp, Triticum aestivum
  Clone ID: LIB3281-027-P1-K1-C8
ttcctgaagctggaggaggaggtggtgatcccgactacgttcaaatgtgccattacttatgacttgctcttcaaacctgtggtcttggtttgtggacacaccttcttgttcttgagtattgctgagcatatgagcatcttagttgacactctatgctccttgtgcatgacgcatgttgcacatttttcaaaaatatgttagacttatcatacttttgtttataaattgaaaccagcgttttatgtaagtattttaatttgtattttttt

SEQ ID NO: 5454 - DNA, 71 bp, Triticum aestivum
  Clone ID: LIB3281-027-P1-K1-C9
ttcctgaagctggaggaggaggattatatccttactacaagcaaatgtgccaattcttatgactggctctt

SEQ ID NO: 5455 - DNA, 382 bp, Triticum aestivum
  Clone ID: LIB3281-027-P1-K1-D12
gcgcgacgaggagaccagcggcgacacacgcagacgcagatttggcattcagaaaaaattgaaattgtgaactgtgaagatgacggcaccagcggagctttcccgtgaggagaatgtgtacatggctaagctcgccgagcaggctgagaggtacgaggagatggttgagttcatggagaaggtggccaagaccgtcgactccgaggaactcactgtggaggagcgcaacctgctctctgttgcatacaagaatgtgattggagcccgccgtgcctcatggcgcatcatctcctccattgagcagaaggaggagagccgtggcaacgaggaccgggtcacgctcatcaaggagtaccgtggcaagatcgagactgagcttagc

SEQ ID NO: 5456 - DNA, 388 bp, Triticum aestivum
  Clone ID: LIB3281-027-P1-K1-D2
tgcggagccgccactccccaccccgcggaccatttcgcaaacctagatccaagccctcgtcgccggccatggccacccgccgggccatctcgtcggtcctacgcaccgcctcccgcatccgcgccgcctccccttccccgtgcccccgcgcgccgctccaccgcccgtccccggccggcttcctgctcaaccgcgccgccgcctactcgtcatccgccgcggcgcaggccgctccggtcacgccgccacccacctccgataagcacaccggcactaagattaccgatgaattcaccggcgccggtgcggtgggtgaggtgtgccaggtcattggggccgtggtggacgtgcggttcgacgagggtctccccccgatcctgacggcgct

SEQ ID NO: 5457 - DNA, 277 bp, Triticum aestivum
  Clone ID: LIB3281-027-P1-K1-D3
tttctgccatggccactcgcctggccatctcttatgacctacgctccgccttccgtattcgtgccgtcttctcttccccgtgcccccgcgcgccgttccaccgaccgtacccggccgggttactgctcaaccgcgccgccgcctactcgttatacgtcgcggcgcatgccgctccggacacgccgacacccaccttcgataagcacaccggcactaagattaccgatgaattcaccggcgccggtgcggtgggtgaggagtgccaggtcattggggc

SEQ ID NO: 5458 - DNA, 201 bp, Triticum aestivum
  Clone ID: LIB3281-027-P1-K1-D7
gccacgcgtgcggactagttgtagctcacgccgacccaaatatggcgtttagaaaaaattgagatcgtgatactgtgtagatttctgtacctgttgatctttcccgtgtggagtattgtttcttggctttattttccttgcatgcttagaggtactaggagatggttgtgttcatggtttaggtgtcttagtccgtcaact

SEQ ID NO: 5459 - DNA, 259 bp, Triticum aestivum
  Clone ID: LIB3281-027-P1-K1-D8
cgcagcacctagggcatcataagcatgctgggattaattagtactgctaccacatgcgtcgatcacttatcagctagctcatcatcatcatccgtcgctatgcatatatataatgcataagcgcgcgcgtttaatttgtgtttggttacttcgttgctgctgctgctgtgtcgttaagttgttgatgtgtctgttatatttgttgttggagcgtacttacgcaccctctaattatgaacagctgctaccttataatatt

SEQ ID NO: 5460 - DNA, 158 bp, Triticum aestivum
  Clone ID: LIB3281-027-P1-K1-D9
cgcagcacctagggcattataagcatgccgggattaattagtacggctaccacatgcgtcgaacacttatcatctagctcattattatcatccgtcgctatgcatatatataatgcataagcgcgcgcgtttaatttgagtttggtacttttttgttg

SEQ ID NO: 5461 - DNA, 388 bp, Triticum aestivum
  Clone ID: LIB3281-027-P1-K1-E1
cggacgcgtgggccgaattcctcgcgattcctctcccctcgcctcctcgtcctccccctcctaggggatcgccggagaggaatcgcgacgagggcttcctcctatcagttaaatcaaagccatggagcacaaggagaccggctgccagtctcgggagggtcccatcctttgcgtcaataactgcggattctttggcagtgcggcgaccatgaacatgtgctccaagtgccacaaggagatggcgatgaagcaggagcaggccaagctggctgcctcctctttcgacagcatcgtcaacggtggcgatgccgcgaaagaacaccttgctgctggcagcacggcggtggcagttgctcacgttgaggcgaagacgcttattaccgcacag

SEQ ID NO: 5462 - DNA, 112 bp, Triticum aestivum
  Clone ID: LIB3281-027-P1-K1-E10
gcggtaccgtccgaatcccggtcgacccaccgtcgtcactccagccacgccgtcataaccctgccctctccgcgcggggcgccgcgcggggcggcaggcggctcgcgggctt

SEQ ID NO: 5463 - DNA, 368 bp, Triticum aestivum
  Clone ID: LIB3281-027-P1-K1-E11
ctcatcactgctccccagtcccttccgccatggcgatctgcaaggcctggatctcgctgctgctcgcgctcgccgtcgtcctgtccgccccggcggccagggcggaggaggccgccgccgccgcggaggaggctgcggcccccgaggccgtgctcaccctgcacgccgacaacttcgacgacgccatcgccaagcaccccttcatcctcgtcgagttctacgccccatggtgtggacactgcaagagcctggcacctgagtatgagaaggcggcccaactgttgagcaagcacgacccagcgattgtccttgctaaggttgatgccaacgatgagaagaacaagccgcttgcgggcaagtacgaggtt

SEQ ID NO: 5464 - DNA, 383 bp, Triticum aestivum
  Clone ID: LIB3281-027-P1-K1-E12
cggacgcgtgggacgaaattgggagggagaggctcgtgagggctcccaaattacgtaggagataagcgaaatccccaaatttctcgccccctcccctccccgtccgcagtcgttcgagtggcctgcgagcgagcgagcgagcgagcgcccccgagctcggtcttccccgcgcgcagtgcgagcgtgcagccgacgccgagagcttggctttgttgctgcttttgtgtttcctggctgattattttctttgtcttttgtccgtattttctcggtattatcctgatttgcggtgatttctcggtgattttgccgcgccctcgctcgggcgggggatctgtaatttctgcgcctggtctgccgaatcctctcgccggggcttggat

SEQ ID NO: 5465 - DNA, 239 bp, Triticum aestivum
  Clone ID: LIB3281-027-P1-K1-E2
cggacgcgtgggccgaattcctctcgattcctctccccttgccttctcgtgctcccgcttcaaggggatcgccggagaggaatctcaacgtgggctttctcctatcagttaaatcaaagccatggagcacaaggagaccggttgtcattcttgtgggggacctatcctatgcgtcaattacttgaggatttcttggcagtgctggctattcatgaacatgtgtctccatgtgccacaag

SEQ ID NO: 5466 - DNA, 230 bp, Triticum aestivum
  Clone ID: LIB3281-027-P1-K1-E7
cccacgcgtccgaagaagaagtaatttgacaattgatggcagccttggtcaccttagccccggttgggtccttcttcttgacgcccttgatgactccaaccggggctaaggtgtctcttggctgtcagtaagcgtgtgtgcttgctctcattggttttcgaatttttgttccattttatttagcattcttttcgtttttctgtgcagctttttttatttgtgtctacttt

SEQ ID NO: 5467 - DNA, 285 bp, Triticum aestivum
  Clone ID: LIB3281-027-P1-K1-E8
cccacgcgtccgcgcacgaaccccctccgccgccgtcctcgcgtcttctcctgcgcatctcggaggtgcttcctagtttccacgatgaagctgatcgcagcctaccttctcgcctatctgggcgggaactcttccccaagtgccgctgacgtcaagaacatccttgactcagttggtgctgaggctgatgaagaaaagcttgagttccttcttgctgaactcaaaggcaaggacatcacagaagtgattgcattctggaagggagaagtttgccctttgtgcctt

SEQ ID NO: 5468 - DNA, 318 bp, Triticum aestivum
  Clone ID: LIB3281-027-P1-K1-E9
catcaagatgcgtgagatcgccgaggcttacctaggagtaactattaagaatgctgttgtcaccgtgcctgcttacttcaatgattcccagaggcaggcaaccaaggatgccggtgttattgctggtcttaatgtgatgcgtatcatcaacgagccaacagcagctgcaattgcctatggtcttgacaagaaggctaccagtgtcggtgagaagaatgtgcttatctttgaccttggtggtggcacttttgatgtctccctccttaccattgaggagggtttttttgtggtgaaggccacggctggtgacactcattt

SEQ ID NO: 5469 - DNA, 388 bp, Triticum aestivum
  Clone ID: LIB3281-027-P1-K1-F1
cggacgcgtgggcagcgcctgcagagcattgtgcgacagcgggaggagctgcagcaggtcgagatcgacctgcgcgcacaggccatcgcccacccacagatcatcgaggtgcagcgccgattcggggaggctaccaaggagcatgcagtagcagctgaaaagctcaaggaacaactacatgaacgggagaagtacattcttgagctggaaatgaaattggatgatacacatagggaattggatgctttgaagattgaccatcaaacggtatgggcaaatcaagatcttcttagagaacagaccaaggaaatcgcaagtttcagaagggagcgtgataattctgaagctgaaagagcccaacatcttaaacaaattcatgatctgcaag

SEQ ID NO: 5470 - DNA, 277 bp, Triticum aestivum
  Clone ID: LIB3281-027-P1-K1-F10
caaggaagcattatcaacacattttatgaagtgtgggacagtgcttaagctcaatatgttgacagatgcaattactggccacccaaaaggggctgcatttgttacttttgctgacaaggaatctattgggagggccctatctttgagtgggacgtcgattaactttagagtttttacagtaatgctgaaagcacaagcacctcctggttctttggcgtctattcagcacattgcgaggactatgccatggaactcgtcaccattttataaaggggtt

SEQ ID NO: 5471 - DNA, 370 bp, Triticum aestivum
  Clone ID: LIB3281-027-P1-K1-F11
gccacagctggtgacactcatcttggtggtgaggactttgataacaggatggtcaaccacttcgtccaggagttcaagaggaagaacaagaaggacatcagtggcaacccgagagctcttcggaggctgaggacatcctgtgagagggcaaagaggactctctcctccactgcacagaccaccattgagattgactcgctgtttgagggcattgacttctactccaccatcacccgggccaggtttgaggagatgaacatggatctgttcaggaagtgtatggagcctgtggagaagtgtctcagggatgcaaagatggacaagagcaccgtgcacgatgttgttcttgttggtggttccactaggattc

SEQ ID NO: 5472 - DNA, 382 bp, Triticum aestivum
  Clone ID: LIB3281-027-P1-K1-F12
cggacgcgtgggtgttggaaagtctcttgtggaggaagacaaacttgaactggcaacttcactgatcgaaacggcaaagtccaagggtgttaagctcttgcttccgactgatgtcgttgtggctgacaagtttgcagcagatgccgaaagcaagattgttcctgccactgctatccctgatggttggatgggtctggatgttggcccagattccatcaagactttcgcagaagccctggacaccaccaagactgttatctggaacggtcctatgggagtctttgagtttgagaagtttgccgcaggcactgatgcaatcgcgaagcagttggctgagcttactgggaagggtgtcacgaccatcattggtggaggtgactcc

SEQ ID NO: 5473 - DNA, 305 bp, Triticum aestivum
  Clone ID: LIB3281-027-P1-K1-F2
gtatctgttatagctgtgctccgtactgcatggtggggctagcaaaagagcgagtctgactcgcatgaaaccgagcctacaccaggcacacatccaagagacagacagaggaagtgatctagctcgcttgcttagccgggttgggtttggccaattgctgacatcctatgagccataaccgccattagaccgaccctaaaagacccagatacactcggctgtcgcttgcccgaccggcaaatcgagctccctatcgtgctctggttccgatgtcaccagacgaggagctgctgtacactacctgg

SEQ ID NO: 5474 - DNA, 74 bp, Triticum aestivum
  Clone ID: LIB3281-027-P1-K1-F3
ctgagataatgtcagagattccagagagcttggtcatctttgacattatctcagcggtcgcgtgatatgacccg

SEQ ID NO: 5475 - DNA, 127 bp, Triticum aestivum
  Clone ID: LIB3281-027-P1-K1-F4
cggacgcgtgggcggacgcgtgggttcctaacaagcaccgccgctgacgcatctcgagtagtttccagttcgccggataaggatcaagatggccgtaaggaagggcggctacaggtataaggcggtt

SEQ ID NO: 5476 - DNA, 383 bp, Triticum aestivum
  Clone ID: LIB3281-027-P1-K1-F6
ggggaaaggcgtcttcgtactcgcctctctccgcgcaaccgagccttccgcccacctcctccccatttcgccagcggcgcacccaccaaccacccccacccgccgccatgagggagtgcatctcgatccacatcggccaggccggcatccaggtcgggaacgcgtgctgggagctgtactgcctcgagcatggcattcagcctgatggccagatgcccggtgacaagaccgttgggggaggtgatgatgctttcaacaccttcttcagcgagactggggctgggaagcacgttccccgtgctgtcttcgtagatctcgagcccactgtgattgatgaggtgaggactggcgcttaccgccagctccttcaccctgagcagctt

SEQ ID NO: 5477 - DNA, 333 bp, Triticum aestivum
  Clone ID: LIB3281-027-P1-K1-F7
cccacgcgtccgcccacgcgtccggataaaattggaacgatacagagaagattagcatggcccctgcgcaaggatgacacgcacaaatcgagaaatggtccaaatttttaaaaaaaaaaaaaaaaaaaaaaaaaaaaaaaaaaaaaaaaaaaaaaaaatatataaagaaaataataaaaaaaaaaaaaaaaaaaattaaaaataaaaaggggcggcctttcttgaggatccaagttttcgctcccttgcataccaattaatatttttttttatgggtctcattaaatttaatttactgtccgtagtttaacaacgtctttactggaaaaacct

SEQ ID NO: 5478 - DNA, 337 bp, Triticum aestivum
  Clone ID: LIB3281-027-P1-K1-F9
cggacgcgtggggtgatacctaacataggcagctgctccagtcaaaaccctggcctgcctgccacagagcgagtggcaaaaccccatctaaggtggccgctgcatgtgctgccgctggcatggcttcagcaggggcactcgaagaacacattcgggactctcgaccaaggatttctggctggctcacttcacgacctacatgagcgactttttctgaggcagctggaaaggcgcttgacttaattaaacctagctctagaggcagagctacaatctatggagtaccttatatgcgtgcacttaagtgttagcgagcttagggactttgttaatgttt

SEQ ID NO: 5479 - DNA, 390 bp, Triticum aestivum
  Clone ID: LIB3281-027-P1-K1-G1
ggaaggtcctcctcatcgtcaacgtcgcctccaaatgcgggttcacggagactaattacacgcagctgacggagctttatcagaagtacagggagaaagactttgagatattagcattcccctgcaaccagttcttgcgacaagagccaggcagtgaccagcagatccaagactttgcatgcacaagattcaaagctgaatatccagtttttcagaaggtgcgtgtaaatggcccagatgctgcgccgctttacaagtttctgaaagctaacaaacctggtttgtttggttcaagaatcaagtggaactttaccaagtttcttgttgacaagaatggaaaagtaatcaacagatacgcaactgctaccacaccattttcattcgagaaag

SEQ ID NO: 5480 - DNA, 306 bp, Triticum aestivum
  Clone ID: LIB3281-027-P1-K1-G10
gagacgtttccaaacaacgcctgtttatgcaatagaggatcgaaatggccggcaccgcatgctcaagtacacaccagagcatatgcattgctttgctatgttatgggggccactggctccaccaaaaagcggtgtactagcagtccatagtcttttcagcaataaggtaccatttagaattactgcaactggttgggtacatgaattcaacaatactgtccgaattatgaaaaagatcaagctcacaggcgctccatgcaagatatttaagaaatactgccttaattaaaggggatgttcaacatt

SEQ ID NO: 5481 - DNA, 371 bp, Triticum aestivum
  unsure (1)...(371): unsure at all n locations
  Clone ID: LIB3281-027-P1-K1-G11
ttctcgagtatgatccaaattttgtagcttctgcctgtatttggacagccagttctcttgttggagcaaggatcaagacaatcgggccatcaccttgttctagtcgaggctgtgcaccaacatgaaccaaaccaggtagtatgtaagatagtgttttcccagatccagtttctgcaataccaatcacgtccctgcccttcaaggccatcggccaaccctgagcttggataggcgttggctccacaaatccggacttagcaattgcttgcatgcagtaatctggaaagttagcttcatggaagaagcggataggcttgggcacctnccggccctccacggtgatgtcccggagctgacggtactgcgccacc

SEQ ID NO: 5482 - DNA, 384 bp, Triticum aestivum
  Clone ID: LIB3281-027-P1-K1-G12
cggacgcgtgggtggcaatcagtccacaaatgactcctttaagggaaataatgcccatgctgtacctgttgttccaccactattgggactaagtggttttgttcctcctgggcagatggctgggatgcattcttatatgctgcatcctcaaggtattcctcaatctttagcttcgcccaactctggtgttcctcagtttggtaccttttagcctacaatccaacccaccttacactggcctaatcaacaggaaacacaagctgtctcacaaacacctgatgcaacgaactatcgcaccacagctcagctcccacccacttccaaaccctcttgccggagccccagcaacccgccagcaagcaagatggacggcagcaaggcgat

SEQ ID NO: 5483 - DNA, 226 bp, Triticum aestivum
  Clone ID: LIB3281-027-P1-K1-G2
ggagccgtcccggatgactctcttccggttcggcaacacgtccagcagctcgctctggtacgagctggcctacagcgaggccaaggggaggatcaggaggcgcgacaggatctggcagatagcgttcggttcggggttcaagtgcaacagcgctgtctggaaggcgctcaggtcagtgaaccctgcgaaagagcagaacaacccctgggtggacgagatcgacaca

SEQ ID NO: 5484 - DNA, 375 bp, Triticum aestivum
  Clone ID: LIB3281-027-P1-K1-G3
gtgagataatggcataaatttcatagagcttggtaacctgtgacataatctgatggggaacgagcttggctacggggagaccaaggtgaggatcaaaaggctcgacaggatctggcggatagcgagcgcatcggggttcaagtgcaacagcacttgtttggaagcgcttagttcagggaaccccgctaaggagcatatcaacccatggatggactagatctaaacataatcggtggtggtttcaacggttttcaaggttggagaattgcttctcctgtggattagatattctacccagaacagctagtgatcaaaacttgccattggaatcgactgtatgcaatatgaatctgttatcagactggtattttaaat

SEQ ID NO: 5485 - DNA, 288 bp, Triticum aestivum
  Clone ID: LIB3281-027-P1-K1-G4
tcgcggacgcgtgggcggacgcgtgggcggacgcgtgggcgcagctgctcgagagaatcacccccaagtgctcgatcttccccagcaaaccctaagagcttgttcaaccatcagaaatggcgaccggtgctggcggaggtcagccgagcgttctgagcacattgccgaagaatctgccgttagactttctgaaaaccatcaccgaccaggtcttagacgagcgtaaaatctgttcaggcgcatttggaactgcttatatgggattaatgccggatgggcatataatta

SEQ ID NO: 5486 - DNA, 377 bp, Triticum aestivum
  Clone ID: LIB3281-027-P1-K1-G7
ccatctcgctctcgcggccgagagatcgaatcggagaagaaggagcggagaggcctctgctgccctagctccgccgcccccgcaccggccatggcgctcgccgctcgcctcgtatcccgctcccgacagttatattctgtccaagctgctttggccaatggaggcgtcactcaagtccgctcatttgccaaggaggcagctcctgtcagcggagatgacctattgaagggcatcttttttgaggtgaagaaaaagtttgagaccgcacttggggtccttaagaaggagaagatcacgatagacccaaatgacccaacagcagttgctaactatgcccaagtcatgaggactggtagaagaaaagcagatcttttttc

SEQ ID NO: 5487 - DNA, 377 bp, Triticum aestivum
  Clone ID: LIB3281-027-P1-K1-G8
ctccttcacctagggttttgctggctcccttccccaccgacggcgtggccgggcgtgtgcaccatggggctgcccaaccagaacaccgtcgattacctcagctttaagctcgtcatcgtcggcgatggcgggactggcaaaaccacatttgtgaagaggcatgtcactggagaggttgagaagaaatacgaacccaccattggtgttgaagttcacccgttggatttgaccactaactgtggaaagatacgattgtactggtgggacactgttgtgcaagagaaggttggtggtcttagggatggatactatatccaaggtcagtgtgcgattatcatggttgaggtcactttaaggcttacctacaagtatgtttc

SEQ ID NO: 5488 - DNA, 379 bp, Triticum aestivum
  Clone ID: LIB3281-027-P1-K1-G9
cgccagacgagccttttccttttcaatctgttttacatctaccacttctggagctggagctggagctggggttatttctttctgggatgaaccactaccagctgcctttggtttggcctgcttatgggtctgggttggtggtaaaacaggaaaggaatcctcttctacagggacaacaactgcagtagacttttcaggtgctgcttctttagttgtaatgggaacgtttgggcttgaaacagtgagttgagatggattgttgggtcttctactgtaattgttactgggaatgacgggaggctcctcatcaggaccaagtgatcttccatcatgggtagctaatctcctcagagtgctaatctggtttgcttcaacatac

SEQ ID NO: 5489 - DNA, 158 bp, Triticum aestivum
  Clone ID: LIB3281-027-P1-K1-H1
aggtgctataccaaacggtggcgctacataccagcatgacgatcatgaggacgggaactaggagatctgggcgtgtcgtggacaagcattcgggtgatcctggggagagcgtgtgctcaattgcataagtggaaaacctaatgcgtggggaatcaata

SEQ ID NO: 5490 - DNA, 61 bp, Triticum aestivum
  Clone ID: LIB3281-027-P1-K1-H10
cccacgcgtccgagcacagaccggcgtcttcgtactcgcctctgtcgcgcgcgttccgagc

SEQ ID NO: 5491 - DNA, 382 bp, Triticum aestivum
  Clone ID: LIB3281-027-P1-K1-H11
cgaaatgtctctcagcactatgatcttagtaacgagtttttctcgctttttatggataaatcgatgacttactcttgtgcaatttttaagatggagaacgaaagcttagaagcagcccaggaacgtaaacttagacttctaatcaacaaggctaaagtcgagagggggcatcatgttcttgatatcggtttcggctggggaagtttggcaatacaagtggttaagcaaactggctgcaaatacaccggagtcactttgtcggaggagcagcttaaatacgcccagggaaaagcaagagaagctggcttagaggaccacataacttttctgctgtgtgactaccgtcacataccaccttacaagtatgacgcaatcataagca

SEQ ID NO: 5492 - DNA, 253 bp, Triticum aestivum
  Clone ID: LIB3281-027-P1-K1-H12
cggacgcgtgggcttctcctccccttccggttcgggttctggttcggttcgggttcggttcgagagagaggccgagtagctagcctagtctagggtttcggtagagaggaagggagatccatggcggagacggagtaccgctgcttcgtgggcggcctcgcctgggccaccgacgacaacaacctccagcaggcctttagccagtacggcgagatcctcgacgccaagatcatcaacgaccgcgagacggtga

SEQ ID NO: 5493 - DNA, 209 bp, Triticum aestivum
  Clone ID: LIB3281-027-P1-K1-H2
ggcagcggtagcgaaggagggggaacccatcctaaagccaatcttgttggcggcaggcatacccccgggttgttgggccaaaaaagcttctttgacaacaacacccccgggggggggctgaacagtgcgcacccctagaccaaggttggcccagtgtattccaaaaacagcgaaattctggattgacacaccgtgcacccaaggggggg

SEQ ID NO: 5494 - DNA, 389 bp, Triticum aestivum
  Clone ID: LIB3281-027-P1-K1-H3
cggacgcgtgggcggacgcgtgggcggacgcgtgggcggctaactccaccaatgccgccgctgctcaccctctcctcctcgccggtgctgccgcccagggcccggttcagggtctcggcctccgccgacgtcggcgccaccggccgagccgccgccgactccaacggcttcccgccgttcctgcccagggcggtggagcgcattcgcgacggcgccgccctccgtcttgccaagcgaatcgagcgcgtgcccgtccagaccggcttcttgaagagcccgataccgagcagctgcgtgaggccactcaagcagcagcagagcgccgatccggtcgtgctgctccacggctttgacagttcttgtttagaggggaggtacacctacccttt

SEQ ID NO: 5495 - DNA, 125 bp, Triticum aestivum
  Clone ID: LIB3281-027-P1-K1-H4
cgtccgttccactacccgacagctgggagcttggttgcaatttcaccacttgaattattcttgggggatactaggcaataatgacagtcatttttttctgggatgcgtacaaagacaaacttttt

SEQ ID NO: 5496 - DNA, 298 bp, Triticum aestivum
  Clone ID: LIB3281-027-P1-K1-H7
aggaaagtcaccatggcaagcagcatcaacatcccaacccacaacggtcgggggaaccctggtggggcagggggcgaccggcccgccggggtggttggccttgggaccgggaaacccgcccaattggtggcccaagggggattccccggattattatttcggggtaacaaaaagggacaacttaacggacttaaggccaactttggcaaggttttggggatggccggcattggcaggggtttttttcaacaaacaaaacaaatggttggttggcaaccgggcattgtccttgacgccc

SEQ ID NO: 5497 - DNA, 311 bp, Triticum aestivum
  Clone ID: LIB3281-027-P1-K1-H9
gtcattcctcctctggatacggtggagagagtgcctccttgcaccgctgcgagacgagagaggaagctggaggactacttttccggccgtgtggtacaacccgctcggatatacactagagagatagcccctagccggacgggggcgacccccacgcacaatgtaagggggttatccacggcctatgggactggggcgggtactatcacctgcggtgggcacacgtctgacacccacgaggaggtcagtccgcaagaaatagatagagatagcagacgattcttcgcctatgaccaaggtccgaaagcagt

SEQ ID NO: 5498 - DNA, 402 bp, Triticum aestivum
  unsure (1)...(402): unsure at all n locations
  Clone ID: LIB3281-028-P1-K1-A1
ttttataataactaaaaacctccctttttatttatatatttttattgggggggttttaaataaattttcggatttttaataaatattaaatatattttttttttttttttttaaaaaaaaaaaaaatatcccatttttcacccaaaaagtttaattattttaacaaaatttttttttatttttcctattttttccaaataattaaaataattttctacatttttttttttttatcatatttacattatatgtttatattatttatttattctctttctttntacaaacataatttttagaattaatgtgtgtgacaaatattattttaccgccctccacattttaattttttttttcccccccaccatattttttaaaaattctttaaaatattattatttt

SEQ ID NO: 5499 - DNA, 391 bp, Triticum aestivum
  Clone ID: LIB3281-028-P1-K1-A10
agttacaggagaaacttcttgggagattcctaatggattagcttcagtaggtgctgctgatggagtcacttctgcatctgtgcctactcatatggggtactctgtagaagctcaagcacatgtccttccccacagtaatgtcgaagcatatcctagtgatgtgtctgttggaaatggcacagcaacctatactgctatgggaacttatactcatgatccttatgcttacactggagccgttgctagtcatgggagagtggacattgaccccttgcagcttgcaaaatatggtgaggatttactgcaaagactgaagctgctggaaaggccacatgttgccattgacagtcttgagttgataaaaagagaaattgagatacgaatagcagac

SEQ ID NO: 5500 - DNA, 329 bp, Triticum aestivum
  Clone ID: LIB3281-028-P1-K1-A11
cgttccacggagagaaccaacatgggactctcctaatgtgaatacactctacgggggtgatgataccggagccactggttgaatttctccatactcatattgcgtgctctgcagaagctgaagcgcatgtacgatacaactggtacgttaaagggcttagtagtgatacatgtgctggctagggctcagaaacctacactgttatggaagcttaccatgaggagacttctgcttacgctgtaaccaatgccagtgaagctggagctcacatccacactgatgatttgggtagcaaaataaaaagatattactgctaatgcagatgatgc

SEQ ID NO: 5501 - DNA, 347 bp, Triticum aestivum
  Clone ID: LIB3281-028-P1-K1-A12
gtggcaggactgagaagccaatgctcaaggctggtaacgcctaccacaagtgaccgtgtgaagaggaactcctggcctaaggtgcgtggtgtggccatgaaccctgtggagcatccccacggaggaggtaaccaccagcatattggtcacgcttccactgtccgccgtgatgcaccacctggccagaaggttggtctcattgctgccaggaggactggtcgtctcagaggccaggctgctgcctctgctgccaaggccgacaaggccacttagagctatcgttgctgtttatctatgtttgctgcctctagattacccgtcaaggacatgtattgcaatatggattg

SEQ ID NO: 5502 - DNA, 397 bp, Triticum aestivum
  Clone ID: LIB3281-028-P1-K1-A2
cgtggtcctcgttgtaatcgcagtatctcgaaccctacacatgggctagctcctaatctggtggtggtggcggcctagcctccgaatccgtagagggtgcgtccctggcgcttgagagcgtagacgacgtccatggcggtgacggtcttgcggcgggcgtgctcggtgtaggtgacggcgtcgcggatgacgttctcgaggaagatcttgagcacgccgcgggtctcctcgtagatgagccccgagatgcgcttcacgccgcccctcctcgccagattaggagctagcccatgtgtagggttcgtggtcctcgttgtaatcgcagtatctcgctgttgctcgctgtgttctgtaggatccaatggaatggaattgaaattaaactatttcggcgttg

SEQ ID NO: 5503 - DNA, 419 bp, Triticum aestivum
  Clone ID: LIB3281-028-P1-K1-A3
cccacgcgtccgcccacgcgtccgcccacgcgtccggttaccctccacagcaaggaggttaccctccacagcaaggatacccgcctgcacctggagcttacccacctgcacctggggcataccctcctgcacctggggcgtaccctcctgcacctggagcgggaggccctgacggggagaaggggctcctctccaacatcatgcatggtgttgccggtgctcatggtggtggtcatggctacccatctggtggccacgggtaccccccgcagcagcatggataccctcagcaaggctaccctcctcagcatggctacccaccgcagcagcatggctaccctccacagcagcatggctacccccctgctggctaccctggctcatctggtcacagtggtagccatggaagaggaggcatg

SEQ ID NO: 5504 - DNA, 403 bp, Triticum aestivum
  Clone ID: LIB3281-028-P1-K1-A4
acaagtgggaggggctctaccgacaaaggtagtatgcctgacccaggtggttgcagcagatgaactgagagatgatgaggaatacgaggatattttggaagacatgagggaagaagggcgcaaatatggtaaacaaaatgaaatccatggacttgccttcatcttgttttgaacccttttgcattctgttatcattgtgttcagttactgaacttaatttgttttgtgtgttgtctttttgtgtgtcttttttgtagtccacataaatgccattgcagagtcttttatagtccaaccccatgcaatattggcaatcgggcttaacctacagaagacacactattcttttccaattggatatgattgatcatatatcatgtatttcttggttatgtatgtactc

SEQ ID NO: 5505 - DNA, 403 bp, Triticum aestivum
  Clone ID: LIB3281-028-P1-K1-A5
agaaggcgtgggatctttacccgctagagtcgagtagcctaaaccagcacccgtgtaacacacaaactcactcatggtgctccctaccccgctttccggcaggccatgcagattgaccggcagctctccggcaaaccgatggcatcccatgacctcgcctggatcttgttttgaacccttctgcattctgtcatcattgtgttcagctactgaacttaatttgttttgtgtgtcgtcttttcgcgtgtcttttttgtagtccacataaatgccattgcagagtcttttatagtccaaccccatgcaatattggcaatcgggcttaacctacagaagacacactattctttttcaattggatatgattgatcatatatcatgtatttcttgcttatgtatgtac

SEQ ID NO: 5506 - DNA, 408 bp, Triticum aestivum
  Clone ID: LIB3281-028-P1-K1-A6
cggacgcgtgggcgcccgcccgcccccgccgccgccgccgcctccttccgcaggagctccctcctcgcaggcgagatggtgtacatcaagaaccagaagacaagggcgtactccaagcgtttccaagtcaagttcaagagaaggcgccagggcaagactgactacagggccaggctgaggctcacaaaccaggacaagaacaagtacaacactcctaagtaccgttttgttgtgcgatttaccaacaaggatgtcactgcacaaattgtttatgctaccattgctggtgatattgtgatggccgctgcctactcccatgagttgcctcgctatggtcttgaagttggcctcatcaactatgctgcagcttactgcactggtctgcttttggctcgtcgggtgcttaaa

SEQ ID NO: 5507 - DNA, 344 bp, Triticum aestivum
  Clone ID: LIB3281-028-P1-K1-A7
tggggtttttttctttttttgtttttttttttgttttcttttttttctttttttttttttttttctcccccccccaaaaggagaggcccttttgccccccttgacgttcaaaaccgcccccggaacttatcacccccccccctaatggcccccaggaccaatccggccccctattttttccccccccgcggccccaactctttttgggttgcctttccggggcgggccccccggttcacggggcccgccccccccgccccctattttttttctccccccccccatggggggggcgggggtcttggtttttccccagggggggggcccccttgggggggcatggg

SEQ ID NO: 5508 - DNA, 385 bp, Triticum aestivum
  Clone ID: LIB3281-028-P1-K1-A8
cgccgccgctccgcaaaccctaggccgcaccaggtgaaccggcgaccggcgaatcaacccgtccccgcggcgagccatgagtaagctatcgaccgacgccctcaaggaggccatcacccaggtggtggcggacgccaaggagaagaacaggaagttcaccgagacggtcgagctccagatcggcctcaagaactacgacccgcaaaaggacaagcgtttcagcggttccgtcaagctgccccatgtccctcgccccaagatgagggtctgcatgctcggtgatgcccagcatgtgggagaggctgaaaagattggtcttgattccatggatgttgaagctcttaagaagatgaacaagaacaagaagcttgtcaagaggcttggc

SEQ ID NO: 5509 - DNA, 374 bp, Triticum aestivum
  Clone ID: LIB3281-028-P1-K1-A9
gattgatagatgaatatgaaatgagttcacttgtcacaaaacaaagtgttgagtttacataatatgttcacaactcaaaaatatatatgagctcacagccgagagaaattggagaaattgagttatagaagatcggtggcacgcggcgtcaaggaaatcggcggcgtcatgacgtccaggagacgggggtggcgtccagcgattgacccaagaagtccaggcaatcagggaatgttccagcaaagaaggcaatgacttttccatatcacccatatcatgaattttttgacttcaaactgtatgatatcatggactctgcataagttgataagacatgataattaaccgcaaaaagcatgggtatggataacaca

SEQ ID NO: 5510 - DNA, 418 bp, Triticum aestivum
  Clone ID: LIB3281-028-P1-K1-B1
caaagccggcggcgcttcctcgtctctaccagagagagagagagccccccttctccaaagccggcggcgcttcctcgtctctaccagagagggagagagagagagagagaggcgtgggaggaagagggattggaagaggagcacgaggaggatatggaagcgtcggaggaggaaggggaggatgtggtggtggggcagatgccaacgttcatggtcccaaagcacatcaataagcgcgccctgaagaacaaggccctctccgtctccctcgacaagaaagccctcaaggatttcgtgactgggtttcacaagagaaagaagaagaggagaaaggaggcgcagaggattacgcaggagaaggacagacggaagcgaatcgaggcacgcaagaagagaaagcaagagaaagagattgctc

SEQ ID NO: 5511 - DNA, 308 bp, Triticum aestivum
  Clone ID: LIB3281-028-P1-K1-B10
caggaactctccgatgccttccagaggtttgggagagtaataagtgccaaggtgttcgttgacaaagcaactggttccagcaaatgcttcggttttgtaagctatgacaaccctgtgtccgcgcagtcggccatcgccatgatgaacggtttccagctaggcggcaagaaactcaaagtacaactcaagagagacaacaacaagcttagtaaacctttttgacaaaaatcatctgtgatgcccatgcggtcttgttcccggtacatatttgtcagatagttgaccgtgacgctgattgtttccccaca

SEQ ID NO: 5512 - DNA, 129 bp, Triticum aestivum
  Clone ID: LIB3281-028-P1-K1-B11
tttcaatcactccagtagactctttttttcaatacatcaccaacatcagggggagttcaccaaggtgggtacagcttcatcaacatttttccttgctttattcactaactacagcatataaagtacacc

SEQ ID NO: 5513 - DNA, 405 bp, Triticum aestivum
  Clone ID: LIB3281-028-P1-K1-B12
ctcaagacaatggcactagaatttgctgagtatcaagtttgtgtggatgtgttccttgccacacagtcatacaccgatattgcttcgatatcagttgttcccagtaccactggtggcagggtttactactacttcccattttctgctgtttctgatccagccaaactcttcaatgatctcagatggaatatcactaaaccccagggttttgaggctgtcatgcgtgtcaggtgcagtcaggggcttcaagttcaagactattctggcaacttctgcaagcgtgttcctactgatattgatttgcctgctattgactccgacaaaaccataatggttaccttcaagcatgatgataagtttcaggagaacacagaatgtggtttttagtgcgcacttctttacacc

SEQ ID NO: 5514 - DNA, 417 bp, Triticum aestivum
  Clone ID: LIB3281-028-P1-K1-B2
gcggtgtaaaaaacaattgtttttcatattaaacttctatacttattttaaactaagtgtaccatattacagttgtaataaatatatttttattagttagttatataaaatcttttcaaataatagttatattattcattggtatgcagttgtaatgtatatcattgaaaattataattctacaaaatgaaaattttatgatgcaccaaaaatttctttattgttgaaacaatctttcatatttttatttttctaatactgcataaatgatgtatgtatacacatttgcatatatatgcgtttgttcatatatcttttgatattatgttgaatattatcatagagatttctaaattatagacacactaacaagtatttttcttgtgatttctattgtatattaggcagtcaaattaa

SEQ ID NO: 5515 - DNA, 387 bp, Triticum aestivum
  Clone ID: LIB3281-028-P1-K1-B3
gggacgcgtaaaacaactaggcgtcttattaaacttatatactcatataggggtagagcgtaccatagtgacagatgcaattattatatttgtatcatgtaagctatataaaatcttttcaaataatagctatacttatgcattggtatgcatttgtaatgtatatcatcgaaaattataatgcctacaaaatgaaaattttatgatgcaccaaaaatttctttattgttgaaacaatctttcatatttctatttttctaatactgcataaatgatgtatgtattcacattggcatatatatgcgtctgaccatatatctttttatattatgttgaatattatcataaagatttctaaattatagacactctaacaaggatttttct

SEQ ID NO: 5516 - DNA, 378 bp, Triticum aestivum
  unsure (1)...(378): unsure at all n locations
  Clone ID: LIB3281-028-P1-K1-B4
cggacgcgtgggcggacgcgtgggcccacccacactaggtcgccttccgatgggaacctcccccaaatccgcagcagtccacaggaggcgaagccaccgcgatggcccgtacgaagcagaccgcccgcaagtccaccggcggcatggcgccccgcaagcagctcgccaccaaggcggcgaggaagtcggcgccgaccaccggcggagtgaagaagccccaccgctacaggcccgggaccgtcgccctccgggagatccgcaagtaccagaagagcacggagctgctgatccgcaagctgccgttccagcgcctggtccgcgagatcgcgcatgacttcaagaccgaccttcgtttncagtcccacgccgtgctggccc

SEQ ID NO: 5517 - DNA, 347 bp, Triticum aestivum
  Clone ID: LIB3281-028-P1-K1-B6
tccgctcgacaataaagcccctcaaggtatttcgtgactgggtttcacaagcagaaagaggaagaggagaaaggaggcgcacaggattacgtaggagaaggacagacggaagcgaatagaggctcgcaagaagagaaagcaagagaaagagattgctctatacgataaattcgtgtcatcaaaaaatgcggatggtgaagacggcgatggtgatagtgatgagatggactgcagctgctcctgaaatcaacacatctcaagatggcaatactagaataacatgcgtgaccagtggaataactcattgagaggaagaacacctgtaaccttttacaaggatctttact

SEQ ID NO: 5518 - DNA, 265 bp, Triticum aestivum
  Clone ID: LIB3281-028-P1-K1-B7
accacacgctcgtgttcgcgtggacgcttgacggcgaatgactccttggagccagcgcatctagtctggcgcccctacatcacactcactggcatagggctagacagcactgaggttaccttgcacaccatgcggtccacgcagttgatttagcttagtcacgggtactgcgtccggctgtcgaagctactcatcttcctgaccacgagccaacattgaaggagagtactcggggcatagacagctgcatcgatggcgctctctt

SEQ ID NO: 5519 - DNA, 294 bp, Triticum aestivum
  Clone ID: LIB3281-028-P1-K1-B8
cttctctctgccttgtacaagagaacgccatggacgccgagctcgccaaagcccgccgccagggaccccctccggcgctccctcgacccgcgccgccccggatccggttctcccctccgccgcctcacggcctcttgcaccgccgctttctctcctgggcctcttccccgacgctcgaggtgcagcagggtgggcgctgccacgttctcgatccagtcggatctggcgcaagtcgccggcatccggcgccgagcgccgtgattccagatcgggcgtaggtctgcaccaggagag

SEQ ID NO: 5520 - DNA, 331 bp, Triticum aestivum
  Clone ID: LIB3281-028-P1-K1-B9
agcagtagcagcagcagggttccttggtggatacagcagcagcagcagaaagaggacaccatggtgggtacagcagcagcagcagggttccttggtggatacagcagcaacagcagaaagaggacaccatggtgggtacagcagcagcagcagggctgcatcttcaaggtcagcatcagcaggaggtcgatggaccgtgatcccttctccacctctcgtttcatatgcaagcaggcaagatttcatccctacagcagaggacaagggcctcacttgatcatgcgtgccagtcaatgtcgcaacgcactgaggggggacgcgcttttgttcg

SEQ ID NO: 5521 - DNA, 432 bp, Triticum aestivum
  unsure (1)...(432): unsure at all n locations
  Clone ID: LIB3281-028-P1-K1-C1
cgggggggacccacgcgtccgagatggcgtcgtcccctctgcctgtctggtgtcctcgcctatcttccaaagattgctttttttttactccaacgcatctgaagcggtgatgggtacttgtgcggaggcggcggaggcggcggaggcggcggcggcgctgtatctaaagaggagcacagcgagtagcagcctgggcactgactaggaggcgttggggcctgggcgagcctgggaggaggcgttggggcctaggcgaggaggcgctaggcgcagcgagcctgggagaggagccgatgggcatagcgagctggaggcgctgggtcgaggaactgctggtgctgggcgatggcgacgtgcatgagctgctggtgctgggcgacggtgacgtgcatgagctgctaggagatgcgcctggagnctcgtggcgttggg

SEQ ID NO: 5522 - DNA, 362 bp, Triticum aestivum
  unsure (1)...(362): unsure at all n locations
  Clone ID: LIB3281-028-P1-K1-C10
ggaagccaacatttttcatttccatagatgatagcaacaagaaggtaccatcagattaggcataacagatccaccatgacaagaacaacacaggcacattctgaaacactactagcacacgcacttcctaacaaggatctaacagacgacgcatggattgcagatcgcggcctaggccctctcgccacggatgcggcgggcgagctggatgtccttgggcatgatggtgacgcgcttggcgtggatggcgcanaggttggtgtcctcgaacagccccaccaggtaggcctcggcggcctcctgcagggcggagacggcggaggactggaagcggaggtcggtcttgaagtcctgggcgatct

SEQ ID NO: 5523 - DNA, 397 bp, Triticum aestivum
  Clone ID: LIB3281-028-P1-K1-C11
agatgtcactttcagtgttggaggcgagacctttcaggcgcacaagatttggcttgccatgcgatcacctgtcttcaaagcagaactctttgggccgatgaaggagaagaggatgcggtgtttgaccatcaaagacatgcagcccgctgttttcaaggctctgctgcatttcatttatacagattcattgcctgacttggatgatcttgaaggcgatgataagtgtgaaatgatccggcatttgctggtagctgcagataagtatgccatggacaggctgaagattatgtgtcaaaacatccttggcaagagtcttgatgtggagaacgtggcaactacattggctttagctgatcagtatagctgtgacaagcttaaagatgtttgcattgaattt

SEQ ID NO: 5524 - DNA, 409 bp, Triticum aestivum
  Clone ID: LIB3281-028-P1-K1-C12
cccacgcgtccggtttgatattgatgccaatggaatcgtgacggtctctgcaaaggacaaggccaccgcaaaggagcagcagatcaccatccgatcgtccggtgggctttctgagtcggagatcgagaagatggtgcgggaggctgagttgcactcacagaaggaccaggagcgcaaggccctcattgacatcagaaacaccgcagacaccaccatttacagcatcgagaagagcctgggagagtacagggacaagatccccgcggaggtcgccaccgagatcgagacggcggttgctgatctccgcacggagatggcctctgacgacattgagaagataaagagcaagatggaagcggccaacaaggcggtctcaaagatcggggagcacatgtccggtggttgagcg

SEQ ID NO: 5525 - DNA, 365 bp, Triticum aestivum
  Clone ID: LIB3281-028-P1-K1-C2
cggacgcgtgggagcggcggcaaccccaaggcggcggcggcgctggtgccggacttccagcgcgcgttcgagcacatgtgcatccactccggcggcaaggcggtgatcgacacggtggcgaagctgttggggttcgcgccggcggtggtggagcccgcccgcgccacgctgcaccgcttcggcaacacctccagcagcctcgtcttctacgagctggcctacttcgaggccaagcgccgcgtccgcgccggcgaccgcctgtggatgctcgccttcggcaccgggttcaaggcctgcatcgtcgtctggcgcgcgctccgcgactacggccccgtcgccgacatcccttggatcggctgcgcgca

SEQ ID NO: 5526 - DNA, 226 bp, Triticum aestivum
  Clone ID: LIB3281-028-P1-K1-C6
gctcgatggggaggagagctcggttgctcatcgggggacgagagcttggtgtggtgcgtcggggaggagagcttgctagatccggcgcgcggcctcagatgtgaccatggcgggtcaggcggcggaggtcgaggtctaaggcacgctggcgcctttcatggccgtacgcgggcggcggggcgcatccttcgccggcctatgctttcggcttgtttccaagattttt

SEQ ID NO: 5527 - DNA, 347 bp, Triticum aestivum
  Clone ID: LIB3281-028-P1-K1-C7
ggcggcgccggctccggcggacggaaggctggcaaccggaggctgatgatgctataagcttctcgcatcagctagtatatcacaccttaaatttttgcggctccttcctttgccagtttcaatccaacaaagcgatgtaatcgtatactgcacttgtggaacatcagtaatgaaatcttgaattgtgaaaaacctgaacgagcctgagaggaggcgtttgtgcctaatcaaggaggcgcttggcgcacctagcctgggataggaaccgatgggcatagcgagctggaggcgctgggtcaaggaacttctggtgctgggcgattgctacctgcaagatctgctggtgc

SEQ ID NO: 5528 - DNA, 235 bp, Triticum aestivum
  Clone ID: LIB3281-028-P1-K1-C8
gggatggactgcaaggctccttccttctcgtcagtttggttacatcgtgctgacaacctctgctgggatcatggaccatgaggaggcaaggcgtaagaatgttggtggcaaggtgctaggctttttctactgaaaatggaaaatggaaaattcgatgaaagtatctgagatgtgttagtaggatatttcccatggaacacctaagttgtctttttttgtctgactagcttacgct

SEQ ID NO: 5529 - DNA, 308 bp, Triticum aestivum
  Clone ID: LIB3281-028-P1-K1-C9
ggaacggaaccaacgaatccccattcaatctcgtctccgatcgaccccagggtcgtcgtatcctgctacaccgcctcctcaagatgcaaatctttgtgaagacccttaccggcaagaccataaccctaagagttgtgagctccgacaccattgacatcatactagccatgatccccgaccaggttggcatcccatccatccagcatgaccctatctatgctgtcaagcacatgaaggatggtcgtacacgctctgaacacaacatgcacaaggtgttcacaacactagctacactgctattaaaatgc

SEQ ID NO: 5530 - DNA, 375 bp, Triticum aestivum
  Clone ID: LIB3281-028-P1-K1-D1
tgtaaacttacctgcttcgacttcttgaaggaaataagtacatggaagttggacggcaggcatctgatgaaacactgcatcttgttctagaaaccctccaatcagccattaaatctggtggtgaacaatcaacatcaatcgagccagtcatctctcctatcatactagatgtatgggcccaacacattgccgacccattcatcagtattgatgctgtagaagttctagaggccatcaagaatgctcctggatgcttagaaccgcttgtgtcccggattcttccaacaatagcgacaattttatcaaaatccaagatccagcccgatggactagttgcaggttcactggacctcctgacgatgatactcaaaaatg

SEQ ID NO: 5531 - DNA, 88 bp, Triticum aestivum
  Clone ID: LIB3281-028-P1-K1-D10
tcttactcttttttactcgtgtttttttccaccttccaccaagccatacatgtacgttcatttaaccaaattctcccccttcaagctc

SEQ ID NO: 5532 - DNA, 85 bp, Triticum aestivum
  Clone ID: LIB3281-028-P1-K1-D11
cctactcgtcgttgctcgcggacgtcctcttgcgcatgcgggcaccggggggggatggcgtgcaacattgtatgttacccgagct

SEQ ID NO: 5533 - DNA, 351 bp, Triticum aestivum
  Clone ID: LIB3281-028-P1-K1-D12
cccacgtgtgcggccacgcgttcgcccacgcgttcactctcctcttgtgggcggctcctccgatgctcacagaacacatgctggccagcgtagcttcttaggtgtacggacaacgcactcactagcctgccggcttcctccacatcttcttaacatcacccgatgcagtccgtgccattcggtgctccaatacaagggcatggcgctcggacgatgatgtaactaatctagtggtgcacgaaccaaccatggacgctgatgctcggcgcaacgacagcagcatggagggcgtcctcttgtttgggatggtaatggaactgcacataggtgtgggagcggcgaccaggatgc

SEQ ID NO: 5534 - DNA, 411 bp, Triticum aestivum
  Clone ID: LIB3281-028-P1-K1-D2
ggagaaaataaagttgcttggtgaacaatatgatgctttaaggcgaacacgaggagatggaaactgcttttatcgaagctttatgttctcctacctggaacatatcctagagacacaagatagagctgaggttgagcgcatcctaaaaaacattgaacagtgcaagatgacactttcaggtcttggatacattgaattcacttttgaagacttcttctctatgttcattgaggagctgcaaaatgttctgcagggacacgaaacttctattgggcctgaagaacttctagaaagaaccagggatcagacgacttctgattatgttgtcatgttctttaggtttgttacctctggtgaaattcaaaggagggctgagttctttgaaccatttatttctggcttgacaaattc

SEQ ID NO: 5535 - DNA, 365 bp, Triticum aestivum
  Clone ID: LIB3281-028-P1-K1-D3
gttccggccgtgccacaccccccatctctcttccctcctcctgtcctccgggcgccctagggactgtggcgccagatcgagggagcccggcaacggaggtcgccgcctctccgtctcgatccgtcggctgctggatccgactgcatggcccgctggtgccctccagggacccctccccccccccgaccccgtgtcggtgaggacagccatggatgggcgccctggagctcttttgccgtcgcccgatctggccgcccgcccagtctccggaccgtgctccggatccggccaacagcctcgcctacaactcgattcagacgcccacagtcttctttcgtcacctgcgccatgcatgcccccagctc

SEQ ID NO: 5536 - DNA, 381 bp, Triticum aestivum
  Clone ID: LIB3281-028-P1-K1-D4
ctctgctctcgccgtgctccgaaacgtccaagcaagcgccggcggcgcgacgggccgtaccacccgatctctcaccatggagaagcccgcggcgcaggcaccggggaaggcggcttcagaggagaagcagcttgacgacaaggagctggagctagagcgggagcggaaactgaagaaagagcagaaggctagagagaaagaggagaaaaagctcaaggcaaagcaaaaggagactgctaggctccaggctcaagcaacatcggatggacctaagaaaagtgagaagaagcaaaagaagaaggctgcgggggatgaaaaccccgaggatttcattgaccctgagacccctagtggtgagaagaaatcgcttgcacctcaaat

SEQ ID NO: 5537 - DNA, 271 bp, Triticum aestivum
  Clone ID: LIB3281-028-P1-K1-D6
catgattccattaaagccctcttccacttccagctgccgcgtggcaccacggacgcttttaccctccctgcaccccaattgcccctcctccatcatccattccttctcctccttcacccccaagctgcctcctcctttcacctcctcgccattctcctataagtgccttgtctccggcttctccctattcgcctcgttaaggaacaacacgtttcagctttgtgcggttcttggtcggtgttctcgttccctttctttgcatctttctttt

SEQ ID NO: 5538 - DNA, 254 bp, Triticum aestivum
  Clone ID: LIB3281-028-P1-K1-D7
cccactcgtccgacacctggcacatccagttgtgctcctcatatgctgagggctcatgctcccatgtttacacgccctaagaaaagaaagaagaagacacaatccttcattcattcagcgcacagctgataattctctttcatcccatgacttatgcacttcttcctagaagatcccaccaacttcacatccaatacatccaaacccatgctgattcacaccttctgcacatatagaatgagtctgatctctta

SEQ ID NO: 5539 - DNA, 269 bp, Triticum aestivum
  Clone ID: LIB3281-028-P1-K1-D8
cccacgcgtccgcggggaaggtggtaggaagcagcggagtcagccatggggagggggtgggtggagctgtagcggctctataacaagatcaaccgccagtttacctttgccaagcgcaggaacggcctgctcaagaaggcctactagctctcctttctatgcgactccaaagtctctctcatcgttttctccaacctctgcaagctctacgagttctgtagcacccagagcatgacgaaaacactcgacatgtatcaaaaattcaattt

SEQ ID NO: 5540 - DNA, 333 bp, Triticum aestivum
  Clone ID: LIB3281-028-P1-K1-D9
tttactcgagggttcgtgccccctgattcagatgaggatttgggtttgaggaccgctcatcggattcgagttgcatgttccaaggggcataatcaaccttgccacataactgcctaactccaatttcaggtacctaaaatctaatgaagagtccaaagagtatgccaaatctaccctaccaacggcgcgtcgtgaagaaggctaagcgtacactgcgtcaccttcttttattcatgtaggtcgcagcctatcgatgctttttccacacattttacacatccacgaatatgccggaccttggccaccctcatgctgtagaaatacctccctctc

SEQ ID NO: 5541 - DNA, 404 bp, Triticum aestivum
  Clone ID: LIB3281-028-P1-K1-E1
ttgttgcaagcgaggcaacagataaaaatgtgtgggacgcggtgttgaagaatgagagggttatggaattttacaagagtcaccagcaaactctggtcaatacttttcctgagggcactgactctactgactcagtagagtcaccggagaaatttgaagaggcatccccagaatatgcactacccactgcctcacctttgtcggactttgtggacaatgcgaagaagacgatgatggagatggttgacaacataaccaactttttccaagacctgttccacaacccggcagaagccgaggctggaccgggctcatcctctaaaaagccttcgttcgcggagatggcggctggtggatctttcatggctcttgccatggcggtcatcctagttgttctgttcaag

SEQ ID NO: 5542 - DNA, 410 bp, Triticum aestivum
  Clone ID: LIB3281-028-P1-K1-E12
cccacgcgtccgcccacgcgtccggcaccgtgcacgatgttgtccttgttggtggttccactaggattcccaaagtgcagcagcttctccaggacttcttcaacggcaaggagctgtgcaagagcatcaaccctgatgaggctgttgcgtacggggctgctgtccaggctgccatcttgagcggagagggcaacgagaaggtccaggacctgctgttattggatgtcactcctctttctcttggtctggagacagctgggggtgtgatgacagttttgattccaaggaacaccaccatccccaccaagaaggagcaggtcttctccacctactcggacaaccagcctggtgtgctcatccaggtgtacgagggtgagaggacatggacccgtgacaacaacctccttggc

SEQ ID NO: 5543 - DNA, 335 bp, Triticum aestivum
  Clone ID: LIB3281-028-P1-K1-E2
tacactctaactagctagctaggcgaggctaggccggcgagggagaaggagaaggagaagtaggcgccaagatgttgaggatgcagcagcaggtggagggcgtggtgggcggcggcatcgtgtccgatgcggaggaggcggcggcgtacgagcgggtggctcgcatggccagcggcaacgtcgcggtcgtcttaagcgccagcggctgctgcatgtgccacgtcaacaagcgcctgctgattggccagagagtagcccacaccgtctacgagctgtaccacatgggcggagaagcccaggatatacaggcctcattctttcaaaagctttccctc

SEQ ID NO: 5544 - DNA, 392 bp, Triticum aestivum
  Clone ID: LIB3281-028-P1-K1-E3
cccacgcgtccgcccacgcgtgcgcggacgcgtgggctcatagccatcaccgtggccatcccacacgagctaagcgcacacagcaactgccacagatccgtgcccggcgagctaagccaggaaggactccatcggcttctcctcctctcctctccgcagcgagcagagcagagcaggggatgaagcgcgtcgtggggagcccggggacatggagcggcatggcgctgcggctgtcgcagtgcgtctttcgcgccgtcttcttctactacatggtcttcggtttggggttcttcaactacagcgcctacttctacatgaatctagcttttatccctgcagctgatgtgtagatttggccttgcttgtaaggtaacctttgctctaaggaatat

SEQ ID NO: 5545 - DNA, 78 bp, Triticum aestivum
  Clone ID: LIB3281-028-P1-K1-E4
cccactcttcctaggacccgtggttgttctcgcctacctctcacaccatgggggggtgtcctctcatagtcacctaac

SEQ ID NO: 5546 - DNA, 270 bp, Triticum aestivum
  Clone ID: LIB3281-028-P1-K1-E5
ttctcgagtatgatccaaattttgttgcttctgcctgtatttggacagccgggggtcttgttggagcaaggatcaagacaatcgggccatcaccttgttctagtcgaggctgtgcaccaacatgaaccaaaccaggtagtatgtaagatagtgttttcccagatccagtttctgcaataccaatcacgttcctgcccttcaaggccatcttccaaccctgagcttggataggcgtaggctccacaaatgcgttcttagtaattgctagca

SEQ ID NO: 5547 - DNA, 402 bp, Triticum aestivum
  Clone ID: LIB3281-028-P1-K1-E7
tcgcccacgcgtacgaccacactttaatgtacgcgacgccgtgctcaagaaggggagcgttatggaattttacaagagtcaccatcaaactctggtcaatacttttcctgagggcactgactctactgactcagtagagtcaccgtagaaatttgaagaggcatccccagaatattcactacccactgcctcacctttgtcagactttgtggacaatgcgaaaaagactatgatggagattgttgacaacataaccaacttttttcaatacctgttccacaaccgcgggagaatccgatgctggaccggactcatcctctaaaaagccttcgttcgcagaaatagcggtttgtagatctttcattgctctttccatagcggtcattctattttttcttgttc

SEQ ID NO: 5548 - DNA, 335 bp, Triticum aestivum
  Clone ID: LIB3281-028-P1-K1-E8
gaagaagcctcaccgttaccgccctggaactgttgctcttcgtgagatgggggaagtaccagaagagcactgagctgctcataaggaagcttcctttccagaggcttgttagggagattgcccaggacttcaagactgacctccgcttccagagccatgcggtgctggcccttcaggaggctgcagaggcctacttggtgggtctcttcgaggacaccaacctgtgcgccatccatgccaagcgcgtgaccatcatgcccaatgacattcatctggctaggaggatccgtgcctagagggcttaaggtgctttctttttctttgggaattgcttt

SEQ ID NO: 5549 - DNA, 378 bp, Triticum aestivum
  Clone ID: LIB3281-028-P1-K1-E9
gccagaggatatgaatccactctccctggaatctgagagttcccacttgggttcacagatgaagtgtgctgcaaccccttatgtttctgcaactgattttggggtcactctcactgatgtcgtactgaaggcgcttattaaggagatgtagacacaacccgcagaggacaatgtagtttcttgtagggaacgagttagtggttatgctcaacaaaccgttgaaagtgagatgtgtgcgttctttatacgtggatcctggtctcgaggcaacacatgcgctttttctcattacctttgggcccccaaaccaatattcaagttcttccttcattacagggttgtagaaatggtagctcttggtcattttcacatgattgg

SEQ ID NO: 5550 - DNA, 373 bp, Triticum aestivum
  Clone ID: LIB3281-028-P1-K1-F1
cactttcctagctcaagctaagctccgcaaccatggcgcccaccaggttgcgtctcctcctcctcctcgccgccactgtcgctgccgcggccgacctgtccgtctaccacaatgtccaccctccgtccgcctccccgctcgagtccatcatcgcgctcgcccgcgacgacgacgcgcgcctcctcttcctctcctccaaggccgcctccaccggcaccgcctcggcgcccgtcgcctccggccagaccccgccctcctacgtcgtgcgcgccgggctcggctcgccggcccagcccatgctcctggccctcgacaccagcgccgacgccacctgtgcgcactgctccccgtgcggtacctgccccgccagcag

SEQ ID NO: 5551 - DNA, 416 bp, Triticum aestivum
  Clone ID: LIB3281-028-P1-K1-F10
cgccgccaccgcccgcagcctccgatcgatttcggttcgattgcggtttcgtccccccgcccgccgacgaggtagcagcatctgttttgctgcaatctgacaaagtggaggggtacgctgaaccttcttttatgtctgaacaagcatcggtctatttgggatcagttggattgctgggagagtactctcgtgcaacgagaaaaaggcataagtttgtgctcccctgcatgcatcaagagcccattaggttctctggttctgagagttcacttgccactgcctgtgctcagagtcctgcagctactatttcttctgaattttgccacatctgatagcatctgctgcagaaagattttctcaagatggcgctgcaaaacattggtgcttcaaacaaggatgatgccttctacaggtac

SEQ ID NO: 5552 - DNA, 247 bp, Triticum aestivum
  Clone ID: LIB3281-028-P1-K1-F11
cgcacgcatcggccgaagcctgctatcgattttgtggcgattgcggaggggcgctctctcccgcggtcgaggcatcattttatggattgctacaatctgacaaagtggaggtgtacgctgaacttccttttttgtgtaaacatgcttcggtttattagagatcagttgaattgctagaagagtactctcgtgcaacaagaaaaatgcttaagtttgtgctaacttgtttgcattaagagcccattta

SEQ ID NO: 5553 - DNA, 419 bp, Triticum aestivum
  Clone ID: LIB3281-028-P1-K1-F12
cggacgcgtgggctctactccacctacctgtctcgccctccttgttcacatgatctcccttggctttcccttcgacgcttcgagagagagggagagagagaaggaacgaggaagatggcggacgaggggacggccaactgcatcgacatcatcctcgccatcatcctgccgccgctcggcgtcttcttcaagttcgcctgcgggatcgagttctggatctgcttgctgctcaccttcttcggctacctccccggcatcatctacgccgtctgggtcatcaccaagtaggactgcaggaggggctcctcacctctgcctctaggtgatccatgtcgaacttgttctgtgtctggtacaagccgtttgtccgagacgcgagccacggttcatggtgctgcctgcctacatgtgtgtgttca

SEQ ID NO: 5554 - DNA, 393 bp, Triticum aestivum
  Clone ID: LIB3281-028-P1-K1-F2
gcgagccaaacgtgccggaaaagaagctcaccctcgaacccgagcggactcgagccacccccagagcggcggagcagacgaggggggaatcccgatggcggcggtggcgatggacatcgcgaagccctcggcgctgccggcgagcgttgacgacccgtcggcggcgtcggccaagggcagggccggcggcggggagggcctgcgccagtactacctgcagcacatccacgacctgcagctccagatccggaccaagacgcacaacctcaaccgcctcgaggcccagcgcatcgacctcaactctcgagttagaatgctccgggaagagttgcagctgcttcaagaaccgggctcatatggtggcgaggttgtgaaggtcatgggcaagtcaaa

SEQ ID NO: 5555 - DNA, 313 bp, Triticum aestivum
  Clone ID: LIB3281-028-P1-K1-F3
gaaagagaatcataattttattatagtaagaatattacaatgtctttacaagtatccaataaaaggaaaattgcaaggaaataaaagaaaatcctaaaactaatcttctagtaatcttttcttctttttcttcactttatccttccagacattgaggatctcgttgtgcccggcgaagacgctgcggagtgcgtcgcggattgaccttctacagcgatagctgccccagatgaactcgttgtccttcttcaccttccattccactaagaaatcaggggaaaaatttgggagcagaagctcaacataatgcacc

SEQ ID NO: 5556 - DNA, 322 bp, Triticum aestivum
  Clone ID: LIB3281-028-P1-K1-F8
cggacgcgtgggtcagggagatgcttcgcatcaagcgtacagtggccggtggccgcagtcagactcatttcatccttccggagtacctgatgcaaagggatcagaagctaaacatggatgaggcggtcgacactctgacgcgtgccggtgtcccgcaggatgagatggccgccttagaaaggcagctagcttctggaccatccccggcgccagcagcggctccaagcaccagtacgactcccgcaaacagaatgatgaactttgttagtgccggagtagaggcacgggccgagagcagcactcaacaggctgctgctaacaa

SEQ ID NO: 5557 - DNA, 348 bp, Triticum aestivum
  Clone ID: LIB3281-028-P1-K1-F9
cggacgcgtgggcggacgcgtgggatccttttggtggtattacaggggcaggaaaaacttgtattgtttggaccaccattcaacgtgcaaaaggtgcacaagatctgggcctgtctatcgaacttcttccattgagtaggcctgatgaggatttcaacatgtccctgttttatgcaaatttgattggtctggagggagatgaagtactgcagtatgtgccatctgctggtgaaaagctggaggatatgactgatcaactgagaaagcgaatgatgaaaaagcgcaaagtcaaaactctctcatttgcaattacaaatgatgtttgcatagaggtgaacacatatgcgt

SEQ ID NO: 5558 - DNA, 177 bp, Triticum aestivum
  Clone ID: LIB3281-028-P1-K1-G11
gctactgcatgatgaaccgaggattcaagtggtccacgtactccgcggggggggaaattgcgctggaggagcagtccctactattccctgggatggatgttcccggagaaaaggaggtggccctgcatatgcccttgatgcttcctagaaggctattgttggcacttccaagccatt

SEQ ID NO: 5559 - DNA, 424 bp, Triticum aestivum
  Clone ID: LIB3281-028-P1-K1-G12
ctctctgaataacacggcaaccatatggatgggatcatgcagtgtgtggttcctttgacacaagaccagtatggcaattatgttatccagcatgtcttgcaacacgggaaaccagaagaacgtacttctataattaagcagcttgctgggcagatcgtgaagatgagccaacaaaaatttgcttccaacgttgttgagaagtgtctgtcttttggttctcctgaggagcgccagattctaattaatgaaatgcttggcactactgacgagaatgagccattacaggcaatgatgaaagaccagtttgcaaactatgtagtgcagaaggttttggagacttgcgacgaccacaaccgtgagctgattctttcgcgtatcaaggtccacctgaacgcactgaagagatacacctacgggaaacata

SEQ ID NO: 5560 - DNA, 402 bp, Triticum aestivum
  unsure (1)...(402): unsure at all n locations
  Clone ID: LIB3281-028-P1-K1-G3
acgcgtccgcccacgcgtccggagggagggcatagaagactaccaaaggactccatggccggcatggacgtcctctccgccaagctcctccgctcctccctccacccgcacgccccctgtcttccctgcccatccctcccgtcccgacgctaccgccgcccctcctcaatctactgccgcctcaccacctcctccctcccgtcctcctgcgccgccaccacgtgcgagggggacgcaaaccaggaccttaccgccctcctctgcgatgaatccaccaccgccgcgcccggcgccggttccaggaagaagcggccgaacagcggcgcgtcgagcatcccgtccggggtgcggctggagaacatctncaagtcttacaagggagtgacagtcctgaaagacgta

SEQ ID NO: 5561 - DNA, 112 bp, Triticum aestivum
  unsure (1)...(112): unsure at all n locations
  Clone ID: LIB3281-028-P1-K1-G4
cggacgcgtgggtgaaaaccataaaacataacccaccatcgagcgtcancgggtcggcgcgtgccctagctcgcagatacctcagccgtgtagctatgctcatgccgccgac

SEQ ID NO: 5562 - DNA, 318 bp, Triticum aestivum
  Clone ID: LIB3281-028-P1-K1-G5
ggttactgtaactggtgcaaataatgaggcagacgcaggtaagattgctcgtgcagtgtcagcgtcctccttggttaaagctgctgtatttggccgagacccgaactgggggcgcattgcttgctctgtcggatattcagggattcattttgatgcagatcaacttgatatttcccttggagttattccactaatgaaaaatggccaaccactcccttttgacagatctgctgctagcaagtatctcaaagatgctggtgacatccatggtacagtgaacattgatgtatcagttgggaatggatgaggcactggaaa

SEQ ID NO: 5563 - DNA, 400 bp, Triticum aestivum
  Clone ID: LIB3281-028-P1-K1-G6
cattgttcaacctcgtccgcgccgccatgtccacatcgtcttcatcttcccttcctgtcccagccgattggctgctccctttgatggcatgccctctctgcagcgacgaggcccgtcagtgacgtttctttgagttccagcgcgcatactgcaggaggatgatccacgagcagatccttgctgcgcagcatcaagcgggatggcaccgagcggggcacggatttgcagtccagcacggcatcggagctgcccagattgttcccgctgccatacaaccccaagagtacaggttgctctgcatacttgcggatagaaatttctagtgcgctcatcctcgacgggcaaggcacccggtcaggtggtgcactttcaagcccgagcctgcatattaagaagcaaa

SEQ ID NO: 5564 - DNA, 395 bp, Triticum aestivum
  Clone ID: LIB3281-028-P1-K1-G8
cgcccccggatccgctgctccaccccccaactccgttgccacacgcccttgcacaagcgagcgagcagaccatgtcgccggcggagcagacgcgagacgagagcgtctacatggccaagcttgcggagcaggccgagcgctacgaggagatggtggagttcatggagcgcgtcgcgaaggccaccggcggggcagggcccggggaggagctatccgtcgaggagcgcaacctgctctctgtggcttacaagaatgtcatcggggcccggcgcgcgtcctggaggatcatctcctccatcgagcagaaggaggaaggtcggggcaacgacgcgcacgccgttaccattcgctcctaccgcagcaagatcgaggccgagctcgcaaagatctgggac

SEQ ID NO: 5565 - DNA, 175 bp, Triticum aestivum
  Clone ID: LIB3281-028-P1-K1-G9
gctactgcatgatgaatcaaggaaacaagtggtacgcgtacaccgcaaggagggaaaatgcaccaaaggagcgttccctcatatacactgggattgatgtaccccgaggaaagaagaaggccctgcatgtgcccttcatgctgacgagaaggctaatcgaggcacaccaagccat

SEQ ID NO: 5566 - DNA, 390 bp, Triticum aestivum
  Clone ID: LIB3281-028-P1-K1-H1
ttcagtatgcgcgccgccgttcacatccctcccgtcctcctcccgtaggcggagccacccggacgctcgagccccgaaccaaccatggcggcagcggctggagaggcccctagggcgctgccccagaaggagcaggacatacagatgatgctcgccgacgacgtccacctggtcaccaagaactgcaacttccagatggagcgctacgcctacaagcgccgctccgacggcatctacatcatcaatctgggcaagacatgggagaagctgcagctcgcggcgagggtcatcgtcgccatcgagaacccccaggacatcatcgtgcagtccgaccgaccctacggtcagcgcgccgttcttaagttcgcgcaaaacaccggctccaacgcc

SEQ ID NO: 5567 - DNA, 428 bp, Triticum aestivum
  Clone ID: LIB3281-028-P1-K1-H10
cggacgcgtgggcggagagcagaagaagtggttgatccaatcctcgaggttaggccaacaattagggcacttaagcgagctctgttgatcgcactaaggtgtgttgatcctgactctgaaaagagacctaagatgggccaggttgctaggatgctggagtctgaagaagttccatttcgggaggaccggagaaaccggaggagtcgcacaggaagcatggacatcgaatctattacagagggatcaacttcggctgaatttgcaatcaaggtagaaaggactggcagctcaagatcagaccggtctcagacctgacgtatacgggtctgtcttgcatcatgagcactcacgctcgtttatcagtccgagaaacgatgttcatcaccaaggtgattactgccccgaatccgtgtaggaaatattagtgg

SEQ ID NO: 5568 - DNA, 197 bp, Triticum aestivum
  Clone ID: LIB3281-028-P1-K1-H11
ctgactcgtcgtctgactcgtgaggattttattgcctcctccctcaatcgggggctgagtattccgtgatgaaggttactcacgctttcttgtcaaaactaaaatggggcggttcgtactttaagaactatcatactgtcggagtaccaactacccaaatgcgcttcacctatatcgaattacgcgccatccacata

SEQ ID NO: 5569 - DNA, 411 bp, Triticum aestivum
  Clone ID: LIB3281-028-P1-K1-H12
cccttccgcccacccgtccggccgtcttcgtcctcgcctttttccgagcaaccgagcctgggccctcctccttccccatttcgccagcggggcagcccaccaaccacccccacccgccgccatgagggagtgcatctcgatccacatcggccaggccggcatccaggtcgggaacgcgtgctgggagctctattgcctcgagcatggcattcagcctgatggccagatgcccggtgacaagaccgttgggggaggtgatgatgctttcaacaccttcttcagcgagactggtgctgggaagcacgtcccccgtgctgtcttcgtagatctcgagcccactgtgattgatgaggtgaggactggcccttaccgccagctcttccaccctgagcagcttatcagtggcaagga

SEQ ID NO: 5570 - DNA, 387 bp, Triticum aestivum
  Clone ID: LIB3281-028-P1-K1-H2
cggacgcgtgggtttttttttttttaaaaaaaagtaaacatatttgacaataaaatgtacttaatacatgataaacattgtgtacaagagaatggtcaattaaatcatataatttggttctatacaaaaggaaatttcctcttttgtgtacatcctaaagaccacccccttgtgatgaacgctttatccttcgagtcaaatggcacagctcctgtcctttgtggcaaaataatacccatcaatgtccaaagcaaaaagattatgtaatgcatcgcaactgattgattgtttcatctacgcaactacaaatcgtgtcttcaaaaggttgcagaagctctaaacttctccggaatagctgcaacagaaaagaataagctataccagcag

SEQ ID NO: 5571 - DNA, 410 bp, Triticum aestivum
  Clone ID: LIB3281-028-P1-K1-H4
gcatatggctgtagcagataaatggatcgaactgctcaagcaaagtgacgaatgtgtggaaaatgggcgatattgtgcacacccttacaaatagaaggtggcttgagaagtgcgtcacttatgcagaaagtcatgatcaagcactagttgttgacaagactatgcgcattctaggtgctggataaggagccgtatcatctactggctctagttctgcctgaaatgcttcgccttgtgcaactgcatgccgtagatgacgtgcggcaacattgacaagtgccacgtgtaccgtgacaagaccaccccccactttgcgctcatgattcccaagtgcctatgatccatcagcaccctccatccaccctccggtcgtgatgacgcttgcctagcatgtacctgaactttttgca

SEQ ID NO: 5572 - DNA, 430 bp, Triticum aestivum
  Clone ID: LIB3281-028-P1-K1-H5
cggacgcgtgggcggacgcgtggggattgaattgccttcttcctcaattgacatctcatattccgtgatgaagggttctcacgcttcctcgtcaaatggaaaaaggggcggttagtagttcaagaactattatactgttggagtaccatgaacccaaaggagctacacctatgaggaatcaagtaccataaacatatttatgggatggtcacattgagagttagtaaagtttacggtttgaagatttaaggtagtagtggatgctgatggtggaggagacgtgttgaactttttgagagagatgggcttgcttgttgcttcaatactgataaatcaacttgggttatcgctgcaaaggaagcctctcaaatggaaactgaccttgggacgtaatggatgccgattagggatttctggaccattgaagagc

SEQ ID NO: 5573 - DNA, 429 bp, Triticum aestivum
  Clone ID: LIB3281-028-P1-K1-H6
gcgtccacgcgtgcgcccacgcgtccggccttactgtcaccggcggcggcgccctccgtggctcgccctcttctcctactctgctgacggccggctccaccacgccacaaaccccgacgacccaccccgtctctgtgcccgcctcggcaaccacctccgtcgcgcgtctgagtcccatccgtgtccgcgccggctccgtctctgtctcctttcgtgggaggtgatccgcacccggacccgcggcggggcaggggtggcgacggcctcgtgtagatcccatcctgatcccgtagcagccagtgtagccgcccccacctgctctcctctgctccgggatccatccatccactagggttctgcggccgaccggagtccaggccatggcgcgggagatgctcaaggacggggaggcgcccgccatcgcggacg

SEQ ID NO: 5574 - DNA, 265 bp, Triticum aestivum
  Clone ID: LIB3281-028-P1-K1-H7
cggacgcgtgggcagaggaggaagaggatggccaccatccacgtcgccgacccgcacggcacgcgcgtggtcggcgcgtcggtgtctgtggagcagacgtgcaaggacttcccgctggggtcggcgatcgcgtccaccatcctgggcaacgacgcgtaccagaagtggttccgggagcggttcaacgcggcggtgttcgaggacgatgctaagtggtactcgacggagccggcgtctgggctgctccggttcgacgtgccagacc

SEQ ID NO: 5575 - DNA, 265 bp, Triticum aestivum
  Clone ID: LIB3281-028-P1-K1-H8
cggacgcgtgggcagaggaggaagaggatggccaccatccacgtcgccggggcgcacggcacgcgcgtggtcggcgcgtcggtgtctgtggagcaaacgtccaaggacttcccgctggggtcggcgatcgcgtccaccatactgggcatcgacgcgtaccacaagtgtgtggtgctgcaaggcaagccggctgtgtttgaggaccagctcaagtggtactcgacggagccggcgtcggtgctgctccggttcgacgtgcctgacc

SEQ ID NO: 5576 - DNA, 283 bp, Triticum aestivum
  Clone ID: LIB3281-028-P1-K1-H9
ctgacgcgtgtgcagacagcagattaagttgccaatccaatcctacaggtggggccaacaattagggcacttaagccagctttgttgatctcactaacgtgtattgaccctgactctgaaaatatacctaagattgcccaggtctctaggatgctggaacatctagaagtaccatttcgacaggaccggagaaaccgtaggagtctcacaagaagcatggacatggaacttatctcagagggatcaacttcggctgaattcgcaaatcaacgttgaaaggact

SEQ ID NO: 5577 - DNA, 340 bp, Triticum aestivum
  Clone ID: LIB3281-029-P1-K1-A1
tggttttttttttttttttggcagaagaattcaagggtagaccacttcaatttccatttcatcccaggactactacatccaagcaacaacagtcaaggccaggacatacagcagcgagatgcagccattacaccgaagcccatgaacaatacacagccatagctagctacgagcacaaatatggtggtggggggatcgattcgcgtggcctagccgccgaatccgtagagggtgcggccctggcgcttgagggcgtaaacgacgtccatggcggtgaccgtcttgcggcgggcgtgctcggtgtaggtgaccgcgtcgcggatgacgttcttcaggaaga

SEQ ID NO: 5578 - DNA, 346 bp, Triticum aestivum
  unsure (1)...(346): unsure at all n locations
  Clone ID: LIB3281-029-P1-K1-A10
cggacgcgtgggggcgcttcaaacttttgtttctcaatggcatccttccagctggtactggcaacgatcttgcgagggttttgtcttggggtggtggtcttggtgttgttgaaaagcggggaggtttattctcagttttgaaagatgtcgagcatgccgcagntactgttctggacagatggaagatcactataaaggacaatcaagggaagctcatgtgttcaccaaaatttatgaacaattactttggggttggttgtgatgcaaaggttgctctagatatccacaacctgagggaggaaaaccctgaacggttttatagccagttcatgaataaagtgcttta

SEQ ID NO: 5579 - DNA, 262 bp, Triticum aestivum
  Clone ID: LIB3281-029-P1-K1-A11
acgtggacaccttgtgacacttcaatcttttgtatatgaatagcctacttggagcgggtactgtcaacaaaataaacacggtacacttgttggagtatcacactggtgttgggacagtgaatgccaccagttttttcagtcatgaatggtgaaagaactggcaatattaagtttcgctgtgatctgaggatggcattcttatgcgcgtctactctgtggcgatgagaaaaggttgttttcatcacccttttttagagatgtt

SEQ ID NO: 5580 - DNA, 395 bp, Triticum aestivum
  Clone ID: LIB3281-029-P1-K1-A12
agatcaaccacagactcacagtaggactagcttcagctagcctgcagcgtctgccactccgggcattttcttgcatcaaccacggcaatggccaccgctgatgtccagaacccgacggccgcgctgacggaggaggcgcccgcggtggagacgcccgtcgccgccgaggaggttgctaagacagaggaggtccccgcgccggtggaggccgaagtcgaggcgcctgcccccgtcgaggttgaggcgaccaaggaggaggcaccggccgccgccgagacggaggagaccaaggagcccgagccagcagctgctgccgagccggaggccgaggcgccgaaagagccagccgtggtcgagacagagaccaaggaggcggtggcagaagaagtgaagga

SEQ ID NO: 5581 - DNA, 146 bp, Triticum aestivum
  Clone ID: LIB3281-029-P1-K1-A2
cggacgcgtgggttcagatatgacaccccctttccgcggagctgtcgattaaaatgtcgggtcgagagcatagagagcattcagttcagttcacctggaacttctcttttaacactcttcattcaaaagtccttattcttgttgtc

SEQ ID NO: 5582 - DNA, 366 bp, Triticum aestivum
  Clone ID: LIB3281-029-P1-K1-A3
acatgctccatacttcagtcgacagacccaataatacactggctgtaatcagcatgaatgaatcccttttaataatttgtcatgtaaccaaaaatagagattgacccctcctatggtgaaatggtaaatccgcagcaatggctaaaagagacaacaaatgtacatacaacaacacagcaggcatatagtatctcatcaccactctgctactactggactggagtagtaaaacttaccgcagggacagggtcagggcaggatggggtccagatccctccttaagtacacagaccaccaaccaatcaatcaaaacgatgaagaagatgagggcagagttgcattcatacggatcagagcagactcgca

SEQ ID NO: 5583 - DNA, 339 bp, Triticum aestivum
  Clone ID: LIB3281-029-P1-K1-A4
acgcggacgcgtgggcaatcccacctactccacctctcgccggagccccagcaaggagcaggcaaggaagatggacgccggcaagctgaagaaggtggccgggaagaagttcggcgggccgaggaagaagtcggtgaccaggtccgtcaaggccgggctccagttccccgtcggccgcatcggtcgcttcctcaagaagggccgctacgcccagcgcgtcggctccggcgcccccgtctacctcgccgccgtcctcgagtacctcgcagccgaggtgctggagctggccgggaacgccgccaaggacaacaagaagagtccgatcgtgcccaggcacct

SEQ ID NO: 5584 - DNA, 346 bp, Triticum aestivum
  Clone ID: LIB3281-029-P1-K1-A5
gcgagctgtcaaacctctcagagtgcactaaaattcatacgaaaagccaaccgagtacggtcacggtaaaaaaaaaaaacacggtacacttgtgtaatgatcacaatggtgtggcgacagtgaatgccaccagcttcttcagacatcaatggtgaaagaactggcaatttaagttccgctgtgaactgaggatggcattcgtatgcgcgtctactctgtggcgatgagaaaaggcagttcccagccccctctcctagagaagtaatctgagtccagggacactgccagagcaagagctacgggccttttaggtaaacttagcgggcgaacaaacgtttagtttttt

SEQ ID NO: 5585 - DNA, 81 bp, Triticum aestivum
  Clone ID: LIB3281-029-P1-K1-A6
acgcggacgcgtgaacgaccgaattagagaaggtatagcataaggtaggcttgagggggtggcactacggtaagtgtattg

SEQ ID NO: 5586 - DNA, 211 bp, Triticum aestivum
  Clone ID: LIB3281-029-P1-K1-A7
cgtggagctgtcgattaagatgtcgggtcgtgagcatagagagcattcagggcagttcacctggaacttctcttttaacactctgcattcaaaagtccttattcttgttgtcaagaaaaaaaaaaaagggcgggcgatctagaggatccacgcttacctacgcgcgcatgcgacgttatagctcttctatcgcgacacctgaagtgagtgg

SEQ ID NO: 5587 - DNA, 55 bp, Triticum aestivum
  Clone ID: LIB3281-029-P1-K1-A9
gggacgcgtgggccggcggcggctcgtagcacaagaaaagggacaggcgggggtg

SEQ ID NO: 5588 - DNA, 425 bp, Triticum aestivum
  Clone ID: LIB3281-029-P1-K1-B1
ggcccgattcccggttcggcgctacgacctcacgcgtatcgaaaagccttaagtcactgcaggctcaattgacacaaactttagcaggtatcggtattacccgtactcgagaagtatttcaccttaaacggtctctgaacctttgttagtggtgaggagtaacatgtaacaggctcacagccctggctcactggatgcttggcaagctaggggtagctttaggccccaagccatcatctgatgctcacaaggccagggagcgccaaactctgatcctgatcctgaggcacagactgaaatatgctctcacctacccaggagtgcagtctattcttatgcaacgccatatcatggttgatggaaaggtccgtactgacaagaccttccctgctggtttgatgggcattattttcatttccaagact

SEQ ID NO: 5589 - DNA, 423 bp, Triticum aestivum
  Clone ID: LIB3281-029-P1-K1-B10
cggacgcgtgggggtgtccgtacctacccaatcccaatccaacatagggagggggggtcgctgaccctcaccgtagacgccgtggattccccccgctgaccttcgccggagctagccggactcgtagggtttcttcagttgtcctctttcctgctggagatccgcaccctaagaaggaaggaagggaggaaggaagcaatttgagttgttgcaaaattattatattacattttttactctaacaattttctaacttataccttatcttaattattattcactacatgagttgctattataatctatatattaatctttattatctttcatattatatatatcatctatattttatatatctatactatattttcatatctttcttcattatattcttatatatatatatttatcatctatcta

SEQ ID NO: 5590 - DNA, 406 bp, Triticum aestivum
  Clone ID: LIB3281-029-P1-K1-B11
ggacagcacatctgaacttaacaacagagagcgcccctgttgagagtcgagcgagagaagcacgtcccggcccgatccccaatcttccccggcggcgatgccggctggaggagagaagggagaggagcacggaggagctatgtatatattaagtctaagttgagtcttacccctgtggcgtctggcgctatgccgaggtggagcgtaccgccgccgcgttcgagcagcggccggtggttagcggtggctgcagtcctggctgcgctggtgtgccagttgcttgtcaggagtgggttgccggtgacttcacgaataagctcgtttggtccgctgatctggaggaggtccttattttcctctgctttcaaggttaccattgtggtgaaggaggaagagaggaaagatt

SEQ ID NO: 5591 - DNA, 356 bp, Triticum aestivum
  Clone ID: LIB3281-029-P1-K1-B12
cacgcccgtccccgcccacgcgtatcgctggacgtctgtgggcttgactccgtgggacaaagcctcgccagcggcgtggtctcctaactcagcgctccgcggcagcaatctctcggcattggcccccgcaccaaagcagacggtcgaggtaagtccaaccggcggcaacggcgccgaggaagcagctggccaccaaggccgcgcgcaagtccgccccggccaccggcggcgtgaagaagccccaccggtttcgccccggcaccgttgcgctccgggagatccgcaagtaccagaagagcacggagctgctcatccgcaagctccccttacagcgcctcgtccgggagatcgcccac

SEQ ID NO: 5592 - DNA, 251 bp, Triticum aestivum
  Clone ID: LIB3281-029-P1-K1-B2
gtaattttccaggtatacatcaatgaatcgactccggcatgctcatttctgggtaatgcaagaaggagtcctatataagtatacagtgttcaaagggaactgaacatgcacgagttgatagaaataagtcatatctcgggagcagcacaacatctcaagctaccttgatggacaacaatcctcccatgttcatgaatttacgtttatccaagattgcaagtgcttcctccaaacttgattaaatgcttggt

SEQ ID NO: 5593 - DNA, 286 bp, Triticum aestivum
  Clone ID: LIB3281-029-P1-K1-B4
cggcgccacgcctacccgtgcgtatatagcacacagacatacaaagttactagcttcagctagaccacagggacgggcaatccgggcatgtgtcgtgcatcaaccacggcaatggccaccgctgatgtccagaacccgacggccgcgctgacggaggaggcgcccgcggtggagactcccgtcgccgccgaggaggttgctaagacagaggaggtccccgcgccggtggaggccgaagtcgaggcgcctgcccccgtcgtggttgaggcgaccaaagaggaggcac

SEQ ID NO: 5594 - DNA, 162 bp, Triticum aestivum
  Clone ID: LIB3281-029-P1-K1-B6
acgcttctcctccccttacggttcgcgtgtactttttcgattccccttcacttccggggagcggcctaattacctaccctactctaccccaatcttacacagcatcgatgcctcctggaggaaaacaaggtagaggatcaccgatgagctatctatatatta

SEQ ID NO: 5595 - DNA, 142 bp, Triticum aestivum
  Clone ID: LIB3281-029-P1-K1-B7
ggtaccgagatcccgattccagctacgacctcacgcctatcaaacgagtccatgaagtatgagtcttaatggattcaaacttttaagggtattgttattacgagtactcgataagtatttcctattaaaaggtgtctgaaaa

SEQ ID NO: 5596 - DNA, 277 bp, Triticum aestivum
  Clone ID: LIB3281-029-P1-K1-B8
gtaattttccaggtatacatcaatgaatcgactcctgcatgctcatttctggctaaggcaagaagcagccccatttccctatacagttatcgtaaagaaatgagcatgcaggagtcgattcattgatgtaattttgcaggtgtacattccaccttacatgtgacattcatgaacgaacacattccactttgttagcctctgaaatcacagaagtggcaaaatgtcctttggttataaaaaaaaaaaatagggctgtcgttctagatgattcaagctt

SEQ ID NO: 5597 - DNA, 114 bp, Triticum aestivum
  Clone ID: LIB3281-029-P1-K1-B9
actgtagaggattcaagcttacgtgcccctccatcccaacgaatatgttttgtatcgagatacctcaaatcaatacacttgccccaattaaacaactgttggcctggcaaaaca

SEQ ID NO: 5598 - DNA, 415 bp, Triticum aestivum
  Clone ID: LIB3281-029-P1-K1-C1
acgcccacgcgtacgctgggtgcaatcttatggatccaggtgcgtcaagccaccgattaggtatggtgacgtgagccgccccaaccccatgactgtgttctggtccaagatggcacagagcatgactgctcgcccaatgaagggaatgttgacaggccctgtcacaatccttaactggtcttttgtcagaaatgaccaaccgaggtttgagacttgctaccagattgctcttgcaatcaagaaggaggttgaggatcttgaggcaggcggtattcaggtcatccaaattgacgaggctgctttgagagagggtctgccactccgcaagtctgagcacgctttctacttggactgggccgtgcactccttcaggatcaccaactgcggtgttcaggacaccacccagatccacacc

SEQ ID NO: 5599 - DNA, 348 bp, Triticum aestivum
  Clone ID: LIB3281-029-P1-K1-C10
tcgcggacgcgtgggcataaagaaatcccctacggagaaagttccggatgctccgagagaatcgaatgggcaagaacctgatgacattgccagtggttctgatgctacggctgcttctgtggaggaacatgacaagtctgatgaaacccctgtttctacacctgctgaaagtaatgacatgactgctgaaattcttttcaatccaaatgtatttacggagtacaagcttgctggcagtcctgaggagattgaagtagatgaagctttggttaaaaagggtggttcgtatctgctagataccgtgatcccaaaggttggtcaagaactttgcttttttggaggcttccc

SEQ ID NO: 5600 - DNA, 315 bp, Triticum aestivum
  Clone ID: LIB3281-029-P1-K1-C12
cggacgcgtgggcaaaagcgaagagagaggagaggagagagagcccccagcgtacaagccaccggccaccaccagatgtgagacgaacagagccaagccgacgagggtagttttaaaactctgcgccgagaggagatttgcggactgcggaggaagaccaactgggtgaaattctgcgtcggcgcgggggcggccaatgggaggggcggaggcggccgtcgtggaggccgcgtcgaccgctgcggcagcggaggccgctgagggcggagaggacgggcggatggaggggtggctctacctgatccgatccaaccg

SEQ ID NO: 5601 - DNA, 276 bp, Triticum aestivum
  unsure (1)...(276): unsure at all n locations
  Clone ID: LIB3281-029-P1-K1-C2
cggaanngcagatgtcgacccacacctacgcgcacgcccacgctttctataatatatcttttccaaaacactaaaacaatcgggttctgcttaattacaagaggccacttccccaacaacatcactttaattatcaaacttccctttgctaccaatattatatcatctaaatagaaactctatctttcttattcaaatccttaactgttaatattactaaaaatcatcaacttaatccttatatttactaccatattttatattcaattaataact

SEQ ID NO: 5602 - DNA, 345 bp, Triticum aestivum
  Clone ID: LIB3281-029-P1-K1-C3
ctacgcgtacgcgtgcgtttgtatatggtcgcagtggcgtgagctttttcattactgcatctgtttattcaaactcaatttttctgttgttgtggagaggaagatcataagctcttccatacatattcattaccttcactaaaaaaaaaaaaaaagttctttccctctaatagtatccaagttaacctacgcgttcatcctacttaatcatttttactatagtttcacctaaatttaattaacttcctcttcttttacaaccatgtgactggaataactccttctctacccaactgtatttcctttcatcaaatttccattttcttcttctttcattataactat

SEQ ID NO: 5603 - DNA, 271 bp, Triticum aestivum
  Clone ID: LIB3281-029-P1-K1-C4
gttcagtttgcctggatgattgcccttgtactactctttcagaaggaagggggtaggtggagcaaaaggcacgaggagaaaggagtaacgccatagggacgacgttgtcggcagcgcctttgaaaggattcgccatggagaagctacggtggctgaccatcttgctcgggaagtgggaaggatgtcattcggaacgccccttggttctaggggcgtgcgtccataccgtggccggagtggtcacaaggtgttatttttgtgcattttttca

SEQ ID NO: 5604 - DNA, 341 bp, Triticum aestivum
  Clone ID: LIB3281-029-P1-K1-C5
cacttggcagcaactgtccatgaaggggttcgccggcgacacggccaaggcgcgcgcgaagacgagcatgatcgccggggagggcctcagcaacatccgcaccgtggcggccttcaacgcgcaggacacgatcctggccctcttctgcagcgagctgtgcgcgccccagatgcacagactgcgccggagccagatcgccggcgtgctctacggtctctcgcagctctccctctacgcctcctaggcgctcatcctctggtacggcgcccacctagtacgccaccacgttttcgccttcttcagggttatcaaggtctttgtcgtacttgttattaccggca

SEQ ID NO: 5605 - DNA, 192 bp, Triticum aestivum
  Clone ID: LIB3281-029-P1-K1-C6
cccacacctacacactcctaaacaactacccataaattcctattcctaccacacaaacaatccgcactcgataaattttactacccccctcttatttcatacttcacattcaaacctccttattctattttaaaaacttttccctcaaataaaattactttcttctacttaaaacccaccatattaaaatcc

SEQ ID NO: 5606 - DNA, 312 bp, Triticum aestivum
  Clone ID: LIB3281-029-P1-K1-C7
acgcggacgcttggtccaagtttatatatgcaaaatacttgcctacttgaagatggttaaaatcgagagatccttgaactaattttcatgtatacaatatcactagcttacatatcttcactggacaccacaatgaaacataaacattactgtccctgaaacaatccttaactggtgttttgccaaaaatgaccaacctgggtttgggacttgctaccacattggttttggcatcaaaaaggacggtttggatcttgtggcgggccgtattcatgttatccaaatagccgaggctgatttgtgagagggttt

SEQ ID NO: 5607 - DNA, 282 bp, Triticum aestivum
  Clone ID: LIB3281-029-P1-K1-C8
acgcccacgcgtccgtacggttaccgttgtgtcttcgccaggacatccggtgacgacgccatcaaagtcagccacaaccccgacaacggcacctcaaggatcaagctcccctctggtgccaagaagattgtcccaagcagctgccgtgccatgattggtcaggttgctggtggtggcaggactgagaagccaatgctcaaggctggtaacgcctaccacaagtaccgtgtgaagaggaactcgtggcctaaggtgcgtggtgtggccatgaaccctgtggag

SEQ ID NO: 5608 - DNA, 388 bp, Triticum aestivum
  Clone ID: LIB3281-029-P1-K1-C9
cccactccttcaattgcttaattttacgtttcatgccaagaaacaggggtggggggtttccaccgcacctatataaacctcgaccaaccctagccgttatggcgcgcctttgatgctcacaacctgggccatagatctgcgacaggggccttccttcttcacccaggcggagcaagtgcctagccatctgaagatttgcagtaacaagcgccggatgaggagaggacaagtaccgcgacccgcggggcaccccagctcgacctttccggctacgttaacgccccggacaagatcaacatgacctctccgcctcttcagttcaatggaagtggaccaccgggaccacacgcttcagcccgacaagcttgactagctctatggtcaagtt

SEQ ID NO: 5609 - DNA, 359 bp, Triticum aestivum
  Clone ID: LIB3281-029-P1-K1-D1
acgcctcggccccgtcctccacttccccacctccacctccccgcccaagatccagggctagcgcggttgcaccggcccgatggaagcggcggccaaccctagccgctatggcgcgcctctgctgctcacgacctgggccatggatctgcgacaggggcctccctcctcctcccaggcggcgcaagtgcctcgccatctgaagatttggcgtagcaagcgccggatgaggagaggacaaggaccgtgacccgcggggcacccgagctcgacctctccggcgacgtcaacgccccgcacaagatcagcaggacctctccgcctcttcagttcaatggaagtggaccaccgagaccacacgc

SEQ ID NO: 5610 - DNA, 71 bp, Triticum aestivum
  unsure (1)...(71): unsure at all n locations
  Clone ID: LIB3281-029-P1-K1-D11
acggagcactgaggaggcagtagctagcgttgcgggttggcggagatggggtggtggaagaacggnncctt

SEQ ID NO: 5611 - DNA, 210 bp, Triticum aestivum
  Clone ID: LIB3281-029-P1-K1-D12
cggacgcgtggggtcggcagctgcatatgcgtagtacgtggtccggtcatgcgtgccgtgtcttgtaattcggtccatgggatcgcttgtcttaattagcccgcattgcttttcctacttgtatttaaatttagcgaccatatgtatgatcgatccaacgtcgccacctttctatctaagtcatcaatccaccaagcaagtgatcatccc

SEQ ID NO: 5612 - DNA, 189 bp, Triticum aestivum
  Clone ID: LIB3281-029-P1-K1-D2
acgcgtacgcatggtcctacacttgttttcctagaactactcagtaactatagggagggcgtggctcactcctttggttttaacccaatcttaaacccttagatatggaggtgatcatgtgatgaacaccattatgtatatttattgttgaacactgcctttttccttctattatatcaaccatgttac

SEQ ID NO: 5613 - DNA, 306 bp, Triticum aestivum
  Clone ID: LIB3281-029-P1-K1-D5
aaccccctcttctctgtcggtgaggaactccactagagattgcgttttggggctcggggctactgtcgctcgatctggcctcccccgctcagttgttgccccatgctccggatcatgccacagcaggcctcgccctgaccaacaggctcggatccatcccttccctcctcctggcctccacatgcgtagactgtggcgccagatcaagggagcctgccaatggaggtcgccgtctttccgtctcgatcggtccgtcgccggatccaccatgctgtgccatgggatgggcgccttgcatcttgctcc

SEQ ID NO: 5614 - DNA, 323 bp, Triticum aestivum
  Clone ID: LIB3281-029-P1-K1-D7
caatttcagaagctggtaatttagctgatgcgaagtctaccagtatgcagccgtgcgcaagtgcagcatggttggaatcggtttccaaccctaccttctatggctcgcctctgctgctcacgacctggtccatgtatctgtgacaggggccttccttcttctactagtcggaacaagtgtctcgccatctgaagatttggcgtagcaagcgccagatgaggagaggacaaggaccgtgacccgcggggcacccgagctcgacctctccggcgacgtcaacgccccgcacaagatcagaaagaccttttcgcctttttaattta

SEQ ID NO: 5615 - DNA, 252 bp, Triticum aestivum
  Clone ID: LIB3281-029-P1-K1-D8
ctacgcgtacgcatgaaaccacacgtgatcttacatagtaatactcagcagctagagggggggggtggccaactactgggggtgtaacctaattttaaacgcttgatatggaggtgatgatgcgatgaacagcattatgtattcctgtggtagaacactgtttgtatcctgcgattgcattaactttgttactgttacttttgattactgtcaactgatggttcagttgttgaaaggaatttacatgattcc

SEQ ID NO: 5616 - DNA, 328 bp, Triticum aestivum
  Clone ID: LIB3281-029-P1-K1-E10
cccacgcgtccggattactgatgcaattaaggatggagttggccgacgcacggcctgatttcttctggcgctgtttcccagatggaaaggatctttatgataatgtcactactggtgttctgtgccatggagagaagagtgtcatcaaagaaggtcacaaaagcttcccaagtggacactcatcatggtcttttgccggcctaggcttccttacgtggtacttgactgggaaaatcgcagtttttgaccgtaaaggtcatattgcaaagctttgtattattgttctgcctctacttactgctgcacttgttgctgtttctcgagtgga

SEQ ID NO: 5617 - DNA, 406 bp, Triticum aestivum
  Clone ID: LIB3281-029-P1-K1-E11
ctgagttatatccatctgactgtttgtagatccacgaacctttgtgggcaggctctgcctattctttcatttgcaataacatgagttattctgaattgatcatttgatgttaccctagcagtgcctccatagaaaattaaatctagttgatgttatcctttgatcaacttctgcaaacataaggagctagttggtctcgctccaataatacatggattaccatttggtctatgtgtttagatgagggtcactatatacatctgcagattagcatttatcattcagattttcaatttacatttgcaaggtatgtgatttgatttatctggaggtaagttgtgctttctgtcggttgcaattactatatgctccaagctgtggcaacaatacttcaaaattatttttc

SEQ ID NO: 5618 - DNA, 411 bp, Triticum aestivum
  Clone ID: LIB3281-029-P1-K1-E12
gcgcaaacacctccctcctttcaccttacctgcattttggtgagctgagtgtgcgcaaggttttccaccttgttcgaatgaagcaactcgtgtggagcaatgagggcaaccatgcagctgaggagagctgcactctgttcctccgatcggtcggtctccgggagtactcgcgatatctttgcttcaaccatccatgcagccatgagaagcccctccttgcacacctcaggttcttcccttgggtggtcgacgaaagcaccttcaagttttggcgccagggacggactggctaccctcttgttgatgctggcatgagggagttgtgggcgactgggtggctgcatgatcggatacgtgtggtgggttcaagttttttcgtcaaggtccttcaactaccatggcgatggggga

SEQ ID NO: 5619 - DNA, 255 bp, Triticum aestivum
  unsure (1)...(255): unsure at all n locations
  Clone ID: LIB3281-029-P1-K1-E3
cccacgcnttctttgcaccatcacacgaactactctacacaacaatggcaacaactacgcgagggcgaactccaatttgagcaggctcaccccacttcacgaatcatctaaggtggctatctatatcaaaatgaagacatccctatatttcaaaatcatctttacttacacccctaaaataacaatcacgcttatccacatgcatcctactctccttccgaaactccaaactgttgcccacgacacctccaagta

SEQ ID NO: 5620 - DNA, 319 bp, Triticum aestivum
  Clone ID: LIB3281-029-P1-K1-E5
cggacgcgtgggtgataagggagatttgattacagcaaatgaggtcagtccgagctgtgatttttacaggaagacagtctccatacataaacggggcattattttttcttttaagaggatgtctatggaatctaaactaagatttaaactaaagaactttacaaatgcatcctaagcgcacacttctatttacattttatcttcaaacatgttctatacagttttccttagttccattaattcttctaattctctacatattatatttcttttttctttgtatagtattatgttttttatacttctcttactaaatatt

SEQ ID NO: 5621 - DNA, 78 bp, Triticum aestivum
  Clone ID: LIB3281-029-P1-K1-E7
cggacacctgcactatctcaggtttactaccacatgcattacttgggctggggttctgttcggtgatcagctaaactt

SEQ ID NO: 5622 - DNA, 94 bp, Triticum aestivum
  Clone ID: LIB3281-029-P1-K1-E8
gttctcctacctaccagcgaaacttcacctccccgcacctactacgtgtgggggcgtattaaaatccatggctcccaaagcttataataagcct

SEQ ID NO: 5623 - DNA, 410 bp, Triticum aestivum
  Clone ID: LIB3281-029-P1-K1-E9
gcgcgccgccacacgaacccccccacccaacccgagcgagcaccgggcgagggggaagaggaaggtgagatggctcgcggcacggcggccacggcggcggccgctgccaagggcaagaagaaggggtccgtctccttcgtgatcgactgcaccaagcccgtggaggacaagatcatggagatcgcgtcgctggagaagttcctccaggagcgcatcaaggtcgccggcggcaaggccgggaatctcggcgactccgtcaccgtcacgcgcgacaagagcaaggtcaccgtcaccttcgacggctccttctccaagaggtacctcaagtacttgacaaagaagtacttgaagaagcacaacgtgcgggactggcttcgtgtgaacggagccaacaaggagcgcaacgtgta

SEQ ID NO: 5624 - DNA, 383 bp, Triticum aestivum
  Clone ID: LIB3281-029-P1-K1-F1
cggacgcgtgggggctctggtccaatatgagctcctggaaagtttgatttcagcaggggcttaatgaatgttgttttccctgtagaatattgacccaagagcataaccattggcttcgcatcgaagtcactgttcgtcagcaatggagaggcaaaatcattgaaccggtatgcaacttctaaaggcttcagtttttcgatgtacagtcttttcaagccatcaattacagaagtaacagcagtcagaggcgtttgaatcttctttgcagatttggaactgaaccagctgttttgagaaggtgcttgcacctgaggggtgccattttcttgtgggcgaactacattcacaatagccattgatctaggtactttgtttggtgcaac

SEQ ID NO: 5625 - DNA, 313 bp, Triticum aestivum
  unsure (1)...(313): unsure at all n locations
  Clone ID: LIB3281-029-P1-K1-F10
cccacgcgtccggagggcgagtcgtcgtcggagcagatcgaccgggggggcgtcccggcgatggggaacgcgtcntctatgctgacgcagtacgacatcgaggaggtgcaggagcactgcagctacctattctcgcagcaggagatcgtgtcgctgtacgagcgattctgccagctcgaccgcagtgccaagggctttgtcgccgaggacgagtttctcttcatcccagagtacttcaccaacccgcttttccagaggttgctacatattggtgatggattgaaccttaaagaaattcgttttttttttttta

SEQ ID NO: 5626 - DNA, 248 bp, Triticum aestivum
  Clone ID: LIB3281-029-P1-K1-F11
acgcccacgcgtccggcggcttgctcgcagcggcgtccgtctcctccacgtaaagagagagacatggcatgctgcacctatgaaagacagcaataatggataatgacaatgtccgcatggctactgatacaccttctcgctttctttccttctttcaacaggtgataaataagcaccctcgcatcataataataatcatcctttagagccaagcagtacctattttaacatcaaaatgtgacacaact

SEQ ID NO: 5627 - DNA, 362 bp, Triticum aestivum
  Clone ID: LIB3281-029-P1-K1-F12
acgcttacccaagtgttcgtcctgggctgctcatgcctgcatcttcattcactcgggggtgatcatggatctactctccaccaccattataaaggtgctaatgtataccatggatccatgtatccgccatcctgaccagatagctcttattgccaaccacaattgtttctgcacacacctgaccatctcattgacccaatccccgtgctatgcataattaaaattaatgggtaatatgccattaccaaatctaattaccccacattactgttaaacccgacggtggacgacgtgaaaataaccgaggcgatcttggtccctttgcttcccatttatcacggtgaaaaagatcgaggacagca

SEQ ID NO: 5628 - DNA, 264 bp, Triticum aestivum
  Clone ID: LIB3281-029-P1-K1-F2
gcccgcccacacccactcgtacgcatatacatatcttgtccaatattttcaacataaaagcttaattacagccgcgtctaaataaatattccttatcctttacaactataacccactaacataaccattttcttcatatcaaaaacactgcttaactcaacttcacacacataattattctaccgctacatacccattaatacattcaagacatatgatgtacactctttaaaagccattaattacatacattacttcattcat

SEQ ID NO: 5629 - DNA, 239 bp, Triticum aestivum
  Clone ID: LIB3281-029-P1-K1-F4
ctgacgcgtgggcagcggtggagtcagtgttgggagctcaaatttaccggtgggtgtgtcatttatacatcaacgcctctttattcttcttatttcaacatctatgtggttcaggaacactgcattttcctattctctcatcatgatattttttttttttactagctttttttccaacttttaccacttttttcatttttttcttttcttctatttactatttttcttttttcattttt

SEQ ID NO: 5630 - DNA, 324 bp, Triticum aestivum
  Clone ID: LIB3281-029-P1-K1-F5
cttacacatcggcagacgcctcgctcagtccttctccgtcatctaactctgcgacttgtatgtgatttcataacactccctatcaaattcgccgctgctagcactaaactattttatttctctttttattattcttctcgcttcctttacctgcttcaacaagtgataaataagaacggtagcagcatcatcattatcagtattagatgccaagcagtagtaatttaagcgccaagatgtcactgatcgtccctatcaccaggaggcgggaggctgtctggctcggactgcgactctggggcaactttcgaagcctgcgacaac

SEQ ID NO: 5631 - DNA, 350 bp, Triticum aestivum
  Clone ID: LIB3281-029-P1-K1-F6
cggacgcgtgggtgcggcaaggtgagcttatcccatttactttgttcaatcgggagggaagattcatatccccttcactgtcatttcatttgtgagaatttattccattgatccatgttggcggcatcctgacaatttatctttttctgccgatcacaattgcttctgaacacaccggcccatctcattgaggaaatccccctgctctgcttaattaaaattaatgtgaaatatgtttctaccaaaactaattacaatttattctttttagtttctactgatgttgactatgaaatattggggcccgagtagttcagttcaatttccggtggatattgtacacacatgta

SEQ ID NO: 5632 - DNA, 367 bp, Triticum aestivum
  Clone ID: LIB3281-029-P1-K1-F8
caatgacagagagcgtctcgttgatgcaagagatgagctacaccgggtgctgaatgaggatgagctgcgtgatgctgtgctgctggtgtttgccaacaagcaagatcttcctaatgccatgaacgctgctgaaatcactgacaagcttggcctgcattctctgcgccagcgacactggtacatccagagcacatgtgctacctctggagaggggttgtacgagggccttgactggctgtccaacaacattgccaacaaggcttgaagcatctcggcaggggcttctatggatctggataagctggatattcggactaatactgcctttacgtattataaactatatagtcttgacagattatgtggg

SEQ ID NO: 5633 - DNA, 299 bp, Triticum aestivum
  Clone ID: LIB3281-029-P1-K1-F9
tcccacacatacaaagactcatagcactaatacttccatttcacttggggctggttttttattagactacctcatcacacatttacacttatttactatcaatcaacatctagctaatccaattaacctttctgacattactgacatgcttcttatttattctcttccctacctactcttcttcatccatatcacactttcctcctctctattcgtttttaatcatcttctttaatctttttcaacatcatttcttcattatttttatattttttttttatatgctttttgtgattttt

SEQ ID NO: 5634 - DNA, 223 bp, Triticum aestivum
  Clone ID: LIB3281-029-P1-K1-G1
gcgcctccccaacatttaaacagccaaaccaaacaaaagccacacacgccgcgccgggctgctccactgggccaccacccacacagtcccactctcccactatcccccagcctccagctgagccagctcccctcgccgccacgccggcaatggcgcccgcttgctccctccccgcccttctcctcctcaccctcgcggtgctgtcccccaccccggccgcggt

SEQ ID NO: 5635 - DNA, 428 bp, Triticum aestivum
  Clone ID: LIB3281-029-P1-K1-G10
accgaaccggcacagtgtgcccggctcgacccacccatactacaaaagctgttactaaaccagttgaggaattcatgattaaccataggggggcaaagacaacaagagtgacacacgccattcacaattatcaaaaccatacattcaagtcaaaaattgaatcttagcccccgggtactgcaacacgtaactcaggtgcataggatgggcggagaaaactttcaaatttattgaagcaacaaggcgttcattctaaacgggctccaaaaagcagccctccacctaaccaggaagttcctccttttctttaacctcgcggtagactcgcggtgtattacactcatggaaatactagaacgtcacttccaaaagagggcaatggaaaattttacactggagactgttatatatggctttatacatatcat

SEQ ID NO: 5636 - DNA, 374 bp, Triticum aestivum
  Clone ID: LIB3281-029-P1-K1-G11
ctcttcctctcaagtcctaactacctaaccgccccccaaatccccggaccggagctctaccccacccccacccacacgacgcaaccggccgtcatggacgagaccgacgacgacaagctcgcctacttgcaggccgccacaggcatgtacgaccccgacctctgcaccgagattctcgtggccaacaactgggacctacagctcgccgtcttcttcataaccggcgaccccttctcggccgagccctgcaattaccccccgacgtccccgacttcggtggaggccgatttcatcggctaccacccccctgcgccgggttcgcagaaacagaaggagacccggatcgcgtggaggcttgtgacactccccttcta

SEQ ID NO: 5637 - DNA, 94 bp, Triticum aestivum
  Clone ID: LIB3281-029-P1-K1-G12
acggcatctgatacagatgcttataaatgtgccacatccttgagaactggtgtgggtaatcggtggtgattcaataaggtagtgcaaataaagt

SEQ ID NO: 5638 - DNA, 155 bp, Triticum aestivum
  unsure (1)...(155): unsure at all n locations
  Clone ID: LIB3281-029-P1-K1-G2
cccacacatacgnctcctcctcaacatttaaacactttaaccatacaaaacccacacacttccctgcccggctttttcactggaccaccatccacacattctcacttttccactattccccatcctccaccttcatccatttccactcttctaca

SEQ ID NO: 5639 - DNA, 405 bp, Triticum aestivum
  Clone ID: LIB3281-029-P1-K1-G3
cccacgcgtccggcttcgtgtcccagtcatgtccatcacctaaaggcgacatgtacggggcctcaccacctcgtggcctcacactccttccactccccactggtccaactatcacagtcacagatcaggagtatcaatcagagaggtggtagatagccagaacatggcggactgggccccggtgttcgtcgggctggccctattcatcctcctctcgccggggctgctgttccagatccccggcaagggcaggatcatggacttcggcggcttccagaccagcggcatctgcatgctcatccacgccgtcatctacttcgccctcatcaccatcttgctcctcgccgtccgcgttcaagtcttccttggttgaccagcaactgcttccttatcactttcaagcct

SEQ ID NO: 5640 - DNA, 376 bp, Triticum aestivum
  Clone ID: LIB3281-029-P1-K1-G4
cttcgccaagtggtcgtcctgcgccggccaggcctgcatcgccatcgactaggtgcgcgtcgaggagcgattcgcgcccaccctgatcaaggtgctcaagtcgacgctgaagaggttcatcgccgatcaggaccagatggcgcggatcgtcaacgggcggcatttccaacggctgagtaacctcctcaaggacccggcggtggcggcatccatcctgcacggcggcggcttggatgccaagaacctatccatcgagcccacgatactgcttaacccgccgctggactccgggatcatgaccgaggagatcttcggccctctgcttcccatcatcacggtgaagaagatcgaggacagcatcccgtttgtgagggcg

SEQ ID NO: 5641 - DNA, 366 bp, Triticum aestivum
  Clone ID: LIB3281-029-P1-K1-G5
catacttgcagtctgttagcaaaaggcttgaagagtggaggttgaggcaacgggacgtggaggagtggatgagacatcaccggctcccacccgaccttcaagaacgcgtccagcggtttgttcaagttaaatggcttgcaacgcgtggagtggaagaggaatccatcttgcaagctttgcctgctgatatacgtcgggatgtacagcggcatctttgtttggatcttgttcgacgtgtccctttcttcgctgagatggacgaccaactcctggacgccatctgggagcgggtggtgtccttcctgtgcccggagggcacatacatttctcgcgagggcgatcctgtgagcgagatgctttttatta

SEQ ID NO: 5642 - DNA, 283 bp, Triticum aestivum
  Clone ID: LIB3281-029-P1-K1-G6
acgcatacagattttctcttagttccatattacctatccgggaactctagaactggtgtcgggtattagtggggaaccaatcacaagatcctactcaactacaaagaaaacctcccgcacgaggacctagttaacttatcgccatgcacggacatgtcgacatgcccttcatactagggatgtccaatgctataactgggaccttccagaaggcctctttttccacattagagacgcagactctctccaagcaatagatttcatgcctactcccctttctcca

SEQ ID NO: 5643 - DNA, 140 bp, Triticum aestivum
  Clone ID: LIB3281-029-P1-K1-G7
acccacgcatcctcctcaaacattaaacactcaaaccatacacaagtcacacacatcagcgcctggtctttcactgggccaccacccacacaatcccactcttccactatcccccaccctccatctgatccagttcccct

SEQ ID NO: 5644 - DNA, 444 bp, Triticum aestivum
  unsure (1)...(444): unsure at all n locations
  Clone ID: LIB3281-029-P1-K1-G8
gaanngccggggcggcgccacacctcacgcccactcttatctcctttcntgtcctcattcatgttcccatcacctaaaggtctacatcgtacacgtgttctctaccacgctcgtggtcctcacactcacttccacttccccactgtgtccaacttatcacagtcacatgatcatggagtatctaatctagagatggtggtacgatagccatgaacatggctggactggtccctcggtgttcgactgggcttggccctattcatctctcctctcgccggtgctgctgttccagatccccggcaagggcaggatcatggacttcgtctgtttccagaccagcgtcgtgggcatgctcattcactccgacatcttacttcgccctcatcaccattttgcttctcgccgaccgctttcaagtcttttctgtctgaccagctactgctt

SEQ ID NO: 5645 - DNA, 318 bp, Triticum aestivum
  Clone ID: LIB3281-029-P1-K1-G9
acgcccacgcgtacggtggactgtggttccaaagactgataaaggcaaggggaaggctctccccgcgtacaaggacaaatttataagcaagatgttcactacaccgggtatatcatacatcatcatccttaggaacccaaaatgagtatgactactctatgtaaaccagaatagattctcttcgctatgctactgttgaaacaatgcctaatgctctgaatcaacgatggtgaaaaacaattattaagcaagcattgcctagtctaacaaatgatactgtgcttaggtgtgataattacttatataacatttttcata

SEQ ID NO: 5646 - DNA, 393 bp, Triticum aestivum
  Clone ID: LIB3281-029-P1-K1-H1
caaaatgcaaacagaaagctgttagctccctgacttattttatgaaaaagcggtgaagtatgtaagcgcatctgaggtgaaaagttattttctaaatttattaattgtgtaatatagcactttatctgtatttaaacagttgtaccattgctttggtatgatcttttccatatatgtacttttgagttttattggtgaaacaggtcatcgtaataagatgcaacgatgttaagaaattatagtttagcggcagaggcaaaattaaacagcagagactgtaattagtagtcataattccttctatttcattttgcagactcgtgatgatgctaggcagttcatgaagtaccttcaccctgaccttggtgttgaattacctgaaagatcctatgg

SEQ ID NO: 5647 - DNA, 327 bp, Triticum aestivum
  Clone ID: LIB3281-029-P1-K1-H10
gtaccgaaccgcaattccgacccacacccacgcctacgcgtacgcgtaagcttctttattaatgaaaacatacttagcaaatgcgctcggattttttcggcattataaatccaaaaattatacctttgactatacaatacctatgccccaaactgaccctatataatattactacaatcccgcactccaacacaatatgacctgtattctatgattttataccattctaatgtatccagaacgatcgctagctctgagcactctaatttcttcaaagtaactattcctaaaacacgatccgttccattaaaactagcagctccatcc

SEQ ID NO: 5648 - DNA, 370 bp, Triticum aestivum
  Clone ID: LIB3281-029-P1-K1-H11
ccgaaccccgaggtcgagcccacgacctcacgcctacgcgtacgcgtacgcccactccttcatacgtgttatattgaaagatgggcttggggtcattaaaggatgtagatgacaataatttttataaactaaaaacgagatatatcgctcataatatcttactagcactgatctgctacacctgacattgctttcatatgtccaatcattccaccattatcaaactcttcaaagatcaggcacatgcctaaatactatgcccccaaaagtgcaagacatcatatcttcatagtctctctttgtttccttggaaacagccttctccagcggcacgctgttcctttttttgtacgcctcctttattaccttc

SEQ ID NO: 5649 - DNA, 339 bp, Triticum aestivum
  Clone ID: LIB3281-029-P1-K1-H12
cggacgcgtgggggtttttctgtttatgctgcaggttaagacctgggctgggtacatggtgtgaatagcccgacagcgcagacaatgagctcgatgtcaatcatttgcttggttgatttccatctgcagcgcagacccggcatgctacaatattacccgcgttctctgccttgttaaaagatggctcagatttcgcaagtgttgagaagaacatctcgctctttaaggggtttgggagcacaaataaagaattggtagctgaactttttgtaacactgatgaataagctactatcagtggagagtttatgggagcacgggctctgcgctagcaattttg

SEQ ID NO: 5650 - DNA, 324 bp, Triticum aestivum
  Clone ID: LIB3281-029-P1-K1-H2
aatatagggggggaaccatgtgcatcaacattccacctattgctggtacatttgttaaacaaattttcaatacaccactgtgtaccaaatctgaaattccaggttacaacatttggcacaacacgtatactaaaccaagagtgattttgacgtgctcgttgtgttgtaagccatgtaggcagaggacgtgttcatgtcattcaagcccagctcctagtttagctcccagctcctctaatactcgtcaattgttagctgattgtcatcttctagcgaatcttgttgtggggcaataaacgaagccgccaatgcatcatcaagttt

SEQ ID NO: 5651 - DNA, 277 bp, Triticum aestivum
  Clone ID: LIB3281-029-P1-K1-H3
acgcgtacccccacgcgttcatgcgtgccttgtgcatataaaggtgcccgactgggcagttaaggtgatgttgattgatcttgaacgcgtgtgatagtgcacaggtttcgaacaactgttgtttttcaccatgagggtcaagcttgagctccttatgcccttgctggcgcaatacaaaacacccgcatgggccacattggtcgtcgccttctttgtgctgtttgcccttatcctttccatgtacctgatatttgagcatctatcggcttacaacaac

SEQ ID NO: 5652 - DNA, 245 bp, Triticum aestivum
  unsure (1)...(245): unsure at all n locations
  Clone ID: LIB3281-029-P1-K1-H5
acatttttacaaaaaaggctagggatatttctgcagctcaaatgacnaaatgatataattcatcggacgagtactgccatgcaggctaacttataatcatccatgaaaaacaacacactcgacagttttatgcactcttattcccccatcatcaagcatatggtagatcaggcacatgcctcagtactctgcccccagaagtgcaagcatcatatcttcatagnctctgcttgtttccttggaaa

SEQ ID NO: 5653 - DNA, 312 bp, Triticum aestivum
  unsure (1)...(312): unsure at all n locations
  Clone ID: LIB3281-029-P1-K1-H6
taccgaaccgccaggccggccacgacctcacgcgtacgcgtacgcgtaggcctactacatcatttgtgaaaacacgaaagctggggtngggtcattcatgcatgtgaatcaacaataataatatttaacttcgaactaaatctgttgctcataagatgttacttagcgctgaacagatgcacgtgacttgggttgcatatgccctcttattccagcattgtgagatttttggtagatcagggacatgcactacatctatgcccccaggagtgtaagcataatatcttcagtagtgtccgatggtctccatgg

SEQ ID NO: 5654 - DNA, 387 bp, Triticum aestivum
  Clone ID: LIB3281-029-P1-K1-H7
acgccaacccgtgaggtcggagaggcattacttattggatcctaaagtggggaagaatctcaccacatcttatgtcaactcatattttgtaaatttattaatcgtctaatatagcactacatctgtatctaaacagttgtaccattgctttcttatgatctattacatatatgtacttttgagttttattggtgaaacaggtcatcgtaataagatgcaactatgttaagaaattatagtttagcggcagaggcaaaattaaacagcagagactgtaattagtagtcataattccttctatttcattttgcagactcgtgatgatgctaggcagttcatgaagtaccttcacccttaccttggtgttgaattacctgaaagatccta

SEQ ID NO: 5655 - DNA, 342 bp, Triticum aestivum
  Clone ID: LIB3281-029-P1-K1-H8
cggacgcgtggggttccgcgaggagttcaagcagaagaaccccaagaacaagtgcgtcgccgccgtcggtaaagcggccggtgagaggtggaagagcttgagcgaatcggagaaggccccctacgtggccaaggccaacaagctcaagggcgagtacaacaaggccattgccgcctacaacaagggcgagagcgctgctgctgctgccccaaagaaggcggtggccaaggaggtggaggaggaagatgaggaggagtcctgcaagtccaagtcggagatcaatgacgacgacgatgatgagggtagcgatgaggacgaggacgacgacgagtgaagaaacgc

SEQ ID NO: 5656 - DNA, 212 bp, Triticum aestivum
  Clone ID: LIB3281-029-P1-K1-H9
cggacgcgtgggggattcagaccacctcccgttgggaaaggagctgagagggggccgaacgaggcacttcagacggaccgaatataggcaatgagacgagcccttgggggcgcaagcccaactaatgtccaaagccaacaaggtcaaggtccagttcaacaaggtcattgtcgactacaacaaggagaagagcccttatgctcatggcccaa

SEQ ID NO: 5657 - DNA, 403 bp, Triticum aestivum
  unsure (1)...(403): unsure at all n locations
  Clone ID: LIB3281-030-P1-K1-A1
cggacgcgtggggttctacagctcacttttctgtacatcgcatgatccaaactcagcaagatgggtgatatcatcaatattttctgggagcctctactcttccagtgttctgaaaaatccatgtgatgtctttctcttgattggtacttctcgacatctccaacatcctcaggcccaaagaaagaaaatgaatcatcagtggcatcttggaggccatgcatactcatttccagcttctgagcatgctgaagagtttctgccatgctacctccatgacagaccactngattatctaaatatgtaaatcatttctcatcttccagangacccacaacaatgctaaggatattcacgttaactattactggcatgccatgcaatatatctngttatcttgatttat

SEQ ID NO: 5658 - DNA, 395 bp, Triticum aestivum
  Clone ID: LIB3281-030-P1-K1-A11
gggtgagaaagatgacaagatcatagctgtgtgtgctgatgatcctgagtaccgtcacttcagagacatcagtgaacttcccccgcatcgccttcaggagatccgtcgcttctttgaagactacaagaagaatgagaacaaggaggttgcagtgaatgatttcctcccagcagaagatgccatcaacgcaatcaagtactcgatggacctctacggttcgtacatcatggagggcttaaggaagtgatctccagttggtggactgcagatgctacgctatccgccctacggcttatcaatagtacggcagacatttatgttaacatgatgatcgaaaaccatcagtctgtcggggatatatatatatacctttctgtccatgctgagccaagcat

SEQ ID NO: 5659 - DNA, 356 bp, Triticum aestivum
  Clone ID: LIB3281-030-P1-K1-A12
cggacgcgtggggcaagccaaggcgataggatctttacacctgtcaaggtacgaggaagatcatggcgtccgatgtcaagagcaggatccttgtgatcggcgcgacggggtacatcggcaggcacgtcgtcgcggcgagcgcgcggctcggccaccccaccctggcgctcgtccgggacgccgtcccctccgacccggccaaggcgcagctgctcaagaccttccaggactcgggcgtgacgctcctcacgggcgatctctacgaccacggcagcctggtgagcgccgtcaaggcggccgacgtcgtcatctccacgctgggcgcgatgcagatcgccgaccagaccaagctcatc

SEQ ID NO: 5660 - DNA, 287 bp, Triticum aestivum
  unsure (1)...(287): unsure at all n locations
  Clone ID: LIB3281-030-P1-K1-A2
acgatccaaccttccaatactgcatgtgagtataacgttgagcagctcctctcctgtggattgtttctctgctcgaagatgaagctctccatgcagtcgctggcccggaagctctccatcccgtcgcccaagcggggcaagaagcagcagcagcagcaggacggcggcatgcgcggcatctcccggagcgaggcgccgtcgttcgcgtcggcgtcctcctcctccaccacctcgtccttctncgaggacgctccccgtcgaccaagccccacctcaagggctacaag

SEQ ID NO: 5661 - DNA, 207 bp, Triticum aestivum
  Clone ID: LIB3281-030-P1-K1-A3
cggacgcgtgggcgaggacaagcttgagttcagcaagatcttggaggctatcaaggctaacttcaacgacaagttcgacgaggtcaggaagaagtggggcggtggcgtcatgggctccaagtcgcaggacagactgaaagggaaactacatggcatatgctctgacaatacttatagggctaggcttagttcatcctctgcgcagcc

SEQ ID NO: 5662 - DNA, 315 bp, Triticum aestivum
  Clone ID: LIB3281-030-P1-K1-A4
tgtggacatggcaaatgtattagcccattggctaaattccatgacggacgacataggaggtggggattatattcacattctgttatggatgatgcggagataagagactgcggttcaaatgaatctctgtacgatgatacacaatctgttaatcggttcagagaccatgattcccaaccttcagtggggcaatactcaggtgtacctgtaagtgcacgggtaaggaggcgactgttgagtaatggttctgacagacagcatcaaatgtccagtgatgagtttcctcgcactattgtatctgattatcgtgatggt

SEQ ID NO: 5663 - DNA, 380 bp, Triticum aestivum
  Clone ID: LIB3281-030-P1-K1-A5
cggacgcgtgggtttggattcaagacctttgaaacaatctcacgaagccagcactttagttggcctgctacaaaaaattagcgccaagtttaagaaaggctttcgcgaaatattggaccgcaaagcatcggcccatccttttgagaatgttcaggccttgcttccagtgacttcttggttgggagctcaccccgtgccagaacatagaagagatgcagccagggctgaggattctgttgtgctgtcatatggtaccgagttgattgggatgcagagagactggaatgaggaactgcagtcatgccgagagtttcctcatgccaatcctcaagaaagaatattgcgaggcagagcactctataaagtgacatgtgattttg

SEQ ID NO: 5664 - DNA, 353 bp, Triticum aestivum
  Clone ID: LIB3281-030-P1-K1-A6
gagagagagagagagagagagagagagagagggagaggggggaggggagaccctgaccaatgccaagaacaagaagagatcagtgaaaatccccaccgggcgagaggagacgagctccggcccccgtcctccaagaacaagaacaagagcaagaaggaatccgggagcacgagggaataaagcggccggaggagaccggaaaggccgtggagaaaaaagctccggcgacgatggagaaggggatggatccggcgctgctggacaacatcatcgccaggctgctggaggtgaagagcctcaagcccgggaagaacgcgcagctgtccgagtcggagatcaagcagctctgcgcc

SEQ ID NO: 5665 - DNA, 341 bp, Triticum aestivum
  unsure (1)...(341): unsure at all n locations
  Clone ID: LIB3281-030-P1-K1-A7
ctccaacctcccaaaaataaaggagaaaaagtagagagagagagagagagagaaacgcgaaaccccaaatcgatggccgccgccgccctcctccgccgctcgccggcggcgcgcgccctcctttcgccggccctctcctcccgcctcgtcgcctccaagccccactcttcatcccccgcgccgncgccgccctcgtcgaagcccgccagcaccaagaccttctcgatctaccgctggggcccccgactccccgtcgaccaagccccacctcaaggactacaaggtggacctcttcgacttgcgccccatggtgctcgacgcgctcctcaagatcaagaacg

SEQ ID NO: 5666 - DNA, 397 bp, Triticum aestivum
  Clone ID: LIB3281-030-P1-K1-A8
gtggacagctagagccagccaccaccgtcttcctggcgagaggggaggaaggggcaggtttagcctggcaggtgcttctcgggttccatggcttccagcgagggggcggcatccttgctctgcatcaagctcgtggtctgcctctgcttcctcggattatcccaaggcaggggcacggccaagccgccattcacgttgaggaatctcccacccctcgagaaggcgagcagcttccccgcgatgcgccacgacagctacgactacattgtcgtcggcgggggcaccgccggctgccccctggcggcgacattgtcgctcaagtacaaggtgctcgtgctggagaggggcgggtccccttacggcaaccgcaacatctcctacatggagaaacttcaca

SEQ ID NO: 5667 - DNA, 405 bp, Triticum aestivum
  Clone ID: LIB3281-030-P1-K1-A9
cggacgcgtgggcgataggcgtgtttgaaaaaaaagggtcagttcgtgttgcaatttcatgaaaacttgcttatgcggtgttattgcactggtacaaaaaatgtcatggtctttttcttcctgtttagatcgccacctacctatgaattacgactctgggcatggcagaatgtcaccataatttttgttcagcaactagatttcatcccaagacgtgccatctctctaatttgactctgagcatgtaatacagttagttaatcatgtgggttggtcttgtgtcttcccgctgcaattgaattagtctaagcaatcgaggtcctactaattaattaagctggctatttgcttgcttcttgtacctacggcatgctctctgattttttttatcacagtatgcaagct

SEQ ID NO: 5668 - DNA, 409 bp, Triticum aestivum
  Clone ID: LIB3281-030-P1-K1-B1
cggacgcgtgggcgctttccgccacacccgcgaaaaccctacctccggaggcaacgccgggcgagatgaagggcggcggcgatatcgaggcgggcaccgcggcaccgaaggggacgacggagagccccgagctgcgctgggcgctcatccggaagatctacgtcgtcctctgcctgcagctgctcctcaccgccgccgtcgcggtcgtcttcgtcaaagtcagcagcatcccgcgtttcttcgtctcctcctacgccggcctcgggctgtacgtcttcatcctcgtcttccccttcgtcgtgctgtgcccgctgcacatctaccgccagaagcacccaatcaacttgctgcttcttggcgtcttcacagtggccatcagcttctctgtgggcttgacatgtgcctttac

SEQ ID NO: 5669 - DNA, 319 bp, Triticum aestivum
  unsure (1)...(319): unsure at all n locations
  Clone ID: LIB3281-030-P1-K1-B10
ggggaagccgcttgcttcctcttgacttatgaattatcaatcccacctactccacctctcgccggagccccagcaaggagcaagcaaggaagatggacgccggcaagctgaagaaggtggccgggaagaagttcggcgggccgaggaagaagtcggtgaccaggtccgtcaaggccgggctccagttccccgtcggccgcatcggtcgcttcctcaagaagggccgctacgcccagcgcgtcggctccggcgcccccgtctacctcgccgncgtcctcgagtacctcgcagccgaggtgcttgagctggccgggaacgc

SEQ ID NO: 5670 - DNA, 394 bp, Triticum aestivum
  Clone ID: LIB3281-030-P1-K1-B12
cggacgcgtgggcggacgcgtgggatccccccccgcccctccccccacgaacccacagcgcgcacccgagatccgcagccgaagcccgtgagaacagcgaagcgcgacaggaaaggcactgaactagtttgcaacaaagaagagagaaaatgtctaccgctgaggcaacccgtgaggagaatgtgtacatggccaagctcgccgagcaggctgagcgttatgaggaaatggtcgaattcatggagaaggtggccaagaccgctgatgtaggtgagctcactgttgaggagcgcaacctgctctctgtggcttacaagaatgtgattggtgcccggagggcttcctggaggatcatctcctccattgagcagaaggaggagagccgtgggaacga

SEQ ID NO: 5671 - DNA, 398 bp, Triticum aestivum
  unsure (1)...(398): unsure at all n locations
  Clone ID: LIB3281-030-P1-K1-B2
gcagaactaagcccattaggctagcttataaattaagcctgcagcctaacatagaccatctcaaatcaaggaggctctgttcgttgtcaacatcgtcattggtcagattctcctattaggtcaaattcttttgttttcaattgaaacaatggcatacaatatgctcgatgcgattaacaatgggaaggattcctggaaagtgaaggtcagagtaattaggctatgggacgccattaacctcaataacaatgaactaattagccttgacatgatactgcttgatgaacagggcactatgatacatgccaaggtaataaaacatatggttaacaaattcaggccattgatccaagaagtttagtctacatgatagcanatttcaagttacatctgccatg

SEQ ID NO: 5672 - DNA, 297 bp, Triticum aestivum
  Clone ID: LIB3281-030-P1-K1-B3
gcagaactaagcccattaggctagcttataaattaagcctgcagcctaacatagaccatctcaaatcaaggaggctctgttcgttgtcaacatcgtcattggtcagattctcctattaggtcaaattcttttgttttcaattgaaacaatggcatacaatatgctcgatgcgattaacaatgggaaggattcctggaaagtgaaggtcagagtaattaggctatgggacgccattaaccttaataacaatgaactaattagccctgacatgttcctggttgatgaacagggcacttt

SEQ ID NO: 5673 - DNA, 389 bp, Triticum aestivum
  Clone ID: LIB3281-030-P1-K1-B4
cggacgcgtgggtttttttttttttttttttttttttttttttttttttttttggttttttttttttttttttttttttaacagcgcctatgatctgattttatagggggttctggctatggtaagagtatttttttagtttgattttttacggggcttttgatgaatttcttacagggggctttttttaacttctactattattttatcacattaatggggtttttcattttcaatgaaagctgaaattttgatagggggcttttaaccattttgcagggcactttttccatataggtccaggttttttttttttggggccttaaaaccataaaacctggtggagttgttcagtctaacaaacaatggttaaaaacccaagatttttt

SEQ ID NO: 5674 - DNA, 394 bp, Triticum aestivum
  Clone ID: LIB3281-030-P1-K1-B6
gatgtctccggcggcggcgccgctcgacgacgaaaacctactctcggagatcctcctctgcctccccccgctgccgtccaccctcccccgcgcctccctcgtctgcaagcgctggcgcctcctcgtctccgacatcctctttttccgccgcttccgcgagcaccaccgccacagccctcccctcctcggctgcttcgtcgagggcgaccgatgcgtctcctacacgcccaccatggattcgcccgaccgtatccccggcgagcgcctctcattgcagctcatcgaaacctgccactcctcggtcctcggctgccgccacggcctcgtgctcatctcccccgattcacggaatcacgtcctggtgtgggaccccgtcaccggcgatcagcaccac

SEQ ID NO: 5675 - DNA, 412 bp, Triticum aestivum
  unsure (1)...(412): unsure at all n locations
  Clone ID: LIB3281-030-P1-K1-B7
caaacactgtctcccaacaagacttgattgacttgggtagagctggtcttggtacctgtttgcttgctggtttgcctgggtggcttgttgcttacacggcccagctggtgcggtttatattcttcgagaggcagaaacttcctaatgagatctttaagcacaacatggaagagaaacgccagttttttacagatataaatatggattccgagaggaatgatgctgaggttcaggctgagggtgtattaaattctagattacagcatttaactcatacacttgataaggtaaggtatgttatgagatgtatattcggngaccccaagaatgccccccctcctctggtgaggcttaccgggagaagtctagtgtctgccatctggaaaggggaggctcattagttgatgagctc

SEQ ID NO: 5676 - DNA, 410 bp, Triticum aestivum
  unsure (1)...(410): unsure at all n locations
  Clone ID: LIB3281-030-P1-K1-B8
atacgaatgatagatatgcaaacaggaatactgtattttttgatattaacttgaggggtcttgatggcatccaaggaccagtttatgtggggactggttgcgtgttcaacagaacagctttatatggttatgaacccccgatgaagagcaaggagtcaggtttattctctaagctttgtgggggtagaacctcaaaatcgaagagcacaggaagtaagaagtcagataagcatgcagacggttctgtgccaatgttcaatcttgaagatatagaggagggtattgaaggttctggatttgatgacgagaaatcacttcttatgtctcaaatgagcctggagaagagatttggtcagtccagtgttttcgtagcctncactctaatggagtacggtggtgttccccagtct

SEQ ID NO: 5677 - DNA, 409 bp, Triticum aestivum
  Clone ID: LIB3281-030-P1-K1-B9
gatctcgcaggctcgcggaggcctcgtcagccagcgcggcggaggagaaagagccgtcgccgtcctaatgagttgggaggagacgtcgtcgagctccaaggcggctgctccgccggccatccgcctcgtcagcttcgtctccgaggagcagctcgacgaggcgaagcggtcgagaggggagcgggtggaagacggcactgcccagcgcgacaagcccctgttccagatcctgcaggagaacaaggataagaaggatgccgagttcaatgagcgcttcaagcacagacccccaaaggctttggatgaggatgaaacagagtttcttgacaaattggctttgtcaaggagagaatatgaccagcaggtggccaatgaagaagctgaacaactccgtagtttccatgaggct

SEQ ID NO: 5678 - DNA, 373 bp, Triticum aestivum
  Clone ID: LIB3281-030-P1-K1-C1
cggacgcgtgggggaaagatggacatggcaatgcggtgctttgaggagatgcagaagggtgggtgccagccggatgttgctacctatacgtgcttgcttgggggatatgggaatgcaaggcgaatggatagagggactgcgatgttggaagaaatggcacaaaaggggtgcccccctgatggccgaacgtacaatgcactgattaagctggtcaagaacaggaatattccagatgatgcagtaaggatatacaaaaagatgataaataaggggcttgaacccactgtccatacgtacaacatgatgatgaagtcgtatttccttggcgggaggaactatgcaatgggttgctcactgtgggatgagatgcatc

SEQ ID NO: 5679 - DNA, 397 bp, Triticum aestivum
  Clone ID: LIB3281-030-P1-K1-C10
cgagaagatggtccaggaggctgagaagtacaagtctgaggacgaggagcacaagaagaaggtggagtctaagaacgccctggagaactactcgtacaacatgcgcaacaccatcaaggacgagaagatcgcctccaagctgccggcagacgacaagaagaagatcgaggacgccatcgatgctgccatccagtggctggacacgaaccagctcgctgaggcggacgagttcgaggacaagatgaaggagctggaggccctgtgcaaccccatcatcgccaagatgtaccagggtgctggcgccgacatggagggcggcatggatgacgacaccccggctgcatccggcggcgctggccccaagattgaggaggtcgactaagctagtcgatgttct

SEQ ID NO: 5680 - DNA, 302 bp, Triticum aestivum
  Clone ID: LIB3281-030-P1-K1-C11
ataaatcgttattgagatacaatctatgcattctgatgatatcatacttacagctttaatattatctctgttttgataaaaaagggaatttgatgaaaatctactgaagaaagtatttgaactattgtacgaaaatgagttactggatcttccctatgctccagatgtcggtgactacttagtctccgaggaccctaattttccaacaagcaataaagatcctgcccctatacctgatggtatgagtggaactgaagtagagaagagattgaatgggccggcatatcaaggggacccaaaac

SEQ ID NO: 5681 - DNA, 395 bp, Triticum aestivum
  Clone ID: LIB3281-030-P1-K1-C12
ccgcggtgcccgccatcgactgcgactgcggcaaccccaaggcccccaagccctcccacccgcccaagaccaagccccccaccaagggccccaagccgggacccaagggccccacctacccgtcgccggcgcccaagggtcacctcccgcacccgccggtcgtcggcccgccgaagggccacgtccctcgcccgccggtcgtcggtcctccgaagggccacgtccctcacccgccggtagtcggacctccgaagggccacgtcccccgcccgccggtctacggtccgcccaagggccccatcacgcgcccgccggtcaccgctcctcccgtcgtcgtcgggccgccggtgacctaccccacgccgtcagtgactgccccgccggtcacctacccc

SEQ ID NO: 5682 - DNA, 283 bp, Triticum aestivum
  Clone ID: LIB3281-030-P1-K1-C2
cactcactcacgcgcgcgcacagagagctagccaaaggaagggaagaggaactgccatttcaggaaaggaagagggggatccatggccgccggagacgtcgcgacggtgttcctcgagatgagcctcggcacccgcctcgccgtcttctttcccgccccgttcacacaccgtggccgacctcaagcgcagagtgagccatgagcacaccgcattgtttccccaccttgtgcagatcgcgcggcaattccatcaagatcgagcacggagggtcgtggttccacc

SEQ ID NO: 5683 - DNA, 235 bp, Triticum aestivum
  Clone ID: LIB3281-030-P1-K1-C4
cggacgcgtgggctcttcagaaaaaggcaacagccccagcgatatgattgttctcagcgactcccaaatccacacgaagaagatacacacactcatgatctctatgcatgcatcgggtgtgttgtgctgcaaataagtggtggccttatgttgacgaagttcggaatttccacggcaaaattgtgtatagtattgtacagtgtacatcaaatcatcaattaccattatatgtgcc

SEQ ID NO: 5684 - DNA, 398 bp, Triticum aestivum
  Clone ID: LIB3281-030-P1-K1-C5
agatcgtggtgattcaaatgtaagatatggatggctgggttctacgaagagtgacatagttaggattctaattaatgggtttggtaacaccggaaaacctgctgagaaggcatgcttgagcgctggtgtttatctttcaccagaagatcgcgcctttaccagtgtcggtctttgtgatgttgacgaaaaagcggtgcagtatatgttattgtgccgagtgatattgggcaacatggaagctatcacgcctggatcacaagattcttttccaagcagcgaaatatatgattccggagttgatgattgctccaacccaaagtgttatgttatgtggccatcccatcttaacactcacatccgtttagaatatcttggtagtttcagactttcaccaaaag

SEQ ID NO: 5685 - DNA, 391 bp, Triticum aestivum
  Clone ID: LIB3281-030-P1-K1-C6
cccacgcgtccggaaagagtccaccgcaccaccatcaccaccaccaccatggcaggcctcttgcgccgcgccgcccctctcgctcgccgcctcacctcgccgcacccgctccccgccatcatccccatccgccccttccgcgcagccgccttcccaaccccatcccgcgccctcaccaagctcccctccgccgccagcgcccgccaccccgatctgctccggatcgcccgccgccagacccatggcgactcctccgccgtcgccggcctcgagcagcgcatcagccgcgtcgaggcggacctcgcaaaccacgtctctcgcctggaggttgatttggcaaacaacaccgcccgcatcgaggtctatgtggaccacaaggttgtcgcgctcg

SEQ ID NO: 5686 - DNA, 83 bp, Triticum aestivum
  Clone ID: LIB3281-030-P1-K1-C7
atggtgttcaccctcaggagcagttgcgcttcttcggcgcgggcagggggggtggctccttgacctgttacactttttttttt

SEQ ID NO: 5687 - DNA, 337 bp, Triticum aestivum
  unsure (1)...(337): unsure at all n locations
  Clone ID: LIB3281-030-P1-K1-C8
gaggtcacaaccttatttcacttggaccggccaatgtatttactaggatatcttgctaaccagagccgtgtctatcttattgacaagcaatttaatgttgttgggtacactctactccttagtttgatcgagtataaaacactagtgctgcgtggggattttgatcgtgcaaatgatattttgccatctataccgaaggaacaatatgacagcgtggcacatttcttggaatcgcggggcatgttagaggaagcccttgacatagcaacggactctaattacagatttgacctggctgtgcagcttggtcgcgttgatgatgcanaggcatttgctc

SEQ ID NO: 5688 - DNA, 384 bp, Triticum aestivum
  Clone ID: LIB3281-030-P1-K1-C9
aggaggagtttctcagttaggcctgacagcggtagctgttggttgccgagacctggagtacatagctgcctatgtatctgatatcaccaacggtgctcttgaatccattgggaccttctgcaaaaatctctacgacttccggcttgtcctgctcgacagacaaaagcaggtaactgatctgccactcgacaacggtgttcgtgctctgttaaggagttgcaccaagctccggagatttgctctctacctgagacctggagggctctcagacataggcctcgactacatcgggcagtacagcggcaacattcagtacatgctgctggggcacgtcggtgaatctgaccacggggtgatccgctttgcgataggatgcatcaacct

SEQ ID NO: 5689 - DNA, 305 bp, Triticum aestivum
  Clone ID: LIB3281-030-P1-K1-D1
ccaaaatctggattgattcaaattcgtgttgccttgcactctactcaaagcttagaccagatcaagctttgatgctgcaatcgcccattactctaccaaaggctgtcaagaatcccatggagctgactggtttgaggaaggcacacattcgagatggcgcagctgttgtgcaatacctggcttggctggataatcagatgcaagagaactatggggcctctggttacttcagtgaggccaatggatcacagaaaaaagagcatttggaaataaaacttactgaggtttctgtcagtgataaactc

SEQ ID NO: 5690 - DNA, 390 bp, Triticum aestivum
  Clone ID: LIB3281-030-P1-K1-D10
gatgtgtctgaggccaattctggaacctcatcagagtctaccagccaaattgccaatgataaagatatcagaagtagcattcaggaaaccggattagctgtttccggtattactcctggcatgttgcctgtgaatcattcagttgcatctgaggggcaagtgaaacatgcagatggagcgaaggatgagtcaagcactgagcaatcaagtgccgcaccaacaggttctgttagaccattatcaagggaaaaacctactgcagagcttacccgaacaaaatctgcagctgggagaaagaagaagcggaaggaaatgctttcaaaagctgatgctgctgggacctcagatctttacaatgcatacaaaggaccacatgaacagtctgatagt

SEQ ID NO: 5691 - DNA, 373 bp, Triticum aestivum
  Clone ID: LIB3281-030-P1-K1-D11
gtccgtcgtcgcgtaccgaatctccaccatcccccccgcgcgccgccgcctgcgcctccgccctcgacgatgggtctctgggatgccatgtaccgcgtggtgatgcgccgtaacggcgtgtacgtcaccttcgtcgtcgccggcgccttcgctggcgagcggctggtggactacggcgtcaacaaggtctgggagatgaacaacgtcgggaaacggtatcaagacatatcagttctggggcaaaggccggttgaggagtgaagacattgaagcccagatttcccatgatcttttaagtgaaattaggcaccttataaagctccatgttttggcattttcttttggcacaataatattgtaaaactctcgctgg

SEQ ID NO: 5692 - DNA, 396 bp, Triticum aestivum
  Clone ID: LIB3281-030-P1-K1-D12
cccacgcgtccgcccacgcgtccggccgagcagagccctccagacgccatccacgctcccgtgaacagatttcttacaggaaacttgacaaatggctgatgaggatgttcaacctatcgtgtgcgataacggcactggaatggtcaaggctggttttgccggtgatgatgcacccagggctgtctttcctagcattgtaggaaggccacgccataccggtgtcatggttggtatgggccaaaaggatgcctatgtgggcgatgaagctcaagcaaagagaggtatcctgactttgaagtaccccattgaacatggcattgtcaacaactgggatgacatggagaaaatatggcatcacacgttctacaacgagctccgtgtcgcaccagaggatca

SEQ ID NO: 5693 - DNA, 331 bp, Triticum aestivum
  Clone ID: LIB3281-030-P1-K1-D2
cgcaaactagcaagcatgaaagcaggctacacacaaaaaactgcttcacctttcgctgacatgctggcttttcgcaaggtcaaggcaaggctcggtggccgtcttcgcctactaatctccggtggtgcacccttaagtactgaaattgaagagttcatgagagtgaccagctgtgcatactttatccaaggctatggtttaacagaaacattgggacctagcacagtcggttaccctgatgatatgtccctggttggaactgccggtgttgccgccaccttcactgaactgcgactggaagaagtacctgagatgggttatgatccacttg

SEQ ID NO: 5694 - DNA, 350 bp, Triticum aestivum
  Clone ID: LIB3281-030-P1-K1-D3
aaggggaaaaaattatcacgcatagccactctagtaatataatgtatgttcttttacacgcaagtaacacaataatcttgagcatcaaatacagggttctgaagttttcatgacacaaaagttgcatgcaaaataactgaggatcttgactggaataatccatcactcgaagtagaatacatgcatatatgcggccggctgggtgccgcgtatatacttatttttcacactttcttcgccgtcttcaatcaaggcaaccatgggggcatgaaagtagtcatgcatgagctattcagggactcaagagggtaccctatgtgaagggtgggttcaccagctgcatcaagggg

SEQ ID NO: 5695 - DNA, 398 bp, Triticum aestivum
  Clone ID: LIB3281-030-P1-K1-D4
cggacgcgtgggttaccccacacagagcacactccagtccagtccagcccactgccgcgctactccccactcccactgccaccacctccgcctgcgccgcgctctgggcggaccaacccgcgcatcgtatcacgatcacccaccccgatcccggccgccgccatgtcgtcggcggtcgcgtccgccgcgtccttcctcgcgctcgcgtccgcctcccccgggagatcacggaggaggacgagggtgagcgcgtcgccaccccacaccggggctggcaggttgcactggccgccgtcgccgccgcagcgcacggctcgcgacggagcagtggccgcgcgcgccgccgggaagaaggacgcggggatcgacgacgccgcgcccgcgaggcatccccgcgc

SEQ ID NO: 5696 - DNA, 334 bp, Triticum aestivum
  Clone ID: LIB3281-030-P1-K1-D5
ctgactcttggtcggacgcgtgcgcctgctagggttttggtccttcgctttcggcggcgcaagatgggggagagggccaagggaaccgtgtagcggttcaacgtcaccaatgggttcggcttcatctacccgcacgacggcggcgaggaccttttcctgcaccagctctccatcaagtccgacggctaccgcagcctcaacgagaacaactcacgtgatttcgagatcatcaccggcgacgactgacgcaccaaggccaacgtcgtatccccaccatgtaggaggtgcactctccggccgctcccgacctgtctaatgcagtgatgaccgtggg

SEQ ID NO: 5697 - DNA, 402 bp, Triticum aestivum
  Clone ID: LIB3281-030-P1-K1-D6
tgggcctcggtgcggtcgtctggaactccggtgccctcatgacccaaatccagtggttccgtgatctcaagccttccttctgcaactccaccaaggaagaatgcaaggaattctatgccaactcgctgttcgttgttggcgagtttggtggcaacgactacaatgcacccctatttgcaggcaagggccttacagaggcctacatgttcatgccggatgtcatccagggcatctccgacggtgtcgaggaattgatcgctgagggggcagcagatcttattgtgccaggggtgatgcccactgagtgctttcctgtgtacttgaacatgctcgatatgccagcccacgagtatggctcccggagcgggtgcattcgtcagtacaacacgttctcatgggtgc

SEQ ID NO: 5698 - DNA, 314 bp, Triticum aestivum
  unsure (1)...(314): unsure at all n locations
  Clone ID: LIB3281-030-P1-K1-D7
ggcggctcggctggattccatctccccactcggccactccccaccccatagccgcggatccactgcgccgcggcgaggacgacggcgaggcgatcccggccctgtgcaccaggggcgcgatggctgaccatgacccagagttggaggccattaggcagaggcgaatgcaagagctaatgggacagcgtggtggtgcggcaagcccacaaaatgcagggcaacaaaaggctcangaagatgcaaagcangaagctgaggaacgccggcagatgatgcttgctcagatactgtcttctgaagctagagaaagaatc

SEQ ID NO: 5699 - DNA, 93 bp, Triticum aestivum
  Clone ID: LIB3281-030-P1-K1-D8
gtttggtcggacagctaagtctgtaagatttatcagtgtgaacatcgaacatcaattcaattaacttactgcttatggatttgaattccccgc

SEQ ID NO: 5700 - DNA, 296 bp, Triticum aestivum
  Clone ID: LIB3281-030-P1-K1-D9
ggagaaggtttgtgaaattgttaagaagcagcttgctgttcctgaaggcactgaagtttgcggtaccaccaagttctctgaccttggagctgattcactggacacggtcgagattgtgatgggcctcgaggaggagttccagatcagtgtggaggagacgagtgcgcatgcaattgcgacagttgaagatgctgccacgctcatcgacaagcttgtctctgcgaagtcatcttgaagggaggtcgtaaatcgtaatgattggagctcgtaagctagtagtcctaccttgggttgat

SEQ ID NO: 5701 - DNA, 349 bp, Triticum aestivum
  Clone ID: LIB3281-030-P1-K1-E1
cggacgcgtgggtgtttggctaccataccaaccgatgtaaaggctgaagccacttttatcgctaaggaggatggtgtcatcgcaggcataagcctagctgagatgatatttaaccaggttgatccgtcgttgaaggttgaatggtttgaggctgatggaaattatgtccgtaagggattgcagtttggcaaagtatatgggtgtgctcagagtatcattgttgctgagagggttgtgctaaatttcatgcaaagaatgagtggaatcgctacaatgacgaaagccatggctgatgctgctcgtccagcatgcatactggaaacaagaaaaactgctccaggtttacgtc

SEQ ID NO: 5702 - DNA, 381 bp, Triticum aestivum
  Clone ID: LIB3281-030-P1-K1-E11
gcctctctccagcaaactcacgccccccaccaccgaagctcccaaccccacccgaagcggcagccatggcccccaaggcagacaagaagccggcggccgagagcaaggtggagaaggcggccgagaagacccccgcgggcaagaagcccaaggccgagaagcggctgccggcgggcaagacggcgtccaaggaggccggcggcgagggcaagacccggggccgcaagaagggcagcaaggcgaagaagggcgtggagacgtacaagatctacatcttcaaggtgctgaagcaggtgcaccccgacatcggcatctcctccaaggccatgtccatcatgaactccttcatcaacgacatcttcgagaaagttcgccggggag

SEQ ID NO: 5703 - DNA, 397 bp, Triticum aestivum
  Clone ID: LIB3281-030-P1-K1-E12
aaagtatcctctccctactcatgatgtagttgtacgtggtggtgctccaaatgctttctcgcaaagcattgttgcatatgatgagacgcaaagaccgactttgaagaaagctctccttcttggtgatgccatttcagatttgcccaaggtagacaactgtcagcctcatgaggtaattgaatatggtggtcaacccaagactgacttccagcgctacattcgacttagtcgtaaagatatgttggactattcctttggtgatgccacttgtcctgaagaaggaaagctcttggaccaccagcctttgaggctaaaccaagatgattatgaccgcgtccagcagattccgataaagaaaggggcaaacttccgtgacttgccaggcgtcaaggtcgga

SEQ ID NO: 5704 - DNA, 234 bp, Triticum aestivum
  Clone ID: LIB3281-030-P1-K1-E2
cggacgcgtgggcaaggatgatgccttctacaggtacaagatgcccagaatgttgaccaaattggaaggccggggtattggcttcaagaccatttttgggaccttggttgttttagcaaaagcccttgccaggcctgtttcttaacaaaccaattcctttgatgggaagctggggcacaatcaaagtttgatgagaagaccggaatcttcttggtcaatggagcccatgacact

SEQ ID NO: 5705 - DNA, 350 bp, Triticum aestivum
  unsure (1)...(350): unsure at all n locations
  Clone ID: LIB3281-030-P1-K1-E3
gcctaccattgtctttgcggaagcagaccgcacctcaactgcaatatcttgtggatcaaatggcgaataagttgcccaagtggagggctgccctaatgccgaagagtggaaggctgaccttggtacagtccgtcctatgtgccatgccaatacatgcgatgatggcgttggacttgcccatcaagacgatcgaagctatgatcaagatatgtagaggattcctttggtgcagaaggatggaagcgaagggtggaaactgtgctgtggcgtgggacgcagtttgtgctcctaaatgggcaggtggcttaggattgcctaactngcgttggatgaacgtggccatgcagtct

SEQ ID NO: 5706 - DNA, 353 bp, Triticum aestivum
  Clone ID: LIB3281-030-P1-K1-E4
ggaatagggttacctcggttccagataaataccgtatacatgtctcaaaaacaagataaataccatatacaaagaccagtttccgctgggatttcagcttggtgcaaaatcatggatagtacgcatttctgacttagaaaagctactaggctcataaatgaacaaacaagatgacagtacatgacagtcagagtcgaacggtcaatgtttatttgctagaataagtcactcttgtatttctcttcggatacagttcttcccctggcacatctaatggctttatgcagtttttacatcaactgtggatgaaattgaaattcttagtgttgaggacagttaatcttgtcaagact

SEQ ID NO: 5707 - DNA, 405 bp, Triticum aestivum
  Clone ID: LIB3281-030-P1-K1-E5
gccacgcgtccggcggatcatactagagactacatagtcgaatttccagacatgagtccaagttctcttagttgctagtattgcaaaccaagacgtatctcaactgcgaggaaacattcacggttcttacgcgaggtctctgcaagcctaccacaaccacatctatggtattctacggaggaagccgtcaaatcccgcgaactatttcttaaagcaggatatgatctttgcagaaaggctgacatataggtacgacctttttgatttggcaaggcaatcactgtcaaaattagcatataaagtgtaccttgatgctatgggttcttaccaaatgagggattcaagtggtttaaactctcacacaaagaaattcctagaactcatcatggatatcgagacgctact

SEQ ID NO: 5708 - DNA, 395 bp, Triticum aestivum
  Clone ID: LIB3281-030-P1-K1-E6
cgcaggcaaggagggggttcgatccaatctttctttccacttcctcctgagtcctgaactaccaacgcggctgtaaatctctgccatcgccgtccgcgttcttcctcatcgcaacatcgtgcccctccgcaatatttgcccagtgggttctaaggccatcccagggatgcttctagctcttgtactctctttcgatcatcgcaagagcaaaggtgtggctgttccatcagacttgtctccctcctcaaagcggcgaaaatatgtatggtttgcgctaacaggttatggtgttggcttggtaactgcattggcagctgggatcttgtctcagtctccccagcctgctctactctacctggtgccctcgacactcgggcccatcgtgtacctgtcat

SEQ ID NO: 5709 - DNA, 93 bp, Triticum aestivum
  Clone ID: LIB3281-030-P1-K1-E7
gtctggcctgacagctaactgtgttagatttaccatggtgaacatcgagggggaattccatggacggacggcttatagatttgcattccccgc

SEQ ID NO: 5710 - DNA, 211 bp, Triticum aestivum
  Clone ID: LIB3281-030-P1-K1-E8
cccacgcgtacgcccacgcgtccgtttttttttactgaaccagttgtaggatatcacaattgcaaggctgcaagttacacaggtactagtttatcatgatcaaaagaaacttgtctcttagtctaaggtactgccgtaattctgcctaacggctaacgttagctactccaccagttcagttacacacggttccttaattcggagaatgatc

SEQ ID NO: 5711 - DNA, 151 bp, Triticum aestivum
  Clone ID: LIB3281-030-P1-K1-E9
cccacgcgtacttccacgcgtacttttttttttactgaaccagcatgggggggtcacaattgcaaggctgttagctacacatggtctagttttttatgatcaaaagaaacttgtctcttaaacctaggtactgcctttattctgcctaacg

SEQ ID NO: 5712 - DNA, 319 bp, Triticum aestivum
  Clone ID: LIB3281-030-P1-K1-F1
cggacgcgtgggtgtttggctaccataccaaccgatgtaaaggctgaagccacttttatcgctaaggaggatggtgtcatcgcaagcataagcctagctgagatgatatttaaccaggttgatccgtcgttgaaggttgaatggtttgaggctgatggaaattatgtccgtaagggattgcagtttggcaaagtatatgggtgtgctcagagtatcattgttgctgagagggttgtgctaaatttcatgcaaagaatgagtggaatcgctacaatgaccaatgccatggttgatgctgctcgttcagcatgcatactgg

SEQ ID NO: 5713 - DNA, 402 bp, Triticum aestivum
  Clone ID: LIB3281-030-P1-K1-F11
gggccccgtggcctggggtcgggggttaattgtcccgcctttcgtgtccccttcttaagctgaaggttggggaccggttcgccgggggggggacttaggcgagacgttgccaggatgccccgtcgccgtcaagggccttcacgccgaccagtgccgtacagatctgtcgtggccgatgcaccaatgacaagcgatttggagggaaaaagctgatccagccatggtcctctcctatgaggaggacgagtgccatcacaccagcagcagttcaagatgtgatcgggattgtcattcaaaaaaaagggaatcgggactgatctacacaagaggcgtcatgtggatctatagtaggctatggtaaatcgggactgctatgtcatgctgatctacacgagttgatgt

SEQ ID NO: 5714 - DNA, 280 bp, Triticum aestivum
  Clone ID: LIB3281-030-P1-K1-F12
cccacgcgtccgcggacgcgtggggaagaagcgtgtcgaggccatgatcgaggaccttgagccgtttgaggggcaggccttgctggacgccaagtgcttcaagtaagcgaacagtgcctgggatcgtgatggcggtggcaaagaaactatctaggacttgaaattcagtgtcgaaacagttggtctttttttggaagagtttgcttgttacttaatggctatttgacctggtgaactagttaattttgtgctatgctaagagtttttgggtatctggtcc

SEQ ID NO: 5715 - DNA, 340 bp, Triticum aestivum
  Clone ID: LIB3281-030-P1-K1-F2
aatgtcatcaagggcacaaagaaagagcagatggagcagattatcaaagacataagggagttcaaggagaagaacaaggtcgacaaggtagtggtgctttggacggcaaacactgaaaggtacagcaacgtctctgttgggcttaatgacacgatggagaacctcttggcgtctgtggacaagaacgaggcagagatatccccatcaacactgtatgccattgcctgtgtcatggagggcgtcccgttcatcaacgggagccctcagaacacctttgtgcctgggctgattgatcttgctattaagaacagctgcctgattggtggcgatgatttcaaga

SEQ ID NO: 5716 - DNA, 346 bp, Triticum aestivum
  Clone ID: LIB3281-030-P1-K1-F3
cggacgcgtgggggcttggtggtgagaagatcagttgctgaagctcctgctgacataaatgtcactaccaacagctcctttgtgttggcggaacatcgaacatttcgaaaggaccctctgaatgcgttcaacagatatgaaggaggttggaatatcagcgaagttcactactgggcttctgttggatacacagcgtatcccttgttcgtcgtggccttgctgtggtttgtgctgttcttccttcttatgctggggatttcctgccaccattgctgctgcccgcaccacagttacaactactccagaatagcatatgccctttcactgatactcctgatattattca

SEQ ID NO: 5717 - DNA, 405 bp, Triticum aestivum
  Clone ID: LIB3281-030-P1-K1-F4
catttctttcagtccacctcttcttcttctcggcgacggcggcggcaggcgggcgggcgagcgaggaaccctaaccctaaccactacttccgatccgcaagggcttcgacgatggcggcgtctctccgcgcggcggcggcggcggccacgaggatcctgcgcccggcggtgcttccaggggagcggcttcgacggctcgtccacaccgagcagcatcccgcacccgcctgttccttgaaggaaggataccgtgggtcgcaaacccagcagaagaaagaggagctgtacgcggctttccagctagacaggcgcccaataactacagccaaaaaggtgaccgagtggactgcgacagcgtctgctcttgttgctggtgcggtcactctgggtggcctagctactgct

SEQ ID NO: 5718 - DNA, 51 bp, Triticum aestivum
  Clone ID: LIB3281-030-P1-K1-F5
catttcctttagagcaccgtttctttatactccacacctcgagatccctct

SEQ ID NO: 5719 - DNA, 392 bp, Triticum aestivum
  Clone ID: LIB3281-030-P1-K1-F6
cggacgcgtgggatccaaacaaggtttccacctcaaattattgccatcgtggattccttgcacgagcagctggacttaggactattgtgctactgccattcgaagctggagtacttgagttaggcgcaatgcagaatgtgcttgagagtgctgaacctatggaaaccataacgtctgtgtttctaggggcaagcagtaagaagccagcgtgtgggaagcatgatgagtacgggtctactcaaatatcacccggtttggctaagatttccagaaaggattcgaatctcagccgacctctagtcaacacgggagcactcccattaaaaatgaacgaaaggtcatgggatatgcataagaattgtggtggcgagagcctgtcgctccacaatgtc

SEQ ID NO: 5720 - DNA, 320 bp, Triticum aestivum
  Clone ID: LIB3281-030-P1-K1-F7
ggtgtcgtcgcctctcatccaagctttagcgagggaagggattcaggccgtgatggtggggaaaggaggcgaggccgcggcgtcggcgcagcacaaggaggagcatgaggaagatggcgacatggttggcgtggtgaagctgatcagcgccgagggtttcgagttcgtcatcgacaagaaggcggccatggtctccaacaccctccggaacatgctcacctcacctggtggtttcgcggagacgcgcgagggcgaggtgaggttcccggagatcagcaccgcgatcctagagaagatctgccagtacttctactggtctc

SEQ ID NO: 5721 - DNA, 134 bp, Triticum aestivum
  Clone ID: LIB3281-030-P1-K1-F8
ggtgtccttatctctcatacaagctttagcgagggtaagggattcattccgtgatggttttaaatagaatctttacctcaatttcatcacttcacaaggtaggagcattattaacatgtcatacatttttatcg

SEQ ID NO: 5722 - DNA, 401 bp, Triticum aestivum
  unsure (1)...(401): unsure at all n locations
  Clone ID: LIB3281-030-P1-K1-F9
cggacgcgtgggcggacgcgtgggcggacgcgtgggcaacaatgtaccgctttcaagcttaaaaggtactggtccagatgggcgtattttgaaggcagacattgaggattacttgtcttctgcagccaagggttcgaagaaggaagctgcagcagctccaggactaggttatgtggatcttccaaatacacaaatacggaaggttactgcaaaccgcctgctgcaatctaagcagactatccctcactactatctgacagttgatagccgtgttgacaaacttatcaaattgcggagtgagttgaacccgatgcangatgcatctggtgggaagaagatatctattaatgatcttgttataaaagctgcagcattggctcttcgtaggattcctgcctgta

SEQ ID NO: 5723 - DNA, 406 bp, Triticum aestivum
  Clone ID: LIB3281-030-P1-K1-G10
cggacgcgtgggcctcccaccctgcagcggtgcccccatccccgaccaccttccaccccgcggcgcctacctctccccttcccagtggatcccggcccagcggcggggaactgctctggccaactttctcgcccccctgcgccgctgcccaccccgcgttgtgcgccgccgcccgcaccgaccaccaacctgctctgcatctgcctcagtctggcgatatacctcagatccagctctccctcacgctgctggtgagattcacctcgccggatccagtggctgaggccacagatcgttcgatcccgagcggatctgtcgatgtgagccgcgagaaaacaacaccgtttggtggcggagagccaggcccggcgcagtgccctcctctcgatgccgcctctcacccccc

SEQ ID NO: 5724 - DNA, 409 bp, Triticum aestivum
  Clone ID: LIB3281-030-P1-K1-G11
ccgccgccgccgcccctcgcatctccgctcgtcccgcaggtatccttccatcgccgccagaagtccgcatagagtcatctcctgcctctgccgccacccccttccgttggtcgccgtcggcagccgcacggactactcctggacaggactgcagatcctcgcgccagagaatcccttcccccagctcaaggtgagcagccccctcctgtaccattgatttggctagtttgtacagtgtatggagctgctctctgctgccgaacgaatcactgctcccgtcgaaagctagcggcggccggcttctcgggaagctggctattccctgaagctggagaagacccgaaggggccctaagcctctcactgacatattgatttgacatgcgccttgagtttcttcatcaattttc

SEQ ID NO: 5725 - DNA, 410 bp, Triticum aestivum
  Clone ID: LIB3281-030-P1-K1-G12
gctgtccatggcatcgtggaggctctgtttaggagatacacggagcaaggggtggacgaggagctggcatacaaaagcaccgtggagggcatcactggaattatctctaagaccatctcaaagaaggggatgcttgaggtgtacaactctttgagtgaggaaggcaaaaaggagttcaacaaggcatacagcgcatcattctacccttgcatggacatactctatgaatgctacgaagatgttgcctctggaagtgaaattcggagtgttgtgttggctggtcggaggttttatgacaaggaaggccttcctgctttccctatgggcaaaatcgaccaaactcgcatgtggaaggtcggcgaaaaggtgcgctcgacccggccagatggtgaccttggcccactccaccc

SEQ ID NO: 5726 - DNA, 411 bp, Triticum aestivum
  Clone ID: LIB3281-030-P1-K1-G4
cggacgcgtgggccgcgaccgacgagcgcctcggactagctcctagggtttgtctgcccaggccgcccgtccccaccccgtctcgtcggaggcgatggcgtcggagtccgccgcggcgtcggcttcgtccccggcggcggcgcgggccgggggcgggaaggacgacgagctggccgatctggtgcggcgcatcgtcgacgtcctctcccgctactccgatcgcctccccttcgacctcgaccgccagaagcttcgctcgcttaccacacttgctgcaattgccatcacaattgtatttgcctggaaactgttgagagctcctccagagcaacctcggaggccacggagacgggatgctccatcatctagcaacacaagcattagatcacagccaggtgctttggtcggaac

SEQ ID NO: 5727 - DNA, 413 bp, Triticum aestivum
  Clone ID: LIB3281-030-P1-K1-G5
cttgtaatacttgcaattgcacctttattagaatcagccaaaaagcttgcatccacaaagggcgatattatgcagggaagtacatgcgagagtggatatcttttagcacgggtgcattggagaatttaatttaaatagtttaaaaatcatactaaaagtaaaaaaaaaaaaagaattcttcatgatcatatggatgtaattactcacgtgtaaagtttggtgattaaataagtaaacacgtgagctatagaaaaatggcaaaattgtgatttctaaatagtgaataaaatgttcatctttacaaaatcatgattttgtcatttttacgtaactcacatggttacttatttcatcatcagaatttgcacacgtgtagtagcacatccatataaacatgttgcttttccggatgg

SEQ ID NO: 5728 - DNA, 413 bp, Triticum aestivum
  Clone ID: LIB3281-030-P1-K1-G6
cgggagcaccgaccgccggagccccccctcgtccagccgaggccaccggggtttgctccgccccccgcctccgctccgccccaccccgccgcagggttttaactgcctgtgcttgcgtaatggaagatccaccaagcgatagcgggcaatcagcaaacggcactgagcctgatctggaccatatgcaattggatgacaatgaagagagcatgtcccataccatggatgattcaaatggacagtcttctatggatgttgacagagaacagctttctatggatgctgatatgaatgggaaaccatcctcggatggtgatggtaagggaaagtactcttccgagtcacatgcagaagttccaattgacatgagcttgggaagcctagagaagttttgcaaggaagcatcaaggtca

SEQ ID NO: 5729 - DNA, 389 bp, Triticum aestivum
  Clone ID: LIB3281-030-P1-K1-G7
cccacgcgtccgcccacgcgtccgcggacgcgtggggtcctgttagggatgtttaccttccaaaggattattacagcggggagccccgagggtttgcgtttgtggagtttgttgacccttatgatgcctctgaggcccaataccacatgaatcgccaggtattttttggccgggagataactgttgtgcttgctgctgagtcacggaaaaggccagaggatatgcgcactagaactagagtcagggggtactctggaggtcatgaagggcgccgttcctctcattatgggaggtctcgttcccgttcacgctcagcctctccccgccctcgtggcggtggccgtgctcggtcaaggtcatactcttctgcttcaagacggcgagatgac

SEQ ID NO: 5730 - DNA, 363 bp, Triticum aestivum
  Clone ID: LIB3281-030-P1-K1-G8
gcgggtccgcctccgtgatgctggccacccacaacgtggagtccgggcagctggcggcggcgagggcgcaggagctgggcatcggcaagggcgaccggaacctgcagttcgcgcagctgatgggcatggcggacgggctctccctggggctccgcaacgccggcttccaggtgagcaagtacctgccctacggccccgtggagcacatcatcccctacctcatccggcgggccgaggagaacagagggctgctctccgcttccgccttcgacaggcagctgctccggaaggagctggttaggaagttcaagaacgcggtgatgggactggagtgaggtggcccgccggaggttcacgggagag

SEQ ID NO: 5731 - DNA, 331 bp, Triticum aestivum
  Clone ID: LIB3281-030-P1-K1-G9
cattcattcattcctagtaccaccaccaccttcgtctcccccctctccacccacactccaattgagaaacagctccgtcgtcctcctccggccattgccgtcgcgaattaagcggcaaggaggcggccggcggcaagatgttcgggcgggacccgtggggcgggacgctggagatctcgaacgcggactcggcgacggacgacgaccggagccgggacctggaccggggcgccatgatgcggcaccagctggacgagacgcatcatagctggctgctggccggcccgggcgaccaggccgggaagaaaaaagaagaagtacgtggacatcg

SEQ ID NO: 5732 - DNA, 360 bp, Triticum aestivum
  Clone ID: LIB3281-030-P1-K1-H1
cggacgcgtgggcgagatacagagatggggcgtcgggtcgccggcggcggacctcaccgtgtgctgccttatgacctcgtcgtgttccgaaatccagcagatagcacgccccatccccgggccgccgttctccacctcggctccaacacctcaccacacccgccgcctacctccgccatccatcgacggctagatccgccatccgtggatgcctagctccgctattcaccgagaccggagaagggaactccagccttcagactccagcagtgatggttcggatgaagatttcaggaacttccttggcgacggtgacaatgcctactcaagaggacgaagcgacacccaggcaccatattt

SEQ ID NO: 5733 - DNA, 411 bp, Triticum aestivum
  Clone ID: LIB3281-030-P1-K1-H10
ggcagcggcgacgccaaaccaaagttcatgaagaggactgcgcatcggctcaagactctgtgggcgcgccatgacatcgcaacccagatcaaggagctcaaggctcgcgtcatgtaggaaagtgagcgccgtgacaggtacaagcttgaagagaattactacagtgcaacgaagacggtggagatagacccgataactgctatccacgaggaggtcaagggcttggtggcaatggacggcccaatgaagcacgtcattgccttgctgatggatgagagtaaagagttgaaagtggcgccgattgttggatcaggagggctggggaagacgaccctggccatggaagtctatcgcaagattgcattaggaggagactctcagtgtcaagcttgtgtgtcagtgtcgcgcaca

SEQ ID NO: 5734 - DNA, 407 bp, Triticum aestivum
  Clone ID: LIB3281-030-P1-K1-H11
caccaaaaaccctagccgttcagcccacatctctctccctctctctggcacactctctagcccatccccagattcctccccagcacaccacctcgccgcagcggagccgagccccatgccgcccaaggcatcgaagaaagacgccgagccggcggagcgccccatcctcggccgcttctcctcccacctcaagatcggaatcgtggggttacccaatgttggcaaatcaactttcttcaacatagtaacaaagttgtccatcccggctgagaacttcccattctgtaccattgaaccaaatgaggcacgggtacatgttccggacgaacgatttgactatctttgccaacttttcaagccaaagagtgaggtggctgcatatctggaaatcaatgacatagctgggc

SEQ ID NO: 5735 - DNA, 352 bp, Triticum aestivum
  unsure (1)...(352): unsure at all n locations
  Clone ID: LIB3281-030-P1-K1-H12
cggacgcgtgggcggacgctttggtcgctttgctactagctaacagcagcagcttctgcagggtagctactcagtccagtacgtctcgagtgaacaagatcagcaggtcgatggcgctctctcgtcgcatgaccgcgtgcgccctcctcctgctcttcctcctcgtcgccacagagatggtgacgacgacggtcaaggtggcggaggcgcggaactgcctgtcgcagagccacaacttcaagggcgcgtgcctnagtagcagcaactgcgccgtcgtctgccgcacggagaacttccccgacggcgagtgccacgcgccgcactacgagcgcaagtgcttntagaagaggcc

SEQ ID NO: 5736 - DNA, 334 bp, Triticum aestivum
  Clone ID: LIB3281-030-P1-K1-H2
cccacgcgttcgcccacgcgtccgcccacgcgtccggaaattttaaaaatcatgatttttaaaatttcaaagcgcaccatgcatcatcacatccatgcacttctagcacaagcaaaatcatttcatgatttggcctaaggaacaaaccaacatttctcggactcggtcgtgcttaaccaggttcaagaacgggttgaggtggacatcaaggagctgcctgagcagattgacacttcaaaatacatgccgtcgtagacccgcgccgacattgcaaggaggacgcgaggagaagatggaatcctcgtatgttttgcttgaagtgatgctgtttttt

SEQ ID NO: 5737 - DNA, 368 bp, Triticum aestivum
  Clone ID: LIB3281-030-P1-K1-H3
tagctcgcagcctctaaattttcgagctcctggtgccagtgtttgctagcaagctacaatctgcagcagcagcaatggcgaaaacttgcaccctagcgctgcttggcgcgctggtagtgctctcgcttcttgtgagccccattgcttgctcccgcaagctcgccaaggtgggcgggcaccacaaacctgctccagtcaagggccacaaaaaccagaccaccactaacccctcctcgtccgccgcatacggcggcggctggttgcccgccggcgccacgtattacggcaaccccaacggcgacgggagcgacggcggagcgtgtggctaccagaccgctgtcgggcacccgccgttctcgtcgatgatc

SEQ ID NO: 5738 - DNA, 385 bp, Triticum aestivum
  Clone ID: LIB3281-030-P1-K1-H4
catcgacaccctcatcgtcaccaccaccctcagcagagggattggctccaatgtcgacatcaactgctgagggtggtggtgacgatgagggtgtcgatgcccacgccttgatcgtcccggacattctggaccggttccggcttgcgtaccagcctgctctatacaaggtggtatttatctctcacatgaagcgcttcatgaagaacctcactgtcaagcttgattgcgatgacctagatgtattaaagaagaatgtctagtcttccacgaagtattttcttaacaagctcaaggacctttacttatttgtcggcgagagcattcattatgatacgcgtttttgtgctccgcgtactactagtagtggagccagctgatccaactt

SEQ ID NO: 5739 - DNA, 300 bp, Triticum aestivum
  Clone ID: LIB3281-030-P1-K1-H5
cggacgcgtgggtttttttgaaacaagaccagcattttgattagatctatgtttgcctcccagtcaacacgtgtcgcagttgcacaaaacatatttacattttctcgagaaaacctagctcctatagtttttagtggtcaacaaaaggcaagaagccttctcaaaaccaggggttcaccaacttcactttttaaggtgggagtgtcggcttattttctttcttcttcccaaaacctaaggctcaaaaattcaagggaggcccaaccacattggccattggagattggccgattgggccac

SEQ ID NO: 5740 - DNA, 409 bp, Triticum aestivum
  Clone ID: LIB3281-030-P1-K1-H6
cccacgcgtccgtacgactcggtcttggaacatgacctactggagcatatacttgacttaagcatgaaacctagggatctaccgttgtcacttctgaagaacattacaggcaatttctccgaaaagaggaaaattggtgagggtggatttggaatagtctacaggggtgccctcccaaatgcggaagttgctgtgaagaggattattaagaacgtccagacaaatgatgagaacctatttcgtcgggaagttgacagcatgatggaggtcaaccatcaaaatatagttcggtttattggcttttgttctaatacagagcataaaaggatccaacatggagtaccaggaggatacatttacgctgaggctagagagcgaatactgtgtttcgagtacatcagcaatggca

SEQ ID NO: 5741 - DNA, 382 bp, Triticum aestivum
  Clone ID: LIB3281-030-P1-K1-H7
ctcagacatgaatgctcattaccaagcagggaggcgaactgaaatgacgttagatactcgagcaagtttggcactttttaagtcattcacttcagcagattatgttgctgctcaatgtctgaggagaaggataatgtactatcacatggaagctttcaagaaggttgacgtcatagcaacccctacaaccggcatgaccgcgccaaaaataccaccaagtgctctgaaaggagagtctgattatgttgtatcagccaagctgatgcaattcatttttgccgggaaccttcttggcttgcctgccatttctgttcctgttggtcatgacaagcaaggccttcctatcggcttgcaactgataggccgtccgtggggcgaggct

SEQ ID NO: 5742 - DNA, 346 bp, Triticum aestivum
  unsure (1)...(346): unsure at all n locations
  Clone ID: LIB3281-030-P1-K1-H8
gtttttgcaaaaaatccctccccaaattcccgacataacccgcgctcctggtcttctccggtcgtctgcccgcgctcctggcatagccgcgtagctccgcctgagctcccctgttcagctccggtgcacaactaccctgctctgccgtgcatcctccgccgccgccgcagctgcctcctgcgccgatccctcccgcctcacgaagctcccctcccccccactcgcctgcctgccacagcaccctttcaccccacaaatccatttttcttgctctacaggcttctacggcgtactccggctccggcgagcctncgatccagcacgcatatcgctcgcgcgcgggatg

SEQ ID NO: 5743 - DNA, 337 bp, Triticum aestivum
  Clone ID: LIB3281-030-P1-K1-H9
gcattccgatccagcaccgccgccgcaaacaccacacctcgagagccctcttcgccggtgaagtagcaagcaagatggctggaaggaagggaggcgacaggaagaaggcggtgacccgctccgtcaaggccgggctccagttccccgtcggccgcatcgggcgctacctcaagaagggccgctacgcgcagcgcgtcggctccggcgcccccgtctacctcgccgccgtcctcgagtacctcgccgccgaggtcctggagcttgccggcaacgctgccaaggacaacaagaagacccgcatcatcccgcgccaccttctgctcgccgtccgcaacga

SEQ ID NO: 5744 - DNA, 280 bp, Triticum aestivum
  unsure (1)...(280): unsure at all n locations
  Clone ID: LIB3281-031-P1-K1-A1
cagcaacagcagcagcagctcatgtactactgagtgtatgaagcaagtatgctggcgacggaggggactacaacaccctccttcctaatatatatacatatatggtagatgaagcctcaccagggccttttcttttgttattactagtccaacatcgcaattagtaatttactatccttcgccgctgttaacgctccgggtcgccggctatatatagcaccaatgtactagaacatatgtatccctgacgtgttaagagttgggcaattcttatttttnt

SEQ ID NO: 5745 - DNA, 140 bp, Triticum aestivum
  unsure (1)...(140): unsure at all n locations
  Clone ID: LIB3281-031-P1-K1-A10
cggacgcgtgggagttttagccctacaaaataaggtctctagcgtcgagtaggatcccaaaactttctggtagacctnataagatgccaaaacaggctgactctgacaacgtcgagacacactctacagaatcttcatcc

SEQ ID NO: 5746 - DNA, 312 bp, Triticum aestivum
  Clone ID: LIB3281-031-P1-K1-A2
gattgtatgaagcaagtatgctggcggcggatgggactacaacacggtccttcctaatatatatacatatatggtagatgaagcctcaccagggccttttcttttgttattactagtccaacattttaattagtaatttactatccttcgtcgctgttaacgctccgggtcgccggctatatatagcaccaatgtactagaacatatgtttccctgacgtgttaagagttgggcaattcttattttttagggggggggggggggggaaattaaatattttatatggtgcggccgctttataggattcaagct

SEQ ID NO: 5747 - DNA, 265 bp, Triticum aestivum
  unsure (1)...(265): unsure at all n locations
  Clone ID: LIB3281-031-P1-K1-A3
aattaacancattattttctcattttcaactttttctctaaaacatatattcaaaccgcattttttaaaacaacaccctcccttcaaaaatatatacaaatatattatatccaaatctttacacatatacttctctttcttttaatactataccaccatttatatttttctaataactaaaactctccccttttaacactcctcaacatacaaattaacattcacccaaatatctccaattttataacaatttctctatttaaaa

SEQ ID NO: 5748 - DNA, 379 bp, Triticum aestivum
  Clone ID: LIB3281-031-P1-K1-A4
tgcctccaccttcttcttcttcttctacctcccaccctcctgggcggcgcatccttgtcttctgttggctcttcgcgggcgccaaagctcactcttgacctctccgtcccaccgacgccggccacccactgccggaacgaccggtcgtccgttggctagcgagcatgcagagcatggatttggtgtcgccgtccgagcacctctgctacgtgcgctgcacgtactgcaacaccgtgctcgcggttggggttccatgcaagaggctgatggacacggtgactgtgaaatgcggccactgcaacaacctctcctttctcagcccacggccgccgcccatggtgcagcccctctccccaaatgaccaccaccaccccatggg

SEQ ID NO: 5749 - DNA, 316 bp, Triticum aestivum
  Clone ID: LIB3281-031-P1-K1-A5
cggacgcgtgggcgtgctcttgctgagcgttatgacaatgtgactgggggagtacgaaaaaacatgccatcatctctcaaatcacagggctcaggtatatctgaatctgactccgaggcacagtctactcccgcatctcctgagtctgaaaagaagacctcaaaagagaagggtaaaaagggaagtgatggatcgtcatcatcttcttcttctgattctgattccgaggttgatgaagcgaaccaagagaatggcaatgggattactcatgcactgaatgaacgagttattgagctagaagatgagctcaagggag

SEQ ID NO: 5750 - DNA, 382 bp, Triticum aestivum
  unsure (1)...(382): unsure at all n locations
  Clone ID: LIB3281-031-P1-K1-A6
cgcgtccgcggcggccgtcgacnatncgcaagtgggcgctctcctgcgcgctcctcctgggcctcctgctcaccaccctccccgatccagctaagaagctccaagtcaatgccgaggagagcagcgacgaggtgggcgactttcccaaggtagaggagaagcttggggccgtcccccatggcttgtccaccgactccgaggttgtccagagggagtccgagtcgatctcgaggaagaccctcaggaactcggccgagaagtttgagttccaggccgaggtgtccaggctcatggacatcatcatcaactcactctacagcaacaaggacatcttcctgagggagctcatttccaatgcatctgatgctttggataagattag

SEQ ID NO: 5751 - DNA, 306 bp, Triticum aestivum
  Clone ID: LIB3281-031-P1-K1-A7
cccacgcgttcgcggacgcgtgggcggtcgcgttctatgacacggatatggcggcacggtactagcaggcgttccatctaatcttataaggtgacacttattccctaccacaagtagcccgaattatcataatctttctacttacactaaatcctcacgagcgtctacaatgctttgcccacttacttccgtgtgctccaccaaggacgccatcttatccctaggatgatcctccaccacctcaaggaacaggacagtgcggatttctttcttcttttgcttatcggggatctaaagaattcagtc

SEQ ID NO: 5752 - DNA, 395 bp, Triticum aestivum
  Clone ID: LIB3281-031-P1-K1-B11
cgacgccggtgtacggaactccatcgccgagctgcctgtgcaccccgaccggggagcccggatgccagtgcccaactccaacccccacgccggtctacgtggcgccgccgacgccggagctccctcctcccacgccggtgtacgctccaccgacggcgcccgtgtacggtactccatcgccgagatgcttgtgcacgccgaccccggcaccggggtgcgagtgccctgctcccacccccacgccgggctacgggacgccaacaccgacgcctgccgctccggcgtacccacgggcggcgcctgaatacggagcgccgccggcgccagaggtgcccgcaggagtacggcacgcccaatttacactttcctcgggccaccacttagctccattaatg

SEQ ID NO: 5753 - DNA, 391 bp, Triticum aestivum
  Clone ID: LIB3281-031-P1-K1-B12
acgctccgattcgaaatactccttccccagctagggttttgctgcctccggcggcggctcccgccagcgtcgtccccccatggcgctgccgaaccagaacaccgtcgattaccccagcttcaagctcgtcatcgtcggcgatggcgggactggcaaaaccacttttgtgaagaggcatctcactggagagtttgagaagaaatatgagcccactattggtgttgaagttcacccattggatttcaccactaactgtggaaagatccgtttctactgctgggacactgctgggcaagagaagtttggtggccttagggatggatactatatccatggtcagtgggcgataatcatgtttgatgtcacttcaagggctacatacaagaatgtt

SEQ ID NO: 5754 - DNA, 297 bp, Triticum aestivum
  Clone ID: LIB3281-031-P1-K1-B2
cccacgcgtccgcggacgcgtggggtagccgtcccaatcctcgatctggtgggagaccctcctccgggcgtcgcagctccagatttccttccccatggctccgatcaagatcggtatcaacggtttcggccggatcggcaggcttgtggccagggttgcgctccagagccccgatgtcgagctcgtcgccgtcaacgaccccttcatcaccaccgactacatgacctacatgttcaagtttgacactgtccacggacagtggaagcaccatgaatttaaggggaaggactccaagac

SEQ ID NO: 5755 - DNA, 390 bp, Triticum aestivum
  unsure (1)...(390): unsure at all n locations
  Clone ID: LIB3281-031-P1-K1-B3
cccacgcgttcgcgtcgtcactcgagcaccgggacgccatggacaggatgggcacttgcttccctgcgccggacaccatggagtggctagatctggccatggacggcgactcccagtgacaagggacggcctgtcctgccaccttgaagccatagcaaggcggatgaacaaggaggagaccacagtctgaggggagctaggaggggtctgaagcggtcgtctctttcgagcgcaaagacgggtctgcggtggatgctgggttgcagctcaggtcgatggtgcggccatggacacaacctngctaaccttgacaaccaatgcgtcggcaggggagcaactaattcctgaacctttgcttctcctctttaatttgaagttcttagtgtagtt

SEQ ID NO: 5756 - DNA, 202 bp, Triticum aestivum
  Clone ID: LIB3281-031-P1-K1-B4
cggacgcgtgggcggacgcgtgggttccactccactgccagcgagaactccgctgggtggtccgtgcggccggccctcgagatccagcatgatccctgccggtgctgcagctgctgctggtggaattgttgctcctcctcccggaggggtgatgcgcatccgcgcggtggcatgggctcacattttgcttgggtgggccacc

SEQ ID NO: 5757 - DNA, 338 bp, Triticum aestivum
  Clone ID: LIB3281-031-P1-K1-B6
caccattcgttcgggttgacgaggctagtctatggaacaacgtatctcaacagagggaggaggactcactatggcactacactaacaataggactgaatggaagctagggatattggtcaggctagaatgggctggatgtaggaacaaacaacatggccgcgagctagctgattggaggctgcagttttgggaaagtaaggatgcaaggcttgagggatgacacacctggtgcaggtggaggaggaaaccccaagttcagagcgaggagttaatgtgttgcggacagagatcgatctactttcacgtattgttgaaccggcacttggtgtatcttatt

SEQ ID NO: 5758 - DNA, 266 bp, Triticum aestivum
  Clone ID: LIB3281-031-P1-K1-B9
cggacgcgtgggcggacgcgtggtttttcctaatagaagagaagtgcatggggccctgtgcgcgggacgagaagaatctgaagagagtgtcatacgaggacattgttaaagctaccaactggttttctttggtccatactatcagtttaacttgtactggttcagattatgttggtaggttcaagtccgacaagagcctatttgccattcaaagtatttaagttgaatgaacctttgtggatacttttgttacctttattgagtgt

SEQ ID NO: 5759 - DNA, 401 bp, Triticum aestivum
  Clone ID: LIB3281-031-P1-K1-C1
caatgatgactcctactgcaccaagggtgcctagtactacgtgcaggacgctgacaacgaccaggagtagtttaagaggatcccaggcaggaagcctgcgcctctttcaatctgtatcccagtttgtgctagtcatcttatggcaacttgtttaacttatgtctatactcagatattgttgcttccgctgactcatctatgatcgagcacttgtattcgagccctcgaagcccctggcttgtattatgatgcttgtatgacttattttatttttagagttatgttatgatattttccaataagtccctgatcttgatcgtacacgtttatgtgtatgattaatggacgattgaatcaaggacatcacaaacaccaagcaggcttcaacaggagaaatgcac

SEQ ID NO: 5760 - DNA, 198 bp, Triticum aestivum
  Clone ID: LIB3281-031-P1-K1-C11
cggacgcgtgggcttcctagatcaattttctgaagactagaacaggtggagaaagagtatggtattacaccaataatattgctattttgaagggtaatctttacaaggtgactcatattacctaccttatgcgggatctcaccatttatctagttattatattggtttgtttttttcgagtaaagggatattaccgat

SEQ ID NO: 5761 - DNA, 362 bp, Triticum aestivum
  Clone ID: LIB3281-031-P1-K1-C12
taaccccgttagcatcttgtgccgaggagatgaagaatttgccttggcgcggttgaacctccgtagatccaacgatgagtggggcaaaattgaggctgagctgtgtgtcctccgctccaaagtaagcaatcgtcttcacgagtggaagagtgagaagtggctgccaatccagtacgagggacatgaaagatctgatttggacagttggagaacggacagagtagttccattcaacaagtttttgtgttgggttaattacggcgggggaggcatcttattctgtgaggtgttcaaacaaaaaccaaacattttttacctccgactacctataattgcgcctcgtttacatcaatgttcattga

SEQ ID NO: 5762 - DNA, 392 bp, Triticum aestivum
  Clone ID: LIB3281-031-P1-K1-C2
cacacgcgcgtcgcattgcgggctttgcacaagcccggagccggaggcaagggtggatgctgccgcgcgtcctgacctctccccgcgaataatctggtctcatggcgaagcaacactatgcaaccagcagccttgtgataggctatgccttgtgctcgagcttgctggcgatcattaacaagtatgccgtcacaaagttcaattaccctggcctcctgacaacgctacagtacttgacatctgctgctggtgtttgggcccttggaaagctaggttttctctgccatgaccccttcaacctggagactgccaagaaatttgcaccggctgctattgtcttctacctcgccatatttacaaacacaaacctctttgtttatgccaatgtggac

SEQ ID NO: 5763 - DNA, 278 bp, Triticum aestivum
  unsure (1)...(278): unsure at all n locations
  Clone ID: LIB3281-031-P1-K1-C3
tatatctcctcttaatatcatatcggtcttttgggacattggtatcatancggagagcttgggttcaaatctcggtgcccgcatattccccaatcatttatccacgccaacgttgggcattggtggacgtgttgatcattccatatccacatcggatgtgagggggagtgggtggggtggggggttaagtatactagaggatacatggctcgttgttgcttgtattggatgacattattttttgtttttgatatcatgtagctccttaattatttttt

SEQ ID NO: 5764 - DNA, 364 bp, Triticum aestivum
  Clone ID: LIB3281-031-P1-K1-C6
gaagagagagccgcccttcgctccccccagaggccagagacggacacgatggcggggcccacctcctccgcggcatccaccctcgcccccttctcccaccccaaaaccctagccgccgccaccgccgccggaggctcatcctctgtcgccttctctccggccgcctcccaccccgcatgcgccctatcagtctcgggcgcccgccgccgcgcggtcgccgccatggtcgcggccccggccaaggtcggcgccgccatgccgtcgctcgacttcgacaccgccgtcttcaacaaggagaaggtcttcctcgcctgccacgaggagtacatcgtgaggggcgggcgcaaccctcttccgtgcttcc

SEQ ID NO: 5765 - DNA, 242 bp, Triticum aestivum
  Clone ID: LIB3281-031-P1-K1-C7
cggacgcgtggggtctgtggaaagcctattattgcagttctaattgaattggagttgtgggtgatggctgatgttctaaatcttgttgacagaatagcatggcatctatcagagatcactgctgctggaatcttgtaacaagtatagtagtacattgcttattgtgaacttaattatgcatgcactgagttgtgatgagtatggttgttctcgctgcttaaaaaggcaggctgtgccctttg

SEQ ID NO: 5766 - DNA, 297 bp, Triticum aestivum
  Clone ID: LIB3281-031-P1-K1-C9
ccggcatcagtcactcctcttcactcctaaccagcgagtaacactccaagcggccaatggcgttctccaagcccctggcggctctcctcctcgccgtggcgctggcagcgactgccatgtccgccgccggtcaggatccccaaaactgcaagccgagccgcaaggtgacggtgcagaacctgtgcggcaaggacctctacctcggtatcgagccgctggccaacagcaagctcctctacagccctggctttctgctccgccacggcacccacgtgtcgtacgacgtgtgctcgtgga

SEQ ID NO: 5767 - DNA, 233 bp, Triticum aestivum
  Clone ID: LIB3281-031-P1-K1-D1
gggcgcgctcgacgaggactgcctcctctcgttgcggttgcgcaccggcatggtattccgggattgcgacctgctgtccgcgaatactgttttcgagaacgtctcgctgccgctgaagatcgccggcgtgccgaatgccgagcgcacgcgcaaggccgaggctctgctcgaactcgtagggctcgccgcgaagcgcgacgcgtacccggcgagcctgtttgtcggacagaagc

SEQ ID NO: 5768 - DNA, 386 bp, Triticum aestivum
  Clone ID: LIB3281-031-P1-K1-D10
cccacacgtacataacattcaatttatactggcttattccatattgggagcgtggtcttttgggatccccataccggactgggtgaataacataccggactgggtgacttatgggatccccgtcccggattggccgatatagtaagtaaggttgcagtgcctgaatttgagccaaagagtggggttaagattgaaacagatgagtaggctactaaccttttcagcgcctcagttgacgatactgttgttatttaagaccctataaccaagcttgaagcatgtgcctagaaactacttttaggattccaaatgattccctattttttactgcttttgattgtgttagagttttcaagaggttttacaagcttgatgctttgtttatt

SEQ ID NO: 5769 - DNA, 166 bp, Triticum aestivum
  Clone ID: LIB3281-031-P1-K1-D11
ctcaagcagaagcagcagccaccccaagctcaagctcaagctctgcgctgggggcctgcaatggcgcgcatccagctcgtggctctggccctgaccatgctgttcgccgccaccgtggcccaggccccggcggacacccctatgcccgcgcgcgtggacccggtgt

SEQ ID NO: 5770 - DNA, 372 bp, Triticum aestivum
  Clone ID: LIB3281-031-P1-K1-D12
cggacgcgtggggtttgaagttgtagctgtatccttggacagtgatgaggaatcattcaataacagtttttcaagcatgccttggctcgccattccccatggcgacaagatgtgtcagaagcttgtcagttactttgagcttagtgatcttcctacactagtgctgattggtcctgatgggaagacactgagcagcaatattgcagacataattaatgagcatggtttggatgcatgggaggggttccccttcaatgcagagaagctggaaattctagcggagaaggcaaaggctaaagcagcgtcacagacattggagtcccttctggttactggtgacgtagactttgtcatcgggaaagatggagcaaa

SEQ ID NO: 5771 - DNA, 285 bp, Triticum aestivum
  Clone ID: LIB3281-031-P1-K1-D2
cccacgcgtccgcccacgcgtccgctccaccccacgcgcaaaggagacccgagccgagtccgcccaccaaatcccacccgcgtctgccgcctccgcctgccgccggcgagatgatgatgctcgtcaactgctccggctgccgcacggcgctgcagctgccccacggcgcgccctgcatccgctgctccatctgcggcgccgtcaccaacgtcgccgcgccacccgcgcctggccccgtcgtggaccccgcccggggcgcgcaggcgccggcgccggggtgggggc

SEQ ID NO: 5772 - DNA, 318 bp, Triticum aestivum
  Clone ID: LIB3281-031-P1-K1-D3
cccacgcgtccggttcgtcacgcccagaccccatcccaccgctgctacagggtacaatctactcggagaacgacggcgagcaccgcatgccgcatctccgccacagtagctccgtcgcagcatcagaagtcgcccgccgcgagctttatcgcagcaccccgtcgctctcggcctctcgcggcatcagacatcgcggcagcatgcgtgcggcggtgctgcagtggaccgctcgccggtggcgatgctgcgatgcagcgtttgcgcagaggcccggagctcggcgccgaaaggaagcttgaccggttggtgcaatggagc

SEQ ID NO: 5773 - DNA, 256 bp, Triticum aestivum
  Clone ID: LIB3281-031-P1-K1-D4
gttacgagtccctctagacacgtcctgtcccgcccgatcccatatcctttggcggcgggaaccctcgtggaagaagttatgcacctaatgcctcatctccccctcaacatattcgtagcaggatcagaagtctcccgccgtgagctttatctcattaccacgtcttctctcaggtctctatcgggatcagacattgtggcagtatgcgtgcggtggtgctgcataggacctgtcttccgtggcgatgcttttattg

SEQ ID NO: 5774 - DNA, 391 bp, Triticum aestivum
  Clone ID: LIB3281-031-P1-K1-D6
aaagatcactgctagagccatggaacggacaatgaagaaaattggacacctgtcaggattttacattttcttctcttactggagggagttcttcagtggacgctctgacccctaaaatgcagaaggacacactggattcatttcgctccggaaaggtgaacttactatttactacggatgtcgcggaagagggtattgatgtcacagactgctcgtgtgtaataagatttgatttgccaaagactacccgtagttatatgcagtcacgtggacgagcacggcagatatcaaattattttgtttaacattttccctgtcaatcattagtatgtgtgctcaaggagagcagcgacgacgtccgggacgactggttcttgctgggcaggttcga

SEQ ID NO: 5775 - DNA, 330 bp, Triticum aestivum
  Clone ID: LIB3281-031-P1-K1-D8
tcggcaagctcagtgataacttattcgcaatcattgtgccgaccgagggtgagtatttaatggccagcactagaaagaaggaaattgttgatgttatagttaaggctatccagagcacatttgagtatgaacctgaggtggcttcctctaacaggtcgtgagaccatgctgctgccgaagtgattaaagaagttgtatttgaagaagctgattgtcgcatcaaaactaggatcaccctctaggagaagccatgattcataatcatttttcttgcttcctgtacgatgggtatttttttttaattcttgtttgatttttatattcttctta

SEQ ID NO: 5776 - DNA, 309 bp, Triticum aestivum
  unsure (1)...(309): unsure at all n locations
  Clone ID: LIB3281-031-P1-K1-D9
cccacgcgttcgtcacattcaatttatactggcttcttccatattgagagcggtgtcttttgggatccccataccngactgggtgaataacataccggactgggtgtcttttgggatccccgtaccggattggccgatatagtaagtaaggttgcagtgcctgaatttgagccaaagagtggggtttagattgaaacagatgagaaggcttctaacctctccagtgcctcagttgacgatactgctgttatttaagaccttttaaccaagcttgaagcattgtgccaagaaacctaccttaagatttca

SEQ ID NO: 5777 - DNA, 390 bp, Triticum aestivum
  Clone ID: LIB3281-031-P1-K1-E12
cggacgcgtgggatactttcgaaaaccacaagttatctgacagaggactatgcaaacttttacttatcaatgagcttgatgaaagcttgcttttagttggctcaagtgatggaaatgtccgtatatggagaaactatgctcaaaagggaggacagaaacttgtaactgctttctcatcagttcagggccatcgagctgcaggccgcagcgttgtgattgactggcaacagcaatctggttatctgtatgcatctggtgacatgtcttccatccttgtatgggatcttgacaaggagcaacttctcaacaccattccatcatctgctgatagtggcatttcagctctgtctgcatctcaggttagacctggtcaatttgctggcggtttta

SEQ ID NO: 5778 - DNA, 379 bp, Triticum aestivum
  Clone ID: LIB3281-031-P1-K1-E2
catctctcctccctccgttagggttccactcccattcctcctccggccgggggctgcgcatcgacctcctcggttgccatgggcacggatgaccacgaattccggctgctcacgatccctacgcccatccaccccgaggatccggactctcctcttccggagaccatcctcatcgactcgttcggctacctcagcgaccgcaccaacgccaccactgccaatggccgcaggagcaggaccgagaagaagggcaagcgcatcctggtcaccttctggccggctgccccgccgcgcgtctcctgcttcactgtccactgcccagatctgaaggccgacgcgtacggcagcatccccaaggtctgctacacggaggacgggc

SEQ ID NO: 5779 - DNA, 387 bp, Triticum aestivum
  Clone ID: LIB3281-031-P1-K1-E3
cccacgcgtccgctctgagaagctgctctcgcagaagaatggtactgaaagtgttggagattccagaggttaaggattatcaacgtagaaaggtacctggggatgaagttcttgagcaagaagtatacggcatagatccatacacacataatctcctgcgtgacattatgccagccgacgttggcttgtcatctgctgacaaacatacctttattgaggagctgcttctgaatactttgaataagcaggttcgggatttcactggttctggaaatactcctatggtttacccccttaaacctgtcattgaagaaatccaaaagtctgcataggagagtggtgatagactaattgcaaagatgtgctcttggaatgctaaaggccatg

SEQ ID NO: 5780 - DNA, 173 bp, Triticum aestivum
  unsure (1)...(173): unsure at all n locations
  Clone ID: LIB3281-031-P1-K1-E7
gttcgcggcgcagagcacggacggcggcgtgccgctgcactggggggtggggtcggacgggtcggtggttatctgcnactaccgttctgtggtcaaggcctggtgctgggttttttttattcgttttttttttgtttttgtgtatttttttttttttttgtttttgtttttta

SEQ ID NO: 5781 - DNA, 134 bp, Triticum aestivum
  Clone ID: LIB3281-031-P1-K1-E8
gcggggccagcatggacaaggcggacctcgacggcgactgctccgggcctgtgcagaccacggtgccggcatcctatcttcgggagctcttgaagagactgtaggtctgccaccctttcaccatttacgacttt

SEQ ID NO: 5782 - DNA, 371 bp, Triticum aestivum
  Clone ID: LIB3281-031-P1-K1-F1
ggcttctcctccccttccggttcgggttcgggttctggttcggttcgggtgcgagagtagctagcctagtctagggtttccgtagagaggaggaggagaggaagagagagatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgcgggttcggcttcttcacgttcggcagcgaggagtcgatgcgccaggccatcgaggagatgaacggcaaggagcttgacgggcgcaacataaccgtcaacgaggcccagtcccgcct

SEQ ID NO: 5783 - DNA, 204 bp, Triticum aestivum
  Clone ID: LIB3281-031-P1-K1-F10
tcgactcgtcccgagcctttaccaccctaccccatcggacctatacctggattgcgggttcctacccccgtggctccttctctctacgtcttcatggttgtagctcgcttactagtttcttacaaattttttacttggactgaggcgtggatattttgggtagcccttctactttatataatttcagacgccttaaatgatgag

SEQ ID NO: 5784 - DNA, 256 bp, Triticum aestivum
  Clone ID: LIB3281-031-P1-K1-F12
catgcctgatcctgcgatgcatggtgttgggggtgcgatcacatcgggatgggagatgggagggatgcctatgacatatacctttccctcacaaacagttccaattgaggcattggcttcatgcacttgccaattcacccccagagactcaaagaatcatgcttgacaagaacttggaccctcttgatgatcaactggggcacgaccaggcttccaaggtgaccggaatgcttttcgagatggaccatacttaggt

SEQ ID NO: 5785 - DNA, 370 bp, Triticum aestivum
  Clone ID: LIB3281-031-P1-K1-F2
cggacgcgtgggcaggcctacaggaagatcagactccgtgctgaggatgtgcgaggggatgaatgtcctcacaaacttctggggcatggacttcaccactgacaagctcaggtctcttgtgaggaagtggcagacactcattgaggctcatgtggatgtgaagaccactgacaactacatgctccgcatgttcgccattggcttcaccaagagacgcccaaaccaggtgaagcgcacttgctatgcccaagcaagtcagatcagacagatccgccgcaagatggttgagatcatggtcaaccaagctgcaagctgtgacttgaaagagcttgtgaacaagttcatccctgaggtgattggaaaggagatt

SEQ ID NO: 5786 - DNA, 167 bp, Triticum aestivum
  Clone ID: LIB3281-031-P1-K1-F3
gcgtcaagcgcatctccgtgctcatctaccaaaagaccctctgcgtacttagaaggggggtttagaacgtcatcctttactcctacacctacacctaacactcttgtcttaagacctgtaaggtcatggactttcaattacttgccgtaatcgccagggtctcaccc

SEQ ID NO: 5787 - DNA, 350 bp, Triticum aestivum
  Clone ID: LIB3281-031-P1-K1-F6
ggagaagctctgcgacgcggtggaggagcagaggatcgacaccatcgtcgggtgcggtcgcggcctcggcaccatccagaggattcttctgggaagcgtgaccaactacgtgctgtcgaacgcgtcgtgccctgtgacagtcgtcaagggagacctgtaggtttgccatcggtgtgcatcaggatgcgcttcatcgttctctgctccgttgctgcgtccgaataaagtatggagcctgttgtgttttctgtatgccggaccttggcagattattgaagtcgtgtgtgtttctgaacatttgggttcaaattcagtaaagtgttttaatttattttctttttttcatgaat

SEQ ID NO: 5788 - DNA, 240 bp, Triticum aestivum
  unsure (1)...(240): unsure at all n locations
  Clone ID: LIB3281-031-P1-K1-F7
cggacgcgtggggtcgcagccacccactggagctcgccagtcccgtggtggctagtcgcgcgacacgagtcntcttgcccaggtcctctctggcgagttagccatggacgcttgctttccggtcctcggcgtcggggcgctgctccttgtcctcctgggggcctcggcgccgacggcgttcggggcgcgggcctttttcgttttgggcgactcctcgtgacaccggaacacaactcctat

SEQ ID NO: 5789 - DNA, 101 bp, Triticum aestivum
  Clone ID: LIB3281-031-P1-K1-F8
tcctccttcatctcttcaccccaatttttactaaaaatttcccattcacactagggttggcttaaatttctacctttatttatcatacttaaattctattc

SEQ ID NO: 5790 - DNA, 228 bp, Triticum aestivum
  Clone ID: LIB3281-031-P1-K1-F9
cggacgcgtgggtgaaattcccgatgacgcaatcttcactgatgttgagcgggtcttggagcctcttgaactcttttacaggtccctttgtgcctgtggtgatcacactattgcagatggcaatcttcttgacttttttcggcaagtgttaacatttggactatcccttgttagactagatatcatgcaagaatctgaaagacacactgattttatggattgtataac

SEQ ID NO: 5791 - DNA, 306 bp, Triticum aestivum
  Clone ID: LIB3281-031-P1-K1-G1
gctggtctgcctccggcgaggcctttccctcctccggcagcgccagccccggctccggccccgcctgctgctccacctctccgccgagccgatgggggacccggccgtcgcgccggacgcgccctacctggaggcggtgacgcagaagcggatccgcatcttcgaggagatccaggcccggcaggccctcgagcgcctcaacatcggcggcgaccccatcagagtaactttgcctgatggcgcgataaaagaaggcaagaagtggatatcgaccccgatggacattcgcacggggatatcaactgg

SEQ ID NO: 5792 - DNA, 136 bp, Triticum aestivum
  Clone ID: LIB3281-031-P1-K1-G10
gtttcatggacaaaaggttttaaacgaaggaaatatgaagtacatggggggggagggtgaggtatgggctctttataagggatggaacatgcattggggttcatattcatataattatagatcctatgtatatgat

SEQ ID NO: 5793 - DNA, 381 bp, Triticum aestivum
  Clone ID: LIB3281-031-P1-K1-G12
cccacgcgtccgcccacgcgtccgtacgaacagacctgatgctgtcgaccaagcgcttcgaagaccaggaaggtttgatcgggaaatatatcttggcgttccagatgagaatgcccggaaacagatactggagaggctcactcagaaacttcgattgcccccggaaggccaatttgatttgttgaagatagcaaaggccacggcaggattcgttggtgcagacttgaaggcgttggttgatacagcagggagtgtagctatgaaaagattttttaatgctagaaaagacaagtttctgaaggaaggaaacaacctggactaccggaagcatcctttggataaacatgagatgcagggcctaagtataactatggatgactt

SEQ ID NO: 5794 - DNA, 362 bp, Triticum aestivum
  Clone ID: LIB3281-031-P1-K1-G2
cgaatccctcgccccgccccgccccgccccgaaaccctagctaggcagccatgggcaacccggagaagctgatggcgcaaatcttcgacctcaagttcacgtccaagtcgctgcagcggcaggcgcgcaagtgcgagaaggaggagaaggagcagaagctcaaggtgaagaaggccatcgagaagggcaacgtggacggcgcgcggatctacgccgagaacgccatccgcaagcgcaccgagcacatgaactacctccgcctcgcctcccgcctcgacgccgtcgtcgcccgcctcgacacgcaggccaagatgcaggccatcggcaagtccatgggcaacatcgtcaagtcgctcgacttc

SEQ ID NO: 5795 - DNA, 351 bp, Triticum aestivum
  unsure (1)...(351): unsure at all n locations
  Clone ID: LIB3281-031-P1-K1-G3
cnaatccctcgccccgccccgcccttccccgaaaccctagctaggcagccgggggcggcccgtagaaggtgatggctcaaatcttcgacctcaagttcacgttcaagtcgctgcagcggcaggcgcgcaagtgcgagaaggaggagaaggagcagaagctcaaggtgaagaaggccatcgagaagggcaacgtggacggcgcgcggatctactccgtgaacgccatcctcatgcgctccgagcacatgaactactttcggcttgccttccgcctagactccggggtgggccgcgcttacacgcatgccaagatgcaggccatttggtaaggccatgggctacatttgttaa

SEQ ID NO: 5796 - DNA, 397 bp, Triticum aestivum
  Clone ID: LIB3281-031-P1-K1-G4
cgcaggttccgccaccccctgcagcaacacaaccccgcaatcccctgccccggcggcggtccgaacccctgccgtccgccgccgaccaccaccgcgatcgttcgttgccaccacctgcgctgcctgggctattatgcctggctgcgttttgggcgaaataatctcgctggagacagaggcgggagaagagtcgtcgatttcgttgtgcaatcgggtaagagaggaggagtttgattgctgtttgtgcggcaagcgcagtccaaaaggagtaattattattcggagtttgtgtgttgagaagttgtaaccagatactcctccctctcctctaacaatctcctcccttttggaggagagccggcccaaataaacaaaggagtgggaggagtaggagggg

SEQ ID NO: 5797 - DNA, 86 bp, Triticum aestivum
  Clone ID: LIB3281-031-P1-K1-G5
cctaaatccccgccaaccacggcgccctcggctaatgaaagatacctttcgtggggaagtacaacagcatgttggcataactattc

SEQ ID NO: 5798 - DNA, 122 bp, Triticum aestivum
  Clone ID: LIB3281-031-P1-K1-G6
gttgggtctcgtatttcactttggtcaatcataggaagggaaagggtcactgcatgtgcatcagacgatgtgatactgatacatatttatgcttctgattactcacacttgaattctactcc

SEQ ID NO: 5799 - DNA, 225 bp, Triticum aestivum
  Clone ID: LIB3281-031-P1-K1-G7
cccacgctccgcccacgcgtccgcggacgcgtgggtgtgtgtttagttcaggtgagctccagaggaacggtacgaacaatacagaaaaaggccagacttcctaacagaatacatattccctggcggttgccttccttctttggcccgtgtagtgtctgccatgagcaagtcatcaaggttgagcatagagcatgttgagaatattgggccccattactacacaac

SEQ ID NO: 5800 - DNA, 268 bp, Triticum aestivum
  Clone ID: LIB3281-031-P1-K1-G8
acccgtatccgtcgcctcggccggtcccggcccgaaaccctagctaggcaagcaggggcagcccaagaacacggatgacatccaatcttaacacctagagcttcaccgtgcgagtgaggtacaatcctgtagagagcggcaagtgcggagctgtgtgctacacgtgccaaaccaccatggggattaggtcgttgtttgagggcattgagattggcgcggatctacgccgagaacgccatccggaagcgcaccgagcacatgaactacc

SEQ ID NO: 5801 - DNA, 288 bp, Triticum aestivum
  Clone ID: LIB3281-031-P1-K1-G9
cggacgcgtggggtcctccccggggagctcgccaagcacgccgtctgtgagggcaccaaggccgtcaccaagttcacctcctcttagattgcgtcgcctgtatctagtagcaaatgcagttccttcctgttggtttagtgcttgtctgtggactctggttatctgcaagtaatattagtcctactgttggatgaaaattgccgaatcattgccaatgcttttttggctcgtcggaaacaatgttgcgttgttggttctatttatactgatttccgcggtgatttactt

SEQ ID NO: 5802 - DNA, 384 bp, Triticum aestivum
  Clone ID: LIB3281-031-P1-K1-H1
cccacgcgtccgcgctcctccaatcccacattcgctccaagctcgaacaaaggagagaccgtcagccatgtccgggcgcggcaagggaggcaaggggctcggcaagggcggcgccaagcgccacaggaaggtgctgcgcgacaacatccagggcatcaccaagccggcgatccggcgcctggctcggaggggcggtgtcaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgacagggccgcaccctctacggcttcggcggctaggctcg

SEQ ID NO: 5803 - DNA, 403 bp, Triticum aestivum
  Clone ID: LIB3281-031-P1-K1-H10
cggacgcgtgggataaaatttgagccaaatattatgtgtgaaccagtggacgtgtgatgtttccttcagtttaaaccagattgcagatggagacatattgtgctaccaaaaacgttgttctctggaccaacaccgacatcccaatgtatcttctttctttgaatatgtccataatagacaggttgtgcacttcagattgcttgaaaagccaaaacaagatgacttctctctagaactatcaaaacgttccacatatgatgatgttgttgagaaagttgcacaacatcttggtatggatgatccttcaaaactccgccttactcagcacatccctcatttacagcaaccgaaacatcaatacatcaagtatagaagtattgatcatctttcggacatgttactt

SEQ ID NO: 5804 - DNA, 346 bp, Triticum aestivum
  Clone ID: LIB3281-031-P1-K1-H11
ctatcttgttagtagcgtgatgtatcatttgcctctcgcgtgcggttgatgccatctgtaagaaatatttatgctaatccttaacgggtagattgatagttttttaaaaaaaaaaaaaaaaaaaaaaaaacaaaaaaaaaagaaaaaaaaaaaaaaaaaaaaaaaaaaaaaaaaaaaaaaaaaaaaaaaaaaaaaagaacaaataaaaaaaaaaaaaaaacaaaaggggcgggcgttaaaaaggatccaaatttactacccggtgcttgctaagaaagagctttttaatggggtccccaaaaaaaaattaagtggccctgttttaaaaacatattaacgggaaaaa

SEQ ID NO: 5805 - DNA, 394 bp, Triticum aestivum
  Clone ID: LIB3281-031-P1-K1-H12
cggacgcgtgggggccatcctccctctcctcccctctcttccacctcacgtgctcacccaaccacctgatagccatggctccgccgcctcgcctccgcctgcgccagtcggagtagccgtcgcggtctgccggtgttggagggtaggggcgtagggttggcccggttctcgagcggagatggggcgggggaaggtgcagctgaagcggatcgagaacaagatcaaccggcaggtgaccttctccaagcgccgctcggggcttctcaagaaggcgcacgagatctccgtgctctgcgacgccgaggtcggcctcatcatcttctccaccaagggaaagctctacgagttctccaccgagtcatgtatggacaaaattcttgaacggtatgagcgc

SEQ ID NO: 5806 - DNA, 391 bp, Triticum aestivum
  Clone ID: LIB3281-031-P1-K1-H2
cggacgcgtggggtgccaccgccgcgagcgttgccatggagccgaagcggccaccagcagatcagcagccgtgcctgctacttcggaggtcctcacttttttgctgcaatcggtttgtgggaagctgcaaccggccgtctaggagctgcgaccggcgacggccacctgcgggatgcggcggcgctggaaacggtgacatcagggatgctggaacccgtggtgttttttgctgctaccagctgtaatttttgctggaactggtgtgttctttttccttggatcggtgtcggcggtgattttctgctggaaccaagttctatttttgctggaaccagtgatatgttttctgctatgggaagaatttttggtggaactggtgtttcctttgctc

SEQ ID NO: 5807 - DNA, 385 bp, Triticum aestivum
  unsure (1)...(385): unsure at all n locations
  Clone ID: LIB3281-031-P1-K1-H3
atcgggtacaagcaccagacggaccccgcggtgaacgccgccgccgacgcggcgtgcggcggcgtgggcgtgctcggcatcgcctgggccttcggcggcatgatcttcgtcctcgtctactgcaccgccggcatctccgggggccacatcaacccggccgtcaccttcggcctcttcctggcgcgcaaggtctccctggtccgcgcgctgctctacatgattgcgcagtgcctcggcgccatgtgcggggtcggcctcgtcaaggccttccagagcgcctacttcgtcaggtacggcggcggcnccaacacgctcgccggcggctactccaagggcaccggcctcgccgcggagatcatcggcaccttcgtgctcggctacaccg

SEQ ID NO: 5808 - DNA, 397 bp, Triticum aestivum
  Clone ID: LIB3281-031-P1-K1-H4
cgcaggtctgcacattttaccagaacggtgtgtgctcttatggcagccgttgcagatatgaacatgttgaagtttcttctgaatacacccaaccatcaactactgcagcacttgcaccatccaactcttatctgtcatggtgtcctctttgtgagggggaaatagatgtgagcaaccagacacacaaaagtttatcggtatgctctgtgcatcagtctacctggagatttgatgatgaagattgcattccagaggatgggaacagcttgtcatcagcgctaactgcacaaaaccaagcgctccacccacttgctcatctgcccatatgctcttttgccgcagctggaacttgtccctatgggaaagagtgccctcagatgcatggggatccatgcac

SEQ ID NO: 5809 - DNA, 402 bp, Triticum aestivum
  Clone ID: LIB3281-031-P1-K1-H5
gcttgcaaggaccacttcagaaactgatctcatgacagagtatgtggtcactcgttggtaccgagcaccagagttgctgttgaactgttcacaatatactgctgcaattgatgtctggtcagttgggtgcatacttggtgaaattattactcgtcaacccctgtttcctggaagagattacatccaacagttaaaattgatcactgagttgataggatcaccagatgattcgagcctaggatttcttcggagtgataatgcacgaagatacatgaagcaattaccacagtacccaaggcaggacttccgcctgcgcttccgcaacatgtctgatggtgcagttgatctgttagagagaatgctggtgtttgacccaagcagacgcattactgttgatgaggc

SEQ ID NO: 5810 - DNA, 385 bp, Triticum aestivum
  Clone ID: LIB3281-031-P1-K1-H6
ctctactactccatcccagccaaacttttctctcgccctcgaagcagcagccgccggagcatccatggcacccaaggccgccgagaagaagccggtggagaagacccccgcgggcaagaagcccaaggcggagaagaaggtgccggcgtccaaggagggcggcgacaagaaggggaagaagaaggccaagaagagcgtggagacgtacaagatctacatcttcaaggtgctcaagcaggtgcaccccgacatcggcatctcctccaaggccatgtccatcatgaactccttcatcaacgacatcttcgagaagctcgccggcgagtccgccaagctcgcgaggtacaacaagaagcccaccatcacgtcccgcgagatccagacc

SEQ ID NO: 5811 - DNA, 363 bp, Triticum aestivum
  Clone ID: LIB3281-031-P1-K1-H7
cccacgcgtacgcgctcctccaatcccacattcgctccaagctcgaacaaaggagagaccgtcagccatgtccgggcgcggcaagggaggcaaggggctcggcaagggcggcgccaagcgccacaggaaggtgctgcgcgacaacatccagggcatcaccaagccggcgatccggcgcctggctcggaggggcggtgtcaagcgcatctcggggctcatctacgaggagacccgcggcgtgctcaagatcttcctcgagaacgtcatccgcgacgccgtcacctacaccgagcacgcccgccgcaagaccgtcaccggcatggacgtcgtctacgccctcaagcgacagggccgcaccctcta

SEQ ID NO: 5812 - DNA, 389 bp, Triticum aestivum
  Clone ID: LIB3281-031-P1-K1-H9
cggacgcgtgggataaaatttgagccaaatattatgtgtgaaccagttgactgtgatgtttccttcagtttaaaccagattgcagatggagacatattgtgctaccaaaaacgttgttctctggaccaacaccgacatcccaatgtatcttctttctttgaatatgtccataatagacaggttgtgcacttcagattgcttgaaaagccaaaacaagatgacttctctctagaactatcaaaacgttccacatatgatgatgttgttgagaaagttgcacaacatcttggtatggatgatccttcaaaactccgccttactcagcacatccctcatttacagcaaccgaaacatcaatacatcaagtatagaagtattgatcatctttc

SEQ ID NO: 5813 - DNA, 347 bp, Triticum aestivum
  Clone ID: LIB3281-032-P1-K1-A1
gaatagttaaaagatgaatccaaataaaacgaacatgtctaatgtcatccaagttacacaaactaggtggaggtacaacactgcaaaatccaggaatatattcttcaagacagtacagcttacacataatctagcatgaggcccatcatgcgcagcatgttatcatccaacttagacatcgggcctctgctgacgcaaagagaacaacaacccttcacctgtcatagccaccgccgccagcacggcggccatagcccctttcgggcatacggtacggggagtagggcagcgacctagaccgctcccttcttgccctgccaccataaggagggggagacctgtggggg

SEQ ID NO: 5814 - DNA, 394 bp, Triticum aestivum
  Clone ID: LIB3281-032-P1-K1-A10
cctaggcgcaccaccctaagccaccgcaggaccgctgcggctttgccaccggagttcgtcggaccaccgtgcggatcccggtccgtcgccgcaggcgagggcctccgacgccgatcgaagtgctgctgctgctgtttggtgcagtagccataaaggagattgtgggccagtgatttcttgtttagcctggttgatcctcgacaacacactcttcaacttgttcagtttatgcaatgcaacctgtgcggcaaccgtttcaacttgttgatcaggacatgccagaagctaacatggggatgtcagagcagatgccacatttcccacaacttgggcaccatatgcctcactctggccttgttctacctgcaccacgagctgtgctacctggtggata

SEQ ID NO: 5815 - DNA, 396 bp, Triticum aestivum
  Clone ID: LIB3281-032-P1-K1-A11
cgtcttcacaaacgccggctcgctctcgctccgtctccctccctcctcccccgctccgcgccctccgccgccagatcccgtcgagccccccgcgcccccgcgtcgaagatgagggagtgcatctcgatccacatcgggcaggccggcatccaggtcggcaacgcgtgctgggaactttactgcctcgagcacggcatccagcctgatggccagacgaacggcgacaagaccatcggaggtggtgatgacgccttcaacaccttcttcagcgagaccggagccggcaagtacgtgccccgtgcggtcttcgtcgatcttgagcccaccgtgattgacgaggtccgcaccagcgcctaccgccagctctttcaccccgagcagcttatcagcggcaag

SEQ ID NO: 5816 - DNA, 390 bp, Triticum aestivum
  Clone ID: LIB3281-032-P1-K1-A12
gaccgacatggggttcttcatgcaaggcagcctcaagttcgtcctctatggcgaagaagaataatcagcaggtgcacatgaacaaagagaacaaaggagtagacgatcaagatgtacctgggctcatgttcagatcgatttgacgaccaacctggagcagttcttcatgcaaggcaacctcaagttcgtcctctatggcaaagaagaatcatcagcatgtgcacatgaacaaggagaacaaatgaaaagatgatcaagatgtacctgggttcaggttcaaatcgatttgatgaccaacctggagcaattcttcatgcaagggaggcacatgttcaacttctccctctcctggtgctatgttcaagtcaatggccatggcctctctatgtg

SEQ ID NO: 5817 - DNA, 391 bp, Triticum aestivum
  Clone ID: LIB3281-032-P1-K1-A2
agtgccaaacctaagattcattaatactcgaatgaatatggttcacgactttattacagaaatctgcgagggaaaggcggaacatccctccgctctcataaccttttccaacaaatagtccatacttagtaacaactaatttattagactcgaataccaacttaaacccttctctacatagaagggagccactaacgaggttcttcttgatggcggagacatgctgcacgttctttagctgcacgatccttcccgaagtaaacttcagatcgaccgtgccaacaccatgaacagaagcactcgcgccattccccatcaatacggacccgtggcctgtgacccaaatgcaccattctcattgttgctcacaatcatgttgacagacttggag

SEQ ID NO: 5818 - DNA, 267 bp, Triticum aestivum
  Clone ID: LIB3281-032-P1-K1-A3
cccacgcgttcgtttatgcgttcgcagacgtgtgatcggacgcttggtcggtgtctttggttgacaagttaatgagagaaattttcttgaagaaagtgctagctatattactgtgtgattatattttggaacaaatattttatacttagtaacaacttatttttttgatttgtataccaaaattaactttttatttagatatgatttttgtatatattatgaaggttttttatttgttttagtgtggttttatttataaaatttatt

SEQ ID NO: 5819 - DNA, 384 bp, Triticum aestivum
  Clone ID: LIB3281-032-P1-K1-A4
gctaactggaagtaagctcgactgacaatacgcgttatcaaatgcttgctcttctaactaaagacacaggtcatggttctggatctatacttactgaaatgattactatagagggcacacagcttcaaaagtgaagaatgaggggcgtgttatgttgtttatttccgacaggttggttcaatataaaggtgccatttattgaatatagagcatgggctggaatggctatgcagaattaaacctatatgagttcagggtattggataacatacttatatgtagttctcgagtgtgcacacatgtggctgggctacataatatgtagatgcattatacatgcaaagtggttatgctgctgtctgcttctatgggtacctaaaagac

SEQ ID NO: 5820 - DNA, 388 bp, Triticum aestivum
  Clone ID: LIB3281-032-P1-K1-A5
gtcaactggaagattgctcgactgacaatacactttattaaatgcttcctcttctagggaaaaacacaggtcatggtgctccacctatacttactgcaatgttacctttcgacttcacacagcttccaaattcaaccatgagggccagtgtcttgtgattcattttccgccagttacttccaatttcaaggtaacatttattcgatatagttaatgggctgagaaagagctatgcacatttaaacctatatcatctcagggtattggataacaaacttttttgtagtttgtgactgtgcacacatgtggctgtacaacttaatttgtacatacatcatacaagcaatgtttttttatgttcctttctgcttctataggtccctaaaat

SEQ ID NO: 5821 - DNA, 386 bp, Triticum aestivum
  Clone ID: LIB3281-032-P1-K1-A7
cacgcctcctgggcggccggcggcggctgtcactttcgggggacgccgttcctgacctcggacgcgctcacgctcgccttcatcaccttggtctccctgctctacttcaaggactacaccgctacgctccaccccacctacaaaccaccatgacgacacgcaccatccccgcacccccagcatgcaatcctacttcacttcttaccagagttgccagggcccaaacctgaaagcgagctgactttcaagctttacctgccctcaacagagccaagccaatgccaaagccaagaacactagtgcttacccctgccccacccccagatgccaaccggccagctgattaaccttcccaagccgtgccagaatggatcggcccgtgcacg

SEQ ID NO: 5822 - DNA, 404 bp, Triticum aestivum
  Clone ID: LIB3281-032-P1-K1-A8
ctcattattgttgataataagacatcaaacatcatcgaggaaacaaagaagatacaaattagaagaaagcctaacagttccagtttgcatatgcagaatcctgctgcagatgcattcccccctccgagtttcactcagaataaagctgaggcagctcaggagacccagttaaaagcttctcgcgacgtaaggttgctaatgcgatggctgctaaagcaaaacttgtacttcgtgaactaaaaaccgttaaagcggacctagcctttgcgaagcagcgctgcactcagctagaagaagagaacaaaatgttgcgtgaaactaagcagaaaggggtcaaaattgaagaggatgatgacctgatccgcatgcaactggagacattactcgccgagaaatcaaggctg

SEQ ID NO: 5823 - DNA, 405 bp, Triticum aestivum
  Clone ID: LIB3281-032-P1-K1-A9
cccacgcgtccgcgccctcccccaaaaccctcctcctccgccgccgccgccgcggccacgatcgccatgtccgggccaagctgccccaccaccgtccccgtcggggaggacacgacggtgcctctgaggatgctgcacgggctggccccggagacgctgaacctccacacgcacacgatgctctcattcctctactccttcctccccaagccacccgtctccacactcgcccccctgtgctgcgccgccacggccgccgtcgccgacggaagcgcggaccgcctcagctgcctacccgacgatctcctccgtcgcgtcctctctcgcctccccgccaaggacagcgcgcgcaccaccgtgctctcctcccgctggcgcggcctctggcgctctgtgccgctcgtc

SEQ ID NO: 5824 - DNA, 408 bp, Triticum aestivum
  Clone ID: LIB3281-032-P1-K1-B1
ccaacaccagcaacacacacacagcagccaatcgaagctcgtctcagatcgaagatgtcggtccgcggcaaggacgataaggtgctgggcaagggtgtctataatcgccacctaaaggttctctattacaacatgcaattctttaccaagccgtccatgcattatatggcacggcgggacatgcgtgaagcgcatgtttgcgcttatttactaagagacccgctgtgtgcataagatctttctggagaacgtgatcgcgaacgccgtcacctacaccgagcacgctcgtcggaagaccgttaccgacatggacgttaaatacgccctcaagcgccaaggccgcaccctctaccgattctgcggataggccttgcctgtacactcatatacacttcgcgccgtcagatt

SEQ ID NO: 5825 - DNA, 392 bp, Triticum aestivum
  unsure (1)...(392): unsure at all n locations
  Clone ID: LIB3281-032-P1-K1-B10
gctaccacttcactgcttcctctcccaaactcatcgatcaacaacgagcatctatctagattggccaagtgttcgttgatctacaagccggtttaagatctgggattggccggtcgaattcaacacggagctgagtgtatgtcgaaacatttnatccatcaagcgccgcctcgccgcctccggccaccccgatgacgccctcgccttcaccaacctccactactccatgaggctgggtgcgtgcgcatggcggcgggtctgctgtggtgcgtgcggtggtggcgcggctgggctcgaggagctgcgatgcggcagggagggagctgcttcctcttgtcctgcttcgtgtccctgaggtggttagctgtgcaaggggcgggcgaggagggtgc

SEQ ID NO: 5826 - DNA, 399 bp, Triticum aestivum
  Clone ID: LIB3281-032-P1-K1-B11
acctcccagccacagccacccctctccttgttttcggtgcctcctcccacctcgagggccgcgccgctgcctcccccctccagatccggcgtgccccagcctcccttcgccacctggcaagcccccagtggtcagccgccgcctgcaccgccctccacagccactcccaagcctccacgtgccttccccgcgcctccagccgccgcggcccgcgaagcccacggggagtccgccccgggccgcgaccgggcccgaccccgtgcgccttggcccccttgcctgcttgcccactccctcgctcgatcccctcgctgccgcatcggtcctgcgctccggccaccaggggcctcgccggagcaggaacacccgaccttcgcccgacccaggagccaccacagc

SEQ ID NO: 5827 - DNA, 397 bp, Triticum aestivum
  Clone ID: LIB3281-032-P1-K1-B12
cggaagctattctagagaaatcgggaatgccctgctcgtcggccccgcagtctcgctccgcccccggcgacctcctcccccccatccacccaaggcagcgagattgctaccccggccccaagtgaagatccatccgggcgtagttccttcttttcttggttcaaatgactttggccagttgggagatgggacagaggagagtgcaaaggaacctaaaaaagtcaatgcactggcaactgagtttgtgaaatcggtgtcctgtggcgcacactgtacagctgctattgctgaacctcgagaaaatgatggcacaatatcgagaagcaggttatgggtttggggacaaaatcagggctcagattaccctcgcctatactggggtgcttttgcaccaaac

SEQ ID NO: 5828 - DNA, 382 bp, Triticum aestivum
  Clone ID: LIB3281-032-P1-K1-B2
cggacgcgtgggtggagacatacgtgtgaatattcgaacagccgatccttgggtccatctgcttttggtgttgccagcggcgcacccatcaaccacccccacccgaatcatgagggagtgcatctcgatccacattggccaggcctgcatccaggtcaggaactcgtgctgggagctgtactgcctcgagcatggcattcagcctgatggccagatgcccggtgacaagaccgttgggggaggtgatgatgctttcaacaccttctttagcgagactggggctgggaagcacgttctccgtgctgtcttcgtagatctcgagcccactgtgattgatgaggtgaggactggcgcttaccgccagctttttcatcctgagcag

SEQ ID NO: 5829 - DNA, 257 bp, Triticum aestivum
  unsure (1)...(257): unsure at all n locations
  Clone ID: LIB3281-032-P1-K1-B3
gctgccgctcaccggctgcctgccgctggccatgacgctggcgcggcccgaggaccgggacaacctcagctgcgtcgcctccgtcaacaagcagagcatggaccacaaccgccacctccaggccgggatccaccggctccggcaggcgcacccgggcgccgccatcgcctacgccgactactacgccgcgcacttngtcgttatgcgcagccccgccaggtacggatttggcgagcccttcaagacctgctgcggtt

SEQ ID NO: 5830 - DNA, 331 bp, Triticum aestivum
  unsure (1)...(331): unsure at all n locations
  Clone ID: LIB3281-032-P1-K1-B4
gcggcatctcggagaagctcccttcccgcccaaatccgcaccgcctaccttggaggtttctggatctcggatggcgtcagcaatcgtcacggtcgaggccggccggccactcgggtgttcccgggggcgcggggcacgggggttggtggtggggagcgcggtgcggtgnactgggggtgcagctcgccgacaagctcaagatcttaagacgacaacttcaccccgaccctcgtgcagtccaagtgccaaccatgacggaaggaaataagacatttggctctatctgaagatctaaagaaggttcagctgagaaatggcagaagtgttatgc

SEQ ID NO: 5831 - DNA, 394 bp, Triticum aestivum
  Clone ID: LIB3281-032-P1-K1-B5
cggacgcgtgggttggggaacaccttttggtgcattacttgatcctgtggccgacaagcttatgtgagctgcaacactagtgttgctgtgcaccaaacctttggaaacttcaatggtcacgaatggaccatgggttttgacagacactatcattggcatgattgggagagagatcacagtgtcagctgctagagagtggactgcgtgttagaatacccaagctcttgaggctggggcacgtaacaatttatggaagtcggagacagggacacacattacagcattgactctgctgcttgccagcagagaccctagtctacatgtacaaggtgctctagtaccccctggtgaggcgttgctctatgcatatgctggacttggcatatggtcccta

SEQ ID NO: 5832 - DNA, 400 bp, Triticum aestivum
  Clone ID: LIB3281-032-P1-K1-B6
agcgcaaggttttccctccctccctccggtcaaccccaccccagcgccatggccgccaccttctccgccgccgcccccgccgacgcatacgacatcccgtgggtggagaagtaccgccccagccgcgtcgccgatgtcgtcggcaacgccgacgccgtcagccgcctcgaggtcatcgcccgcgacggcaacatgcccaacctcatcctctccgggcctccggggaccgggaagacgacgagcatcctggcgctcgcccacgagatgctggggcccagctaccgcgagggcgtgctcgagctcaacgcctcggacgacagggggcttgatgtggtgcggaacaagatcaagatgttcgcgcagaaaaaggtcacactgccacctggacggcacaagatcg

SEQ ID NO: 5833 - DNA, 405 bp, Triticum aestivum
  Clone ID: LIB3281-032-P1-K1-B8
cggacgcgtgggttaaaccccacctcccttcccatctcctccaggccccctgccccttgcgtccccgccgccgccgtcgtcgacgccatggcctcctccgcgtcggcggcctcgccgctcacctgccaccatctgggcattcgccaccgcccccacctcccctcgttctccctccgccgccgctccacctgctcactctcatctaagcccatcttcctctacctctcccactcccattccctccccaagcccctgaccccgtccacagctcgccacctgctcccgcccgtcgccgtggcgccggcatctccccccgcgccggtctcgccgccggcgaagccagccctgcagggcgcggccatcaagccgctgctggccttcattgccacgggggtcatcatctgg

SEQ ID NO: 5834 - DNA, 385 bp, Triticum aestivum
  Clone ID: LIB3281-032-P1-K1-B9
cggacgcgtggacaaggagggcatccccccggaccagcagcgcctcatctttgctggcaagcagctggaggacggcaggacccttgctgactacaacatccagaaggagtccaccctccaccttgtcctccgtcttcgtggaggcatgcagatctttgtcaagaccctcactggcaagaccattacgcttgaggtggagtcatccgacaccatcgacaatgtgaaggcaaagatccaggacaaggagggcattcccccggaccagcagcgtctcatcttcgctggcaagcagctggaggacggcaggacccttgctgactacaacatccagaaggagtccaccctccaccttgtgctgcgtcttcgaggaggcatgcagatcttt

SEQ ID NO: 5835 - DNA, 342 bp, Triticum aestivum
  Clone ID: LIB3281-032-P1-K1-C10
cccacgcgtgcggggactcgtgggccagattcctacacttccctgaccctagccaaccctgcacctcccggcggctgctgtgtcttgctgctagcatcattcagcggcaagatgaggtctattctcatgaaggggcactagcgcccgttcacgttcctgaagtacaaccgggacggcgacctgcttgttcttatgcgccaaggaccacacccccaccttctggtacgccgtcaacggcgacctcctcttcacttaccgtggtcacaattgttcggtttggtgctggaatgatttacttttctcttcctttgtttatcaactttttgcttttttcttcgattt

SEQ ID NO: 5836 - DNA, 401 bp, Triticum aestivum
  Clone ID: LIB3281-032-P1-K1-C11
aaagaaaagacccgacttttctcctctcctctcctctcccctctccgcctccgtccgactgcgtcgcgggagaatccaagccatggccgggcacgccaagctcctcctgtacattgtggtggtggacgagagtggcgcctccttccgctacacccgatccctcctccacagcacgctccagctcatgggatgcaagcccaggcacgcattcgagattagccggcgggtgttcgatgtggtccgcggcgaccccgcggagatggagatgctcatggccatgtccggcagccaagggggcagaggggtgcagcgttacgagctgccggacgccgccaccagccccaggcagttccagttcgagctctacaagcgccggacgacggtgctcatccccagggacc

SEQ ID NO: 5837 - DNA, 387 bp, Triticum aestivum
  Clone ID: LIB3281-032-P1-K1-C12
cccacgcgtccgcccacgcgtccgcggacgcgtgggcgctaaataagagccgtcggccagagaactgaaggcagggtgctcaacaacttgtgcgacgccgccatgtttgctgctcttttggttatctaatcctgcgtagcgtacgttgctgtccgaggctgcatgtggtttgtcttcagcttcgtactactgtctactagtgcttgtaactttattttcttggctcggtatgctcgctgcatgctagcgagtgatgggtgtatgtgtgtgctctgtgtaagctccatgcgtgtgtaaattctctcgtgtgtgtggtgtggtcttctcaatgtttaaccacctatggtaaagacaataacagcctcagagcaagttttcctttttttt

SEQ ID NO: 5838 - DNA, 320 bp, Triticum aestivum
  unsure (1)...(320): unsure at all n locations
  Clone ID: LIB3281-032-P1-K1-C3
ggccaggttcctggcacatggcacttcaggtgcacgatccttccgcaggaggagaagatcccggcgatcatctcccgcttcacggtgttccatgagacgttcatggcagagtaccgtgactaaactggtgtaacatgtgtgggattacatgcaagcctcgtggattttccctaggcgtttttgcccccgttgacagcagtatcatgtagacgagacaaaataaagcaaatccatggcttgtgtgtgtgatatactatatcagattctgaaacagattaccagtctgatgcgtttgatggtaaattggcaactgnnnaaaa

SEQ ID NO: 5839 - DNA, 282 bp, Triticum aestivum
  Clone ID: LIB3281-032-P1-K1-C4
cggacgcgtgggctgatgattgcggacatgctttggaagccatcacatcgtgcttggttacggaaaaagaacctcttgttgcagctagtgaaggaagccaagatgtgcaagctgtgcttgttgcagctcgtgaaggaagccaagatgtgcaggctgcgtttgttgcagctagtgaaggaagccaagatgtgaaggttgtgcttgttgtagctactggaggaagtcaaaaaagcttctgactctggaaatggtttggaagctacagcatttgccttggtttct

SEQ ID NO: 5840 - DNA, 279 bp, Triticum aestivum
  Clone ID: LIB3281-032-P1-K1-C5
gtcactgctgggctaagcaacacggccaaccacagcgcgaatcccccaaagaaaaaggcttcgtttcagaaatcaagaggttcacttgttgggttctcgctgtcggagttcggcggcggacggagacggagtcgtagtcggagcgagaggtctagctggtggctgcggaggcgaggcccggaggaagcggctgattgagtaagcgcgtctagcacaggaaccaagaggaggaagaggaacccaatccaatcatggactcggagcactggatctcgcgcc

SEQ ID NO: 5841 - DNA, 354 bp, Triticum aestivum
  Clone ID: LIB3281-032-P1-K1-C6
cccacgcgtccggtcaagaactttgcgattgatttcctcatgggaggagtgtcagctgcagtttccaagactgctgcagctcccattgagcgtgttaagctgcttatccagaaccaggatgagatgatcaaggctggcaggctctctgagccatacaagggtattggtgactgctttgggcgcaccatcaaggatgaaggctttggctcattgtggagaggaaacactgctaacgtcatccgttacttcccaactcaggctttgaactttgctttcaaggattacttcaagaggatgttcaactttaagaaggacaaggatggttactggaagtggtttggtggcaaccttgct

SEQ ID NO: 5842 - DNA, 395 bp, Triticum aestivum
  Clone ID: LIB3281-032-P1-K1-C7
catagctcagcctcccagcccgacctgctcagtgcgctggtacactacccccacaagctcgaagaagcggtggtgctttgacatggctcctctttcgtccaaggccgttgcactcgttgcactgtcctccctcctcgtcacctacgcctctgccggcgccgggaacttcaacgactccgccttcaccgccgaccccaactgggaggacgccagggccacctggtacggcgcgcccaccggcgccggccccgacgacgacggcggtgcgtgcgggttcaagaacaccaaccagtaccccttctcctccatgacatcctgcggcaacgagcccatcttcaaggacggcaaggggtgcggctcctgctaccagatacggtgcaccaacgaccagtcct

SEQ ID NO: 5843 - DNA, 399 bp, Triticum aestivum
  Clone ID: LIB3281-032-P1-K1-C8
cggacgcgtgggggcgtaccaccagtacatcctccgggcggcggccatcaaggcgctcggctccttccggagcagccggagcaactgagccggccggccaataatttaatgcaacggtcacccaccgcgctagctagcgtgttggcagtagtgcatgctcctcctcgtgtcgttcagtgtcctctctgtgcatgcatgtgagtgagagaaagaccaccatggatcgctgttttcacttgctcttcaattattactccttgtcaccgttaatgttgtccaattatattagttactgttagtgttggtgttggatggatgatcgaacctgtgtaaaaccgctgtgagtgagttggaacatggattaatttattgtgtgatgcatgcgtgtttgattgaaat

SEQ ID NO: 5844 - DNA, 168 bp, Triticum aestivum
  Clone ID: LIB3281-032-P1-K1-C9
catacacctgcctccataccaccttattatacatctctcttaggggattgggtcactcttgtaaattaaaattatctattaaatcatttctgtatcttttttatttaattcaactttcacctacctatctttctatagtataattactattccaattcccttaaatat

SEQ ID NO: 5845 - DNA, 402 bp, Triticum aestivum
  Clone ID: LIB3281-032-P1-K1-D1
ttttactcaacctacctgtctggccctccttgttaacataatctcccttggctttcccttcgacgcttcgagagagagggagagagagaaggaacgaggaagatggcggacgaggggacggccaactgcatcgacatcatcctcgccatcatcctgccgccgctcggcgtcttcttcaagttcgcctgcgggatcgagttctggatctgcttgctgctcaccttcttcggctacctccccggcatcatctacgccgtctgggtcatcaccaagtaggactgcaggaggggctcctcacctctgcctctaggtgatccatgtcgaacttgttctgtgtctggtacaagccgtttgtccgagacgcgagccacggttcatggtgctgcctgcctacatgtgtgt

SEQ ID NO: 5846 - DNA, 394 bp, Triticum aestivum
  Clone ID: LIB3281-032-P1-K1-D10
cccacgcgtccgcccacgcgtccgcgtaaacccttggatttcctccatctccacaccagtgcggctccagtccgtccgagaccggcatggccaccacggccgccgccgccgccgcggtcccagacgctattccagccgcggcgcccgcggccccgtccgcgcaaccgcatcccgttccagacaaatgtacgaattataaaaaccatttgcaagagtggactcaaaggaatgatcagaagttgccagcttataatactgagtcgaaacgtgaccatcatcgacttgagttcagaagcaccgttgaggtgggtggcgagcggtttcaatcagctcgcaatcatagccgccgcaaggatgcggagcaagatgctgccagagtggcatatgaaatctt

SEQ ID NO: 5847 - DNA, 397 bp, Triticum aestivum
  Clone ID: LIB3281-032-P1-K1-D11
atttgataaacaagctatgatcgttggagagtacccctcagatatataggtgctttgatctgaaggattggtttgtgatacgtcattgattcatcgttgacacaaatatgaaagcacactagaaagataaacataggagatcatagctgaagggtgggtttacaacgacggtggtgtgctgcctttcttctagtgccgacacgatggctagtttgtcgccccgtaaccctggtggtgggctcccatgactgccttctgggttacctaccacttagcattaatccatcaaggggcatgggcaatgtccttgttctatttcttactgaatccggttccaataaagatgccgacaactttgcagccgaccacctcaccattgccggcaattgctccctgc

SEQ ID NO: 5848 - DNA, 396 bp, Triticum aestivum
  Clone ID: LIB3281-032-P1-K1-D12
cggacgcgtgggctctcatcagcgtgcgacgaatctccgcccgatcgaatctccagggtgataacagggatggctactggtagtgatgctggaaagtccgctgaggcagtgttggagtggcctaagcaggacaaaaagaggatgctgcatgctgtttaccgtgtgggagatctcgaccgcaccattaagtgttacacagaatgctttgggatgaagctgctgaggaaaagagatgtcccagaagagaagtacaccaatgccttccttggatatggacctgaggatactaattttgcacttgagctgacttacaattatggtgttgacaagtacgacattggagctggctttggacattttgccatcgcaaatgaggatgggtacaagctgtctgag

SEQ ID NO: 5849 - DNA, 401 bp, Triticum aestivum
  Clone ID: LIB3281-032-P1-K1-D2
ctctttctggtggtcacaccctgggaagatgccacaaggagagatccggctttgagggagcctggaccgccaaccctttgatcttcgacaactcttacttcactgagctccttagtggggagaaggaaggccttcttcagttgccgaccgacaagaccctcctgactgacccggccttccgcccacttgtggacaaatatgctgcggatgaggatgctttctttgctgactacgctgaggcacacctcaagctctccgaattgggatttggcgaggctgttgagggctgctgctgattcaagctcggcgcctgaaggttaatgaagaagaagaagatcatgaagaagaagagcaataaggatgtgttggcctgcggccatgtcatggtgtttgctggactt

SEQ ID NO: 5850 - DNA, 304 bp, Triticum aestivum
  Clone ID: LIB3281-032-P1-K1-D3
ctctttctggtggtcacaccctgggaagatgccacaaggagagatcctggggggtgggagcctggaccggcaaccctttgatcttcaacaacttttactttactgagctccttagtgtggagaaggaaggttttctttagttacctaccgacaagaccctctttactgacccgtctctttcttccacttgtggacaaatatgctgctgttgaggatgcttattttgctgacttctctgaggcacacctcaagctcttctaattttaatttggctatgtttttgagggctgcttctgattcaatg

SEQ ID NO: 5851 - DNA, 182 bp, Triticum aestivum
  unsure (1)...(182): unsure at all n locations
  Clone ID: LIB3281-032-P1-K1-D4
ggaannncccggggcgacgccacgccgtccattcttttttggtggtcacatccctgtgtaagattctcacacgtgagagatcctacgtgtgtgcgtagcctagtaccgccgacctttctcatctttttacaactactttactttactgagctttcttagttggttagaatgaattgcctttt

SEQ ID NO: 5852 - DNA, 429 bp, Triticum aestivum
  Clone ID: LIB3281-032-P1-K1-D5
tcgcggacgcttggggccgccttccctcgttcttcttgcttcagatcagttaacgtaaattggcttgacgcataggacattcatccccttgtctgttacatttgaactggaatggtcaatggttgattctttctgatacgttgctttcatttgctttatttcccttaatttgttttattgtttactccattattagtgattttttgttttgtatgatcttattttgttttttttatgtttgtttgatttgtttttatctatttatttcttttttagttttattctttactctttatatttattttttataatttacaattatttttttatttatttttatttttaatatttttattttttcattatttatattatatttctatattttttattatttttatatttattattattaattataattatttt

SEQ ID NO: 5853 - DNA, 287 bp, Triticum aestivum
  Clone ID: LIB3281-032-P1-K1-D6
cggacgcgtgggcgccgctagggtgttcgttcacacacttccgccgccgccatccctgggaaccggagagcgaggccgacactctcgtctcgatgagggccaagtggaagaagaagaggatgaggaggctcattaggattctccttatgtttatgcatttattcaagttggttgccttgtatggagggttagcatttttttatatttattttgttttgatctttgagggattttgatcatttgttcaagtttattttcttttttatttttttttttatttttttttt

SEQ ID NO: 5854 - DNA, 479 bp, Triticum aestivum
  unsure (1)...(479): unsure at all n locations
  Clone ID: LIB3281-032-P1-K1-D7
ncnngacccacgcgnttccggaaaccagcnaagcaaagactgggtgggagcnntgaaggagcacnnaatctatcgaagggaagggttcagcagtgcatnngcttagagtaaccctcagacnnaaaaggtgnnttgacatgnngctggaacgacccaccagaannggagctnntggtttgnnatggaaagnncagccttgtttctannagatgactnnacgcggctttaactcaaannttttacgagggnnagttcnnaacacnnatacannatgaannnatctanntgacangtnnttcgttngaagaaatgggtncnnttcaagnannaaatctngnnctgaaaagggaatattanntgcatatgnnngcctggagananngccttctttaagtcccaaatcaacgagganannttgtcccaattgtgccaagggggtctggattgttattccagnncagtcactgtcntggaacaac

SEQ ID NO: 5855 - DNA, 396 bp, Triticum aestivum
  Clone ID: LIB3281-032-P1-K1-D8
tttattttttaccaaaaaagagtacttgattagcaactacattgcagaagtactagttgatgcggaaaacacaaggtaactcatgtccaactaacatgaaccaggcgtagactggcgacaccatccacatttattcttcgcatagacaaagcagggacacctctgaccaaaggaaatcagaacgctctactgagtcttggccatgtggcggatcagatcgacaacgcgggtgctgaaaccccactcgttgtcggactacaagactagcttgacgaaatggtcgttcaaagcaattacagccttggcatcaaaaatgctagaactgttgttaccgacaaagtgaggggagaccaaatctctctcgacataacccatgagccccttgagtttaccctc

SEQ ID NO: 5856 - DNA, 398 bp, Triticum aestivum
  Clone ID: LIB3281-032-P1-K1-D9
gtcggcgcgctcgacgaggacggcctcgtcgcgttgcggcggcgcaccggcatggtgttccagcatttcaacctgctgtccgcgaagacggtgttcgagaacgtcgcgctgccgctgaagatcgccggcgtgccgaaggccgagcgcacgcgcaaggccgaggcgctgctcgaactcgtcgggctcgccgcgaagcgcgacgcgtacccggcgagcctgtcgggcggccagaagcagcgcgtcggcatcgcccgcgcgctcgtgcacgatcccgaggtgctgctgtgcgacgaggcgacgtctgcgctcgatcccgagacgacgcagtcgatcctcgcgctgctcgccgacatcaaccgccggctcgggctgacgatcgtgctgatcacgcacgagat

SEQ ID NO: 5857 - DNA, 379 bp, Triticum aestivum
  Clone ID: LIB3281-032-P1-K1-E1
acccttccgcggccccgtgggggcttcgtaaaggccgtcgacccatccatttggcgcatgctcgagatagactgggatgaatctgtggtagggtcactaagaaacaggcatgtcaatgcttggcaagtggaacttgttgggtaccctcccatcctgaagaagctcaagatctccgagacgatccttccccctatgtgctctggcgatgtcagcgtggctgaccccctgctggggccagactgcgagaacatggtgatgctgctggggtcacctattcctgctggcatgcagggagccaggcacatcggcctcactgagctgccctcttcatcttctaccgtgctcacaaccaagcagttcttcccacctagctccagcg

SEQ ID NO: 5858 - DNA, 389 bp, Triticum aestivum
  Clone ID: LIB3281-032-P1-K1-E10
cttccgcaaaggagatcgacaaggcgaaggcggagaggaagaagcctcagagaggagaagctcaaggcgaggagaggagagggatcgtcgtcgtggcgatggatcgggtccgcggctccgcgctgctgctcggcgtcctgctcgcaggatcgctgtttgcactttgtgccgcaaaggaggaggccaagaagctcggtacggtgatcggtatcgatctcggcaccacctactcatgtgtcggtgtgtacaagaacggtcatgtcgagattatcgccaatgaccagggtaaccgtatcacgccctcatgggttgggttcaccgatggcgagaggctcatcggtgaggctgcaaagaaccaggcagctgtcaaccctgagaggaccgtcttt

SEQ ID NO: 5859 - DNA, 387 bp, Triticum aestivum
  Clone ID: LIB3281-032-P1-K1-E11
cgccatctgtgggcgcctggtctcctccctgagcacgaagggcacgtacacggtccgcgagggcgacccggtgaccgagatgctcttcatcatccgcggcaagctggagagctccaccacggacggcggccggacgggcttcttcaactccatcatcctcaagtccggcgacttctgcggcgaagagctgctcggatgggccctcgtccccaggccgaccgtcaacctgccatcatccaccaggacggtgaaggcgctcgtagaggtggaggcgttcgccctccaagccgaggacctccggttcgtggccagccagttcaggcggctccacagcaggaagctgcagcacaccttccggtactactcccaccactggaggacctgggc

SEQ ID NO: 5860 - DNA, 179 bp, Triticum aestivum
  Clone ID: LIB3281-032-P1-K1-E12
cggacgcgtgggccaccttccgttgggaagggagcttcgaggcggccggccgcggcacttttgccggaccggcttatccaatgtcacggtcccttgggggcgcatgcttatttaaattttgtttttatctttttattaagttctatttattataattttttttttaattatgtttattt

SEQ ID NO: 5861 - DNA, 329 bp, Triticum aestivum
  Clone ID: LIB3281-032-P1-K1-E2
gttagctaaagatattgctgatgcatggcgcagcgtcctcccaaagctagaggcgtgttccagttcataatcaaaactgtgtttgcccgtctgtgtttgagatagtggttggccctttgagttttaggctgattttttccagcccaatttgacagtggttcatgtatacttaaaagtgacggttgacaatgctccagttgttatattgacatattttctttaccgtgtgcgtgtgtactctgtaactcaaaatttcaaccaattagtctaactgttgaagtccttcaggaaatattatgaataaagagaagacagtggagttgtttaaa

SEQ ID NO: 5862 - DNA, 365 bp, Triticum aestivum
  Clone ID: LIB3281-032-P1-K1-E5
gtcttaccataaacaatggagatcgactcttattaccaagaacacaatccggataaaggatgactaaaggtttaaagacataggagagggatcgtcgtcatggcgatggatcgggtcctttgctccatgcatgtatatctcgtcctgctcgcaggatcgctgttttcactttctttctcttatgaggaggccaagaagctctgtacggtgatcggtatcaatctttacatcacctactcatgtgtcggtgtgtacaagaacggttatttttatttttattcttctattgtctagttgtttttttatttactttaatattttgtttttttttatcttatatcttgtacttatatttctcagtgttt

SEQ ID NO: 5863 - DNA, 400 bp, Triticum aestivum
  Clone ID: LIB3281-032-P1-K1-E6
cccacgcgtccgcggacgcgtggggcccccaaatctcccctccctctgtcgctctcgaatcttccccgagcatcgaccatgtcggcctactgcggaaagtacaaggatgagctcatcaagaacgctgcctacattggcacccctggcaagggtatccttgctgccgacgagtccaccggcaccatcggcaagcgcttcgccagcatcaacgttgagaatgttgaggacaaccgtcgcgccctccgtgagctcctcttctgcacccctggagccctccagtacctcagcggcgtgatcctcttcgaggagaccctgtaccagagcaccaagggtggcaagcccttcgtcgacatccttaaggagggcaacgtcctccctggcatcaaggtggacaagggta

SEQ ID NO: 5864 - DNA, 347 bp, Triticum aestivum
  Clone ID: LIB3281-032-P1-K1-E8
ccccgcccgcctcgccccgctcctcccccgcagcggcgagctactcccgagccagggagagacaggcggcggcggcagcttccccttcccctcctcctctcctccctcgccctcgccgagaaacaacgagagtttcctcttccgtcagcaatggagaacatgagatccgagaacaaccgtggcgcggccatggagggcgtcaagctcgcgtctgaggcggcggccaacaccaaccgcagggcccttggggacatcaagaacattcttggcgcccctcaacagccccaaggccgtaagaagaggggctttgcagaaaaaccccccttccgtgccaagagccaagcttg

SEQ ID NO: 5865 - DNA, 138 bp, Triticum aestivum
  Clone ID: LIB3281-032-P1-K1-E9
cgtcgcggaccgtgggccgagcaccgaccgcgccgcccgcggcgcgcgactgagcatgtgctatccgtgaggagttcagcacatcttgtgtgctaacaccaactgacgtagcaaaatatgtttccttccttcataagg

SEQ ID NO: 5866 - DNA, 296 bp, Triticum aestivum
  Clone ID: LIB3281-032-P1-K1-F1
aataagcgcaccacgctcagggactgatgcggttatccgggtccttgcggacgacggcgagggaggtggaagggcgctgttcgtcatcctccggcgtgaacatctccggcatggtgcctgtctcctccagctccagatcgagctcctgctgcccctgcccctgatccccgccattggctgggccgccgttggcctgctcgtcgaagatggcgtccgcaagggcgcgagaggactcggcctcgatgagctgccagttgtcttcgtagagctcgaccaggcgcttgaggacgggggcg

SEQ ID NO: 5867 - DNA, 87 bp, Triticum aestivum
  Clone ID: LIB3281-032-P1-K1-F10
tttcgcaacaccaatctgcagttatctcttttccaacatatcccccaggcggacggggcacattcttccaataccaccattctcctt

SEQ ID NO: 5868 - DNA, 281 bp, Triticum aestivum
  Clone ID: LIB3281-032-P1-K1-F11
cccacgcgtccgcggacgcgtgggccatattcctacacttccgtggccctggccaaccctgcacctcccggcggcggctgctgcggcggctagcagtagtcagctgtaagatgaggcctattctcatgaaggggcacgtgcgctcgcttacgttcctgaagtacaaccgggacggcgacctgctgttctcatgcgccaaggaccacaccctcaccttctggtacgccttcatctgtgaccgtctcggtacctaccgctgtcactacggttcggtatgtttc

SEQ ID NO: 5869 - DNA, 392 bp, Triticum aestivum
  Clone ID: LIB3281-032-P1-K1-F12
tgtagatgctaaccaagagacggctcctctcaacacggacaagaactcgcaagtgctgataggatccataagcgttgcgatcgaaggcggtggcagctgctcggaggattccaaggattaccacccagctcctcctgaatctgatttgaacactctgaacgatccagtggccgaggcgatgcagccaatcagccatgatgagaacggatgcgaagacgctaacgcagcagaggatcactctccctctagtgtcgtgacagatgaaagcggctgcgacgcagaggcggcagagggcggaagcctacgacgcggctccgtttcttccggtcaggaagcggcggccttcctttctcaaagatggaaggaagtcatggctggggatcatgtgaagc

SEQ ID NO: 5870 - DNA, 403 bp, Triticum aestivum
  Clone ID: LIB3281-032-P1-K1-F2
cggacgcgtgggcggacgcgtgggataataaccaccagcgactgtgagggtgcaggtgagatgttccaagtcactgccttattcagccaggctgaaaaggtggagaaggagcttaaggagaaccctgcaccatcagaagctgacgttgaggctgctaagcttgttgttaaagagaaaggagatgcagttgctcaattgaaagcagcaaaagctagcaagcaagagataactgctgctgtttccgtgcttacaaaagctaaagagaatgtgttaagggtggaagagcgctctaagttgaaacctggacttccactcaaggatgatgggaaaattgcgtttgagaatgacttcttcaagcgtcaagcttttctgaccgtttcaggccaacttcaggtcgaaactt

SEQ ID NO: 5871 - DNA, 396 bp, Triticum aestivum
  Clone ID: LIB3281-032-P1-K1-F3
cggacgcgtgggcggacgcgtggggtccaaggcgaccatatgccaatgactcctcatggagcacatctgcccaatgttccttttgttgacaacgtgtctcatactcagctaaaactacccactggtgacatgcagcaacttttacctcaacttggtatgccaacacccttttatacaccgaattcttttggaagcccatattatcagaatttgcatccagccagtgtattggcaaatccttatgtgactgctgggtatgctttgggtggttcaggtttcccacccgttatgactagctattctccccagagttctgctgcgacacctctagacagtcctatgactccaagctttagtggtaggccatctggttttccttcagcagggaatcttact

SEQ ID NO: 5872 - DNA, 283 bp, Triticum aestivum
  Clone ID: LIB3281-032-P1-K1-F4
attcagttcgcgcgataggtaatcagttcgccgccgcggacaatcccagggtttccgccgccaaatcaccggcgagatgttggaggagctgctcatcttcacgcgcggcggcctcatcctgtggtcgctggccggcgccgccgctgcgctgaagggctccccgatcgacgcactcatccggtccttcctcctcgagggccgctcagcctccgccggggccggcgcctgcttcacccactgtccgcacgcgctcaggtggacctactacaactcgcttgggctt

SEQ ID NO: 5873 - DNA, 398 bp, Triticum aestivum
  Clone ID: LIB3281-032-P1-K1-F5
tctgtttgctctcgcgtccgccgcgcccatcctcgtccgcgcctgcgccccgaccgtgctcgccgcctcccgcccgatccaccggtccaccaccgcgccggcggcatggcggatcagctcaccgacgaccagatcgccgagttcaaggaggccttcagcctcttcgacaaggacggagatggttgcatcaccaccaaggagctgggaacagtcatgcgttcgctggggcagaacccaacggaggctgagctccaggacatgatcaatgaagtcgacgctgatggcaatggcaccattgacttcccagagttcctcaacctgatggcccgcaagatgaaggacaccgactcagaggaggagctcaaggaggccttcagggtgttcgacaaggaccaaaa

SEQ ID NO: 5874 - DNA, 327 bp, Triticum aestivum
  Clone ID: LIB3281-032-P1-K1-F6
cagtcaaattatgcttcacatttgacaacttattcttttgctcacccgtgaaagctagtccacaacagaggtgcaatttacaaaatcaactacctcaggttccttcttttacagcatcttttcaggttcatatcaaatagagaactccacttgcacaactttgttgcgcaaaaaaagggcttcacttgacataccatacactgtttttgacagcagatgccatgtttactcaccatcactgaacgccgggatggtgttcaaacacaaatataatcttgaccacactttggggatggcattgacaaggcatgcagtttttggggattt

SEQ ID NO: 5875 - DNA, 392 bp, Triticum aestivum
  Clone ID: LIB3281-032-P1-K1-F9
cccacgcgtccgcccacgcgtccgcttgaatctggcaagtatatagagtatcttaataagcgagatgcaggactgcccctgactgctgtcaccagtcgctcggcatagtttacttgggttattcttattagtgcgccgtaatctagattcttcacacggccgcacatacaccacgtacgcacatgatagttcattcagctaggtgagttaccagacctgtatactgaagtgcgtagtagtaccgtgtttcagcttgcaatatgcaaacacaaatctgatctgaaaaatcattggcaaaggctgtcaaagtagattcgaggaatatgtgccgtgcccactaatgatgcacgaatattacagtacatctgcagcttaacaacatagtatgcatc

SEQ ID NO: 5876 - DNA, 397 bp, Triticum aestivum
  Clone ID: LIB3281-032-P1-K1-G1
aaaaacctccttttttaacttggcctgggacctaaccaccaacaaagtcagccaggtgcaggatcaaggaagcgatcatttcgaacggctgcttcttgcgtgaatgcaaaatcgagcactccatcatcggcgtccgttcacgcctaaactccggaagcgagctcaagaacgcgatgatgatgggcgcggactcgtacgagaccgaggacgagatctcgaggctgatgtcggagggcaaggtccccatcggcgtcggggagaacacaaagatcagcaactgcatcatcgacatgaacgcgaggataggaagggacgtggtcatctcaaacaaggagggagtgcaagaagccgacaggccggaggaagggtactacatcaggtccgggatcgtggtgat

SEQ ID NO: 5877 - DNA, 286 bp, Triticum aestivum
  Clone ID: LIB3281-032-P1-K1-G10
cggacgcgtgggcggacgcgtgggctgagttaagcttttaaaaccaagagaagcactgaatagaactagagctactgcccaacagtcaaagtactactagatacgacccatcttacaaacaaggacacctatacgataactcatgacgcggtagcattcagttcatgcagctctgaatctctgattgcgctccatcgcctcaatggtcactgctgtgggggccgctgcttgttgctgttgttggtgcggatttgaatgaaaccttggtgcttgttggttggctggg

SEQ ID NO: 5878 - DNA, 351 bp, Triticum aestivum
  Clone ID: LIB3281-032-P1-K1-G11
gctcctcctcctgtttctggcccctctcctcgcgacgcccaccacgatcccgctctaccgacacctgccggcggtcccgcccgccgcggcgcagcaccacccgctctcccgcctcgcgcaggcctgcctcgcgcgcgcctcccgcctgagagccggccgcggtcaccaccaaggccaaggccaagccttctcccgcgggcgcgccgcgctgtacccgcactcctacggcggatacgccttctgcctgtccctcggcacgccgccgcagccgctgcccgtgctgctcgacacgggcagccacctcacctgggtgccctgcacctccaactaccagtgccagaactgctccct

SEQ ID NO: 5879 - DNA, 403 bp, Triticum aestivum
  Clone ID: LIB3281-032-P1-K1-G12
gttagaaataggtttcaggctggtccatttgaagtggaacctatccgcgtaactcattcaattcctgactgctgtggattagtgcttcgttgtggtgatggcacaatcttccatactggtgactggaaaattgatgaatcaccagtggatgggagaatattcgaccgagaagcattggaggagctctcgaaagaaggtgttactctgatgatgagcgactcaacaaatattctgtcccctggaagatccacgagtgaatctgttgtcgctagttcattgttgcgtcatgtttcagaagcaaaagggagaagagtaattacaacacaatttgcttcaaatatacatcgcattgggagcatcaaagccgctgcagacttaactggtcgaaggctggtctttgttg

SEQ ID NO: 5880 - DNA, 370 bp, Triticum aestivum
  Clone ID: LIB3281-032-P1-K1-G2
cccagcgttccaaaaactcccttcttcacttcgtttcggtcttaccaccaacaaatcaggaggtgcttgatcaaagaagcgatcatttttcacggctgcttcttgcgtgaatgcaaaatcgagcactccattatcggcgttcgttcacgcctaaacttcttaagcgagctcatgaacgcttatattattgttgcttgtctcgtctagactgttgtctttgttctttttgcttatttatttagagtcttggttctcttttttttctttttaataacactttatatttattttttttttttatctatattaatccttttaaatatttaaatgtatccttttctatcttctaatttattgtattgtatttttt

SEQ ID NO: 5881 - DNA, 405 bp, Triticum aestivum
  Clone ID: LIB3281-032-P1-K1-G5
gtgtggtggacagatgggcagttgtaaacttttcggctaggtgtaacaccgggaaccttgtcaatgacctcatcaagtgtgggggcatgaagggcattacagtagaaaaacctcatattgtaattgaagagaatggttcaatgagacgtgcacctgctccaaaaagggttgaggatatgtttgagcaagtgaagtctaagcttcctggggctccgaagtttctcttgtgtattcttgctgagaggaagaactcagatgtttatggtccatggaagcgaaaatgccttgctgactttgggattgtcactcaatgtgtggccccaacaagggtcaatgaccaatatctgacaaatgttctgctgaagatcaatgcaaaacttgggggtatgaactcactactacaaa

SEQ ID NO: 5882 - DNA, 389 bp, Triticum aestivum
  unsure (1)...(389): unsure at all n locations
  Clone ID: LIB3281-032-P1-K1-G6
cgactcttctcctccggcgtcagtgcctaccccaagtatcccctcctcaccgacccaaacgagcagagctccccgcccgcgatcccccgccgccggcagccatgtccaaccccgaatcgagcccccaagccgccgcgtcgtccacctcgcctccctcccacgccggccacatccacaccccgctctgccgctcctgcggcgcgcccgccgcggcgcccgccccagccccctggacgggggattccccgccgcccgcctaccgccccatccgcatgccggccatcaacgcgcccaccaacaccgntgccatcgtcctctccccggtcccgcagcccctgcccgtgccgcccgccttgcccgccttcgcctttcaggcccccgccaagcga

SEQ ID NO: 5883 - DNA, 357 bp, Triticum aestivum
  Clone ID: LIB3281-032-P1-K1-G7
gttagaaataggtttcatgctggttcatttgaagtggaacctatgcgtgttactcattcaatggctgactgctctcaattaatgctttttagtggattaaatacaatctttcatacttatgactgtaaaatagattaatcatcagtatatgggttaattatctacctagaagcatatatattttattttatattaagtattacttattttattatttatttaataaatttttcactattcttaaagtttctcaaatttaattatttataaattattgtttgatttgtgtattaatcttatatttaattttttatattatatctttttaataatattttaatataccttaccaatcat

SEQ ID NO: 5884 - DNA, 393 bp, Triticum aestivum
  Clone ID: LIB3281-032-P1-K1-G8
cggacgcgtgggcctggaacaactttttgctctcagtgcactcaacagtcgtggagagttgaccaagactggaagacgaatggcagagtttccactagatcctatgctgtcaaagatgatagtagcttcagagaaatataagtgttctgatgaggtcatgtccattgcatcaatgttgtcgatcggaaattctatattctaccgtccgaaggacaaacaggttcatgcagataatgcaagattgaacttccacactgggaacgtcggggaccacatagcattactcaatgtctataactcatggagagaaacagacttctcgactcaatggtgttatgaaaattatatccaggtccgcagcatgaagagagcaagagacattcgagatcaact

SEQ ID NO: 5885 - DNA, 223 bp, Triticum aestivum
  Clone ID: LIB3281-032-P1-K1-G9
cggacgcgtgggcccagggcggctgcgggaggaggagaaaaaaccagcagagcaccactggattcgcctgcccgcctggatcaaacccaacccaactccaaacccagagggatttcgccgtggcctccgcggggtcgatccgatccggtccgtcgcgcgtgcggcatgcggttgcatcgaggttcgggatcggtcgtgttggcagccgtgttggtgagggctg

SEQ ID NO: 5886 - DNA, 404 bp, Triticum aestivum
  unsure (1)...(404): unsure at all n locations
  Clone ID: LIB3281-032-P1-K1-H1
tttttgaagaagccatgcctgttggatctgggggattgggcctttcaggggacctagaaaaggggccggaggcgattattgtttggaaaaatgaaagggcctcattccagaaggggttggaaaggggggccaaaaatcatcgttgctaagggagaggctgtcaatggccgggaaaaaggggaagggtttggtacagggagcgtgaaaggactcaaggcgaggtcctcgatgagaagaactctgagatagagaagctaagacatgctatngatgaaaagatctctgaaacagagaatgtaaaacatgctttggataggaatagctctgagatagagaagctgaaacatgctctggatgaaaagaattctgagctagaaaagctcagacaagctctggatgtgaat

SEQ ID NO: 5887 - DNA, 405 bp, Triticum aestivum
  Clone ID: LIB3281-032-P1-K1-H10
tccccacccatccaccgaggcgcattacaggggagaagaagaagaagcggaggaggaggaagatgccttgcctgaacgtgtcgacgaacgtgaacctggagggggtggacaccttcgccgtcctcgccgacgcctccagcaccgtcgcaaccatcattggcaaggcggagaactatttgatgggtggtcttaaagggttcagtgcccatggcgttcggaggtacccaggagcctgcagcctacggtgagctggtttccatcggagggctgaaccctgatgtgaacaagaagctgagtgccggcattgcttccatcctggagtcaaagctgtccatcctcaagtcccgcttctacctcaagtttcatgattcaaagcgctcggactttgggtggaacggatcgacc

SEQ ID NO: 5888 - DNA, 401 bp, Triticum aestivum
  Clone ID: LIB3281-032-P1-K1-H2
ccagttccaatttcgattcccaccacgcccgcccctcgggaccgaggaggaggaggaggatggcgatcgtgtacgcgctcgtggcgcggggcacggtcgtgctggccgagttcgccgccgtctcgggcaacgccggcgccgtcgcccgtcgcatcctcgagaagctcccctccgaggccgaggcgcgcctctgcttcgcgcaggaccgctacatcttccacgtcctccgctcccccgccgacggcctcaccttcctctgcatggccaacgacaccttcggacggagagttcccttcatttatctcgaggacatccagatgaggttcatgaagaactatggcagggtcgcccattccgcgctggcctatgccatgaacgacgagtttgccagggtgctccac

SEQ ID NO: 5889 - DNA, 402 bp, Triticum aestivum
  Clone ID: LIB3281-032-P1-K1-H3
cggacgcgtggggccgccactatctttctcaggatccagatccaccactgtggctggggttccccagcgagccaaccctcacatcacagccgcagcctgctccttcctgatccaccggccagccggccctggtctccctcgcccttcaagcccgtccaaaccagtgggccccacgcctccctgcgcgctatccaggaatagcgctcgcccgcctccatgctcgttttggttcgggagaggatctcccgaccgtgccttccacgttgccgcctgctcgccggacgaccagcgctgttgtcggtgaccaccaccaggaacagtgccgccccgccttcctttcattcttctccttttccttcgtcgctcaattcgattctgacctcacagagaccttcaagggag

SEQ ID NO: 5890 - DNA, 177 bp, Triticum aestivum
  Clone ID: LIB3281-032-P1-K1-H4
cgggaggaccgacgcggcccacccacttcggttgccaatactatctagctggtttatccagatccaccactctggctcgggggccctatcgtgcccgcccccacatcacagccgcagcctccttcttcctgagccaccggccagccggccctggtcttcattgcccttcaagcccgt

SEQ ID NO: 5891 - DNA, 265 bp, Triticum aestivum
  Clone ID: LIB3281-032-P1-K1-H5
ggcagtgggcggacgcagcgactgatttctttgaagcattcaaaaactacgatgaagctggcaatccacggagaatccagtgtctcaaatatcttgttcttgccaatatgttgatggagtctgaagtgaatccctttgatggacaagaggccaagccgtacaaaaatgatcctgaaatcctcgcaatgacaaattggatggcgcctaccaaaagaatgacatcatggaatttgagaagatcctaaagagcaatagaggaccatta

SEQ ID NO: 5892 - DNA, 402 bp, Triticum aestivum
  Clone ID: LIB3281-032-P1-K1-H6
cccaatcgtggggggacgcgtgggcaccgttgcaggaacacacacacagagaagccaatctcgccggagaggggagcgtcgacgatgtcgggccgtggcaagggagggaaggggctcggcaaggacggaacgggcgccaccggaaggtgctccggtacaacatccagggcatcaccaagccggcgatccgccgtctggctcgcaggggcggcgtgaagcgcatctcggggctcatctacgaggagacccggggcgtgctcaagatcttcctcgagaacgtcatccgcgacgccgtcacctacaccgagcacgcccgccgcaagaccgtcaccgtcatggacgtcgtctacgccctcaagcgccagggacgcaccctctacggattcggcggctaggccacgc

SEQ ID NO: 5893 - DNA, 395 bp, Triticum aestivum
  Clone ID: LIB3281-032-P1-K1-H7
ggtttctgaggcgcgcgaggtaaaccaaggttggtgctcatggctcgtactaagcagactgctcgtaagtccactggaggaaaggctccaaggaagcagttggccaccaaggctgcccgtaagtctgctcccaccactggaggagtgaagaagcctcaccgttaccgccctggaactgttgctcttcgtgagatccgcaagtaccagaagagcactgagctgctcataaggaagcttcctttccagaggcttgttagggagattgcccaggacttcaagactgacctccgcttccagagccatgcggtgctggcccttcaggaggctgcagaggcctacttggtgggtctcttcgaggacaccaacctgtgcgccatccatgccaagcgcgtgac

SEQ ID NO: 5894 - DNA, 395 bp, Triticum aestivum
  Clone ID: LIB3281-032-P1-K1-H8
ctccgctctccgaaaagttcttcttgttccgcaaaccacacgaagaaaaaaagcaaagagatggcgaccacgaattggacgctccccgaccaccccacgctccccaaggggaagacggtggccgtcgtcgtgctcgacggatggggcgaggccagccccgaccagtacaactgcatccatgtcgcccagacgcccgtcacggattcgctcaagaatggtgctcctgagaagtggaggctagtgaaggctcatggaactgccgttggtctcccaagtgacgacgacatgggcaacagtgaagttggccacaatgctcttggagctggccgaatctttgctcaaggcgcgaagcttgttgatgctgctcttgcttccgggaagatttgggaagacga

SEQ ID NO: 5895 - DNA, 270 bp, Triticum aestivum
  Clone ID: LIB3281-032-P1-K1-H9
cggacgcgtgggctggtcattaacaatggaaatgattgtgtgaaatttaacacattactgggctgcaaactgtttccattattctgctgaacacaacctttttaggggcgcacgggattgctcctttccctttctctgcttgttttcctttctttgcttggagggcgctactgctcttctttctctttctctgcttcgaaggtggggggggtgctgctactgcttgtaggggactgctgcttggaggatgttgctggtcttcttttcctt

SEQ ID NO: 5896 - DNA, 384 bp, Triticum aestivum
  Clone ID: LIB3281-033-P1-K1-A1
tcgcccacgcgttcgcccacgcgtccgcccacgcgttcgcatttactcaggctggcgcgcgctttttttgttctggaggccccccctggacagcgccccaatcgccggcgagcacgccgccgtcgacactgttcaaggggaggacaacgcggctacactgctaacaccctgcatcgcaaccgtgcacggaggccccggcgcgtcggagagcgagccacgtggagggatctgggctggggaagcaccgccggccgtgctgtggttgaagccgtcggggaacggtgggctgttcccgtcggccgaagtctgaacaatcccgtgggttggaattccaggctggctgccaaagttatgggagaggcacactagctagctgatcaagca

SEQ ID NO: 5897 - DNA, 397 bp, Triticum aestivum
  Clone ID: LIB3281-033-P1-K1-A10
gttggacgagcaggtggcgtgtttaactgggtagattgttttgtcagtctctcttcatccatgaagtgtcaatttgatatacgaattccgatgaatgtgaaatatgtcacatgatgttgttctcgtagcacaaacttatctagaattattttctaaattgcagacatatggttattacctagcttacttttggatgaacaacaacatgactagaaaagctcttgggatcaaggaggtacacactatatcttttgcatgaaacttatttcatagagtatgcatccaaaggtatcattatgtagttttaacttctttagatataaaattagacacgatagggtaaaaaatgttgtagaagtagaaaaaagtaaagaaaatcatcaccttttgaatcttg

SEQ ID NO: 5898 - DNA, 275 bp, Triticum aestivum
  Clone ID: LIB3281-033-P1-K1-A11
gttggacgagccggtggcgtgcttaactgggtagattgtctcgcgcgcaagactaaattcatgacgcgtggattggttgtactgaccttgtaggaacagaaacttttcttatgcgggtgctgttgtcgcacactctcactgtacaagaattttataacttggacacctatcgttaatacctacacttctttcggctggccactcatatgggtctaaaagcgcgcgtgagagcactaggtgcacacacacggctctggcgtgacgcgctagtagca

SEQ ID NO: 5899 - DNA, 235 bp, Triticum aestivum
  Clone ID: LIB3281-033-P1-K1-A12
cggacgcgtggggctacgtggcatggaattcatggcatagttggttctttcttcttcctcttcctacctctgcctcttgctcttccttcttcgcaagcagcagcctctccgccctcgcagccagccgctgtcgataggggggaggtcgccaccgccggctgctctctgccacgccgcttcgaccagagacaggtgggatggaaggtttcgagttcttccagatcgtacttgacaa

SEQ ID NO: 5900 - DNA, 321 bp, Triticum aestivum
  Clone ID: LIB3281-033-P1-K1-A2
tccactcgtcttaccacgcgtccgtcgactcgtacgtgcactcttgttaggagacgtcgttaaccattactaccttaacctgttctacaggagaagcgtcaacttgcttttcattgtactgacaaacacggtttacctatgtgacaccacaagtgggtctacatcctcgatagtttccggtgattaagacgatggctcagtcactagtgaaagctgggctcctgatgctccagagcattgcatattggccttaacttctctgttgtccaaatatcgtattacagctcgaaccgactgctgagtacactgtaaggtgctcat

SEQ ID NO: 5901 - DNA, 405 bp, Triticum aestivum
  Clone ID: LIB3281-033-P1-K1-A3
gcgcggcgcagcagcatccgccttccattctcctctccctcctcccacctcgccgccgcctccccgtggtcttgtctctcgccagatcgccatggcattgcacgcccccgtcctcgtgctgaaggactcgttgaagagggaatccggcgccaaggttcagcatggcaacatccaggccgcgaaggctgtgtcagacatcattcgcacaacgttgggtcctaggtccatgttgaagatgcttctggatgccagtggaggtatcgtggtcactaatgacggcaatgctatattacgggagctagacattgcacatcctgctgctaagtctatgattgagctaagccgcacacaggatgaagaagtgggagatgggacaacatctgtaattgttctagctggtgagat

SEQ ID NO: 5902 - DNA, 389 bp, Triticum aestivum
  Clone ID: LIB3281-033-P1-K1-A4
gcgagatgcacaaaaagctgcctttcattcacctatgaatcgtctcacatggcggtcgtctgcacgaagtagtcggtctggacagacacccatggcaatgcaccccgctagcactctggctaccaagactcgtgcgcagagtcaatccggccccaaggttcattaagacaccatacaggtttcgacggctgactgtgacattattcacgaaccgtaagtgccaaaatcgcagctagctgtgcattcgcaatgctcacgttgcgaatccaggtcactaataacgggcatgctttaataaccgagctagacattgaaaattctgctgttaactctctgaaggaggtcagccagacacacgttgaagagctgttagaggacacaacacttgt

SEQ ID NO: 5903 - DNA, 396 bp, Triticum aestivum
  Clone ID: LIB3281-033-P1-K1-A7
cccacgcgtccgcccacgcgtccgcccacgcgtccgcattcactcactctcacgcgcgctctctctctcctggagccgccgcctgcacagcgccacagtcgccggccgagcacgccgccgtcgacactgtccaaggggaggacaacgcggctacactgctaacaccctgcatcgcaaccgtgcacggaggccccggcgcgtcggagagcgagccacgtggagggatctgggctggggaagcaccgccggccgtgctgtggttgaagccgccggggaacggtgcgctgctcccgtcggccgcagtctgcacaatcccgtcggcttgcagtccgagcctgctgaccaagctaatgggagatgcacactagctagctgatcaagcattgagcgtcacaa

SEQ ID NO: 5904 - DNA, 402 bp, Triticum aestivum
  Clone ID: LIB3281-033-P1-K1-A8
gagcggcgaggcgggggccggcggcggcggggaggcgaacggcgtccagccgaacgtgaccatctacatcaataacctcaacgagaagatcaaactcgaagcgcttaagaagtccctgaatgccgttttctcccagtttgggaaaatcattgaggtgcttgcttttaagactttgaagcataaagggcaggcatgggttgtgttcgaagatgttgcatcagcaactgaggctttgaagaggatgcaagattttcccttctatgacaaacccatgaaaattcaatatgccaagaccaagtcagatgttatagcaaaagctgatggcaccttcgtacctcgagaaaaaaggaagaggaatgatgagaaacctgaaaagaagcagaagcgtgagcagcaccacga

SEQ ID NO: 5905 - DNA, 300 bp, Triticum aestivum
  Clone ID: LIB3281-033-P1-K1-A9
atgcgtgcaaacttggtgggctaattcactcgttagaggagaaagcaacgttctagggggcaccctaccgatctacttaaatcacctctaagacatgatcaatctcccgcccctagagacgggcctgattactccctgagcttggcctttaaaacccatagtcgtacttgctaactagactacgaattggaagggacaaacatggtccgggaccacatatgttcgatgcacaagtcggagctctttgaaactgcaagctcacggcttggaagcacatactgtacgcaaaaagttttttta

SEQ ID NO: 5906 - DNA, 287 bp, Triticum aestivum
  Clone ID: LIB3281-033-P1-K1-B1
ggcgctcttggggttttaattgactggttagaggtgaagaaaacgtgtgatgtgacatgctactgtgctaacaggaacatttgtgaggtgtgcctgccacccccgctcagggtgagggctgcttactcgctgagcttgccgattaagtgagctagtctcatgaggaaactagtttacaggttgaaaggtaaaatcggtggcgagaactactatgtgtcgttgcagcatcctgctacatttgaaacataattctaacggtgtagaacctatattgtattctaaaagtt

SEQ ID NO: 5907 - DNA, 395 bp, Triticum aestivum
  Clone ID: LIB3281-033-P1-K1-B10
gaacaaaccagaggttaatcagaagatgatgaaatctgcactcatcaaagatttatacttcgaaatggaccgcctcaagcaagaactgtatgctgctagggaaaagaatggtatttatattccaggggaacaatacctagccgatgaagctgaaaagaaggctatgtcagagaagctagaccgtttagagcttggtttggagtcaaaagacaagcaactagatgagctccaaggactgtacgattctcagaaagtgttaagtgcggacttaagcgataagcttcagacattgcagaaaaggatgcaggaaactgagtgcgccctagcagtccttgaagagaagtatatgcaggcaaacaatacaataaaagagaaggagtatctgatagaaaatc

SEQ ID NO: 5908 - DNA, 304 bp, Triticum aestivum
  Clone ID: LIB3281-033-P1-K1-B12
aaagaaatgaatcaattcgcccctcagcaatcatcgctcgccatggactcaggggagagctcggtcgcctccaacgccgcccacgcggcaatggccgtcgactacgcccccgaggtcgccggctgcgtttcgtccatggtcgacctcagcggcgccgccggcgtggagagccagcgcctgttcctggcgcgccgcacggcgctggagatgctgcgggaccgcgggtacagcgtaccggacgacgagatcgcccgcaccctcccggagttccgcgcgtggtggtccgagacgcccgagatcgagc

SEQ ID NO: 5909 - DNA, 407 bp, Triticum aestivum
  Clone ID: LIB3281-033-P1-K1-B2
atcgctcgctcgctgcacaacgcccgcccacgccgccgtctccctctccctctgcgcctccctccgtccaaccgcagcccgctccacctcatggcgtcgctctccctctccctccgcgcctccggctcctcggccgcagccggatcccgcgccgccgccccaatcaaggcgtcgtgtgtgaggagcaaggttacctgcagcttaccatccatcagagctacctcctcacctgctagaagcattgagcccgtaagagccaccgccacacaggcgccccctgccacccctcaatcttctagcagagagaagacaaaggtcggcatcaatggttttgggcggattgggaggttagttctgcgaattgcaattgatagagatgacattgaagttgtggctgtcaatgatcc

SEQ ID NO: 5910 - DNA, 403 bp, Triticum aestivum
  Clone ID: LIB3281-033-P1-K1-B3
aggacgcgtgggctgacgcgtggggaaagaaggaggattcactgtgtctgtgccacacacactccttgacaccgaaggtttgtttggatcgtggtgctccatggggtttcttgaccagctgtgggacgacacggtggccgggccgcggccggaccacggtcttggaaggctccggaaggacgcgtacttctacctgtacttcgccatctatgagacgaccgttgtcatgtcgtcgaacgatgtagccggtccgagcgagacgcacagaatcaccatctgccacccgtcaattttgtagcagagagaagacaacagtcgggttcaattgctttgggcggattgagaggttagttatgtgaattgcaattgatagagatgacattgaacttgtcagctgtcaatg

SEQ ID NO: 5911 - DNA, 353 bp, Triticum aestivum
  Clone ID: LIB3281-033-P1-K1-B4
aggacgcgtggggaagcgtaaggcttaaagcctacagcctactcttaaaaatggagacccgatccctaaatgggaccataggattgactatgctgaatgatggtcctgatgctgacgccgatcctaggtcagtggtacagcatctgcgtagtgcaagcttgcaagctaacagaacaagcggacgctggagcagcggcttgtaacttaccatgcgctgatgacagaactgttattgatagtcattcacatgacagacgttttctgatacagatgactgattgggttgcacacagacagaccgttcgaagaacggggtaaactgcgctgctgagcttacataggaagctatgatc

SEQ ID NO: 5912 - DNA, 405 bp, Triticum aestivum
  Clone ID: LIB3281-033-P1-K1-B5
ctcaaaacatgatgggcaatgttggtcttccagatggtggggtgccgccacaggggccacagtaaggccagttccctcagcaacaaggccagttccctcagcagcaaggcattcctatgaacccaattggcctacctgatggtggtgtacctccacagagccaggctcttccttcacagccacagggctttcaacctgctgctcctactccttcgcaaccaattgatctcagtgctctcgagggtccaggagcggcaaagcaagctgctcagcccccagcgcctaaagccgtgcgtcctggccaggtaccccgtggcgctcctgctgcagaatgctacaggatgggtcttgcacatcttgagcagaatcagctcacggatgcactaaattgtttggatgaagcat

SEQ ID NO: 5913 - DNA, 386 bp, Triticum aestivum
  Clone ID: LIB3281-033-P1-K1-B6
cggacgcgtggatccgcaacaaacatactgggcagcccgagggttatggttttattgaatttcaatctcgagctgctgcggaatatgctcttgggacctttaatgggcagatgatgcctaatgttgaacaagttttcaagctaaactgggcttcttgtagtgctggtgacaagcggggtgatgatggttctgatcacacaatatttggtggtgatttggctgctgatgttactgacgccatgttggaagagatattcaaaggcacctacccatcaattaaaggtgctaatgttgttactgacagggccactggtcgctccaaaggatatggttttgtacgctttggagatctaaatgagcagacacgtgctatgactgagatgaat

SEQ ID NO: 5914 - DNA, 406 bp, Triticum aestivum
  Clone ID: LIB3281-033-P1-K1-B7
ctcaccgccgccgccactccgcctctgccgccgccgagatgggtcgcgtgatccgcgctcagcgtaagggtgcgggctccgtcttcaagtcccacacccaccaccgcaagggccccgcccggttcaggtcgctcgacttcggcgagcgcaacgggtacctcaagggcgtcgtcaccgatgtcatccacgacccggggcgtggtgcgccgctggccaaggtgacctttcgccacctcgttcaggtacaagcaccagaaggagctcttcgtcgccgccgagggtatgtacaccggtcagttcgtctactgcggacgccgcgccacgctctccgtcggcaacgtcctcccgctccgctccgtgcctgagggaggcgttatctgcaacgtcgagcaccacgtccgcgacc

SEQ ID NO: 5915 - DNA, 387 bp, Triticum aestivum
  Clone ID: LIB3281-033-P1-K1-B8
ctcactcgttgcaccacgcctgctcattccccttctttttggttcgggggagcctccctatagggaaagacaagccctcctccacctcatagtgcccaacctccctactacctgcacgcctgccggattaaggctccactagacagatgctagcccaacgcccataatcaaggggtctctgtgcgaggagcaaggatctcctggaggctaccatccatcatagctacttcctcatctgctcaaatcattctgctcgtaggagacaacgacgcatatgcgccccctgccacccattaatattctataataaagaacacaaaacatggcatcaatgatttttgtcggatttggaggttagttctgcgaattgctctagatagagattac

SEQ ID NO: 5916 - DNA, 163 bp, Triticum aestivum
  Clone ID: LIB3281-033-P1-K1-B9
cagaggcgtaggctgcactcgtcttcttcggggaggcaaacggcgtgggggggaacgtctccatgtacatgaataacctcaacgagaagatcaaactcgaagcacttaagaagtccttgaatgccgatttctctcaatttttgaaaatcaatcaggtacttga

SEQ ID NO: 5917 - DNA, 442 bp, Triticum aestivum
  Clone ID: LIB3281-033-P1-K1-C1
cggacgcgtgggtgctagggttttggtccttcgttttcggcggcgcaagaggggggagtagggtcaagggaaccgttaaatttttcaacttcaccaaggggttcggcttcattttcccggacgacgaccgtttaggacctttttgttcactagttcctcattaaatccgacagctaccgtaatctcaactagaacgactccttttttgttcgatctaattaccgtcgtcaacaagttacatcatggtcttttttttttttgtcctttaatactcatttgtttgattgtggcttctttttattttttattttatttaaattcctttttttttttcatccttttccttacatattattgattttctttatttgcattataattaatataattctcatttctttcttttctttctttttactttctcgtttaatgtgattttttt

SEQ ID NO: 5918 - DNA, 402 bp, Triticum aestivum
  Clone ID: LIB3281-033-P1-K1-C10
cggacgcgtgggcggacgcgtggggagagcacaaagcgtcctcttcttctgggcggcggcggcgaaaggcgaacgagcgaggaaccctaaccctaaccagttccgatccgcaaggcctgcgtcgatggcggcttccctccgcgcggcggcgacgaggatgctgcgcccggcggtgcttccaggggaggggcgtcgcctgctcgtccacacccagcagctttccaaatcaacccgcgcctacgaggaaggaaaccatgccttgaatgaataccgtgcgtcgcttatccagcagaggaaggagcagctgtacgttctcattgccggcgccgaggccaattcccgcaccttcttgctgaacaaaagtctgctcaaggatctctctacacaagtcaagcctagacc

SEQ ID NO: 5919 - DNA, 401 bp, Triticum aestivum
  Clone ID: LIB3281-033-P1-K1-C11
cagctttcaaaagcatactatggatatatggaagttcttttcaacaaccatatcactatcaattctgtcctcaatttggacacaagcacatttgtgcatattgtcacctcgcttgaatctggcttgaaaggattagatacaggaatatcaacacagtgcgcttctgccattgatagcttggctgctttctattttaacaatataacagctggtgataatccaccatcaccagctgcactgaatcttgctcgacatattggggagctccccagtttatttcctcagatactgaagtcactttttgaaatcattatcttcgaggatgcgggtaaccagtggagtctcagtagaccaatacttagtttgataatgatcagtgaacaaatgtttagtgatctgag

SEQ ID NO: 5920 - DNA, 394 bp, Triticum aestivum
  Clone ID: LIB3281-033-P1-K1-C12
cacacgcgtacacctgccgatcgctaaccctaacgccgttgccactaggggagctgtattacgcgagcgctatatttcgacaaacacttatcgcgccataatgtcagctagatggtatctgcctggaaaggattacatacaggaatattaacacagtgtgcttctgccattgatagctcgactacttgctattttaatattataacaactaatgataattcaccatcaccagttgcactagaatgttagctagacatattgtggagctctacagtttatttgcttaaatactgaagtcactttttgtaatcattatctttgaagatgccgataaccaatggagtctcattttaccaaaacttaatttgataatgatcaagtaacacatgtttag

SEQ ID NO: 5921 - DNA, 404 bp, Triticum aestivum
  Clone ID: LIB3281-033-P1-K1-C2
cggacgcgtggggaagccccgactctcaagcccccagacgccgcagcgccgggggtccacccgcagcggcaaccatggcggtcggcaagaacaagcgcatctccaaggggaggaagggtagcaagaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgtttgaagtatctctagctgatcttcagaacgacgaggaccaggcctacaggaagatcagactccgtgctgaggatgtgcaagggatgaatgtcctcaccaacttctggggcatggactttaccactgacaagctc

SEQ ID NO: 5922 - DNA, 403 bp, Triticum aestivum
  Clone ID: LIB3281-033-P1-K1-C3
cggacgcgtgggcggacgcgtgggatctaagcagagtaggagtgagaagaagagcaggaaggccatgctgaagcttggcatgaagactatcactggcgtgagccgtgtaactgtcaagaagagcaagaatatcctgtttgtcatctccaagccagatgtattcaagagccctgcctctgacacctatgtcattttcggtgaggctaagattgaggatctgagctcacagctgcagtcccaggctgccgagcaattcaaagcgcctgatcttagcagcgtcatctcaaaccctgaggcttctacagctgttcaggaggatgacgaggattgtgatgagactggagttgagcctaaggacattgaactggtgatgacccaggccggtgtgcctaggcccaaggct

SEQ ID NO: 5923 - DNA, 311 bp, Triticum aestivum
  Clone ID: LIB3281-033-P1-K1-C4
cggacgcgtgggcgaaaattgaactgaatcttttattactagctgttgctcgatcgccacatctctacggcaccaatttactcgatgcaatgcttggtactaatacaaagatgatgatgatacaatagacaaccgaatacaatttttttgatactggtagtagcactgtctgctaagaactattgtattttcacacgcccagcacaaaaatgtcatgtttcctgtatttatttgccttcctaccacaaattaaaggcaagaaatgaacagatttcgcatcatcaaacatggtaaggatacattttggggga

SEQ ID NO: 5924 - DNA, 405 bp, Triticum aestivum
  Clone ID: LIB3281-033-P1-K1-C5
cggacgcgtgggccagaacacattcgtgaggttgaccgtgtggcctacgaaccaatcattatatcgtttggcccgtatcaccatggaggccaacactttcaatacatggagaagaaaaaatgggaacatttagacagggtactaaaactgaactgtaatagaactctgcatgattacattaaagcaatcgccgaagtagagaagcaagcaaggaaatgctactcggagcagataataatggaaaggaaaaagtttgtgcagatgcttttgttggatgggtgcttcatacttgtgaatattgatgaaaatgtcggcaccaggatgtcaaattccagaactttgaaccaaggatccacccaaacagaagttgatggaaacgtgacgggagaagagctggaacagatt

SEQ ID NO: 5925 - DNA, 412 bp, Triticum aestivum
  Clone ID: LIB3281-033-P1-K1-C6
agccttccgcgaccccttggcccaaaccacattcgtgaggttgaccgtgtggcctacgaggcaatcattatatcgtttggcccgtatcaccatggaggccaacactttcaatacatggagaagaaaaaatgggaacatttagacagggtactaaaactgaactgtaatagaactctgcatgattacattaaagcaatcgccgaagtagagaagcaagcaaggaaatgctactcggagcagataataatggaaaggaaaaagtttgtgcagatgcttttgttggatgggtgcttcatacttgtgaatattgatgaaaatgtcggcaccaggatgtcaaattccagaactttgaaccaaggatccacccaaacagaagttgatggaaacgtgacgggagaagagctggaacaga

SEQ ID NO: 5926 - DNA, 403 bp, Triticum aestivum
  Clone ID: LIB3281-033-P1-K1-C7
tgagaaggctcctccgtgcttaacaggaagagacagggtcacagccgcaccgcacgacggcaggccatggtgagccgcaccgcaccaggtgggctagggcgagctccagggcgagcgagcgcacccgtcgcccacgccggcggtgtcctggccacgagcaacaggaacacagggtccatgaccatggctggatctcctccttctccgtccacatgcgtgcagcaagaactagcagccgcacgggtctgagctcggcctctcaagaccaattaggaggacgcggagtatgtgatggtgagcatacaggagcttggtatcagggacgtccagaaatgctatgagattcggtgcatttaatgaccgagccagccgacgggtccagcgggaacacgggaagtgaaga

SEQ ID NO: 5927 - DNA, 399 bp, Triticum aestivum
  Clone ID: LIB3281-033-P1-K1-C8
gacctctgcaatcgggttcgagggctacgagaagcgcctcgagatcaccttctccgaggcatcgatctttgccgaccctcatggtcgtggcctgcgcgccctctctagggcccagattgactctgttcttgatcttgcacggtgcaccattgtgtccgagctctccaacaaggacttcgactcgtatgtgctatctgagtccagcctgttcatctattctcagaagattgtgatcaagacctgtgggactaccatgctcctgctcaccattcctaggattcttgagcttgctgaaaagctgtgcatgccgcttgctgccgtcaagtactctcgtgggatgttcatcttccccggcgcacagtctgctccccacaggagcttctctgaggaggttgatgt

SEQ ID NO: 5928 - DNA, 398 bp, Triticum aestivum
  Clone ID: LIB3281-033-P1-K1-C9
gacctgcgtaatcccaatcgagttttacgacaagcgcctcgagatcagggggtccgaggcatcgatctttgcccaccctcatggtcgtggcctgcgcgccctctctagggcccagattgactctgttcttgatcttgcacggtgcaccattgtgtccgagctctccaacaaggacttcgactcgtatgtgctatctgagtccagcctgttcatctattctcagaagattgtgatcaagacctgtggtactacaaaacttttgatcaccattcctaagatgagagatcttgctgaacagctgcacatgctgtttgctaccgtcaaatactatggtgggatgttcatcttccccgacgcacagtctgatacccacaggagcttttctgaggaggttgatg

SEQ ID NO: 5929 - DNA, 404 bp, Triticum aestivum
  Clone ID: LIB3281-033-P1-K1-D1
acgtggtctacgctttcttgaggtaatgaaggcttttgaagggaggaggttggatttttgcgcagggtcatttccaaaacttcgatttctacacatatggggcgcagcacaactcaaccaagttagaatagaagagggtgcgataaaaaccctcgctgagctatggttcacagactgccctgagctaaagtttcttccagatggcatcgaacaccttgcagcccttgagaaattaattctgaaagacacgtccgaagaactgataaagaagctccggcagaagagagattcagatgaatgcagcgaagatgtaatgaagattagccacataaggaatgttacagttgcactgagccataatggatttgaggaaaggatttggtgatcgtcaccattcccaagat

SEQ ID NO: 5930 - DNA, 401 bp, Triticum aestivum
  Clone ID: LIB3281-033-P1-K1-D10
tttttccggacaggacccctcctcctgctacattgttagacggatccagggggggatagacggatgccccgcctccattatctccatgccttgatttgattctcgcttcgcccctacatttctcgcgcatcttgattcgatgtccccacaagaattatcttatctagcacgagtggtgcgtacacagtgtacatactacatgtaatctgtactgcaatcaaaaaattcaaggcagctcttgttcatcaccagcaacgaacatctaaagcttgcagagcgcgagcagaggttgcaccaacgccaacagctgctatagcacggacttcggctgcagctacagcacctgccgctccttcaacctgcggaacctgtacaagctgatgctgacatccctaggctcc

SEQ ID NO: 5931 - DNA, 400 bp, Triticum aestivum
  Clone ID: LIB3281-033-P1-K1-D12
cttttgttgtagtctatatatatgcaaaaacaaaatatcttcagtctatgtgacttggtaggttcctttctgtttactgtttgtccttgataaaccatatcttctttataaaagttttggtacgaagcaggggcagaaaagatcaatgaggcaccaggaagtgccatctcaaggacctctgagaattgatgctgacaaacctgacctggcagaagagcgtcctgggagcatgctggtaaacaaccccattgttggccaaacctcagttgttccaccaagcacagatgatgacatggtggccctgcgtgaacatctgatcaagcaattccttgaaatcgacaaatacggcgggcggatcatcgggataaaggaaatgggcaaactgaatgtgaaggcattt

SEQ ID NO: 5932 - DNA, 402 bp, Triticum aestivum
  Clone ID: LIB3281-033-P1-K1-D3
gccctagccgccgccgccgccgtcagcaatcccctccctcaatcgcccaagggtgggaatggccggcgtcaccaccaccgctccgtccacgtagcgcctcctctatcaccaccacaccacatgcgggtccaagcgccacacccaccaccaccagcagcggctcaggtacgcccccaatccgtcccctctcgctctgcgccggcggctttcgccgacagccggggcggcgctcctgccggaccgcgtgaccccggtctcctacggtgcggacgacgaatccgacgaccacccgcgcgaggagcgcggcctggtgggggtagaggtccacccggacgcctgctcgctctgctacctgggcctgcagaagctgtagcaccgtggggaggatgtcgccgggaacgt

SEQ ID NO: 5933 - DNA, 357 bp, Triticum aestivum
  Clone ID: LIB3281-033-P1-K1-D4
caagaccatccggtgattcgctgcttgcaaacaacagctagtaaatcggtcaccgtgggggcggggacatgagattcagagaagagatgctgctgcctgcctatactagttcatatgtatccacccgcctagatctaccatactcacctcgtttcactgtcctactagtagttcctaggccattagctcctgcttgctttttttgctgcacaatgcttattttactgctagtgtccatttagcagtttttttactatgttttggcctagttttgttcacatgtataataagcatcctgaatgctcatttagcagtgtattaataacactgctagttttattcacgtgtattcagatt

SEQ ID NO: 5934 - DNA, 408 bp, Triticum aestivum
  Clone ID: LIB3281-033-P1-K1-D5
cggacgcgtgggaaaacttatcctgatacagtacgtcgttggtgcaaatggcatgtcctaaaaaaggcgaaggaaacactaggaccactgtacagcaagaagggtgacttccaggctgaatttcacaaagttgtgaaccacatgctaactgaggaagagtttgaatcagcctgggcagctctcctcgacaagtacaatttgaggaatcataactacatgacccaaatttatgaaaccagaaggaaatgggcgaaaccatatttccagggtgttttctgtgcaaaaatgacaagcacccaaagaagcgagagcgcaaaccacatgctgaaatcgtacatgccaccagccagcccaacgcatgttttcgtccggcaatacatgaaactgcagtttgatcgagaacaggac

SEQ ID NO: 5935 - DNA, 386 bp, Triticum aestivum
  Clone ID: LIB3281-033-P1-K1-D6
ccgagtccctttaccataccttatcccgttccacctccctgttgtggaaaaaggagtgttataaaaaaggccaagctaacactacgtccactgtgcagaaagaatggttacgttcaggcttaatttaacaaagtcgtgaaccacatgctaactgaggaagagtttagaatagcctgaacaactctcctccacaagtacactttgaggaatcataaatacatgacccaattttattaaaccagacggaaatgcgcgaaaccatatttccaacgctttttctgtactaaaatgacaagcacttaaagaagcgagagcgcaaaccatatgctgaaatcgtacatgccaccatgcaccccaacgcatgttttaatccggcaatacatgaa

SEQ ID NO: 5936 - DNA, 401 bp, Triticum aestivum
  Clone ID: LIB3281-033-P1-K1-D7
cggacgcgtgggattttctaccggtcatctccttccaaatcgagccgcgggggctgaggtccaacaaatccccaaccctaatggcttcccaatggcgacggcggtgtagatcctgtacctagatgggcgaccttggctactggaggaagctttccatttctgcccctagatgtacctagctgggcgaccttggctactggaggaatcttggtcgtcttgtcgccggtggtcgggctgcacgggtggacctctcctgtgctgcgccgcgacgctgtccgagccaatctccagcacataagcctcgatgagcaagaagcaccaacaccgaagatgctcatgtccaagtggccagattacgaggagagagcaagacttgcttgatgccaaaacccctgtaactg

SEQ ID NO: 5937 - DNA, 320 bp, Triticum aestivum
  Clone ID: LIB3281-033-P1-K1-D8
ttggggggttttttttttggggggcagtacatgatgttacatagataagcatcattttgacattagtacaggggccaagaccttaaaggcaagtaccaaacgactacacttgacttttttgagcattacattagcaacatcaacctggtatttttcttccctcgctgaaccaaaggccatcagggactcattttgtccaaaatttgacactcctattacataacgaagggaatgatccattacaggacagctacttcctcgccttcttgctccggagcgtgttctcaggcgtcgagccgtcctgcttgcgttttttgtta

SEQ ID NO: 5938 - DNA, 287 bp, Triticum aestivum
  Clone ID: LIB3281-033-P1-K1-D9
gtttcccgacccgacgacatggggagaaggaagacgcatcatgggcggagcaccgcgcgccgcgcgggctcgcattggccgccgtcccggcctaaatctcggcgcgcctgtctggcgggggagggcggcgtctcatagcagaggttacacggttcaaaattgggagatttaacgccgcaggatgagcctggaggtgttattaccagtcggccttaaatatcggggcagcatatttttgatttggaagctctcattggggagtcgtggaatgattatgtttgtggtct

SEQ ID NO: 5939 - DNA, 382 bp, Triticum aestivum
  Clone ID: LIB3281-033-P1-K1-E10
cccacgcgtccgcccacgcgtccgcaggggttggcttctcctccccactcagtcctcggttcccggcccggttcggttcgttagggtttagtagtggggaagaggaggaagaatggcggacgtcgagtaccgctgcttcgtcggcggcctcgcctgggccaccgacgaccagtccctccagaacgccttctccaagtacggcgacgtcatcgactccaagatcatcactgacagggagacgggccgttcccgcgggttcgggttcgtcaccttccgtccgacgaggcgatgcgccaggcgatcgaggccatgaacggccaggacctggacggccgcaacattaccgtgaacgaggcccattcccgccgctccggcggaggcg

SEQ ID NO: 5940 - DNA, 384 bp, Triticum aestivum
  Clone ID: LIB3281-033-P1-K1-E12
cgcgtcttctcctgcgcatctcggaggtgcttcctagtttccacgatgaagctgatcgctgcctacctcctcgcctatctgggtgggaactcttccccaagtgccgctgacgtcaagaacatcctggactcagttggtgccgaggctgatgaagaaaagcttgagttccttctggctgaactcaaaggcaaggacatcacagaagtgattgcatctggaagggagaagtttgccgctgtgccttcaggtgggggtgccattgctgtgggagctccagctgctgcatctggtggtgccgccgcacctgctgctgagtcaaagaaggaggagaaggttgaagagaaggaagaatctgatgaagacatgggtttcagtctgttcgac

SEQ ID NO: 5941 - DNA, 120 bp, Triticum aestivum
  Clone ID: LIB3281-033-P1-K1-E2
gagagggtatacagttggctcgcacatgcatatatgtgtgttgggtacaacaaaaacaatttgagtgcctttttaaaaattttacttttagagggggggggggggggggccccaaagggg

SEQ ID NO: 5942 - DNA, 398 bp, Triticum aestivum
  Clone ID: LIB3281-033-P1-K1-E3
cggacgcgtgggttggaagcgagaggagggacggggagggagagggggcggagggcgccggtgagctttgccagggaagctgcttgcgtggggctttgcacggccgggccccgcccacgcatccctcttgctcactcactcccaccaacgctcgcctctcacctactctctctctcttatctccttccaagatccctttttccctttcgtctttgctaggaccattctttgatctttccttggctccaaatactcccgttccagctgcgcagatcccacctcggttccctcccgtccgagtaatcagctcgaattagacttgtttcttgctcttcttttttgtggctgctcagttggtgcgcgtctccgcttcaatccgagaacaacccctgctcggc

SEQ ID NO: 5943 - DNA, 380 bp, Triticum aestivum
  Clone ID: LIB3281-033-P1-K1-E4
cccaagagggctttcaagatcaagaagctctccaaccttgtcaaggacgatgaggtgcctcagttatctcaacacgtaccgctactccttgcttaacaagaacggcaagaccgtgagcacgcatcccaatagctcacttactgcgactaactctagcctctaacactactctctctctattatctccttacaagatccgtttttccatttagtctttgctaggaccattctatgatcttttcttggctccaaatactgcggttccagctgcgcacatcccacctgggttacctcctgttcgagtaatcacctcgaattagacttgcttcttgctcttcttttttgagactgctcatttggagcgcgtttcctttcaattc

SEQ ID NO: 5944 - DNA, 407 bp, Triticum aestivum
  Clone ID: LIB3281-033-P1-K1-E5
gccggtaacaactgggccaagggccactacaccgagggtgctgagcttatcgagtctgttttggatgttgtgaggaaggaggctgagaactgtgactgtctgcaaggattccaagtatgccactctcttggtggtggtaccggatctggcatgggtaccctcttgatatctaaaatcagggaggagtaccctgaccgcatgatgctgacgttctcagtgttcccctcaccaaaagtatctgatactgtggttgagccatacaatgcaactctctcagtccatcagttggttgagaatgctgatgagtgcatggttcttgacaacgaggctctctatgacatctgtttcaggactcttaagctgaccacacctagctttggggacttgaaccatctaatctctgctac

SEQ ID NO: 5945 - DNA, 407 bp, Triticum aestivum
  Clone ID: LIB3281-033-P1-K1-E6
cccacgcgtccgggccatcctccctctcctcccctctcttccacctcacgggctcacccaaccacctgatagccatggctccgccgcctcgcctccgcctgcgccagtcggagtagccgtcgcggtctgccggtgttggagggtaggggcgtagggttggcccggttctcgagcggagatggggcgggggaaggtgcagctgaagcggatcgagaacaagatcaaccggcaggtgaccttctccaagcgccgctcggggcttctcaagaaggcgcacgagatctccgtgctctgcgacgccgaggtcggcctcatcatcttctccaccaagggaaagctctacgagttctccaccgagtcatgtatggacaaaattcttgaacggtatgagcgctattcttatgcag

SEQ ID NO: 5946 - DNA, 399 bp, Triticum aestivum
  Clone ID: LIB3281-033-P1-K1-E7
aagattacaaggtggtcttctttaaatgtgattggtatgatgttcatcacaaagctggtattataagagatgagtttggattcactcatgtgaacttctcccgaaaaatacatacaggggagaagttagaggatgaaccttttgtattttcttcccaagtggaccaggtcttctatatccaaaatccgagaagtgagaattggaataccatggtgaaattcaaacctcgtgatatttttgacatgggtggagaaccatcttcagatgaaacagagtagtctttgtgtttttagcttgttatctgcagctaagatataggttgagcaattgtcatccatgctcctaggtataattaacataattatacctaggagcatggatggatcttcttcggaatgt

SEQ ID NO: 5947 - DNA, 402 bp, Triticum aestivum
  Clone ID: LIB3281-033-P1-K1-E8
atcggccagtcccaccccgtgaagctggtgccgttcaacccggcgtacgaggacgcgtcggtgctgtggacggagagcaaggacgtgggcaagggtttccgctgcatccgcatggtcaacaacacccgcctcaacttcgacgccctcaacggcgacaaggaccacggcggcgtgcacgacggcaccaccgtcgtgctctgggagtggtgcaagggggacaaccagtgctggaagatctggccgtgggccgaggcgcacgccgccgtcgagtccggcgccaccatgggcaacaacgcccacgccatgggcggcgggccccccgtgcacgccgtgcgcatcttctgcaaggccggcgaggactacagtctcaccgcccgcaacggcaccgtctgtctcgccccc

SEQ ID NO: 5948 - DNA, 388 bp, Triticum aestivum
  Clone ID: LIB3281-033-P1-K1-E9
atcggccagtcccaccccgtgaagctggtgccgttcaacccggcgtacgaggacgcgtcggtgctgtggacggagagcaaggacgtgggcaagggtttccgctgcatccgcatggtcaacaacacccgcctcaacttcgacgccctcaacggcgacaaggaccacggcggcgtgcacgacggcaccaccgtcgtgctctgggagtggtgcaagggggacaaccagtgctggaagatctggccgtgggccgaggcgcacgccgccgtcgagtccggcgccaccatgggcaacaacgcccacgccatgggcggaggtccccccgtgcacgccgtgcgcatcttctgcaaggccggcgaggactacagcctcaccgcccgcaacggcaccg

SEQ ID NO: 5949 - DNA, 373 bp, Triticum aestivum
  Clone ID: LIB3281-033-P1-K1-F11
gggacgcgtggtgtcgatccactagcctgctgctcgcctatgcgcgaggacccaaatagagctgtataattcatgcccatggtcaacgacacattgcccacttacaccttcggacagtataaccgattacgcgaatagcgacatccaccggcagcataggatgctggccatgctgcatacgcagactttctgccctagaaccgatgtagcaatccaggcatacacctgctccgacttcgtgattctactagatgcacatagcacaagaccttggagagatcccgactccaatgcaataccgcaacggttcgatggcaagcaccgctcatatctactgcctctttgagagtcagactagagatcttccgagatg

SEQ ID NO: 5950 - DNA, 329 bp, Triticum aestivum
  Clone ID: LIB3281-033-P1-K1-F12
ggtttcccccctcttcagcacccagcccgtataagtacgaggcgagagcccccgccgccaacaatctaacgagagcccccgccgctagggtgttcgtccacacactcccgccgccgccatccccgcgaaccggagagcgaggccgacaccgccgccgcgatgagggccaagtggaagaagaagaggatgaggaggctcaagaggaagcgccgaaagatgaagcagcgatccaagtaggtgccttggagggaggggaagcattatcttacatccaggcagcggaactctgagggatgatggcattgtccgagtgattcctgatttgtttt

SEQ ID NO: 5951 - DNA, 404 bp, Triticum aestivum
  Clone ID: LIB3281-033-P1-K1-F2
ccaaaacctttctccttctgtcccgcaaacccccgagagatcacagcatgttcggcttcggtcaccacggccaccatggccagaaccccccggcccacgctccggccgccgccggaggcaaccagcccaccttcaagatcttctgcaaggccgacgagggctactgcctctccgtccgtgacggcaacgtcgtcctcgccccgtccaacccccgtgacgagcaccagcactggttcaaggacatgcgcttcagcgcccagatcaaggacgaggagggtaaccccgccttcgccatcgtcaacaaggccactggcctcgccgtcaagcactcgctcggccagtcccacccggtgaagctcgtgccattcaacccggagtacctcgacgagtccgtgatgtggacg

SEQ ID NO: 5952 - DNA, 404 bp, Triticum aestivum
  Clone ID: LIB3281-033-P1-K1-F3
ccgcaaaacccttcttccttctgtcccgctaaccccggagagatcacagcatgtgggggtttctgtcaccacgggcaccatggccagaaccccccgacccacgctctcatcgccgccagaggcaaccatcccaccttcaagatcttctgcaaggccgacgagggctactgcctctctattcgtgacggcaacatcatcctcgccccgtccaacccacgtgacgagcaccatcactgattcaaggacatgcgcttcatcgcccagatcaaggacgaggagggtaactccggcttcgccatcgtcaacaaggccactggcctcgccgtcaagcactcgctcggccagtcccacccggtgaagctcgtgccattcaacccggagtacctcgacaagtccgtgatgtg

SEQ ID NO: 5953 - DNA, 411 bp, Triticum aestivum
  Clone ID: LIB3281-033-P1-K1-F4
cgctatgcgagctctgctctctcgcatcccggtctctaccgctgccttctcctgctcctcctcccaaaccctagccccgagccctagcctcgcccccctccgcctcggccgccgcttcgtcgccatggccgccgccgccgcggaggagttcgtgaagggtcgcgtcttccccaacggcgtcgccgtcatcaccctcgaccgccccaaggccctcaacgccatgaacctcgaaatggaccttaggtacaaggcatttcttgatgactgggaaacaaatccaaatgtgaagtgcattcttgtggaaagcagttctccccgcgccttctcagctgggatggatattaagggtgttgcatcggaaattcaaaaggacaagagcacatcatttgtgcaaaaggtcttcacagctga

SEQ ID NO: 5954 - DNA, 356 bp, Triticum aestivum
  Clone ID: LIB3281-033-P1-K1-F5
tgccgccgccgtccgatatggtcagggaggagggtctccttctccgagaggggcacacaaaaaattctatatttctaggaaaaagaaccggaagagaagagagctctcgcccaaataattgtagaagctgtagagttcaagatagcttttaatgagaagaggatacacacctgtgagacgaataaggtccatagcagggaaagagagaagattttcgtagaaagccaggagaaattccatgctagcgcagacaagcagtactggaaatcaatctcggagctcatcccacatgaaatcgctaccatcgagaagcggggcaagaaagacaaggacaagaagccatccatcgcagtcat

SEQ ID NO: 5955 - DNA, 401 bp, Triticum aestivum
  Clone ID: LIB3281-033-P1-K1-F6
agcaccaccacccgccacctcaacgcacgcaaaggccgaggaggacaaggtaggaggagcgagcagccatggcttcgtcggtggccgccgcggcgagcgcgttcctcgggacccggctggcggacccggcgccgcagaacgggcgcatcgtggcgcggttcggcttcagcaagaagaaggccccgccgaagaaagccaaggcgcccccgaccaccgaccggccgctgtggttccccggcgcgcaagcgcccgagtacctcgacggcacgctcgtcggcgactacggcttcgaccccttcggcctcgggaagcccgcggagtacctgcagtacgacgtggactccctggaccagaacctggcccagaacctggcgggcgagatcatcggcactcggttcgag

SEQ ID NO: 5956 - DNA, 399 bp, Triticum aestivum
  Clone ID: LIB3281-033-P1-K1-F7
cggacgcgtgggcggacgcgtgggcgacgaacgtgaacctggagggggtggacacctccgccgtcctcgccgacgcctccagcaccgtcgcaaccatcatcggcaagccggagaactatgtgatggttgttctcaagggttcagtgcccatggcgttcggaggtacccaggagcctgcagcctacggtgagctggtttccatcggagggctgaaccctgatgtgaacaagaagctgagtgccggcattgcttccatcctggagtcaaagctgtccatccccaagtcccgcttctacctcaagttccatgattcaaagcgctcggactttgggtggaacggatcgaccttttagacgcctcatatggcgtggagtcctgtatgaacttcagagttcctaa

SEQ ID NO: 5957 - DNA, 351 bp, Triticum aestivum
  unsure (1)...(351): unsure at all n locations
  Clone ID: LIB3281-033-P1-K1-F8
cgcacgcgtgggctgacgcgtggtctacgaacgtgaacctggaagaagagggcacttntccacatgcttgcccactcctacaacaccctcgtaaccattattgtcaaggcggagaactataagaccactgttcaaaaaattttaaaggccatcaagagctaatgtttctacgatcctgaagactacattgagcttgtttctatcaaaccccttgacccgcaccagcacttgtttaaggacatgcgctttatctcccacatcaaggacgaggagggtaaccccgccttctccatcttcaacaaggccactggcctctccgtcaagcactctctcggccagtcccacccggtg

SEQ ID NO: 5958 - DNA, 399 bp, Triticum aestivum
  Clone ID: LIB3281-033-P1-K1-F9
gatcacgccgccccgtcgcccctcgagcacgtcgccggcgcgcatcctcaccgctgcagaggcccactgccccctccccactccccgcccttgccgccgccatggcgatcaccgcccaggttccggacatcatgggcgagcgccagtccggccaggatgtccgcacccagaacgtctcggcgtgccaggcggtggccaacatcgtcaagtcatcgctcggccccgtcgggctcgacaagatgctggtggatgatattggtgatgtcacgatcacaaatgacggagccaccattctgaggatgttggaggtcgagcatcctgcggcgaaggttctcgtggaattggctgagctccaagaccgggaggttggagatggaactacctctgtcgtcatcattg

SEQ ID NO: 5959 - DNA, 298 bp, Triticum aestivum
  unsure (1)...(298): unsure at all n locations
  Clone ID: LIB3281-033-P1-K1-G1
gaanncccggggcggacgccacgcgtnccgaacgnccaacagcatacagcatatcttagcttagattagtattagatggtagctctgcagagagtgctgtatggaggagagcgctccaacccacttgctgcgatattgcaaattattgtggggatttgccttagcatatctctccacagcgtggtctcattcttgtacatgcaacagtcagaaacactattaggcaactcaagattagaggaggcaccacgcaaccactgaataatccttaccatgcagagcattgtaagtattactt

SEQ ID NO: 5960 - DNA, 245 bp, Triticum aestivum
  unsure (1)...(245): unsure at all n locations
  Clone ID: LIB3281-033-P1-K1-G10
cccacgcgttccnccacccttctatgtaatagttctcatataccacaaaggaagtttaattcactatgcatctttttacaacgtcataactggcaaaaccgtacctctacccaacttaatttccatccaatacatacttctttcgccagatgccttcatactgcaaaagccctaacacataacacttcccaacatgttcccaaaacttaatgcacaatagcacgcacactatagccccccattaa

SEQ ID NO: 5961 - DNA, 314 bp, Triticum aestivum
  Clone ID: LIB3281-033-P1-K1-G11
gaaagacttgacaaaatatgactttgaggccgactgctttagttctcctggggatgatgtgaataaaaggaagcttgcctacaggcatcatgctattggagacaagtatgccaagagtttgcaaaaaattctggaccaccgcatgttcaaagtctggagtgatttgtatagttcgacagacaaatatactgatggttgactttcttcagctcataagttgctggaagaagcgctgggtaaatcaacagctgagcccgctgtcaaatatttaagtatcaagtgcatagttacttgacggtccctggttccgagca

SEQ ID NO: 5962 - DNA, 258 bp, Triticum aestivum
  Clone ID: LIB3281-033-P1-K1-G12
ctcagacgtcgccatcgtcttcggacactcctgttagagaacaccgactaggtctgccgaccgacgagggcatttccacctccattcatgctgctcagggccactaagcatcccaggctatctagattctgttgatcaacgcaatctccaaagtgttttgttggcagctttgctgggcacacaactattctaatggttgactctctacaggacaaaagttgttggacaactggcctgcctcaattaatatatcaacta

SEQ ID NO: 5963 - DNA, 341 bp, Triticum aestivum
  Clone ID: LIB3281-033-P1-K1-G2
ggtagggaagtccatgcgttgggcatttagataaactctccacaaatggatacaacacgaaaaatattacatattctttgagaacatacttcagagctaatacacacacgacaataccagtacaatttaaacaaggaaaagtcggttgtattttgagctctttttgaaaaacatataaattgtattttgtagcatggtcgatgatggctccagccgctggggcataaccagccgccacgtgacatcagctcatcaatccatcatggtccgctacgctaggcatgtgcctccgcttctcgccgtccacgccctaaggctgcattagtgcatcatcttgactc

SEQ ID NO: 5964 - DNA, 156 bp, Triticum aestivum
  Clone ID: LIB3281-033-P1-K1-G3
caggtcttctccacctactccgacaaccagcctggtgtgctcatccaggtgtttgagggtgagaggacaaggaccagggacaacaacctgctccttcttggtggggatggtggtgttcctggtgatgagcacagtcatgactcctcctcgatgtga

SEQ ID NO: 5965 - DNA, 343 bp, Triticum aestivum
  Clone ID: LIB3281-033-P1-K1-G4
gagcggtaatggcatgagacaacaataactaagctctgccccgaagaacacaagggttaaaagtactcctggcctaagactttgccacctgagaagaggttgaggcagagcaggcatgcagccagcagcacgcctgggatccaccagctgccgccctcctccgaaaacatggcgcacagcaccaggcagagcagcagcagcatgtagaaccccagcccgcagccccagcccgtccagtcacccccggccccggcgaagccgccgccgtagccccggtgaggcgggtagtagtatatcccggccaggtacaccgccagcagcagcaggagcgcggcaacaacga

SEQ ID NO: 5966 - DNA, 409 bp, Triticum aestivum
  Clone ID: LIB3281-033-P1-K1-G5
cggacgcgtgggctctgagagaagaaggcggcgatgaaaatgcgggggacaaggagagcccgctggttctcaagaacaaatcgcctcggtggcatgagcagctgcagtgctggtgcctcaacttccgtggccgcgtcacggtggcctcggtcaagaacttccagctgatcgccgcacccgccccgccaccgccggcctctggaggagaggcagctcccgagccgtctttacagccgcaaccaccccagcagcagcctacctctgctaccgcacaaccccagcctgctggcagttcgttgtctgcatcgtcgtcctcgtcctcaagccaccacgacacggtgcttctgcagttcgggaaggtgttcaaggacaccttcaccatggactaccggtacccgctgtcggcgtt

SEQ ID NO: 5967 - DNA, 310 bp, Triticum aestivum
  Clone ID: LIB3281-033-P1-K1-G6
cccggaattccaggggggtccaactcttcttttttttagtttttttttaaagataattgcaggcctaaaaatttagttcacaaggggagcctgtgaattaaaagaaacttttctactggcattcttcttttggagacaagcggggccctgaacttccgtggcctgttcacggaggcctgggtcaagaacttccagctgatgatcgtacccgccccgacaatactcgaagtctggaggttaggcagttctcaaatcgtctttacaggcgtaaccaccccaacagcatcctacctctgctaccgttcaaccc

SEQ ID NO: 5968 - DNA, 397 bp, Triticum aestivum
  Clone ID: LIB3281-033-P1-K1-G7
ccgcggacacgtgcgcggacgtaagcttggatgctctagagcagccggcgtaagggccttgttgtgggtgtcgcattcctacctcttgcccccgggttgacctcggaaaaaatgcatgctttctatttcggaaatttagtcccctggtatttatgacccgcccatctctcacgaggaggcgggcctgaaaatccccccttgctcccctagatcgacttccttggtgccccgtcgattttctctttcctctcccgccttgttgatccaaacgtgcgcgcgttttctggagaacatcccggtgttggggcgtgaattggatccattaagatccgaccggatcgggccggttcgtttctgatgccaagggcgggctccttgatttgtttccgtatgaccc

SEQ ID NO: 5969 - DNA, 397 bp, Triticum aestivum
  Clone ID: LIB3281-033-P1-K1-G8
cccacgcgtccgcggacgcgtgggggcagcagaacacaaggatcacagaacaggtggtgtggaggatgcagatgcaaatgaagacattggcgccaaggctgaagagttcaaggatggcaacatgaatactgtagacaatgcagatgcaaaggaagatgaatatgccaatgcatcagaacatgaagatgccaaaatggttgatgtggatgatgcagatgcaaaggaagattatggcaccaaggtagcagaacatgaggatgtcaaaatgggtgccgtggaggatactgatgcaaaggaagataacaacaccaaggaagcagaacatcaggatatcataatgggtgcggtaaagcatgcagatctaaaaaaaaataacagttctaatgtagcagaacgc

SEQ ID NO: 5970 - DNA, 268 bp, Triticum aestivum
  Clone ID: LIB3281-033-P1-K1-H1
gcagggaggaacgtatcgagtgaacttcgccaaagagtagacctttggctagtgagcggcttctcacgcggcaggcggtggctatggaggaggcggtggatcacacacacgcggcggctaccggagtcttggcctacgtggcgttagctattgaagggccccataatctttataaagaaagcacatactatcaactccaagacaatgcgcttttatgacagtatggaaattatgcagaacttatacgagctcgctcttgtaaacacca

SEQ ID NO: 5971 - DNA, 177 bp, Triticum aestivum
  Clone ID: LIB3281-033-P1-K1-H11
cggacgcgtgggcatggacacccaacagacaatggaagcatgcacattttggttggcgagtttctgggcacaatttttggcatactaatacctctatagctgatatgcatcagaaactgtcgtgattatgttgatcattgtacaatgcgtgtcaccttcaattgagagttaagatgc

SEQ ID NO: 5972 - DNA, 386 bp, Triticum aestivum
  Clone ID: LIB3281-033-P1-K1-H12
gcttgtttgggggtttgccgtcagattctggtgctgcagaaacaacagttagtcttgccaagaccgtgtcctcctgcgtgcatcacatggagctcagtgccctcagcgcctgcctcgcagctgttgtctgctcgtcgcagcagccacctctccgccctcttggcagctctgctggtgacggtgctgctctaatcatcaaatcagtactggacagagcaactgagctactggccgacccccattctgcagccaactacagcaggtcaacccgttctctttggcaggcgtcgttcgatgccttctttgggcttctgacgaaatactgcgacagcaagtatgggagcattctgcagaggttcagcatgcagggatccaactcaatggct

SEQ ID NO: 5973 - DNA, 238 bp, Triticum aestivum
  Clone ID: LIB3281-033-P1-K1-H2
acatccaagaacttacaaattaacttcgccaaatagatacctttccctaaagaggggttttttacacggaggcggtggttataaaggacttccttcatcacacactcactgctgctaccttagtctttgcctacctgtagctccatttttattaaacgaactttttccaactgaagtacatcctataaacatacaacattgaaagattttatgacctcatttatattatccacaacct

SEQ ID NO: 5974 - DNA, 401 bp, Triticum aestivum
  Clone ID: LIB3281-033-P1-K1-H3
cggacgcgtgggtcaatatctggcttttcacagcacacactgcagtccttcagcgtatagaggttgcgtgcacttctccgacaaagtggcctcacaaccaaggggaaaaaggcacatgcttaaaacttcttattctgaatttaaagttcgtagaattaaaaatcttgatcaatggtataaccatttgaattctgcttcaaaagaacttaattgagtatcacatatatcttgtacatttgaaggggagccttggcgcaatggtaaagctgctgccttgtgaccatgaggtcacgggttcaagtcctggaaacagcctcttgcagaaatgtagggaaaggctgcgtacaatagacccaaagtggtcggaccctttcccagaccctgcgcaagcgggagctaca

SEQ ID NO: 5975 - DNA, 254 bp, Triticum aestivum
  Clone ID: LIB3281-033-P1-K1-H4
gcgaacgccaacacatacagatatctggcttgattagtattggtggtaggttgcaagcttgctgatggtggatacgctccaacgacttgctgcgatgttgcagcttattttggggatttcggttgctatcttcccgggctggtctcattttgtacatggttcgtcagaaacactattaggcaactcaggattagaggaggcacctcggtaccactgaattatccttctcatgcagtgcattttaagtatgactt

SEQ ID NO: 5976 - DNA, 210 bp, Triticum aestivum
  Clone ID: LIB3281-033-P1-K1-H5
tacttcctggggggaccgacccacgcgttcgcagacgcgtgggcatacacacctaacagacaatggagcgcatgcacattggggttggcgaggttctgggcgcaccttcttccattcttaaacctgtatagctagaaggccatcctaactatcgaggttattttgatcattagacaatgccggttacccttccatgagaagttaagagcc

SEQ ID NO: 5977 - DNA, 355 bp, Triticum aestivum
  Clone ID: LIB3281-033-P1-K1-H6
gatacagccccgtgccgtactgtcgctcgtggggcgcaagcagtgtctactccgggaggcgactctgtgcaagggccttctgcgttttttgaagctggaccgctgaaaggactaccttcttatggaggttgagttcgtcgtgagccattaccggttgccccccagcgagagacatgacggaggaggaccgatctaaggtcgtccaccttacgagcacccatatgagcgttggctcagtcgaggagatcatagtctagaaccacgcgatcgactcgacgtcctgggggcctgagtactacgtcagtgcactggcaatcgtcgacatgcaccaactagagccgttatgcaccatact

SEQ ID NO: 5978 - DNA, 396 bp, Triticum aestivum
  Clone ID: LIB3281-033-P1-K1-H7
cggacgcgtggggccggcctccctgccccgccgccgtcatctccttcgcctgccggagctcagcccgagtttggtggcgcggggttcctggcggtcttcctcccgctgctctgggtggcgtgacgcctccgccgccggcaggagggggccgcgggggccgctggacagcccggctaccagcagctcgcgccgcccagctcgtgggacacctccctcctcctccccatcgggactgggcaggaggatgagcgctgtcgcgccgccgccgcacacccctgtcgtcgcgccgccacgaggaggcggccgacatcaccgcgcgccgcccggccaaggtcttctcccgcgtgcgccacctgctcgccaaacctttcccctacgcgcggtcctcgccgactc

SEQ ID NO: 5979 - DNA, 344 bp, Triticum aestivum
  Clone ID: LIB3281-033-P1-K1-H8
cccacgcgtccggacacccacatggctaatggcaaggagaccggcaagctggtgatcattgacttcactgcttcctggtgcggtccttgtcgtgtcatagccccagtctttgctgagtacgccaagaagttccctggcgccattttcctgaaggtggacgttgacgagctgaaggacgtcgctgaagcatacaacgttgaggcaatgccgacctttcttgttatcaaggatggtgcgaaggtggacactggtgtcgggggcaggaaggatgatatccataccaagatagtggcccttatgggttctgcatttggctaagaagggaagagtgatgccccttttgg

SEQ ID NO: 5980 - DNA, 194 bp, Triticum aestivum
  Clone ID: LIB3281-034-P1-K1-A1
ccgacgcgtcggcggtttcttggtcgtatgcacaaccaaaaggagctaaactgaagagttattgactacagtcccagatcttgccaaaagcaaaacaacaccatacaaatggcatggtagcagatattttgcataacattatatatttactcccgtttacacccaggggtgggaatacgtgctgtgatcaaaac

SEQ ID NO: 5981 - DNA, 316 bp, Triticum aestivum
  Clone ID: LIB3281-034-P1-K1-A10
cgcacgcgtgttgaagaaggtggaggagctccacaagacctattactacatgaaggacatcttcttccaagcccatcactcccttgattgagaagtttagagaattgacgggttatagaatgaaagttcaaaaggctatgttaagaaagacagacatctgcctgacaaatttttgaatctaccaccaactaacaaactagttagacttatcattgaaagatatacatctcttgtcgatgccctcagagtcttggatgatagcctaacgatggagcatttattcgcgggtttaccttctattgaaggagaacttgtg

SEQ ID NO: 5982 - DNA, 139 bp, Triticum aestivum
  Clone ID: LIB3281-034-P1-K1-A12
cggcgatgttcacgttcgtcaaccggtgcgcggacacggtgtggccgggcgtcctgtccaacgccggcaccgcgcggctcggcaccacggggttcgagctcccgccgggcgcgttgcgcgcggtgcttttttccttctt

SEQ ID NO: 5983 - DNA, 351 bp, Triticum aestivum
  Clone ID: LIB3281-034-P1-K1-A2
caaacccaaaatgttcgaaactcaatactcatggactacatttcgagttcttgacaaaagcaagacaacaccatccaaaagccatgcgagcagatattttacataacaataaatactcagacgcgtgaacacccagcggggtgaagatggactctgctcaagacaccttctgactgtctcaaaaagttctcagcatatttcatcgtcaacaactaccaacttccgtcgacaggaaggaccaacaaactgactcttgccaccgagcaatgctcagcagtaacattgtgacgggcgttgctttgcccactactctgagggggctggcgcgactttggtttctgtcttcttgct

SEQ ID NO: 5984 - DNA, 67 bp, Triticum aestivum
  Clone ID: LIB3281-034-P1-K1-A3
cccagccgtccgcctacgcgttgtttcacacacacccgaattgttctacacgtgatacggagctatt

SEQ ID NO: 5985 - DNA, 407 bp, Triticum aestivum
  Clone ID: LIB3281-034-P1-K1-A4
cccacgcgtccgcccacgcgtccgcccacgcgtccgtgaatatataatcccatgtgtaggtgctatccaagtgtcgtgattatttagcacacacaacttgcagggagataactctatactatgaagactttaaaatacgagtgcgtgtcgttggtgtttttgaaaccatcttccatcacgtctaatattgttctatttcataatagtaattgttcagcctttgactaacatatggatgatttttgtaatatatttctttcttccatattaccaggaaatatgtcgaagcacagaatatattccatatgcagtggactaacagaacgacacaacacataaaaagaggagtgtaagtggaaacctttttttctttttaaattcttgaggactgtcacattatgatgaag

SEQ ID NO: 5986 - DNA, 121 bp, Triticum aestivum
  Clone ID: LIB3281-034-P1-K1-A5
aagcatctctctctcacctccggcgaataacacaccagagctcacctctcccctcgcttccccgcgaaaatgtcgactgacgtggctgccgctgacatcccggtgcctcaagtggaggtag

SEQ ID NO: 5987 - DNA, 387 bp, Triticum aestivum
  Clone ID: LIB3281-034-P1-K1-A7
cggacgcgtgggctccggatagctctacccggaggacaagttcattggcgaggagacgtctgtagccctcgtctccaccgatgacctcacctacgaccccacctggatagtcgaccctctcgatggcaccaccaatttcggtccatggctgtccttttgtgtgcgtctcgattggccttaccattgggaagattcccactcgtggagttgtgtacaaccccatcatgaatgagcttttcacaactgtttgtggaaaaagtgcctttcttaatggttcttcaattaaaacatcttcttaaaatgagttggtgaaggcttttattgttacagaggttgggaccaaaagagacaagttcacttttgatgtttcaaccaacagaatttata

SEQ ID NO: 5988 - DNA, 169 bp, Triticum aestivum
  Clone ID: LIB3281-034-P1-K1-A8
cttgactcgtagctccccgcctctcttctcccccgagaccccccccccccctctctctgtgctcgtgctccctcttcctgctcttccttctgctcggcagccatggccagcgcgctatgcggtggcggcagcggcagcgtggcggcgccgtgcggtgacttgggcgccg

SEQ ID NO: 5989 - DNA, 110 bp, Triticum aestivum
  Clone ID: LIB3281-034-P1-K1-A9
cttgactcgagctccccgcctctcttctccctcgagaccctcccggcctctctctctatgcaaggagcgccctcttccaactctacctttagactattagccatagccag

SEQ ID NO: 5990 - DNA, 427 bp, Triticum aestivum
  Clone ID: LIB3281-034-P1-K1-B1
ctgcagcttaatatgatgacagacgaaacacactcatctgttacagaagttatcgaaaaatgcaaactatgataggatggtgaagaggtcacctgtatagactgactggcctcttcgcagcctaggcacacacaagtgttcctcctcgtcccctcgtgcgccgcagatgacctgcagtcgtcttgcaactaaccaagcatggtgtcattctttcttttcttttccttttgcccccctgttgttgtcgcgcatcttttgtgtgtgctccttgccgcctctcaaaacacgttgtttacttagccaattcaaattgaatgtaaaataacatcatagggaatgtactgtgtgtgcgtgtgtgtgttttgaatttgtacctggtccagtcatagtcaggcaccacacatgccttaatctgaagaaacttaat

SEQ ID NO: 5991 - DNA, 412 bp, Triticum aestivum
  Clone ID: LIB3281-034-P1-K1-B10
aaccagccctcgctggcagcatcatgaacaacaacggcagccctcatctggtggcctcgtctctgtttacaccaactgcccttgagctgcccccttacaaatcctgcttcttccaagtgcccaggttctctcctggccatggtgccatcgggctgtgaatattaagcagaaaacaggggtctcctttcctcttaagcagacgaagccatgagcaccccatgaagtgagtgaatggaaggtaaaaggctctaacaaataatataagtgatcccgagagaggagcagggacaccaacaacaacagcaacagaagaaaggaaagaaaaatctagagctaaaacaaccgggaagtatcaaaggagatggtcttggccttcttgcctggtgggctgcaggtgaagaggatggcttgg

SEQ ID NO: 5992 - DNA, 386 bp, Triticum aestivum
  Clone ID: LIB3281-034-P1-K1-B11
gtcggatgcagcaaaagttagggggctcgtgggtgatacacttcaactggttgtgcaaaactctgcaacattagttgctggcctggtaattgctttcgtatcaaactgggagctatctcttatcattttggcgttgataccactcatcggcctaaatggatggatccagatgaaatttatccaaggattcaatgccgatgcaaagatgatgtaccaggaggcaagtcaagtggcaaatgatgcagtaagttgcataaggacagtggccttattttttgttgaagagaaagtgattgatttgtacaacaaaaagtgcgaaagacccgttcaaacaggaattaggacagggattataagtggttttggttttggagttttcttttttt

SEQ ID NO: 5993 - DNA, 311 bp, Triticum aestivum
  Clone ID: LIB3281-034-P1-K1-B12
cgacgcgcgaagcgatatcacgagtgagagtctaggggccatggcacagtcgatgctcatgtccggcgtcaacggcgtggcctccggcaggagcctgctgcaggcggcgcggccgtcgtcggcgtccacgcccttctcgcggctcgcgctctcctcgtcgtcctcggcggcgtactacaagcacatgccgtccctctccgtccggaccatggccctgttcggcaagaagaccaaggccgcgccggccaagaaggtcgctgcccccaagcccaagacggaggacggcatctttggcacgttcgggggggatc

SEQ ID NO: 5994 - DNA, 305 bp, Triticum aestivum
  Clone ID: LIB3281-034-P1-K1-B2
cggacgcgtgggcggacgcgtgggaaaaaagagagagagagaagaggagaaagtctgcagaaatcgcgatcggaggcacagctcgagggatttgatttttatttgcctgggtttgggggaaggctagggaagttcatcacaagataggattttggaattttatggactttgattgcaataaggcaggagagtcttcagccaagcattgttctagcatttgcaacgagggcacactcattcaggcaaacaccttaattcattgtggaaaggctaaaaagtggaatagccttaacaaattcaacaac

SEQ ID NO: 5995 - DNA, 420 bp, Triticum aestivum
  Clone ID: LIB3281-034-P1-K1-B3
gtttttatctctgtatctgtgatacttggtgatggtatctataacctcatcaagatcatttatgctactatcaaggaaataatgaatgcacgatcaaagcaaggaaggcttccccttgtccgggctcaagatgatgatgaaagttctgaattatcttccgaagagaagcttctgaatgatgtatttgtaaaggacagtatccctccctggttagcaggatctggttatgtggggcttgcagcaatttcaactgcaactgtaccaatgatgttcccacagctcaagaggtaccttagcctttctgcctatgttggtggacccctactcgccttttgcaacttatacggcactggccttacagactggaaccttgcattcacatacggtaaagatggtcctttcatttttgccttatgggtt

SEQ ID NO: 5996 - DNA, 245 bp, Triticum aestivum
  Clone ID: LIB3281-034-P1-K1-B4
gacccgctcaagcgcgacttctactttgaacagtgtcgcctggagcgctggttgtcgcggcagttgcgggagtggggctcgccgttggtgccgtcgttatgtcaagcagtacgaaaccacctatgttgcacgtcgtctccagcgcggcccgactctgcacatggggactggcaattgcgatcggattgcctgtttggcggtggattctgggcgctcatcaggcgcggaaacgacctggtctgtgt

SEQ ID NO: 5997 - DNA, 425 bp, Triticum aestivum
  Clone ID: LIB3281-034-P1-K1-B6
cggacgcgtgggatgttttttcttttgcaatgctagacatttgtgctggccaaccatgaatatctgaacaatattttgattcagaaccaactcggcggcaaggacttcccttatgatataatctcctcccagatgtttttcataccagtacctctagaggatggatgggtcgtactgatgtgggacatgatgtcaaggaagccgcacattctggacctgatgatcagaggcgatggtccaactgaaccaacaaaggataagctcgaattgatagcttggaagctacatcatgcactattccattgtctgaacgagtactatgctggctggctggcctacgcaagacggagagtgggaggctcactacgcacttgttgcaatggaacatttgttagggacgaaacagggggatgtgttcttcacat

SEQ ID NO: 5998 - DNA, 187 bp, Triticum aestivum
  Clone ID: LIB3281-034-P1-K1-B7
ccttaatatgatgccggccaaaccaacttattttgtaacagaagaagtctggaaaaactggcgatggtaggaccgtctaaaggtcacctgtttagactgactggctctttcgcaacctaagcacacacaagtgttccttctggtccccttgtgcgccgaagatgacctggagtcgttttgcaactaa

SEQ ID NO: 5999 - DNA, 273 bp, Triticum aestivum
  Clone ID: LIB3281-034-P1-K1-B8
cccacgcgttcgtccactttttcgaccacgtgtccgttcccgtgggggctgcgcgtcggctggtggtcctccgcgttgcaaactctcgtccaaatttgccggattctgtgtcccaggaaccaaggttgatcgttggttaagagctcgtttaagcttgagcacccgttcgagaggaggcaggtctaggtcttacctcataatggtgatggtcttttgacaggtattttcttggtatttgttgcgaaaggctcggtttaagaggtgtttttttcc

SEQ ID NO: 6000 - DNA, 132 bp, Triticum aestivum
  Clone ID: LIB3281-034-P1-K1-C10
gctagcgccatttcgccgccggcgatggctgcttgactgacgcgccttctagaaagcaccacacttctgtgagtggtggcatctctgttatccgtcgtccgcccgtgggatcctgatcgtgttcagccatgt

SEQ ID NO: 6001 - DNA, 107 bp, Triticum aestivum
  Clone ID: LIB3281-034-P1-K1-C11
cccacgcgtccgcccactcgttcgcccacgcgttctcagactcgtggggcgagcgatacacctacagggagctctatatagtcaccatcatcacctaactccactca

SEQ ID NO: 6002 - DNA, 404 bp, Triticum aestivum
  Clone ID: LIB3281-034-P1-K1-C12
tcgcgcaagaggggaggccatggaggagactagggagaccagccggtccagggagagcaggcggatccccatgtctaccaagaggagacctacgcggatcgtgaggattggaacagatctgtcccagacgagcatgttttacctcccactcgcaatctgccccgtatgctgatgaggctgctacctcaaagattctttactactttctctagaggtactgctcatgagcgcgctgagtatccaccttatcgcaggtctactgctgccaaagcaatgactgggtttttggcacattatgccaataatctctcccatttttctcatggggcagaattctttacaatcagtagtagtgatgaagacgatgagttttatatctttaccaatgatgagtcttctctgga

SEQ ID NO: 6003 - DNA, 150 bp, Triticum aestivum
  Clone ID: LIB3281-034-P1-K1-C6
cgccgccgctcgagcccctctcgcccttcgcgccgtcgctgctgcaggcaaccgccggcgtcttttccggaggtgagcccctctcctgacgccatggtgcgtatgcacagcctcgggaagggtatttcgttgtctgtgctgtcgttcaag

SEQ ID NO: 6004 - DNA, 108 bp, Triticum aestivum
  Clone ID: LIB3281-034-P1-K1-C7
cggacgcgtggggcggagaacacttttatcgatgccctcatgggaggagggggagctgtagtttctaagactgcttcatttcccattgagtgtatttagttgttttat

SEQ ID NO: 6005 - DNA, 231 bp, Triticum aestivum
  Clone ID: LIB3281-034-P1-K1-C9
gagctcttcgtgggtgatgctgggctttttggagttctttgctcatgtcatcagctgaggatgtctgtagctaagttttgtgagcatgcaagagggcctgcagaaaaagctggtgtaattgtcctcatggagaatggcatgagtattgcacattggttcaaatactgcgtaggggttggatcatatgttactgacagtaattgtgaccggccagaatgggcgtgtttagat

SEQ ID NO: 6006 - DNA, 350 bp, Triticum aestivum
  Clone ID: LIB3281-034-P1-K1-D10
gtccggtgggcccgtgatccccttccacccagggagggaggacaagcctcagcccccacctgagggtcgcctccctgatgctaccaagggttctgaccacctaaggcaagtcttcggcaagcagatgggcttgagtgatcaggatattgttgccctctctggtggccacaccctgggaaggtgccacaaggagaggtctggctttgagggaccctggacaaggaaccctttgaagtttgaccactcttactttacggagcttctgagtggtgacaatataggggcttttttacttttcaagtgacaaaaccctgctgtctgacccttgtttcattcctcttttggagaaa

SEQ ID NO: 6007 - DNA, 425 bp, Triticum aestivum
  Clone ID: LIB3281-034-P1-K1-D11
caaggaagcattatcaacacattttatgaagtgtgggacagtgcttaagctcaatatgttgacagatgcaattactggccacccaaaaggggctgcatttgttacttttgctgacaaggaatctattgggagggccctatctttgagtgggacgtcgttttactctagagttctcacagtaatgcggaaagcagaagcacctcctggttttttggcgtctattcagcagattgggaggccgctgccatggaactcgccaccattccagaaaggggttagtccaaagcagtcctctggtcatcatcttcagtggaaacgcgagcagtctgccatggaaaattcccctgccaattgccctaccgactgaatctaaggcagcgcctaagaatcaaaacctcaccaatggacatagctttactggatca

SEQ ID NO: 6008 - DNA, 394 bp, Triticum aestivum
  Clone ID: LIB3281-034-P1-K1-D12
cggacgcgtgggcgcccgcccgcccccgccgccgtcgccgcctccttccggaggagctccctcctcgcaggcgagatggtgtacatcaagaaccagaagacaagggcgtactccaagcgtttccaagtcaagttcaagagaaggcgccagggcaagactgactacagggccaggctgaggctcacaaaccaggacaagaacaagtacaacactcctaagtaccgttttgttgtgcgatttaccaacaaggatgtcactgcacaaattgtttatgctaccattgctggtgatattgtgatggccgctgcctactcccatgagttgcctcgctatggtcttgaagttggcctcatcaactatgctgcagcttactgcactggtctgcttttggctc

SEQ ID NO: 6009 - DNA, 140 bp, Triticum aestivum
  Clone ID: LIB3281-034-P1-K1-D2
ctccacgcgttcgcccaaccaagacccgtggtcttggagctggtaaggctggggttcgggccttctcttactgtcctctctcccttcatttccttctgtggctcacatcggtcaagatctcggtggttaagtcctcctgt

SEQ ID NO: 6010 - DNA, 93 bp, Triticum aestivum
  Clone ID: LIB3281-034-P1-K1-E10
actggagctgcaacaaccaacctttacgaaagagagtgacctttcaatggatgtgaacttcactcttctttaatctcctttttctctaatatt

SEQ ID NO: 6011 - DNA, 266 bp, Triticum aestivum
  Clone ID: LIB3281-034-P1-K1-E11
cccacgcgtccgcccgatccaaatcctccagccgcagccgcctcctcctcggtcccctgctcatgctcgagctctctgcctcgatccaccaggcgcccagctcgcacaggagaggagctcctcgatccctttgaccccggccttcttttgaaccccacgccatggatggctgagcccctcgccgagcttctcaaggcgcgccgccaccactcgtctttctggtaccgccgcacctgcagttcgtcgcctcggtcagggccttgtcc

SEQ ID NO: 6012 - DNA, 408 bp, Triticum aestivum
  Clone ID: LIB3281-034-P1-K1-E12
cgcctccgcacttccttccggcgcctcgctttccatttcacaaccgcggatcccctcggagtactgtagacatggccggaaggggcaaggcgattggttcgggcgccgccaagaaggccatctccaggagctccaaggccgggctccagttccccgtcggcaggatcgcgcggttcctcaaggccggcaagtacgccgagagggtcggcgccggcgcccccgtctacctcgccgccgtgctggagtatctcgccgctgaggttctggagttggccgggaactcggcgagggacaacaagaagacccgcatcgtgccgtgccacattcagcttggcgtccgcaacgacgaggagctctcccgcctgctcggcatggtcacaatcgccagcggcggtgtcatgcccaaca

SEQ ID NO: 6013 - DNA, 103 bp, Triticum aestivum
  unsure (1)...(103): unsure at all n locations
  Clone ID: LIB3281-034-P1-K1-E4
cggacgcgtgggttcgcaatggacaaagattttggacatccttgactattatttgagggagaaaggcctgaaggggggccntatttttcgttattttaatttt

SEQ ID NO: 6014 - DNA, 62 bp, Triticum aestivum
  Clone ID: LIB3281-034-P1-K1-F10
tcaagcgtacgcaggaggatggcagagcttgtagtttctatagtgacacctaacaagatggg

SEQ ID NO: 6015 - DNA, 223 bp, Triticum aestivum
  Clone ID: LIB3281-034-P1-K1-F11
ttccactcattcaatctttttttattctatcactgtcatctaaataatttaaagagattcatttattagaaggatttcctttttttaattttttattcttttacaatttcacacaacatactaactttaatcataatttgtaaatcctttcgttcctaataacttagctaactcatattaatttccattcactcactatctcattttacattctacaaaacct

SEQ ID NO: 6016 - DNA, 99 bp, Triticum aestivum
  Clone ID: LIB3281-034-P1-K1-F12
cgtcggaacttaattagcagctagcccaggtgcaacataaggcccagactcatttcccgcagtcggccacaaccacggttgatctggtgcggcggtaca

SEQ ID NO: 6017 - DNA, 393 bp, Triticum aestivum
  Clone ID: LIB3281-034-P1-K1-F2
cccacgcgtccgcccacgcgtccgcccacgcgtccgatccacacgcctttcctacccgtcaaactccaggccagctgcttgaagctgctttgggaaagggaatcgctcttggtggtaaaatcagatatgcaacaccattcaccacagcaacagttgaagtgatctcggaacagttgcacaagcttgggttttcaagaggcggagctgaaagcgttctcaacggccaaaccggcaaaaggatgcagcaactgatctttgcaggccccaacttttaccataggctgatccacatggccgaggacaaggtggagttccggaacacggagtcagtgcacccgctcacgaggtagtccgttttttcagggagaggttcggtgggtcaattctgggaga

SEQ ID NO: 6018 - DNA, 118 bp, Triticum aestivum
  Clone ID: LIB3281-034-P1-K1-F3
tcgcccacgcgtccgcggacgcgtgggttcgcgccgccgctgctgcaggcaaccgccgccgccgtcgtcggagctaaacccctcgcctgacgccatggggcgtatgcacagccgcggg

SEQ ID NO: 6019 - DNA, 391 bp, Triticum aestivum
  Clone ID: LIB3281-034-P1-K1-F7
gaaaggtggaattttggcacatttgaaaccaattgctgacgagaatgacttgcacagctgcctagcctcgtattttgggccggaagttagtcgcatcaagaatgcaattgacggcaaatgcaagagtattcttgaggaccttttaagctttgttgagtcacacaattcagtacagagattgaaggagttggtgccattcatccaggagaaatgctataagaccatcttgggagtactggacaaattagaagccgtacttggaaacctttctgatgcattgggaacgaaaaagggggatgacaacctgcctgctgcatctggtattgtggagcggtctctttttattggccctcttttgtttggattgagatatttatttagttatgttccc

SEQ ID NO: 6020 - DNA, 387 bp, Triticum aestivum
  Clone ID: LIB3281-034-P1-K1-F8
gtcgaggagatggagaaatttgcagtgggtacgaacggtatgctgaatgagatgaggcagcgggttgaagatatggtgctggagaccactcggcagaggcagcgcgctgctgaaaatgagcaggagcttagtcgtgtgaagaacgactttgagtcgctcagaacttatgtcagcacactcgttagtgtcagagaaactcttctttcatcggagaagcaattcgagacaatggagaagctttttgacaggctagtcgcaaggaccaaccagctcgagactgagaaggcacagaaagaagctgaagtccagaaagtgatggaggaaaatgtgaggctacgtgccatggtcgacaagaaggatgcacagctccaggcgatgagtgagcag

SEQ ID NO: 6021 - DNA, 205 bp, Triticum aestivum
  Clone ID: LIB3281-034-P1-K1-G11
gccttcccctctttcacatggcctttccgccgccggagccggcccaagcaaaccctccgccgcggaggggaaggaggaggacgcggaggcgctcggcgtgacgccacagctcctcgacttcctccggacgctctcccccgacgccttcaagtcgtccgccctccagctccaccaaggggcctccgcggaggcggcgggagagctt

SEQ ID NO: 6022 - DNA, 159 bp, Triticum aestivum
  Clone ID: LIB3281-034-P1-K1-G12
tcgcccgacgcctacttcttcggcgtacaagcccttaccggcggcgccggagacgagttcaccgccatacaaggccccgacgcctactctcttggagtacaaggcccccaccccgaggcccccgccttcggcgtgccaccactaagaagatgcaccact

SEQ ID NO: 6023 - DNA, 369 bp, Triticum aestivum
  Clone ID: LIB3281-034-P1-K1-G2
cccacgcgtccgctagttctagaacgctcccggcctctctctgtttgctctcgcgtccgccgcgcccatcctcgtccgcgcctgcgccccgaccgtgctcgccgcctcccgcccgatccaccggtccaccaccgcgccggcggcatggcggatcagctcaccgacgaccagatcgccgagttcaaggaggccttcagcctcttcgacaaggacggagatggttgcatcaccaccaaggagctgggaacagtcatgcgttcgctggggcagaacccaacggaggctgagctccaggacatgatcaatgaagtcgacgctgatggcaatggcaccattgactttccagagttcctcaacctgatggcccgc

SEQ ID NO: 6024 - DNA, 328 bp, Triticum aestivum
  Clone ID: LIB3281-034-P1-K1-G3
cggacgcgtgggcggacgcgtgggaatggccacgcggccacccgtcttttgcactctcacagcgtccttcttcccttccccacctcatctgctacgccgtcttcaaaccctaacccgcgcgcttgcgtcctcctccccgcagcccatggcgtcgtcttctcctctgaagaaggtgctggtgcccatcgcgaacgggacggagccgatggaggccgtaatcaccatctacgtgctgcgccgcgcgggggcggacgttgtcttctccttctgtgagcctggggccgcgcaggtcgtctcattctggggcgttaagcttgccgccgacacg

SEQ ID NO: 6025 - DNA, 412 bp, Triticum aestivum
  Clone ID: LIB3281-034-P1-K1-G9
cccacgcgtccgcggacgcgtggggcaacctccaacgtgccgccccgttcgtcccggcggcgcggcgggcctagaggctggaacacgcgcctcacaatctcctcagtaccaccagcagggtatcagcagccagcaatcaactccgccctcaccaggatgctcctcaccgtctctgcgctaccgctcccagccgcgacagcgactccgcgcgtacgcgtactccctgggctcaagccctcctcccgcctcgtcgcccgccgaagcgcaggggaaactgtacacgcaacggccacagaagaggaggagcaggaggggaaggagctccaggaggaggggctcccgaggcgggggcagcacgcggaggatgaccacgaccacgagcacgaccccgagatcgcggacattatggggg

SEQ ID NO: 6026 - DNA, 300 bp, Triticum aestivum
  Clone ID: LIB3281-034-P1-K1-H3
ccgtcggatcgatcgccgtcgccgtcatgtcgtcgtcggcgccgctcccgctggagagctacttctgccaccagagcgaccgcgccgtcggcatcggcgagccggtctcccgcgatacgagctattctgagagatgagacccggcgcgttcttgatcccgcccccgaggctccccaaggccgaggcagtgcaaagagaggagggctgttggaccccgctgaggttccccaacttcagtgggccgaccccattttcagctcgccgcgtgtgtaccgttagaagcaatggcgtgccgtgtgc

SEQ ID NO: 6027 - DNA, 235 bp, Triticum aestivum
  Clone ID: LIB3281-034-P1-K1-H4
cggacgcgtgggcagccagccagcgcgatccctagcgtcgaggcccattcccccccgcccgcccattccacgatccctcggccgcggtcgggtcgccatgggaatggggccgctcgagaacgccgcggccgtcgaggtgccggtggtgaccgcggcggcggcgggaggggggtcgtacgcgctgctgcagtgcggggaggactcggcgttcgtgcgggacgcgtacaggggctac

SEQ ID NO: 6028 - DNA, 197 bp, Triticum aestivum
  Clone ID: LIB3281-034-P1-K1-H6
gaaacgcatgtgcgagtgcgagtacttgccggtgaccattttattgtggctcctgacttcgtagtcgtgtgctcaggaattttggtgcacatgtggcagaaacaagtgggcatacataattattctgtagtgaaacgctttggctatgggttgtatcatttcattcttattattggagaaaatggtgttggctgcct

SEQ ID NO: 6029 - DNA, 351 bp, Triticum aestivum
  Clone ID: LIB3281-034-P1-K1-H7
ccgctcctcgacctccatccgctcgcagctcgaaccaaggagagatctgtcagccatgtctgggcgcggcaagggaggcaaggggcttggcaagggcggcgccaagcgccaccggaaggtgctgcgcgacaacatccagggcatcaccaagccggccatccgccgtctggctcgccgtggaggcgtgaagcgcatctcggggctcatctacgaggagacccgcggcgtgctcaagatcttcctcgagaacgtcattcgcgacgccgtcacctacaccgagcacgcccgccggaagaccgtcaccggcatggacgtcgtctacgccctcaagcgccagggacgcacccttta

SEQ ID NO: 6030 - DNA, 335 bp, Triticum aestivum
  Clone ID: LIB3281-034-P1-K1-H8
gctacgctcacgcgtgcggctaggcgtgcgtgtgaatcaatcaaactaaaaaaaaagaagcagttggcggactgactggagatgagcggagccttcttatagcttaccgggccgtcccgtcgctcggtgatccggccggagcgcacagagaggggacaaggcctgtgctttttttggaacagtatacagttgagagctgacactgaagtagccatactgataatgtgaccccaagccggggctcttgatgttttcgagatcttcccagggcaagcacatggtttacagaaatgtgacaagcagtttggaggtgctttgcctgcgatgcgaatgcg

SEQ ID NO: 6031 - DNA, 355 bp, Triticum aestivum
  Clone ID: LIB3281-034-P1-K1-H9
atcaaatcgagcctgcccttctcgctcgcgtctccactccatttccctttcccccgaggaggccgccgccgtgacctgagagcacacgcacgcaccatgtggcgccgccttcaaaccctagcccccgcccttcgccgcgctgtcgtcgtagacggcgcggccccctccccggccagcgcccgggccgctccccttttcacggtggtggcggcctttcgccgcactgggctccttctctttgtggacaaagcccgtggcgtcagggaccagtgtggaggacgtcatgcccattgtctccaggttggagcgctaggagcttttatgtggttttttacctggagaagcgcttttacaa

SEQ ID NO: 6032 - DNA, 337 bp, Triticum aestivum
  Clone ID: LIB3281-035-P1-K1-A10
gtcctgtgagacgcttccttctcatacacatctgaagcaacgtttgatcatccgcattagagagttttgcaggtccttgagagaacgttatccagtcagttatgacttgaccatggtctgaggtgaaattggtcctggtccataaaacgaaaggtgctgggcaagcgcaaagaagtcgtctgaaggggagttccataggaatgttcaacttcgatcaaccttggtttggtcccatgcctaaaaaagaaataaggtcaaaaacaaaataggggtgatataacccactgctcgcctaagaatgtactgacgtaatccctactatggctttccggaagat

SEQ ID NO: 6033 - DNA, 96 bp, Triticum aestivum
  Clone ID: LIB3281-035-P1-K1-A11
cggacgcgtggggtcctttctttgatagtgaatatccagaatatcaactagaagaatgtatgggacaagagccgagatgagtggaataaaaatctg

SEQ ID NO: 6034 - DNA, 373 bp, Triticum aestivum
  Clone ID: LIB3281-035-P1-K1-A12
cttccctccctccttcggttcctcggcctcccgatcgagcagtagaagcagcgcaagggcaccgctagcactaaaggaatggcggccgagacgttcctcttcacgtccgagtctgtgaatgagggccatcccgacaagctctgtgaccaggtctccgacgccgtcttggatgcctgcttggcgcatgatgccgacagcaaggttgcctgcgagactgtcaccaagaccaacatggtcatggtcttgggcgagatcaccactaaggccaccgtcgactacgagaagatcgtgcgcgacacctgccgcaacatcggcttcatctgtgatgatgttggtctcgacgccgaccgttgcaaggtgctcgtcaacatcg

SEQ ID NO: 6035 - DNA, 367 bp, Triticum aestivum
  Clone ID: LIB3281-035-P1-K1-A3
acgcccacgcgtgcgcggacgcgtgggagctgcatcaatgaacaatgatggggagaggtttgttcctgagaatgatttgggcgacaatacatggatcgataatgaagtgtgcagttctaacctcatgaatgaggatcacaagcccattgtatcaaaatcaaataatcaggtacctgacgtttgcccagatctacggtctccaattcagggtgagtgaattcttagtgatgatctatgaaataccaaatagaatatgaaggttcacttgcacgcttataatatttgtttaaaactaaaggttaagccagatatgggcaaaccatcatccgggcttacttccttaagtggagaattgcaaacattggat

SEQ ID NO: 6036 - DNA, 435 bp, Triticum aestivum
  Clone ID: LIB3281-035-P1-K1-A4
gccaaaccaagatggtatgtgtggttcacttcgatggtgcttcaaaaggaaacccaggaaaatcaggtgctggagctgtacttatgactgaagacgggagagtgatatctcgacttcgtgagggtcttggtgttgttaccaataatgttgccgagtaccggggccttatcttaggactgaaatatgccatcaggcttggattcaagagaatcaaagtatatggtgactctcaactagtctgttatcaggtgaaaggtacatggcaagcaaagaaagagaatatgatggaactgtgcaaagaagtgagaaaacttcaagagaacttcatctcttttgaggtccaccatgtgcgacgggaatggaactctgaggcggatcgccaggcaaacatagccatcaccctcgcaagggcgcggtttctgaagagcgtggcga

SEQ ID NO: 6037 - DNA, 104 bp, Triticum aestivum
  unsure (1)...(104): unsure at all n locations
  Clone ID: LIB3281-035-P1-K1-A5
cggacgcgtggggcagccgccgccagcagctgcgcanaggctccacaaaccctaaccctagctccaagcttagcttccatcttctcgatctagctagagccatg

SEQ ID NO: 6038 - DNA, 397 bp, Triticum aestivum
  Clone ID: LIB3281-035-P1-K1-A6
tcgcggacacgtgggcagcagccaagcaatccccacacacatatctccactccccgattactttttgcagctcgtcatggacgcctcatccaccgtaaacaaccccaaggagaaaaaagaagccgccggtcgcaagaacggaagccgcactaagaagaacttgtcgcggcccttcaagaacggcgctctactcagcgtcagccgcataaggcgctctctcaagaagggacgctactcacagcgcgtagggtcctgcgccacattctacttaatggccgtgctcgataacataatatccgagctgctggagctcgccggcaacgccggcaaggacaacaagaagagccgcatcatcctccgccacctgctgctcgtcatcatgaacgacgaggagctt

SEQ ID NO: 6039 - DNA, 164 bp, Triticum aestivum
  Clone ID: LIB3281-035-P1-K1-A9
ggagccgatagtggtgcggaagaaggcgcagaacgccgccgacaagaaggacaaaaaggccgtcaacgctgcccgccgctccggcgccgagatcgacaccaccaagaagtacaacgctggaacgaacaaggctgcatctagcggaacttccctcaacaccaagc

SEQ ID NO: 6040 - DNA, 361 bp, Triticum aestivum
  Clone ID: LIB3281-035-P1-K1-B1
cctcgccgcgccgccgcgcagccgcgagtgcagcgaacatcggcgccagtgccacgcttatgggcgccacctgccattccctgctctctccggcgcccacctcgcccccccgagcccgccttcccttccccgacgttcgagccgtcgccccccgccgtagctcctttttcccggacgacgaggcggcggacctcttgatggagttctcggatgccgacgagaaaaaggagaccaagctgtggggcggacgcttcaaagaaggcgtcaccgactccgtggaacgcttcacggaatcaatctcctacgactggcaactgtacaagtacgatattatgggcagcaaggcccacgcgtacatgct

SEQ ID NO: 6041 - DNA, 110 bp, Triticum aestivum
  Clone ID: LIB3281-035-P1-K1-B12
aacttattcgtctcgaaatctgcaccagatcgagcgaaacaaccccagcccagccgggggcgtttgtgttgcccgggtggggccaatccgagatccgttttttttttaaa

SEQ ID NO: 6042 - DNA, 255 bp, Triticum aestivum
  Clone ID: LIB3281-035-P1-K1-B2
accggtcccatcccacgccttccccagcctccctccacgctccctcgcgcgcaggggctccgggcgcgaggacgcatgcgcgcaaccgacttgactcacccacccacccaccccgaccgcgcgttggagctccccgcggaactcgcaaccatgctgtccgcgcgcaccgtcgtcgccgcgtcccccgacggctacctgtggaagcgcggaggtggcgcgggggcccccggggacagatacactatctggctggag

SEQ ID NO: 6043 - DNA, 389 bp, Triticum aestivum
  Clone ID: LIB3281-035-P1-K1-B3
tcgggaactgggatagttgctgctatgaggattcagcatgcattccggaactacaacagaaaaaaaagagatgagagctgctgcacgaatacaaaatcatttccgcacgtggaaggtcagaaggaactttaagaacatgcgaagacaggctatcagaatacaagctgcataccgaggccatcaagtgagacgtcagtaccgcaaggtaatatggtctgttggagtcgtggacaaagcttttgcgatggagaaagaagagaaaaggcttgcgcggcattgcaaatggaatgccagtagaaatgacagtggatgtagaagctgcaagcactgcacaaaaaggtttcttacaggccagccggtaacaagcggaggacaggtttaatagatca

SEQ ID NO: 6044 - DNA, 378 bp, Triticum aestivum
  Clone ID: LIB3281-035-P1-K1-B4
gtgccatggcacaccgcattggcttgtccagatggataacctggtggcggcaccgacatgtgtcatttgtacatgaaggtcgtgagatccagttctttggccctacctgtatgatagaactgctctggtaaaagagaaggtggttcgtcggggcaggccttggtaaatgttgtacactcctactggttgttgcgttcagttgtttcgattgtattatcaatatagatttcctgtaatatatgcttgcgacacaaagataattcaaacggatgtatctatttgctgaccaccttcgggctggtcattttgtgaacaggggcaagagactgtattgtgacctcaacagggtttcatattaaaaggatgatgatatgtgtt

SEQ ID NO: 6045 - DNA, 112 bp, Triticum aestivum
  Clone ID: LIB3281-035-P1-K1-B5
cggacgcgtgggcaaaagtgaaaaaccacatcctccctcctttggagacgccgcccgggccgaccaatggctcccaagatgttcttcgtccggcggaaactggaaatgcaac

SEQ ID NO: 6046 - DNA, 72 bp, Triticum aestivum
  Clone ID: LIB3281-035-P1-K1-B6
cactcactcaccagcgacaccccttattccagcggcatatggcctcctccacgatgcgcgcgccacatcgct

SEQ ID NO: 6047 - DNA, 301 bp, Triticum aestivum
  Clone ID: LIB3281-035-P1-K1-B7
cggacgcgtgggcggacgcgtgggcggacgcgtgggcggacgcgtgggtccggaagcgtcgccgcctcctctactgtattcctccccgccgccaatgccaaccccgctgaagcgcccctccttcggccggctgctcgccgccctccggtcgccgccccgggtcccggtccaaaccggcttcccaaccgcccttgccgacctcgtcgtcaagaaccatgcccgcttaaggaagcccggaaggccgggccgcccaacaacggccttggggttgcttaagcttccgggggaaacacggggggcc

SEQ ID NO: 6048 - DNA, 306 bp, Triticum aestivum
  Clone ID: LIB3281-035-P1-K1-B8
gcaagtttgggaagatcagcaaagccatcagattcccagagaccctgaacttatcttgctacatgaactcaactgatgacaattctcctgtttacagcctatatggaatggttgtccatcatgatgttatgaatgctgccttttctggtcattacgtatgttatgtcaaggacacacatgggaagtggtacaagatagatgacagtcaggtcaaacctgtatctctggaaaatgtaatgtcgaagtgtgcatacatgctgctctacgcaaggtgttcaccaagggcgccaaactctgtacgacatg

SEQ ID NO: 6049 - DNA, 235 bp, Triticum aestivum
  Clone ID: LIB3281-035-P1-K1-B9
gcggctgaggcgaagaggaatcgaccatggcgacccgtatccagtttgagaacaactgtgaagttggtgttttctacaaactcacaaatgcctactgtctggttgcaattggaggatcagagaatttctacagtacatttgtgtctgagcttgcagatgttattcctgtggtcaagacctatatcggtggcactagaataattggtcgcctctgcggtggaaacaagaatggact

SEQ ID NO: 6050 - DNA, 302 bp, Triticum aestivum
  Clone ID: LIB3281-035-P1-K1-C10
acgtggacgcgtgggcagacgcatgcagctactgtagggacgcacgcgctcccgtgctgtgttgtgtcctccgcgctggcgtagacgcgacgtgcgctcccgacggtgaacaggcgggcgcggatacaaagaggagggcgtgcgcacggcagggccaagctcaagctaaggttcgaggcagcggcattggcgccgaggatgaggagctaggaggtgctcggacggaggggaacggccagaccggctgttgcatgcaagcaggcccgcagtcatgtatttcgccaggctcgatgactcgccca

SEQ ID NO: 6051 - DNA, 274 bp, Triticum aestivum
  Clone ID: LIB3281-035-P1-K1-C11
cccacgcgtacgcggacgcgtgggcgtacgcttgggttggaccatcactcgtggcgtgttcttgcttctgccagggctgacactcaccctatcatttctgagggcgctacgttggggattcatactaatgtactgaccccaacaccacagctgcttggtcatgctccgatactattgatccgcatcgcctgcatgaatgtggagctaacatacattggatcggtggggaacgcttttaacggcagtcagattcaagcccccatcctgtgatgta

SEQ ID NO: 6052 - DNA, 270 bp, Triticum aestivum
  Clone ID: LIB3281-035-P1-K1-C12
cccacgcgtacgcccacgcgtacggtcacgtcaggctcggtggatcacggtagcactagcttcagctagccagcctctgccactccgggcattttcttgcatccacgacggcaatggccaccgctgatgtccagaacccgacggccgcgctgacggaggaggcgcccacggtggagacgcccgtcgccgccgaggaggtcgcgaagacggaagaagcccccgcgccggccgaggccgaggtcaaggcgcctgctgcccccgtcgaggtcg

SEQ ID NO: 6053 - DNA, 239 bp, Triticum aestivum
  Clone ID: LIB3281-035-P1-K1-C2
caggcgcgtacggggttcatgttccgcatgaacgctttggctatctttggcaacttggggagggaaaaagggaggtggctgcttatttggaaatcaacgacatatccaggcttagccaaagatccagcgcgcgctacgacctgcacaataccatcttattccaccgacgcccgctttaccaaatatatgatgaagaaaaagcattttatgacactcacatcacccctattggtgataca

SEQ ID NO: 6054 - DNA, 418 bp, Triticum aestivum
  Clone ID: LIB3281-035-P1-K1-C4
cccacgcgtccgctctgaggaacagcttgatttagtattagaagcctgcgaaaggatgaatgcgcatctgacagctgcagtagtttcaaacgacaaattgttcctgcaggaagtactcggtagatcggttaacgggacaacatatgctggaattcgagcaaggaccaccggcgctccgcagaaccactggtttggtcctgccggtgacccgagaggcgcggggatcggcactccagaagccatcaaactcgtctggtcttgccacagggagatcatatatgacattggtcccttgcccaagaagtgggcacttcctgcggctacatgatatgcctaggctaggacaactagctagaagaacacgacggcgatggagagaaagcaacacggacagaattagctggttgagaactgacat

SEQ ID NO: 6055 - DNA, 287 bp, Triticum aestivum
  Clone ID: LIB3281-035-P1-K1-C5
atacatgggcggggtgtgatgctccttcttctgcgggaggcacctccaccacggggtcctcgttgtctgctacgcggccgtcttctcaccttcctgcttgatggaggagcactcctgggtgattaagaactaactgatggggaaagaacggggcgaacaaggcttcctacaagttctggggggcctcgagcgtgcccaacaagggcggcagtaactgcttgtgactgagggcgccatgcacgcctccactgaggggagggctccgctctggtctgatctgaacccct

SEQ ID NO: 6056 - DNA, 308 bp, Triticum aestivum
  Clone ID: LIB3281-035-P1-K1-C7
gggcaaaaaccactttagacgcacaacgataaggctgtccttaaccattccgcgggtgataaaatgtacagatgtcgtactctatcaacgactgaagatgctggcaagaacaatagagtttgtgggcgagaacctttgctataatggccaagctattccttgatcacaaaacactctactacgatgatggatttggacgtgatctatgtcctgagagaacgcgatgatcggagacgccatatggtgggatattttttcaaggccaaactctctgacggagcctataagatggactgcattctcactct

SEQ ID NO: 6057 - DNA, 116 bp, Triticum aestivum
  Clone ID: LIB3281-035-P1-K1-C8
gcgcccacgcgtacggagagagggcacggaaacaacagacacccaaagcatgcgacgcaccgcacaaacacagctgcagctccgacaagatctgcggggaccctacgggatgagcc

SEQ ID NO: 6058 - DNA, 144 bp, Triticum aestivum
  Clone ID: LIB3281-035-P1-K1-D1
ataaaatcaacacaaatcgggcgggtttttattagagcgggcgctgcctgctcactgaaaccttacacgacggcttgcacccccaaatcctgaacctattccatactttagttcgcccccttcgcccccaaatccctagccttt

SEQ ID NO: 6059 - DNA, 411 bp, Triticum aestivum
  Clone ID: LIB3281-035-P1-K1-D10
gctccacccaccccagccggcctcaccgcgcgccaggcagccgctccaccgtgcgtgccaatggcgcccgtccgagcagccctcctcgccttcctcgtggccgcgctgctcccgctcgccctgtcccgcgggcaggggcgtggcccgcacctgccggggcacggcctggtgcatcgccacgggcctggcatcggtcaccacgcccacgcgccgctcggcggtggcgcctgggcctccgcgcacgccaccttctacggcggcggtgacgcctccggcaccatgggtggggcgtgcggctacgggaacctctacagcacggggtacggctccaacacggcggccctcagcacggcgctcttcaacaacggcctcaactgcggggcctgcttcgaggtgcggtgcgacccgggc

SEQ ID NO: 6060 - DNA, 377 bp, Triticum aestivum
  Clone ID: LIB3281-035-P1-K1-D11
cggacgcgtggggccggggctagagcggaagggcaaggtggtcacggagatcaaagacgcgattgagcgccacagcagcgcctatgtcttcacctacaacaacatgaggaaccagaagctcaaggacctcagggaccaactcaagtcctctagccggatattccttgctggaaagaaggtcatgcagatagcattggggcggtcacctgctgatgaagctaagacaggcctgcataaactctccaagttccttcaaggtgcttctggattgttatttacaaatctcccaagggatgatgtcgagagattattccgagaatttgaggcgaatgattttgcgaggacaggaagtattgcgactcaaacggttgagctaa

SEQ ID NO: 6061 - DNA, 300 bp, Triticum aestivum
  unsure (1)...(300): unsure at all n locations
  Clone ID: LIB3281-035-P1-K1-D12
cggacgcgtgggggcgagcttgtactcggcgcctactgcggcggcaagggcaaagcgatgcaatacccgccggttgttaaaaactcgggcgcccggccgccatacttcgngtactaatacctctgcctgaccggcataacggggggcgggaaaaagggtgtgcttcccgggcgggacttcttgcccctgttctgcggcggcgggggcggcgccattaattaatacgggccggactttatttacctaggtccgccggtgttcaagccggtggcggctgcaattgtggccacgggggggggc

SEQ ID NO: 6062 - DNA, 171 bp, Triticum aestivum
  Clone ID: LIB3281-035-P1-K1-D2
cccacgcgtccgagcattcctccgacccagcaccaccggcggcaacaccaccacacctggagaggcctcgtcggcggagaagcaggcaagcaagcaagattgcccggaggaaaggccgcgagaggaaaaaagcggtgaccctgttcgtgaaagccgggcttcagtttcccg

SEQ ID NO: 6063 - DNA, 402 bp, Triticum aestivum
  unsure (1)...(402): unsure at all n locations
  Clone ID: LIB3281-035-P1-K1-D3
agcttaacctgcaggaaggaatggagggcaattctatggctgataaaatgaanacattttctagaggaatggcactcatgacagtcccgttcacaatgaattttgccaagggaattttctgttactgggtcacgtcgaacttgttctccctcgtatatggtattgttattcgtcgacccgctgtgaggaagttgtttaatcttcctgcttgggaagctccgtctgcacctgcgctgaattcagccttgaatatgtttggtggatccaaggcagtaccttcagaaaagtcacctttagcactcacggcagcccagcaatcttctttggagaaacctgatgctgccgctcttgggtatcgggtaaaaaatcttgaaaaggaggggaaatctaaaagcaaatctc

SEQ ID NO: 6064 - DNA, 273 bp, Triticum aestivum
  Clone ID: LIB3281-035-P1-K1-D4
tgcatagaccggggtggcggatggaacatgaggagacacaactcggcgctcaggatcgagatgccgttgtcgcggcgcagggcgattttcactgtggacgctgatctggcgcgcgaccaaaggctgggacgtaaggggcaccacgatcggctgcgcgtctgaccagcctgcctaggacacgctgcggccgcggccgcggccgttctcgcggtactgatcgaccgcatgtgctgtgcggacgccggggacgtgacgatcgaacgctatgtacag

SEQ ID NO: 6065 - DNA, 283 bp, Triticum aestivum
  Clone ID: LIB3281-035-P1-K1-D5
catagaccggcgtggcctatgcaccatgaggagacacaactctacgctcaacatcgagatgtgcttgttccggcgcaggggggaatctcacttccgaccgtgatctgcgcgcagctacccacaggctgggacctttaagtggcacaatgatcgggctgggggtctaaacagcgctgcctagtacacgctcgcggccgacagccgcggccgttctcgccgtactgcacgaccgcaggttctgtgcggacgccggggaccaaaccatccaacgcttagtacagca

SEQ ID NO: 6066 - DNA, 285 bp, Triticum aestivum
  Clone ID: LIB3281-035-P1-K1-D6
aaatcccaaccaatctcgtcttcgatcgacttcaagctcggcgaatccccaccggggaaggggcaaatctttggggaaacactgacaggcaagaccatcacccttgagggtgagtcgtctgacaccatcgacaatgtcaaggccaagatccacgacaaggagggcattcctccggaccagcagcgtcttatattcgctggcaagcagctggaggatggccgtaccctcgctgactacaacatccagaaggagtccaccctccaccttgtcctgcgtctgcgtggt

SEQ ID NO: 6067 - DNA, 240 bp, Triticum aestivum
  Clone ID: LIB3281-035-P1-K1-D7
acgcccacgcgtacgcggacgcgtgggttctcccccaaatctcagcccccaacctagctggctctccatcgggcggcggctggctgctccctgaatccctcgccggcggctgcgcccccaaaaacctcgcctattccattctcttgaaggcccgcctccacctcaaattcctccgcatttgcctcctcttgaacaagggccgctactcacataccggtgaatacggcaacgaccgctacc

SEQ ID NO: 6068 - DNA, 216 bp, Triticum aestivum
  Clone ID: LIB3281-035-P1-K1-D8
tcgagacccctctttttttcctctccaaaccagaccaagcaagagcaaccatggctgcgattggcgtgggcagcaccctccccgacggccagatcgtgtggttcgacgagaacgaccagatgcagcaggtcttcatccactcgttggccgccggcaagaaggtcattctctttcgcgtgcggcgcgccttcacccacacctgctgcgatcagcatg

SEQ ID NO: 6069 - DNA, 166 bp, Triticum aestivum
  Clone ID: LIB3281-035-P1-K1-D9
ggacttggagatgatggtgctatctgcttggcaagaagtttgaagataatcaatgaatccttgaaatcacttgaccttggatttaatgagattagagatgatggagcatttgcattggcacaagcactcaaggccaatgaagatcttgcggtcacatcataaatgc

SEQ ID NO: 6070 - DNA, 349 bp, Triticum aestivum
  Clone ID: LIB3281-035-P1-K1-E10
cggacgcgtgggcggtggctggacggcaacgtggaccccaagaggtcccgggtcttcttcgtcacggcgtcgcccacgcacgccaccggccagctctggggcgacgaggcggagggcagcaactgccacggccagaccaagcccatcgccgacgcctcctactgggggagcaccagcagggcgatgctgcgggtcaccggcgaggtgctggccgcgtccgcgagggtgcccgtcggcgtggtaaacgtcacgcagatgtccgagtaccgccgggacgcgcacacgcaggtgtaccgggagcagtgggcgccgcccaccaaggagcagctcggcgaccccaagagctacg

SEQ ID NO: 6071 - DNA, 289 bp, Triticum aestivum
  unsure (1)...(289): unsure at all n locations
  Clone ID: LIB3281-035-P1-K1-E11
cggacgcgtgggcgccgatcgatcagggccagctcgctctctcgttggttggtggcatgcangagcccgggcggcggccgttcgccggcgccgtcgacctgcgccggcccaagggctacccggcgccgtcggcgaccccgcagccgcaagcggaggcgggggcgggggatgcgcacggtgacccctgcccgcggtgcgagtcgcgggacaccaagttctgctactacaacaactacaacacctnccagccgcgccactactgcaagtcctgccgccgctactggaccaa

SEQ ID NO: 6072 - DNA, 208 bp, Triticum aestivum
  Clone ID: LIB3281-035-P1-K1-E12
gtatgtactaccagtactgctgcctctggtatgagatccggtggtgagctagtcggccattgccgtctccttgctgagctcaattcttttttgccttgcttttgttacaattgtttcttctttgttgctcctactagtatattactaggaataaacctgtacaccatggggttgaaaaggggggggataaaggtaaatgactcgaggt

SEQ ID NO: 6073 - DNA, 453 bp, Triticum aestivum
  Clone ID: LIB3281-035-P1-K1-E2
cggacgcgtggggttccaccgcccgcagcaaccaaagccaagtttcgaagccgccggcggcgaggagcaggagaaggcgagaagccatggcccgtaccaagcagaccgcccgcaagttcaccggcggcaaggcgccccgcaagcagctcgccaccaaggcggcgaggaagtcggcgcccaccaccggcggggtgaagaagccccaccgttacaggccaggtaccgtggcgctccgtgagatccgaaagtaccagaagtccacggagctgctgatccgaaagctgccgttccagcgcctggtccgcgagatcgcgcaggacttcaagacggacctccgtttccagtcccacgccgtgctggccctccaggaggccgccgaggcgtacctggtgggtctgttcgaggacaccaacctgtgcgccatccacgccaagcgcgtcaccattatgccca

SEQ ID NO: 6074 - DNA, 386 bp, Triticum aestivum
  Clone ID: LIB3281-035-P1-K1-E4
cggacgcgtgggcgcacccgttggtctagaacttgctggaactcgaatgcacctgtcataagatcgatctcactgtttgaacggctcatggaatacaacgactcgctggtcgaacgctacattgaagaaatgtgaatgatgcacgctactgcccgggaacatcctgtgaaatttttgcatggaactgatctggtgtcaaagccgttgcctgggaacgacaacgaccttaaggggaactgaaagtaactaactgaattaggtgctcaaactgacatggaaagaagaaaactggagagtgagaggaataaaaatgatggtcaaacgactcctttaccatggtaggactggagcatgaaaaagccaatgatggtgtacggagttttgtt

SEQ ID NO: 6075 - DNA, 366 bp, Triticum aestivum
  Clone ID: LIB3281-035-P1-K1-E6
ctttgttatcagatatttgcatcagcacgtccgctgctccaacttatttgcctgcgcgttacgtcaagactgaagattctcatggaaacatcaaggagtttaatcttattgatgggggagtggctgccaataatccggccttagttgccattggagaagtacgcacgcagatattcaagcaagatccagatttcttcccaataaaacctatggactatggccgggttttggtcatttcacttggcacaggctcatcaaaattcgaagagaagtacgatgcacaaaaggctaaatcatggggggtgttggattggttatgtagcagcggatctacaccattagtagatattttcacacgggcaagtg

SEQ ID NO: 6076 - DNA, 317 bp, Triticum aestivum
  Clone ID: LIB3281-035-P1-K1-E8
aggtatcgcaacataggcatagcaaaagagcgagcaactagcaagcaaagatagaagtgatttcgagggtatggtcatcttgcctgaaatcccgcacggaagaagaacgagtccatgaagaatacaaacggatgtagacgaacgggtcctcacaaacgcgatgttaccggaaccaacccggaaagcaacaccggaaaggagcaaacaacatagtaaacaaccaacacatcaacatggcacgatgcgcaaacaagtatgatgcatgtccggtttaatgaagcatggcatggcaaagtgcacaaacaatcctacaaatt

SEQ ID NO: 6077 - DNA, 349 bp, Triticum aestivum
  Clone ID: LIB3281-035-P1-K1-E9
acgcggacgcgtgggcctcaccttctctttaaagccccccccccgatgccgatggcgacggtcgtgcgggtgcgctggcgacagattggccagccatggcggcggtgctgccacatccgatccaatccgagaggcccgcagcggacctcacggatgcacctcgagcttgttgctccacacgaacacgactcctctattttctcggctcagggtaccttatcgctacgccatcaagatccctcgcctgttttaactgcgatctacgcaggtcagatggggcactgacattgttgctaggtctccttcaaacactatggactgccagatccactggagaccccatttctgc

SEQ ID NO: 6078 - DNA, 154 bp, Triticum aestivum
  Clone ID: LIB3281-035-P1-K1-F1
gcgcgccaccccttcgaaactgggcttaatggccagatttctgtgaaatcacctcccccaccacaaaagcttcgggccggtaccggccccggaaagagaaatcataatctgtttttgtggcctactaagtggtggcagataatttgatcaccac

SEQ ID NO: 6079 - DNA, 65 bp, Triticum aestivum
  Clone ID: LIB3281-035-P1-K1-F10
cggacgcgtgggaagagacagagatcggggtcgggacagggatctagacagggatggggacaggg

SEQ ID NO: 6080 - DNA, 356 bp, Triticum aestivum
  Clone ID: LIB3281-035-P1-K1-F12
ctctctctttcctctccccctttctactgctccggactgtatatataatcgggggggtttatatatctccatggtgggcataggcctgggaaagaccataggcaagatttcagcaattaattttatagagcgagaggggggcatataagagcgtgggagggaagagatagatagagaaagaaaagtatgacatggagatgaaagaaatgagacaacaaccctcttagcctctccccggccctctcctacgccccctctcctccacttctatcccctaagtttcaagcaagagacgaagctagcccggagagactgagccaaaggggaagaagaaggagcactgccaatccaagaac

SEQ ID NO: 6081 - DNA, 383 bp, Triticum aestivum
  Clone ID: LIB3281-035-P1-K1-F2
ggcaacggcaacggggcggtggccaacggtaaggccaacgggaacggcacggccaacgggaacgccaacgccaacgccaacgggactctggtcccgtgctagccgtcgctagctggttcgtaggagcgtgctgtgcgtgcgcgcgtgtcctgggactgatggatggcccatatgccattggcgccgcggccggtgctgttgttgtgtactcctgcctgttgtacgtttcttcagtgttgttgtgtgtgcgtgtgcgtgggatggagctcgcggtccgagcatgtggcgggggcgatgggtcgcctgtacaacaagatcgtgaatcaagtgaactagtatggggtgctattgaaatatggaatcgatccggcttatgtttcctc

SEQ ID NO: 6082 - DNA, 56 bp, Triticum aestivum
  Clone ID: LIB3281-035-P1-K1-F3
ggcaacggcaacggggcggtggccaacggtaagggcaacaggaacgggacatacaa

SEQ ID NO: 6083 - DNA, 345 bp, Triticum aestivum
  Clone ID: LIB3281-035-P1-K1-F4
gcgctggccggcaacacgctcctcgcccggagactgagggcgttgctccggaagctcggctcggttgacctggcggggctctcgcaccagcagaagctggccttctggatcaacgtctacaattcctgcatgatgaatgcattcctggagcaagggatacctaccacgccccatgagctcgtggcaatgatgccaaaggcgacggtagatgtgggcgggcgcacgcacagcgccatgtccatcgagcacttcatcctgcgcctgccctacagcgtcaagcaccaggtgagccctgagggcgaaagaaccaaaggcggcgaccaggcggcgcgcgctggcgcgttc

SEQ ID NO: 6084 - DNA, 406 bp, Triticum aestivum
  Clone ID: LIB3281-035-P1-K1-F5
ctcccgccgccgccgcagccgccgcctgcctcgagccgccgtcgccatggagagaagacctgcgaggtgctatcggcagatcaagaacaagccgtaccccaagtcaaggtactgccgtggtgtgcctgaccctaagatcaggatctatgatgttggcatgaagaagaagggtgtcgatgagttctctcactgtgttcaccttgtctcatgggagaaggagaatgtgtccagtgaggctcttgatgctgcccgtattgcttgcaacaagtacatgaccaagcatgcatgaaaggatgccttccacctcaaggtcagggttcacccgttccatgtgctccgtatcaacaagatgctttcgtgctctcgtgcttataggctgcaaactggtatgaggggtgcttttggg

SEQ ID NO: 6085 - DNA, 52 bp, Triticum aestivum
  Clone ID: LIB3281-035-P1-K1-F6
ccctcccggtggggttttgttattggttcctgaaccttacctagctagggac

SEQ ID NO: 6086 - DNA, 342 bp, Triticum aestivum
  Clone ID: LIB3281-035-P1-K1-F7
tcgaaactgagcttgatggcaagaccccgccacttacaggctgcaccagcattatcgtttggcgcattctctggacgcgcggaacgagctcattacatgggatgacttgacttgctcaatgatgccatgtccttggataacatgtgggatgaaatcagccaggcagcataagcctgatccagtgacaaccgtaacctatatttagtgagctggaacgaccactttttttttctaaaggctgagcgtgatgcatattacatcatcaacacccttgcagaaaggttctacggaggatgcagaccggcctacattttgaaattagacgacaccaccatgatttac

SEQ ID NO: 6087 - DNA, 268 bp, Triticum aestivum
  Clone ID: LIB3281-035-P1-K1-F8
acctaatcccctccccggcactccccgcctgacagccgcggccatggcgtgcgccttctccgcctccaccgtgtccacggccgccgcgctcgtcgcgtccccgaagccagccggggtgccgcagtgcctgtcgtttccccgcgccgccgccaggccctcccgcctcgccgccgccggctcgaggacggccagggcccgcagcttcgtcgcccgcgccgcagccgagtacgacctgccgctggtggggaacaaggcgccggacttcgcg

SEQ ID NO: 6088 - DNA, 444 bp, Triticum aestivum
  Clone ID: LIB3281-035-P1-K1-F9
atcttatagtcgcttacaacaaaaaaccatggtggaaaaactcctggctaaactgtcgtgatgttctcactgagctttatgcatttgtcaacagtgcacctacgtcatgcatcctgcataagggagcaggacataatcaggcactgtaaaaggattctgaattattgtttgtcaaacgcggcagatgattctgcaactggaaagatggctagtcattatcatgcaccttaccaaggaatagtagatgggatggcatgtaaaatagacgcgttaaagtggttggtgctttttgatgatgcaggggctaaagcaaccggttgattggtaaacgttctaaatcaccgggtggatgttgtacttgcggatacatggtttcttagctttgaaatatgctacttgaagagatttgcacaaggctgcgtgtgctgctctattaaaagatga

SEQ ID NO: 6089 - DNA, 258 bp, Triticum aestivum
  unsure (1)...(258): unsure at all n locations
  Clone ID: LIB3281-035-P1-K1-G1
cggacgcgtgggattataccattttcttcttgaaacaaatcaacggggcattgggtgaacttgttactacagagatttccgtattcagtctatcccattactcatttgcttcataagttcctaccatattgtttatgtcgattcattctactcatattcataattcatgcgccgctgtcgccgccactttgaggccttagccaccaagcggcatccttccccggggggcttaattcantacatgctttttttgaattt

SEQ ID NO: 6090 - DNA, 209 bp, Triticum aestivum
  Clone ID: LIB3281-035-P1-K1-G11
cggacgcgtgggcattaagtccaacgggattcaatggtatccaaagcattatcgatggtgtccactggcatgtgggggcacgtcaagtgcatcatcatttccacgcataccatgttctgcatgcgggtggcgaaaaagagggagacgtcggaggtggatccgacagcaccccaagttatgtcgcaaaagtttgggccgtgcgccaccaa

SEQ ID NO: 6091 - DNA, 391 bp, Triticum aestivum
  Clone ID: LIB3281-035-P1-K1-G2
ggggcgcgttgaccgacctgtgtttgctgacatagccgcacatacttcagcttcgttggctggcgaaacatatgcaggaccctctgtatctgtgtctgactggtaccgaattgataatagacgaacctctactgtcgtgtaatattgtgtgctcggaagggtatctaccgctgttcatctatgcgtaacgttgtcgcacgatcgagctgtgacctagggttctgatctgctattggatagcagactgccgcgagccgataacataatatgtgactagctagccatatacagtatttgcttaatgtgtcgatgtgaagaataaaacttgcttaccggtctgctcactaatctgcataagtatttaattagtttttgggctaaaatgtaatta

SEQ ID NO: 6092 - DNA, 412 bp, Triticum aestivum
  unsure (1)...(412): unsure at all n locations
  Clone ID: LIB3281-035-P1-K1-G3
cggacgcgtgggcgtaaacgcgcgcgtccgccgcctcgagcacccggacccccgcttgctccgctacgccagccccgtgcccgtgcacgtcgaccacaccgccatcctcgaggcgccggagaccagggtcaccacgctcgacaacggcctgcgcgtcgccaccgagtcctcgctctcctcgcgcacggccaccgtcggcgtntggatcgacgccgggagcaggtacgagacggaggaggcggccggggtcgcccatttcgtggagcacatgctgttcaagggcacggggacgcgcagcgccgggcagctcgagcaggagatcgaggacatgggcggccaccttaacgcctacaccttgcgggagcagaccaccttatacgccaaggtgctcgacaaggacgtgccacgtgcg

SEQ ID NO: 6093 - DNA, 285 bp, Triticum aestivum
  Clone ID: LIB3281-035-P1-K1-G5
acgcgtacgctttgacctacacgtgtgttctcgcacaaacgcacatactttatctacatgggctggttaaacatatgcaagaccctctctatctgtatctaactcgtaccgaattgctaatatacgaacctcttctatcatctactactgtatgctagacaactcatctacctctattctactaatacctaacgtagtaccacgttctatctcctaccatagcttctgatacgatattggatagcagactttccgcgaactgataaaataatatatgactattta

SEQ ID NO: 6094 - DNA, 452 bp, Triticum aestivum
  unsure (1)...(452): unsure at all n locations
  Clone ID: LIB3281-035-P1-K1-G6
cggacgcgtgggatcccctccgcctccgccgccgttcttctacgtacgactgcgctgcagccgtgcccttctcgtcgccacttaccgacctcgagctccccagccaccgacaaccggaggcggcgccatgtctcaaaacaacccctcccagctcctcccctcagagctgatcgaccggtgcatcggatccaagatttgggtgatcatgaagggagacaaggagctcgtcggcactctctgcgggttcgacgtctacgtcaacatggtcctcgaggacgtcaccgagtatgagtataccgccgagggccggcgcattacgaaacttgatcagatcctcctcaatggcaacaacatagccatcttagttcctggtggttcaccgccagatgctgcatgagctagcaagcacttntggaggatatctgtttgaggctaaacgagacgcagtgaag

SEQ ID NO: 6095 - DNA, 112 bp, Triticum aestivum
  Clone ID: LIB3281-035-P1-K1-G7
acgaaatcgcccttgattccatcctcctacaacaaataatctattcaatcaattgggttggggcaaatcctttggccctctgatctactttaccttcaattacttaaattca

SEQ ID NO: 6096 - DNA, 367 bp, Triticum aestivum
  Clone ID: LIB3281-035-P1-K1-G8
gtttcaagaaccagaaagcatttggccatactgttactattgctgtgaaagggcagaccctcccttcaagtgaaaacaaggatgctagtgacatacctgataaggcacagttcaacctagaggatttccctgtccagtatgatgatgcaaagttttttgtcatcaaatcatacagcgaggatgatatccataagagtataaaatacaatggggggggcaagtaccaccaatggaaataagaagcttgatcctgcttataaagaagctcaggcaaagggctctagctgccctatattcttgtttttctcggtgaatacaagtggacagtttgttggtgttgctgaaatgactgggcctgttgattttg

SEQ ID NO: 6097 - DNA, 180 bp, Triticum aestivum
  Clone ID: LIB3281-035-P1-K1-G9
ggaccttgttccccgatatatttggatagtgatgatgagctggatgactttgggtacaaagagccatcgggcaatttgattttaccctgtgaagagtccatgcgggaagaggagagaaacgactacacagaagaagggaagacaacgcaagaaaagaggggactaataaaggaagggaaa

SEQ ID NO: 6098 - DNA, 314 bp, Triticum aestivum
  unsure (1)...(314): unsure at all n locations
  Clone ID: LIB3281-035-P1-K1-H1
cggacgcgtgggcggacgcgtgggcgatgctaatgtgcgtgagatctttgacaagggtagagggtcagcaccatgtgtcctcttctttgatgagcttgactctattgccacccagagaggaagcagtgttggggatgctggaggtgcagctgatagagtgctaaaccagctattgactgagatggatggcatgaacgccaaaaaaactgtcttcatcatttgtgctaccaacaggccagacattatanaccctgccttgctgaggccagggcgttttgataagcttatctacatccctcttcctgatgtcgagt

SEQ ID NO: 6099 - DNA, 218 bp, Triticum aestivum
  Clone ID: LIB3281-035-P1-K1-H11
cggacgcgtgggtgcatacaaggaaggcatccgtttcgccaagctgaatgacgagggggagtatagcaccattgctgcatatggccagtcaaagcttgcaaatattttgcatgctaatgaacttgccaagaaatttaagggaaagggtgataacattactgcaaattctatacatactggaactatcatcacgaaccttgttcgtcaccacaacatta

SEQ ID NO: 6100 - DNA, 194 bp, Triticum aestivum
  unsure (1)...(194): unsure at all n locations
  Clone ID: LIB3281-035-P1-K1-H12
cccagtttcggcgtgggccgcacgcgtncgaaagggagcaatgttacttgggcaaaactggaagngaactactctaagtacccgagcattacccctgctgctgatgcacatgactactcaacctccaatcttaaccggttcaacagtaatgtggctaagaactaccgccattgctgtgctccaaccaagatcat

SEQ ID NO: 6101 - DNA, 163 bp, Triticum aestivum
  Clone ID: LIB3281-035-P1-K1-H2
aaacatacaggatctgaagtatcgacctctttaatattccttctaccggcagcagcacacttaggccggtgtgtcccgctcggcactatcataccaggcttccacctagtgtgtgccggtggaaaacctaagatgaagcggagcagcctggcgtgcgcgggca

SEQ ID NO: 6102 - DNA, 213 bp, Triticum aestivum
  Clone ID: LIB3281-035-P1-K1-H4
cggacgcgtgggcttatctctccgcgctgccgtcccgaccccgtcttctgctcctccgtggacgcgacaccggccgcgggccgccggccggcctccctccaaatccgtacggccgagcggaccctccttcctttaagacctcctcccgtgccgcagacactgccccccgagatcccgtgcctacagataatttgactctgaaaaggtgacggc

SEQ ID NO: 6103 - DNA, 102 bp, Triticum aestivum
  Clone ID: LIB3281-035-P1-K1-H5
tgcttatggccagtcaaagctggcaaatttttggcttgctaatgacctggccagaaaattaaaggaggggggggtaaccttaattgaaattcttttccttct

SEQ ID NO: 6104 - DNA, 277 bp, Triticum aestivum
  Clone ID: LIB3281-035-P1-K1-H6
agaaacggcgcaatgttatttgggcagaaactggatgggtactattgtactaacccgtgcatcacgactgcttgtgctgcacatgactactcaacctccaatcttaaccggttcaacagtaatgtggctaagaactaccgccattgctgtgctccaaccaagatcatgcacatgtcagcgctttcaccagaaatatccgaggacacgatccttgaacacctaggtgagcatggcaccatcgtcaagtaaaagctgtttgaagcgagtggcaagacgc

SEQ ID NO: 6105 - DNA, 200 bp, Triticum aestivum
  Clone ID: LIB3281-035-P1-K1-H7
cgcttcctcccgcacgcctcctcctctctccctccctcccgcagccgcctccctccctcccgcgcgcctcctctcctccccccgcctcccgcagccacatcgccggcgacgccacccgcctccccactcgggcgaacccctctcctcttcccccgcctcgcctctctcccttcccccgtccaaaccctaggcccgcgccc

SEQ ID NO: 6106 - DNA, 335 bp, Triticum aestivum
  Clone ID: LIB3281-035-P1-K1-H8
cccacgcgtccgcccacgcgtacggagggctcaaacagcagtcgagaacacaatagatacaagaatgcaacacacgagtcttccattccactcctgatcttgtctttctcccacatcacaacatcacaagggtctttcttctcttctcttctcttgagacaagaacatcagcccgtcttcttaagtaggaattcagttcggcaatggtgctgcctccttggcctcttccttgatagatatagacagacgagtgaagtgagtgagcagtgcgtgagtggggatggatcagccggtgccctccatctgcgggctccacccgggcatcgacgtcgccg

SEQ ID NO: 6107 - DNA, 306 bp, Triticum aestivum
  Clone ID: LIB3281-035-P1-K1-H9
cggacgcgtgggcttcactgatcaagtagctggcaagaggtttgaccgcagtacaaccttgcatcccggtcgatcgatggcgtccaaggtcgagctggtggtggaggtgaagtcgccggcggagaagctgtggacggcgatgcgcgagtcgacggagctgttccccaagatcttccccgagcagtacaagagcatcgagaccgtggagggcgacggcaagtccgccggcaccgtccgccttatcaagtacaccgagggggttccgatggtgacgttcgccaaggagaaagtggaggtggcggacga

SEQ ID NO: 6108 - DNA, 392 bp, Triticum aestivum
  Clone ID: LIB3281-036-P1-K1-A1
cggacgcgtgggtttttttagtcaatcaacacacatatgatttatgcagtaagaataatgaggcggttgttgcttgtcaggttcatcagggaaaggaggacgaaaacatattgcatgaaggccaagttagatagcagtattcagcatgtgacttttgagatctgtcatcctggactagcatatgcaagatagacacttgtatttataattcaccacctcactcttatattactttttttcaaggacacattggtgcgcctcatctgtataaatattaaaagaacacggttcatttaagttaaaggtcttcggcgttaccataaacaaatcttgcatcaaaggaaatttatggagtagaaggcgtttgtccattgatgacacatgccatatgt

SEQ ID NO: 6109 - DNA, 363 bp, Triticum aestivum
  Clone ID: LIB3281-036-P1-K1-A10
cccttccggaggtactgccgtggtgttggacgcacagcccaggtgaagaaccgtcagcccaatggtcagggacgctggcctgccaagtctgctaagttcgttctggatcttctaaagaatgctgagagcaatgctgaggtgaaaggtcttgatgttgatgctctctacatttcacacatccaagtgaaccaggcccagaagcagcggcgccggacctaccgtgcccatggacgcatcaacccctacatgtccaacccatgccacattgagctgatcttgtcggagaaggaagagccggtgaagaaggaggctgagtcccagattgccaggaaggcctaaagaaagaagctctacataacctat

SEQ ID NO: 6110 - DNA, 371 bp, Triticum aestivum
  Clone ID: LIB3281-036-P1-K1-A11
ggttgtgaagtccatgcgttgggcatttagataaactctccacaaatggatacaacacgaaaaatattacatattctttgagaacatacttcagagctaatacacacacgacaataccagtacaatttaaacaaggaaaagtcggttgtattttgagctctttttgaaaaacatataaattgtattttgtagcatggtcgatgatggctccagccgctggggcataaccagccgccacgtgacatcagctcatcaatccatcatggtccgctacgctaggcatgtgcctccgcttctcgccgtccacgccctaaggctgcattagtgcatcatcttgactccagaaaacgacaccaaagttgatggacacc

SEQ ID NO: 6111 - DNA, 344 bp, Triticum aestivum
  Clone ID: LIB3281-036-P1-K1-A12
gggggttttggttgtgaagtccatgcgttggccatttagataaactctccacaaatggatacaacacgaaaaatattacatattctttgagaacatacttcagagctaatacacacacgacaataccagtacaatttaaacaaggaaaagtcggttgtattttgagctctttttgaaaaacatataaattgtattttgtagcatggtcgaagatggctccagccgctggggcataaccagccgccacgtgacatcagtttatcaatccatcatggtccgctactctaggcatgtgcctccgtttatcgacgttcacgcccttaaggtgaattagtgcatcattt

SEQ ID NO: 6112 - DNA, 216 bp, Triticum aestivum
  Clone ID: LIB3281-036-P1-K1-A2
cggacgcgtgggctagctccgcacccccgcaccctcgtcgcagccatggcggaagaagccggcgccgccgccttcgcgtgcgccaccaacttcgaggtggacctgggccacctcatggcctacgacccctcgcaccacctcgccgccggcgccgcgtcgtcccgggcggagctgcctgacgagtgcctgcagaaggccacggagctcgcgcaggcc

SEQ ID NO: 6113 - DNA, 434 bp, Triticum aestivum
  Clone ID: LIB3281-036-P1-K1-A3
cccggcaaaggacccaaaggagtaaatttaagcgaaggaagatgttggatcgtcattcaactctagtatctgaagaatttgcaaaatcaaatgcaaagagaaccacaaaggttaatgcaagagaaccacatgctgcttccttggaagcaaataagggcagcaactcaatgccattccatggatcttgtaaatcaaacgattgccatgtgaaacttaagatcaaatctttcaaggtgcctgaacttctaattgagatcccagaaactgcttctgttggttcactgaagaaaactgttctggaggcagtaaatgccatgcttggaggtggtctgcgtgtgggtgttcttcaccatggaaagaaaatcagggatgatagcaaaaccttaatgcaagctgggattggtcatgatgatattctggacaacataggcttt

SEQ ID NO: 6114 - DNA, 390 bp, Triticum aestivum
  Clone ID: LIB3281-036-P1-K1-A4
cggacgcgtgggggtgtttctgtgctttggtaattcagttgcttcaacccgcttcttgcttcaagacgaattcaacatacagacaaccaagtgtgataactgcatcattggtttcatgttctgccttcaacaagttgcttgcatcttctcaatagttgctgctattgtcggtagtgaggaactttcagaggcttcccagatcctttcctgcctgtctgatatggtctactgctcggtttgcgcctgtatgcagacacagcacaaggttgaaatggacaagagggatgggaagttcgggccacagcccatgcaagtgcctccaatgcagcagatgtcacgcatcgatcagcctgtccctccacccgctggctatgcaccacaaccagcata

SEQ ID NO: 6115 - DNA, 243 bp, Triticum aestivum
  Clone ID: LIB3281-036-P1-K1-A5
cccttccaaacaaggaacccaccgagaacaggtccatatctttatatttacatttagacccaaaaacactctcaccctttcactctctccacacctgaaatatacactatctacttggagcgaagtccagcacacttatatcccatatccaaagacaagacgcgcctggagcttgccatgacacccaatccagatcgggaggtgtcccaccgcgcagggagaggaggaaagattctgctgccg

SEQ ID NO: 6116 - DNA, 347 bp, Triticum aestivum
  unsure (1)...(347): unsure at all n locations
  Clone ID: LIB3281-036-P1-K1-A6
agacaagacgccgaccacacacngccagattctgaatcttgacctggtgccaggagcggagttacaccttcagttactgccgacccaaaatatagactaactacttggaccgaagctcaaactactgcatcgacatacgaagacacgaagcgcctgcagcttgtaatggcagccaacagagatcggcaggtgcgccagcgggcagagagagggggaaagatactgctgacggagagagtcgacttggcggcgatgctactggcgactctgccgtgaacgagggtggccaccaactacacggtgagccacgagaatgggcccaaccagaacgtggactacacacgctg

SEQ ID NO: 6117 - DNA, 422 bp, Triticum aestivum
  Clone ID: LIB3281-036-P1-K1-A7
gtgatgccccccccccccaaacatgggcccttgggcgtcgcccatgttcgcctagggccaaagccggccctgttttaacaccaatcagggatgggcaactaaaaatcaaatcttagggcttttgcagaactgcccaatctttcagctccagcaacatgaagtgtctgctattactgatgaaattagtcgcggtgctgttctcatcatacctgaaagcaatgtggatgaattactgatgacacttgaatacacctcatctggaaaaatattaaaagaacacggtccatttaagttaaaggtctccggcgttaccataaacaaattttgcatcaaaggaaatttatggagtagaaggcgttagaccattgatgacacatgccatatgtttgaatggcctgccaaaccagtgcgaaatgagacac

SEQ ID NO: 6118 - DNA, 174 bp, Triticum aestivum; identical to SEQ ID NO: 4208
  Clone ID: LIB3281-036-P1-K1-A8

SEQ ID NO: 6119 - DNA, 295 bp, Triticum aestivum
  Clone ID: LIB3281-036-P1-K1-A9
cggacgcgtgggttcctcggcagagcccatggtctggccttcccctctgaagttcatcagcgagctcgacccggaagccaaggctctgctggaagcggccctgatggaggccaacagggagagggagaagaagatcttgaaggacgcaaagtgctcgccgcagtcccctttgcaatacgatgatgatcacatcgacgacgacatgttctcggaggtgagcgacacggagctgtgctgcatctgcttcgaccaggcgtgcaccatcgaggtgcaagactgcgggcaccagatgtgc

SEQ ID NO: 6120 - DNA, 424 bp, Triticum aestivum
  Clone ID: LIB3281-036-P1-K1-B1
cggacgcgtgggcggacgcgtgggggatgtagctggttgtgatgaagctaaacaagaaatcatggaatttgttcatttcctgaaaaatcctgacaaatatgaagcactgggagctaaaataccgaagggtgctcttctttgtggaccccctggcacaggaaagactctccttgctaaagctactgctggagagtctggtgtaccgttcttgtctatatctggttcagacttcttggaaatgtttgttggtgttggaccatccagggtgagaggcttatttcaagaagctcgggaatgtgcacctagtattgtatttattgatgaaattgatgcaattggtcgtgcaagaggccgtggagggtattctggtgggaacagtgagcgtgaaaatacgttgaatcagttgcttgtagagatggatggg

SEQ ID NO: 6121 - DNA, 145 bp, Triticum aestivum
  Clone ID: LIB3281-036-P1-K1-B10
ccctcgcgttggtactctcagggtgttcgacgcataacccattccacgatgggcgcgacaaaatatctgagggggtgtcctgcctattctaaaaatacccaatataaatttctttaaccacgctggcaaaattggatcaaggact

SEQ ID NO: 6122 - DNA, 394 bp, Triticum aestivum
  Clone ID: LIB3281-036-P1-K1-B11
caccgaacaagacagtgtaattggatctcagctcatctgggaccgtgcccttggcctaccgcttgaaagaccgaagagtgtaaccatggagtggctggagaaccactgcaagaaggctgcggcttgaagctacaccagttcttcgtcttacaactcgagtggcctttgatgttaataattcgacgacataaattaggcacgtttagcctcattttcccatctttttcctgtccaataactggagcaagaggggctcccagacggtagaattttgtacccaagtcggacaatctgtcaaacttggcatgaaagattaggacacgatgcttgggctttgtgtcgctcggcaacgtttttgtactttatgttgctcgagttttgaaccacaccagtt

SEQ ID NO: 6123 - DNA, 343 bp, Triticum aestivum
  Clone ID: LIB3281-036-P1-K1-B12
ccgactccttggacgagttatgggtactgaccttacgagggtctgtacttacggagggtacccacggcaagagctgagattcactttgtcagagaactgctccagtggggagcaaactagaggtatggcaacctgtcttgccatgcgtacatcgggcaggggaacctgacggttagagcttcatgatttacagaagcgctgtgtgcgctccatgagggaagattttacatggacatatccattcactggcttactgaaaaagaggtggatcttacccgcaggagaataccacacctttcagttgacattaactatcttgtcaatatgctccggttcattatga

SEQ ID NO: 6124 - DNA, 403 bp, Triticum aestivum
  Clone ID: LIB3281-036-P1-K1-B2
gtgaccgccgcggtgctgcccgggatgttgcggcggggcaggggcgccatcatcaacatgggatcggcgtcgtccgagggcatctccttacccctccacaccatgtattccgccaccaaacggtatgtcgctcagttctccaggagcctttacgttgagtacaaaagcacggggatagatatccaatgccaggtgccgttcttcgtggcgactacgatggcttccggcttcgccgcgacctggcggccgtcggcgttggtgcccacagccgacacgtacgcgcgcgcggccgtgggctggatcgggaagggcggcccgctctgcgtgcccaacctcaggcaccggctcctggggtggtatttcgccaccgtgccaggcggcgtgcaagactggttctgcctgc

SEQ ID NO: 6125 - DNA, 329 bp, Triticum aestivum
  Clone ID: LIB3281-036-P1-K1-B3
cggacgcgtggtacctgccattctacggatgaataatgtgacagggatttgtccggggggctcacattttaaatggcgtggtaggtccaattacaggcactcaacagaacggatttgattgctcagagggcagaattggttcaaggactagcaatggaagcaatttgatctaagctatacagacatgccaaaagcaaaggggcacagcggatttttctcctactataataacacaattattgcgtctagctatcacaagtgctgtgcacaacgcaagaaagacatatagggatatcgttgtcatagttacagggcactcaatgggagga

SEQ ID NO: 6126 - DNA, 423 bp, Triticum aestivum
  Clone ID: LIB3281-036-P1-K1-B4
cggacgcgtgggacctgccattctacgggtgaacaatgtgacaggcatttgtcggtgtagctcacaatctaaatgccataatagttgcaatcagagggactcaagagaacagatttgcttgctcagtgtgcagaattggatcaaggacttggtatggaagcagcttgatctaagctatccagacatgccaaatgcaaaggtgcacagtggatttttctcctcctataataatacaattttgcgtctagctatcacaagtgctgtgcacaacgcaagaaagacatatggggatatcggtgtcatagtcacagggcactcaatgggaggagccatggctgccttctgtgcactcgatcttgctatcaagctcggaagcgacaatgttcaactcatgactttcggacagcctcgtgttggcaatgc

SEQ ID NO: 6127 - DNA, 416 bp, Triticum aestivum
  Clone ID: LIB3281-036-P1-K1-B6
gctgcagttgcagagtacactgccccagcgggagatacctggggtgctgaatggccaggagctgcagctccagctgctgccgtcgaagccccggctggtgctgagtggactggtgctccagctcctgcggccgatggatgggatgccgttgcagcacctgcccctactggctgggaacagggcagtgctccggcacctgcagcagcaccagctgctactcagaactgggagtgaaggacttgacccaaggtttatgctactcggcactctggagtgaaggagttcggccgtggcttattggtgaaggctgtgttatttgccccgtcagtactctgttggtagacgctggttaagtagatttaatttttacagtactgagttatgttagatggaaatcgatttttgtctctttggct

SEQ ID NO: 6128 - DNA, 293 bp, Triticum aestivum
  Clone ID: LIB3281-036-P1-K1-B7
cccacgcgtccgcgcgtggatccggcagctcctcgaggcgttcctgctgtgccaggaggagtttcgggcggtggcggccgaagtgcggcgccgcggctgtggaggcgcgctggcggagaggctggtgggcgagtaccacgagcgcgcggtgaaggcgctcgacgtgtgcaacgccgcccgcgacggggttgaccaggtccggcgctgggggcggctcgccggcatcgcggcgtccgtgctgctcgcccccgaggagatccacgagggccagatacaccatgcgaggaaggcgc

SEQ ID NO: 6129 - DNA, 412 bp, Triticum aestivum
  unsure (1)...(412): unsure at all n locations
  Clone ID: LIB3281-036-P1-K1-B8
cggacgcgtgggtttttctagagcagcagatttattacagatttcagtctgctgacaacacaatacctgaatgtgaagtaaaaatgtcatcaaataaggcatatattatacaacaaccacagcacaaaacaccaaagaaaacaaagacggattaacacgttcatgcgctgcttcaatccttcttctggaccctgagtgtgaaggcctggagggacaagaacacttgcttgatccggtctctgatctcaacatcaattaaaattccatcactgtcaaacttgggtggctgctgaaatgcttggacgaacagctctggcttgttgatgaaatgaagatctaagaacaccccgacctgccggagatggtactgtgatctacctnctncaaagccacctcccgcgctgacaatcgc

SEQ ID NO: 6130 - DNA, 426 bp, Triticum aestivum
  Clone ID: LIB3281-036-P1-K1-B9
cccacgcgtgcgtggactcaggaggatcgttggagatgtcggacaccgatgagcaccacttagagtccaagggcgactccggcgcctccaagacctacccgtagcaggctggcgccatccgcaagggtggacacatcgtcatcaaggcccgtccctgcaaggttgctgaggtctccacctccaagactgcgaagcatggtcacgcaaagtgtcactttgtcgccattgacatctttaatggaaagaagcttgaggatatcgttccttcattccacaactgtgacgtcccccatgttgaccgccaagattatcagctgattgacataactggtgatggatatgtcagccttctcactgagagtggttacactaaggatgacctgaagcttcccactgatgatgttctgcttggacagatcaagactg

SEQ ID NO: 6131 - DNA, 327 bp, Triticum aestivum
  Clone ID: LIB3281-036-P1-K1-C1
cccacgcgtccgcggacgcgtgggcgcccacggtctaatccgattcaaacgcaccgcttggtcgtgtccgaactaagccccaatcccgtcaccaccgccgctggtgctcggcgcgatggcgcagaaggacgccgccaatggcaacggcgccaccacgccgcccgccgccactcccttccccatccgcttctccaagttcttccaggccaacatgcggatcctggtcaccggcggagctggcttcatcggctcgcacctcgtcgacaagctcatggagaacgagaagaacgaggtcattggtggtgacaacttttttactgggtcaaa

SEQ ID NO: 6132 - DNA, 424 bp, Triticum aestivum
  Clone ID: LIB3281-036-P1-K1-C10
gcgcacatggccggccgcagcaacgagcagatcggccgcttcctcttcccggactggccgcaggcccggctcgacgccttcttcgccgagaaggaggcgctcttcgcgcggtacgccggggaggggctccgggaggtgcccgggctggcggagctgtgccggtgggcgcgggagcgcgggctgaagcgggccgccgtcaccaacgcgccccgcgccaacgccgagctcatgatcgggatcctcggcctggccgacttcttccagctcgtcgtcgccggcgaggactgcggcgagggccgttccaagccctgccccgacccctacctccgcgcgcttgacctgctcggcgcgtcggcggagcggtctctggtgttcgaggactccgacgtcggcgtgcaggccggcgtggccagggggatgcccg

SEQ ID NO: 6133 - DNA, 375 bp, Triticum aestivum
  Clone ID: LIB3281-036-P1-K1-C11
cgcaagcgagcagagcacaccgcacacgtagcagtttccctttcagatatttggggcgactagccaccatgactgctttggccaagccctccgcctcagcgccgaagccgaagaagacctccgccgctggagccgcccacccgacctacttcgagatgatcaaggaggcgatcgcggctctcaaggacaggaccgggtcgagctcggtcgccatcgccaagttcatcgaggagaagcacggcaaggccctcccggccaacttcaagaagatgctctccgtccagctccgctcctccgccgccaagggcaagctcgtcaaggtcaagggcttctacaagctcttcgacgccgccaagaaagactcccccaagccca

SEQ ID NO: 6134 - DNA, 423 bp, Triticum aestivum
  unsure (1)...(423): unsure at all n locations
  Clone ID: LIB3281-036-P1-K1-C12
gcgaatttgtagtccatcgaggagtacagacattaggaggttctgcaatgacagagcgtacccgcggcaagagctcacatgcactccgtcagagaactgctcaagtgcagcaacaaacgagagggaaggcagcaggtcttgacatgaggacaaaggtcaggagaaaatcacgggtggagcttcgtgatttccagaagcgctgggagcgcgccgcgagggaagataggacatgggttgatccattcactcgctcacggagaaagaggaggagcagaccagcagtagattagcacactnttcagctcacattttcttcctttttcatgtgctccgggcgattttgagacgccgaatactcggccgtccagttctgtgcaaaatcttgtgaaccccgtatgcttacaggtgatgttttcatgccta

SEQ ID NO: 6135 - DNA, 430 bp, Triticum aestivum
  Clone ID: LIB3281-036-P1-K1-C2
ctgtacagcgatgttgagaacgatgaacacaaatttgtgttgaaggacaggaacaagccaatcatcttttcaatggcccgtcttgaccgtgtgaagaacatgactggcttggttgagatgtacggcaagaatgctcatctgaaggatttggcaaaccttgtgattgttgctggtgaccatggcaaggagtccaaggatagggaggagcaggctgagttcaagaggatgtacagtctcattgaggagtacaagctgaagggccatatccgttggatctctgctcagatgaaccgtgttcgcaatggtgagctgtaccgctacatctgtgacaccaagggagcatttgtgcagcctgcattctatgaagcatttggtctgactgtcattgaggccatgacatgtggtttgccgacaattgcgacatgccacg

SEQ ID NO: 6136 - DNA, 338 bp, Triticum aestivum
  Clone ID: LIB3281-036-P1-K1-C3
ctcatgcgcatttctttgaattgtgcggacgctgaagtattacaaacccactcaaggggagtgtcttgctggccggcggggctcgctcaggacggcactaactctggactaatgggagttcatgcacaactgccgcattgagttcccagacacatctactactagaactaactgtggcagcagagcctgctcgtgagtcgaggtcccactccaaccaatgtatatcgactgcttccacaagctaagggcttggtacattcacaatcagagctggcatagcgcttactctgtctggactgggcaatacaaaccttgtccatcaagttgcgaacaaaatt

SEQ ID NO: 6137 - DNA, 385 bp, Triticum aestivum
  Clone ID: LIB3281-036-P1-K1-C4
ggccccgaaatacccggggggccacacacgcccgtttatagaccgttctaggggttggcttttcttccctttccggttcggtttctggtggggggcgggttcctgagcggagagagtcccactggctagcatactctatggtctctgtagagaggaaggaagattcatgtgtgccactgcctgccacatctacgtcggaggaccaacgtctcgcaggattacatccacaatcgtcaacaaaccaccccagcccaatgatagagtcatgatccggaacctatggacttgctacatattgcaactagctgtttatagcctaggaattacgtgagattcggattaagatactttcccatccctatcttaacgcgcatttactttttta

SEQ ID NO: 6138 - DNA, 423 bp, Triticum aestivum
  Clone ID: LIB3281-036-P1-K1-C5
gaagtgcagataatacagctatatccttggacatgagaacaccgcttagtcattggcctcctttccgctttggggttgaatttgaagatgtgcataggcttgcagatggtcaagtgaaacactcagctgaagtattttacgctggctcgctatggaaggtaagtgtccaggcattcaatgatgaggatcctcatgggcggcgcacccttgggctttttctccacagacgcaaagctgaattgttagaccccttgaggaaggctcacatgtatatagacccccgggaaaaggtcactgctcggtatcagctcatctgtccatcgaagagagaggtgatgatattcggaagcctgaagcaggccggcactctcctgcccaaggctccaaaagggtggggttggcgcacggccatactgttcgatg

SEQ ID NO: 6139 - DNA, 387 bp, Triticum aestivum
  Clone ID: LIB3281-036-P1-K1-C6
cccacgcgtccgccggcgcaaccaccggccctagccccgatgcccctgctaatggatgctgacgtgtcggagccggccctaccggccgcaagattgaacaatggtactacagctccagcaccttcgtctgcacccaggatgcagactcggatcccattcctcgtcaccttagcgatgctttgcgtctgggccacgggctgaggtcgcaatgccacatgacacgctagaggtctgccggtctactaatccaatgttctttcccctccctcggtaattcgattgttcttgtaatttttgcgttgcggggtttatatacggacgcccctatggcactcagtccctagtgattatcagtacatatgtgttggaatatatcctcttatgttc

SEQ ID NO: 6140 - DNA, 314 bp, Triticum aestivum
  Clone ID: LIB3281-036-P1-K1-C7
cctcgcgttcctcgtgcagaaccccgaggcctcggcagccatggccaccggcggcgaccgcgcggcggaggagctcgtgtccgtcgagatgcccgcgcccgagggatggaccaagaagtttactccccagagcaggggaagatctgagattgtttttgtctcaccaactggagaggaaattaagaacaagaggcagctgaacagctatctgaaggcaaaccctggaggccccacttcatcggagtttgactggtcaactggtgataccccaaggcgttctgctcggattagcgagaaagtgaaggtatttgata

SEQ ID NO: 6141 - DNA, 352 bp, Triticum aestivum
  Clone ID: LIB3281-036-P1-K1-C8
gagcactaacgggcattttgaaaggaacagtcatgagaaagatcttaaagaggtggaggttgttaaaggaaaagactctgagccttatagaactgacatgtttagagatggtgacaagcataccatgcctgaaaatattgataaaaatggcacctacaaagaggaaaagggttctagcatgtatgcaaaacatgggttggatagatgggatgatgccaaaagagatcgaaaggacctttcaaaggatgcaagagagagaaagagggattctgctgatagaagagacataggacacgatgggaatgacgctagatcaaggcatattactaagagctcatctagccacagcagt

SEQ ID NO: 6142 - DNA, 397 bp, Triticum aestivum
  Clone ID: LIB3281-036-P1-K1-C9
cccacgcgtccgatctatgcgcccttcaagagcctcctgcccatggtaaacccagatgatcttgtgtttggtggctgggacattagcagcatgaacctggctgatgctatgaccagggccaaggtgctggacattgacctgcagaagcagctcaggccctacatggagtccatcgtgccgctccccggcatctatgacccggacttcatcgctgccaaccagggctcccgggctaacaatgtcatcaagggcacaaagaaagagcagatggagcagattatcaaagacataagggagttcaaggagaagaacaaggtcgacaaggtagtggtgctttggacggcaaacactgaaaggtacagcaacgtctctgttgggcttaatgacacgatggaga

SEQ ID NO: 6143 - DNA, 435 bp, Triticum aestivum
  Clone ID: LIB3281-036-P1-K1-D1
gtcctgtgagacgcttccttctcatacacatctgaagcaacgtttgatcatccgcattagagagttttgcaggtccttgagagaacgttatccagtcagttatgacttgaccatggtctgaggtgaaattggtcctggtccataaaacgaaaggtgctgggcaagcgcagagaagtcgtctgaaggggagttccataggaatgttcaacttcgatcaaccttggtttggtcccatgcctaaaaaagaaataaggtcaaaaacaaaataggggtgatataacccactgctcgcctaagaatgtactgacgtaatccctactatggcttcccgaaggatccagctgctaagagggtccgagccataacggattgatgtgaccgtagcggcgactggaatcgatctgaatgaggcagttatgggacttatcttatata

SEQ ID NO: 6144 - DNA, 433 bp, Triticum aestivum
  Clone ID: LIB3281-036-P1-K1-D10
cccaaatcagcgcaggcgaccgagccgcgaaatccatcgtcgaggggagagggatcgctcggcgatcaataagcaaggccatggcgggtaacaagaagaagaaggaggaggcggcgaggaagtgtatgatgaggccgtgcaccgccgccaagtctacggagggtgcggtggccggcggccatggtcctgttacgcgtcccctctgcaggaggaaggcggtggccggatccagcggtgagcagcggccggagggatcgtcggatctgctcgaatcagcgaggagggaggacaagatgctgggaaaggccaagctgtcatctttcgtccccaagcaggctggggccaatgcaaccgtggctccagcagcagacgcagcacaaggtggaagcaaatctaagcgtcggctgaccaagagcgagatcatgaccatact

SEQ ID NO: 6145 - DNA, 423 bp, Triticum aestivum
  Clone ID: LIB3281-036-P1-K1-D11
atccaagtatcatattggatgtaaaaactagacttggggtggcattaccaatacaggtgaaggacatcggcttcacgggagttttccgcttgattttcaaaccgctggttgaacaactgccttgctttggagctgtttgtttttctctaagacagaagaaaaaactggatttcaaactgaaggtcattggtggtgatatttctgctattcctggaatttcagctgctcttgaggaaactataaaaaatgctattgaagactcaataacatggccagtaaggaaagtcattcctatagtacctggggactacagcgatctggagctgaagcctgtgggtacattggaagtcaagcttgtgcaagctagagatttgacaaacaaggatctgataggaaaatcggatccttttgccactttatata

SEQ ID NO: 6146 - DNA, 196 bp, Triticum aestivum
  Clone ID: LIB3281-036-P1-K1-D12
cacgcgtgcttggtatggggaggctgaccgagactcccagtgtcattaaggacacggggatctgcaagatcgtggagaggaatatctacgctcgacgactgaactggtgtactcacagactagggttctgttcacgactgtgcctttctatacatcagatctgtactattaattgttagcgctacgagatttttgg

SEQ ID NO: 6147 - DNA, 359 bp, Triticum aestivum
  Clone ID: LIB3281-036-P1-K1-D2
cggacgcgtgggctcatctcctcctcacgcacgcacgcgcacagagagcagcgacactccgctccgctccgatcaccccccaccccagctcacgcccgccgccccacccccacccaccccgccgccgctccccgtagatccgatctgccccgacccgaccgaccgcccgccgcccgatcggatccggcccgaagggttttggaggttggctcatggttcacgatggcgccgtgaaggaccagcagcagcagcagcaggagagttcgccggatatccccgcgccttctgcatctgcggaggcggggtcggcggtagcagaggcggtggtggtaagagcgccggaagcggtggcggggcgg

SEQ ID NO: 6148 - DNA, 187 bp, Triticum aestivum
  Clone ID: LIB3281-036-P1-K1-D3
gctccgctcactgtgtgccgtttcgccccgacccgccccccacctgttcgacggaagtcgtgtccccgccggcgggcgacgatggacttcaagggccgcttattctcgtcgtggcacaagtcgttcgagtcctccaaccccgacggcagcaacagtccgcgcacgcccacctccgtgccgggggcag

SEQ ID NO: 6149 - DNA, 378 bp, Triticum aestivum
  Clone ID: LIB3281-036-P1-K1-D4
gcggataaagaaggattatcatactcaactcgcgagaagcgagctgctgttggttcaagaaccctctactcactagcttcacaaatccttttcccaagttctacttacaatgttggctagttccccgcataatataataataaaaatgcagcctaaacgacccaaattgcctaaaattgaaccaattttttgtaatgcaaggatgctcactgtgaataataaggtgagagtttgcggaagctacaatggtggttgactgtaactgatcacagaactttcacgccactcggtcgtttaccttccatggcatccttcttgtcgcggcaatcagaacaaaggaaagggccttcccatggcttagagctcgaagagaatact

SEQ ID NO: 6150 - DNA, 349 bp, Triticum aestivum
  Clone ID: LIB3281-036-P1-K1-D5
cgatggatttattgttattatgatacaagttaactcgtccaaaggaaaaaagcagtgtgggtgctttctcaaaactgtacttgatgtgtaaattgcagtcttctgatagtggatcacggcccctctcctttctacgtgtacacatgcttcttccaagctctacttacaacggtcgcttggtccgcccatgatataatggtccgaatgcagcctacacgacccaaattgcctaaaattgaaccaattttttgtagtgcgagggtgcgttctgtgaataataaggtgagagtttgcggaagctacaatggtggttgactgtaactgatcacagaactttcacgccactcgg

SEQ ID NO: 6151 - DNA, 433 bp, Triticum aestivum
  Clone ID: LIB3281-036-P1-K1-D6
aacgctagaaagggttcatgcttcccaaagaaaccgacacgggagttctttcatggagtggtcgttccatgttgtgatgtaaatatatacatacgggtttcttctatcttctgcttgcttatcaagtaaagtctacgatggacggatgtcgtgctgaacagaccttctcaactgtactacatcacagcagcggtttggccatcgggtttgaagatcgtcgactcagtgcgcttttgggcatgcactggatttacttttgtgcagctttataagacagggctttgacacctgtagaattgtgtcaaaccactgtcatggcaactcctttatttacgtcctcgaacaaagcatcatgcgttgtaaatatctgccgtagctcttcctgtatgaactccttgtgacaactattcactgtaaataccgctggatcatg

SEQ ID NO: 6152 - DNA, 394 bp, Triticum aestivum
  Clone ID: LIB3281-036-P1-K1-D7
cccacgcgtccgcccacgcgtccgcggacgcgtggggttttcaatctcccaactgaggtgggagggatgggctttattcaatccaaccattttggtattatgtacaacaacaccatgataagctttaacatgcttgaggctggtagaatcaatggtgtcaagaggttcttttatgcctcgagtgcttgcatctaccctgaatttaagcagttggaaactgtagttagcttgaaggaggcagatgcttggcctgcagagcctcaagatgcctatggcttggagaaacttgctactgaggaatggcgcaagcactacacaaaggactttgacattgagtgccggattgtcgctttcacaatatatatggaccatatgggacatgaaagggtggaag

SEQ ID NO: 6153 - DNA, 172 bp, Triticum aestivum
  Clone ID: LIB3281-036-P1-K1-D8
cccacgcgtgcgttcatgtataccacagctcttggtacatttaatgttgtacggggagtagtttgcatgggtgttattcaaaacaaacatcctgttatggtgttctgcaacaccatcataagctctaacatgcttgcatatcgatgacgcaatagacacctagatgctctga

SEQ ID NO: 6154 - DNA, 410 bp, Triticum aestivum
  Clone ID: LIB3281-036-P1-K1-D9
cggacgcgtgggcataaactcatcagatccgaataatcggttctgcgaggaaaaagctctctaacctctaactgctctcgggtcgctcctcgtgggcgactcgagggcgacaaaccctagctctctcaggcctccccctcctcccttccccgccccgccgccacccgaggtggtcgccggcgttcccgcgccgctgtcagtgaaggtggcggcgaggtccctgctgccctgcatcttgtggggagctttggtacgccggggcggcggccctgggtgagaaggcggcgtcgacctcggctggcgggtggcgccgcaggtgttggctggccctcccggtcacgtgggcggcggtggctcctcgcggcgtggtctgccccggcggctgcgccagatctggatcccggtgggct

SEQ ID NO: 6155 - DNA, 420 bp, Triticum aestivum
  Clone ID: LIB3281-036-P1-K1-E1
ggccccttttcttctcttgtttatttgtttgtttcttttgcggggaatctcgtcctgcgaaaaatacatctgacccaccaccgccacgccctagagccgccgccgtgccgcctcaccgccggcgactcgcgccccctccgctgcgcacctatcgcgcgcgtcgccatctccgtcagttcccatctacccaacctcgtcgcgcccctgctccgtccgcaaccttgcttcctgaggtgactggtgtgcgttcttggtagcagctggttgtagcaatggatgatggggacctcgatttctccaacccagaggcgtacctggacaccggcgccgatctgcccggcggtggctgctccatggacagctactttgatgaatacctcaacgacacagagcaccttggctggacttatacccacacct

SEQ ID NO: 6156 - DNA, 290 bp, Triticum aestivum
  Clone ID: LIB3281-036-P1-K1-E10
cggacgcgtgggcggacgcgtgggataggcaccaccatagagatcgtgagagaactcgtgatagggaccgagaacgggaccaggagagagaccgtgggcgtgaccggcgtgatagggataggcacaaggatcatgggcgggatagagaccaggatagagacaggaaacgtgagcgctcttatggcaggggcagagaccgtgacagagattacgagcgtgcaagttacgaacaggaccctctcagggaccgagattacaagcgtgcgcgccatgaacatgatcgtggtcac

SEQ ID NO: 6157 - DNA, 107 bp, Triticum aestivum
  Clone ID: LIB3281-036-P1-K1-E11
cggacgcgtgggtggatcccaaaaatgcttttggtttccgtcctctactattttagtggggtcttatattggccaagttccttgccatatttgggctataggcacgc

SEQ ID NO: 6158 - DNA, 394 bp, Triticum aestivum
  Clone ID: LIB3281-036-P1-K1-E12
aaccaaagttggggcggcgcgcaggcgaatcagcagcggagccaagcaaccgacgccaccatgggtatctggcgtgactccatgcacaagcgccggtccaccggtgggaagcagaaggcttggaggaagaagcgaaagtatgagctgggccgccagccagccaacactaagctttcgagcaacaagacagtgaggagggtccgtgttctcggaggtaacgtgaagtggagggctctccgtcttgacactggtaactactcatggggtagtgaggctgagacccgcaagacccgtctgctggatgtggattacaattcgtcgaacaatgagcttgagaggactcagacctttgacaagaatgccattgtgcaagttgatgcagcccctttcaaac

SEQ ID NO: 6159 - DNA, 387 bp, Triticum aestivum
  unsure (1)...(387): unsure at all n locations
  Clone ID: LIB3281-036-P1-K1-E2
cggacgcgtgggtctgcctgcccccttcccagcttggctgcttcagcatttccttccatagatcaagctattccccaagaaacgaggaaaaagctgtggcaactctcctgctccactgaccgctccgcacgcttcactcgaaaagcagagcagatcgagccagagcgcgtcgggcacacagccgctccaccgatgaagcccgccgccgtgaggaaagaggctggcggcggcattggcagtggcgcgttcggcatctcctgcctcgacatcaaatccttcggcgcctccctggtgctcttcgccctcatcatggcgctctggcagttccacccgtaccagccaatcctcgccatcacccgctcctnctgtcccctcatnccctcccca

SEQ ID NO: 6160 - DNA, 384 bp, Triticum aestivum
  Clone ID: LIB3281-036-P1-K1-E3
gctccgctcactgtgtgccgtctcgccccgccccgccccccacctgttcgacggaagtccgctccccgccggcgggcgacgatggtcttcaagggccgcttcttctcgtcgcggcacaagtcgtccgagtcctccagccccgacggcagcaacagcccgcgcacgcccacctccgcgccgggggcggcctccgcggcctcgccggcctcctcctccgcctcctccagatccgacaagaagaagcccaaatccgagacccccaagaagcgcgacaagctcttcggctccgccgccgtcgccgtgctctcccccagggcctccccggcctcctccacctccagccccttcgacgccaggaagcaccacctcagggattgccgcccc

SEQ ID NO: 6161 - DNA, 327 bp, Triticum aestivum
  Clone ID: LIB3281-036-P1-K1-E4
cggacgcgtgggatcagcctgttgctaaagcaagttgaatgaagacgaaatgtatctcttgtttgatggagaagcaagacgatatcagttccattacagctctatgttatgtatgtctcttgaaatatatatccatctatgatctgccacctagaagttagtagtagtataactggatgatctgtgattgcattgtaggatatgtgtgatgttgctggcctgccatgttaccctttgagtctaaaacttgagcagtattataactggacgatctgtgatggcgttgtaagatatatgtgaattgctggtgtgttatgttgccctttc

SEQ ID NO: 6162 - DNA, 437 bp, Triticum aestivum
  Clone ID: LIB3281-036-P1-K1-E5
cggacgcgtgggagtacatggagctgttgctggccatcccttacatcggagcaatcgttgcccctctcaactaccgctggagcttcgaggaggcggcgcaggcgctggagcttgtgcggccgtcggcgttcatctttgatggtgcttacagctcatgggcgctccggctgatggagagccagagcttctcatccatctgcctttacatcaccatcggggatcctgtcaacaccggccaaggtgcaaactttgtgtcagttgatcatgtcaagaggagttgcagaggaaccgcggaaatggagcccgtgtcggctccgagggatgtcgctttaatatgcttcacatctggaaccactggacagccaaagggcgtagcaataagccatacatctttgatcattcaatctcttgcaaaaatcgccgttgtcggctacggg

SEQ ID NO: 6163 - DNA, 439 bp, Triticum aestivum
  Clone ID: LIB3281-036-P1-K1-E6
gatccttctcagatccccaatccttcatcggccctctcgacctctccagccggcgagcgacgctgtcggcggtccaggccagatccggtgttggctcccctccacagcttcttctccctgcctcctgtcttccactccggcttcaaggtcgcgtggatccgcctcccggccaggcccaacgtcgcgcggcgcatcatcgcagggattcgtcggccgtcgctagtcgtccttgccgatggccgctggcgcctcgggcacagctgcctaggtcaccatctggcctccaccatgccggactccgacgggttcgcgacagatccgaagacccgcggcacagagttgttagagaatacgcagccccgacggctacacgcgccagctcttcttactgactccatcctctcactggctcagtatcaaggtatcttccgtctcaccc

SEQ ID NO: 6164 - DNA, 420 bp, Triticum aestivum
  Clone ID: LIB3281-036-P1-K1-E7
ccgtcccccgcgcgcgccgccgcgacggcgacgacgacggggatggggcggccgtgaccaaggagcggattgtgcaggtggagctccacaaggaggccaccgacgcgtacatgtcctacgccatgtccgtgctgctcggccgcgccctccccgacgttcgcgacgggctcaagccggtgcaccgccggatactctatgcaatgcatgaaatgggacttgcatctcgtaagccatacagaaaatgtgccagagtcgttggtgaggtactcggtaaattccatcctcatggagattcagccgtctatgaaactttagtgcgaatggctcaggacttttcaatgaggtacccacttgttcaaggacatggtaactttggttcaatagaagccgatccttccgctgcaatgcgatacacagagt

SEQ ID NO: 6165 - DNA, 407 bp, Triticum aestivum
  Clone ID: LIB3281-036-P1-K1-E8
acgatgggaaagtttaaggaggtcaaggaagtaccaaaaccttgtccgttggttcagacagcgtagctgtagactatgcactagaggaagttacatctgtttatgttggaaagcgagcaattggcaaatctcccgcaccatgcctgaaagaaaagatgcctggcttgaagaacacctcaggtcatgagatagatctcccaggtgcaaaagttggggaggtttgcgtacgttttgccccagagcctagcggatatctccacattggtcatgctaaggctgcactgttgaaccagtattttgcagatagatataaaggacgtctcttagttcgatttgatgacacaaatccttccaaagaaagcagcgaatttgttgagaacgttctgaaggatattgagacccttgga

SEQ ID NO: 6166 - DNA, 373 bp, Triticum aestivum
  Clone ID: LIB3281-036-P1-K1-F1
agcgatcgtcggtcggttcgcacacaaatcacaaagcatacatcatcatccacgtttgtgacaaagctcaaatcaacaagttccacgtttcttcactctccccgccgacgccagggccgggggagagtggccttttattttcaaatcacaacaccaactacgaaagggagacacaaacttggtggccggccaccagggaaggaggccgctggattattgtggtcggtggtggtggtggcggcgatgatgccaaggggcagatggacggcgttggtgggatggtcctcagctgacgagcttcctttggaggagagccctctcgcccggcatctcataggtgcgccggaaggtgtcgttccgggcgtgccacgtg

SEQ ID NO: 6167 - DNA, 432 bp, Triticum aestivum
  Clone ID: LIB3281-036-P1-K1-F10
atgggtttggatggggatgtctcagtatgcaattctttactcagcatgtatgcgcggtgtatggatttctcctctgcgatggatgtttttcatgagacaaaagatcgtgatgttgtcacctggaacagcattctcactgcatgtgtacagcaccagcatctggaagtagtctttgagttgttcaaccttttgcagaggtcggtgccgagtctggacgggatcagtttaaacaatgttctgagtgcttctgccgagttgggttaccttgaaatggtgaaacaggtccatgcatacaccttcaaagtaggtctggtgaacgatacaatgctgagcaatggtctaattgatacctatgctaaatgtggaagtttagatgatgccgcaaagcactttgaaatgatgggcaccaactgtgacgtgttctcttggagc

SEQ ID NO: 6168 - DNA, 360 bp, Triticum aestivum
  Clone ID: LIB3281-036-P1-K1-F11
ctcacctccacccgtccacgccgcaacgcaacaagagagagagagaatcagatcttggcggactcgaatccaatccaatccaatccaaggcggaggtcgagatcaaagccaccggagatgaagttcttctcggcgttcgacccgtggccggtgttcttccgccgggagtggggccgcacctggcccttcctcgccggcttcgccgtcacggggaccctcatcaccaaaatgcccgccgctttaaccgggggggacctcaagaactccaagttcgtccaggccacaagaacaagtagtcggcggccggccgggccgttcggcggcaggtcacaagggccgcagctgagttaccggcatgtg

SEQ ID NO: 6169 - DNA, 431 bp, Triticum aestivum
  Clone ID: LIB3281-036-P1-K1-F12
cgcacgcgtgggggtgattcgtaatcaaacttgcaaagaacatccttacttttgatgatgtttgaaaagtaccaaggattgatcaacttagaccaccggttgatatttggttgcctttgctttgtaaccagtgagggctgaagtgaatgaatctggaagtgctttagcgattaatgctctgtcccaagttaagcatattctacttccggtcactggccgaaagccttacctttcagttctaattccttgagatcagcgcagttgagaatatagccattgcttaaacacaacaaacctaagcttagcatgaaagagagtatgaaagttctgatctcttcaaaatatgtgagggaccttgctaccttagttgttgcatatggcattagaaacaattgtgcgtgagtcacatggaaatcgaagctcaaggcaca

SEQ ID NO: 6170 - DNA, 429 bp, Triticum aestivum
  Clone ID: LIB3281-036-P1-K1-F2
cggacgcgtgggcggacgcgtggggtccatctgagagaacatttgtgagcatggatgttgcatttcgtgaatcggaacctttctagggtgaaaaaactgatctcggtgttatgtttgaaggccttgacccatctcaggttggtgaaattggtcaagagggggagagtaatagcacattagctcatgtgactcctttgacacaagcattgacctacaccggtgatgtgcaggtttgtgcaccgactcaaattgatagcgtgcctagaggtgtgccgaggtggacaacagagcaagaggagcacctaaaggtctattcacggaagcgaggtgatgatgttgtatcagctccgattggtagcgtgccgaggtggacaagatgatgttgcatctgctccgattggtagtgtgcttgaggggacaagatgatgt

SEQ ID NO: 6171 - DNA, 429 bp, Triticum aestivum
  Clone ID: LIB3281-036-P1-K1-F3
cccacgcgtccgcggacgcgtggggcacgacacgccggcgtggacgtcggacgccaaggcgcaggaggcgttcaggcggttcggggcgaggctggagggcatcgagaagcaggtggtggccatgaacggggacccgcggctcaagaaccgcaccgggccggccaagttcccctacatgctgctctaccccaacacctccgaccacacgggccaggccgaggggctcacggccaggggcatccccaacagcatctccatctgaggacctccatctctgcttgcttgcttgcttgcaccggatactagctactagctactgtgggtgttctgccggtgcatatgcttgccatgatctcaataataataaggcaataatgcgtgcgtgcacgacgggtccgatcggcatgcggtgcgtgtgcgtcgtcgtgt

SEQ ID NO: 6172 - DNA, 433 bp, Triticum aestivum
  Clone ID: LIB3281-036-P1-K1-F4
aaatcatagcacccggccggatctatccgacagccggagctctcctcgctctgcacagccatttttggttcgatcccggagaagctccggggctccttgaagcgatggatcagcgggcgaggcaccctcccggcatcggcaacggccgcggcgggaatcctaactaccacggccgtggcccgccgccgacgcagcagcatcaccagcagccgtcgccgccttcgccgcagcaggcgcaggggcacccgcagcagtacatgcagcggcagtcgcagcactcgcagcactcgcagcaccacagccagcagcttcagcatcagcagtggcttcggcggaatcagaccgctggcgaggccgcctcgggcgccgccagagccagcgagcaccacgcgccggctgccgccgatgacgccgatttgagttcgcaggactg

SEQ ID NO: 6173 - DNA, 453 bp, Triticum aestivum
  unsure (1)...(453): unsure at all n locations
  Clone ID: LIB3281-036-P1-K1-F5
accggtcggaatcccggggggcccacgcgtccgggtttttttttctgccgaacttacctatttcctttcttctctgccgccactgtaattctagaaagtgagatcttctaatcaagtgtggttagtccagataaaaaaagtagttagtccagtgattgcgtggcattgttgtctcctgtgcggcgccttttcgagtaaaacatcagtaatggagtattgcaatcaatttatgtgattttgatgatgcatgantgctgcaggcttgaacaagagtcgggcttttacttcaacgtcaagtactttgaggagaaggtccatgctggggagtgggatgaggtggaaaggtatctctcaggtttcaccaaggtggacgacaataggtattcgatgaagatcttctttgagatcaggaagcagaagtatttggaagcgcttgataggcatgatagagcg

SEQ ID NO: 6174 - DNA, 396 bp, Triticum aestivum
  Clone ID: LIB3281-036-P1-K1-F6
cggacgcgtggggcgaaagaaaaagtgagacctcatctctttcagctaagctcgcaatggagctcccatggggtgccctgctgctggcgctgctcaccgtctccgcctcctccgccgtcgccacgctcgccgtcaccgctccccctccggcccctgcccgtgctcctgcccccgtcaccgcccctgccccggcccatgcatctcctcaagctcaggacgctgaaggtctgctgatgaacggcaacttcgagacggcgccgaggaaggtgaacaagaccctcatcgtgggccgccactcgctgccggggtggacgctgcggggccacgtcgagtacgtgtcggcggggccgcagccgggcggcatgttcttcgcggtgccgcacggcgtgcacgcgc

SEQ ID NO: 6175 - DNA, 321 bp, Triticum aestivum
  Clone ID: LIB3281-036-P1-K1-F8
gggccgccgtaagggtgatgacagtctcattaacccttccttcagcatcggtctggaagaatggaggctcatgtgagagcagacgatgattctattttctatataggcatgggctcatagcgggggctaggtctggctaccatgacgcgggacaacgttatgaggagccggacctgaaacgacgtccttgggtcaccgattagggagggagcagaccagaaatgcagcattcgtttctcaaaattataggtgaaaattattgatctatctgagagaaagaacacgttacgcgtgttgcgaggatgtgttgattcatgaaaa

SEQ ID NO: 6176 - DNA, 429 bp, Triticum aestivum
  Clone ID: LIB3281-036-P1-K1-F9
attatatcattggatttgtatttgaacgtactccctccgttcctaaatactccctccgtcctaaaattcttgtcttagatttatctagatacggatgtatctaatattaaaatgtgacttaatacatctgtatttagacaaatctaagagaagaattttgagacggagggagtataagtttgtgtaaagattccactatggactacatacaaagcaaaatgagtgaatctactctaaaatggtagtccatagtggaaacttatatttaggaacggagggagtagtttccaatggtataatttttggtggcatgcatttacaatttgttagttaaatttatgattaaaatttgacactaaatacgaagaaccaataaaccaggatggaggtagagtactgagtatgggagggtaagtagtattgttccat

SEQ ID NO: 6177 - DNA, 400 bp, Triticum aestivum
  Clone ID: LIB3281-036-P1-K1-G1
ctccggccggcctcagagcgagcgagagagagagagagcggccatggcggggaaggggagcaagaaggacatcgattccgtcctcatgcaggccatgctggccgccaagacggtgcgggcgcagcgcgaccgcctcctgcagctccagcaccgcctgcaggacctccaggccgacgccgcccccgcccccgccgacgccgacgccgacgctaagctcggggagctcgcctccaacctcttcaaggtctactacatcggcctggaggccggcgcccgcatgctcacgacctgcatcgagatcgccgccaagaagggcattcacttctccccgcccaacctggctttcgcggtcatgcccgacgagcagctccacgacgcgctgctcgcgcagcagtttcct

SEQ ID NO: 6178 - DNA, 216 bp, Triticum aestivum
  Clone ID: LIB3281-036-P1-K1-G10
accacatccgccgcacacgcacacgcgcctagagatggagtgagaagcatcaggttgcttccgccgccggccattgccgcctgcccatccatctccaccgccacctccacctccgtcccccgtccgttcgtcatgcgtacaagccatcctcacacctgacacaacccacactccacaaaaccacccccgacccccctccttccttgaattaattcc

SEQ ID NO: 6179 - DNA, 322 bp, Triticum aestivum
  Clone ID: LIB3281-036-P1-K1-G11
atgcagacaacctttgatgaggctccaaatcgtcttggttcattcaagaaccagtttcaggatcacagttatgctcgtcagttcgcagacccatacttatttatgcatcagcaaccttccttgactgttgaatcaagtagaaagatgcacacagagaacaatgatttacatttctggaatgggccgagcaccgtgtacggcaattcaatagaccaagcacaagatttcaggtttaaagaacacccatcaaattggttaagcccgcagttctcccgggcagaacagccacgagtgatcaggcctcacgcatcaatagctctta

SEQ ID NO: 6180 - DNA, 249 bp, Triticum aestivum
  Clone ID: LIB3281-036-P1-K1-G12
accacgcgtacgtccactcgtgcggcaaagcgcaccggcgcatacacatttcgggtggtgtacaactcgccggagacgcagcatgcaagaagatggcctgtatgaaggtcggcgaccgtaataaggtggtgactcactccgagaaggccacgctccagttactggtctaccgtattgggctctacctcaagaagggcctatacacccagcgcgtcaggtccggcacccccgtctacctgaacgccgatc

SEQ ID NO: 6181 - DNA, 375 bp, Triticum aestivum
  Clone ID: LIB3281-036-P1-K1-G2
gccgccgctcgcagctccctcctgcgcgagctcctctcgcgcccgcaagacgcctcgccggcgaccccacacctgcgccacgccccgccgccggcgaccttccccgctggatctccgacctccatggtgtcgttggccttcaatctcgctggatccggccgcctccatgccaaatccaccggaaatggatccaccccggccagatctgcccggatccaaccgggccccgccgtcgtcgccaccggagcgccgccccgaaattttggttcagactgctcttcaatccttgctgatttgtggttttgagacccacccaagcagggctgcgctcaagagaagaacctgctgttcctggaggcctgacagacagccgat

SEQ ID NO: 6182 - DNA, 202 bp, Triticum aestivum
  unsure (1)...(202): unsure at all n locations
  Clone ID: LIB3281-036-P1-K1-G3
atcctccctttccttccctttctttcaccttacgtnctcacccaaccacctgataggcgtgggttcggcggcttggcttcgnctgcgccagttggagtaaccctcgcggtctgtccgtgtttgaaggtaagggcctaaggttggccccgttctcgagccgagattgggccggggaaggtgcaacttaagcggatccagaaca

SEQ ID NO: 6183 - DNA, 161 bp, Triticum aestivum
  Clone ID: LIB3281-036-P1-K1-G5
cccacgcgtccgggtttgttgagtgatggaggcgttcactcccggctagaccaagtgcagttgattgtgaaaggtgccagtgagaggggagcaaaaagaattcgccttcacattcttactgatgggcgtgatgttttggatggcagtagtgttggtttcgt

SEQ ID NO: 6184 - DNA, 341 bp, Triticum aestivum
  Clone ID: LIB3281-036-P1-K1-G6
gcccgaggcttcctcccgcgccgaaaccctagcgaccggagcgctcggcggcggcagcgcatggcggacgacgattacaatgaagttgacatggggtatgaggatgagcctccagaagctgatattgaggaaggggttgaagaagatcctgagaacaatgaggatgcccctgatgatgtggtagggggggggggtgaaaaaagggaccaggaaaggcctgcccgtccccccattcaacaaaatttttttcccagttttgggcggccccccatctttggtccacttgctttgcagataagcatgaatgccccagttatgggtgagcttgagggcgaaactga

SEQ ID NO: 6185 - DNA, 428 bp, Triticum aestivum
  Clone ID: LIB3281-036-P1-K1-G7
ccgcttcttcgcaatggcggcgagatctccgctccactgagcaagccaccggcctccgtacaggcgtgcgtctcccagttcggcagaaacctcggtggcaggcgcggccgaccggcaattgccctcccaacaggagatggcgcacgtttcgttcaaatccaaggaggtggacagcgtgccccggtggtcggaatacctgaccgccgaggagtcttctccctcagcgtcagcaagctggaggaccatgggcgtcgacgggcctcaaccctcgtcgagtggccagaggcaccttcagatggagccagtggttcagctctccaaggtcgcggaagggctgctggccaagatgtacaggctcaacagtatcctggactacccagatccaaacacgcacaccttctcggaggcattttggaaaactggtgtta

SEQ ID NO: 6186 - DNA, 358 bp, Triticum aestivum
  Clone ID: LIB3281-036-P1-K1-G8
ccagcagcttctcccccttccccactatacttccaagcaaaggcgagaaccctagcctcacgagcaccgtgcagcggagatcccgaccatcaccgcgatgcaggccccgacgaacccccccgtcgacctcccgccgctggtggcgccgccgccgcgggtgaaggcgccgaccccgcgcccccctccgccggcctcgctccagcccgactccccgggcgtcttcttcaccaacgccgccgcagccgccccactgggctccgcccaccgccgcatcgccatcgccgtcgatctgtcagacgagtccgcctacgccgtaagctgggccgtcgccaactacctccggcccggggacgccgtc

SEQ ID NO: 6187 - DNA, 65 bp, Triticum aestivum
  Clone ID: LIB3281-036-P1-K1-G9
aaaaaaaaaaaaaaataaaaaaaaaaaaaaaaaaaaaaaaaaaaaaaaaaaaaaaaagggaaaaa

SEQ ID NO: 6188 - DNA, 413 bp, Triticum aestivum
  Clone ID: LIB3281-036-P1-K1-H1
cggacgcgtggggtcgaggtgctcaggactgacaatggcacagagtatgtgaacaacaggtttggggctttcatggctgaccaagggattcttcatcaaaccttttttttttttttttcagaaaaaggcacctgttaggtaaactatgtctccaaagagttacaagactgttgtgctccgcgcatataactcgaccgaaaaacaaacatcagtccgacaacaccgacatgacacacgcaacacgttaaaacgctctgcctctcctcagcgagccacaagctcagctactctgagctgctttactccgcagcgagtcccgccacagtgagccagcaccacaacaagagtgcgggggggctcagtagttggcgtgctgctgccagctctggtgagatggctgctgctgctgctgc

SEQ ID NO: 6189 - DNA, 393 bp, Triticum aestivum
  Clone ID: LIB3281-036-P1-K1-H10
cgcggacgcgtggggcactagttgagaaagcaaaatacatctacattgctggctttttccttacggggtcccctgaatctattcagcttgttgctgagcatgctgctgccaataacaaggttttcttgatgaacctctccgctccctttatctgcgagtttttccgtgatgcccaagagaaggttcttccgtatgcggactatatctttggaaatgaaactgaggcaaggatcttctctaaagtccgagggtgggagactgagaatgtcgaggagatcgcttagaatatctcacaactgcctctggcttctggaaaacaaaagaggattgctgtgattactcagggtgctgatccaatagttggggcccaggatgggaaaggaaaaacattcc

SEQ ID NO: 6190 - DNA, 443 bp, Triticum aestivum
  Clone ID: LIB3281-036-P1-K1-H11
gggtatctggacacctgctctgaaaaacaagataatttatgaagatggttctattcagaagatggaagaaatcccagatgatcttaaagcaatttacaagactgtttgggagattaagcagaaaactctggttgacatggctgttgatcgtggatgctacatcgaccagagccagagccttaatgtccacatggatcaaccaaactttgcaaagcttacttcgttgcatttccatgcttggtccaagggcctgaaaactgggatgtactatttgagaacaagggcagctgctgatgcaatcaagttcactgtggatactggctttctgaaggtcaatggagatgctaatggcactaatggcaaactagcagaggaagacgacgaagccaaaatggcgcaggtcgtctgctccttgaacaaccgggaagaatgcctggcatgcg

SEQ ID NO: 6191 - DNA, 282 bp, Triticum aestivum
  Clone ID: LIB3281-036-P1-K1-H12
cccacgcgtgcgcggacgcgtgggcgatggcgaggaggtgactaaagttgtgccggcggtcacccctgaggttaaggatgccctgaacaagaacataaggaggggaatgacaccacagcctcttaagattcctgctgttgttgagatgaaatgcttccagtttgacggtggtctccacattaaggtagcacatggggcaagctgactctgctggaaacgctgattgccctgtgtagattaagctcgatgctcctacgcttgatgttttgaccacacagacac

SEQ ID NO: 6192 - DNA, 434 bp, Triticum aestivum
  unsure (1)...(434): unsure at all n locations
  Clone ID: LIB3281-036-P1-K1-H2
cggacgcgtgggcggacgcgtggggtgcatgtcccacccgtcgtcatgcccatgccaacgccgatgcaggtccagaccccgccgccgccaaagaaacctcgacagcacctcccacccccgccgacgggacaggctacacagcagccgcagccgcagcctcagcccataccagctgcgcccctccaacagcaaccgccggcgcaaccaccgcagcacaaggaaacgacgcgcgaagaggtcgggacgccccgcagcgcaccggccccgacttctgccggcttatcactcgcgctggttcccgtcgccacggagcagcacgtcgtcgaggccgctggtctgggaagaggggagagcggaggggggccctcgtcgtcacggtggcccaagacggaggtgcacgcgcttatccagctncgcatggacatggacaatcg

SEQ ID NO: 6193 - DNA, 335 bp, Triticum aestivum
  Clone ID: LIB3281-036-P1-K1-H3
tgtccatgtctctctttgcttattttcccctgcatcggctctctcttctcgatctcttagcagcagcttgtccatggaggaggccgcacccgcactccggcctctcgggctggtcggtatcttccacgaggccctccgcgtcgcccgctcccaccccccaagctctggcttggtggcccgcccaggtcctgtgctcaccaaggtccttcttcgccaaaatggccattggcccggcctttttccccaaccccttggcttcttcaaacgccggggccggcttcttcgtcttggcgggaactgggcacccttcttcctcgtagaggcgggctttcacc

SEQ ID NO: 6194 - DNA, 100 bp, Triticum aestivum
  Clone ID: LIB3281-036-P1-K1-H4
accatgcctctctttgcttattttcccctgcatcggctctctcttctcgatctctgagcggcagcttgtccatggaggaggccgcaccaacactacggcc

SEQ ID NO: 6195 - DNA, 319 bp, Triticum aestivum
  Clone ID: LIB3281-036-P1-K1-H5
cggacgcgtggggcactagttgagaaagcaaaatacatctacattgctggctttttgcttacggtgtcccctgaatctattcagcttgttgctgagcatgctgctgccaataacaaggttttcttgatgaacctctccgctccctttatctgcgagtttttccgtgatgcccaagagaaggttcttccgtatgcggactatatctttggaaatgaaactgaggcaaggatcttctctaaagtccgagggtgggagactgaaaatgtcgaggagatcgctttgaagatctcacaactgcctctggcttctggaaaacaaa

SEQ ID NO: 6196 - DNA, 241 bp, Triticum aestivum
  Clone ID: LIB3281-036-P1-K1-H7
cccacgcgtccgccaagactgacttttagtgctacatacgagtaaggcttaaagataggttcaactattgatttggagatggcacttgaactggagtaggaaagctgttggcccatcagactttgaggctaaaccaataagactatgaccgcgtccagtatattaacgataatgatgtagcgaattttcgagactagccagtgagtaaaggtggaatgacataacattgtggagtgggatc

SEQ ID NO: 6197 - DNA, 416 bp, Triticum aestivum
  Clone ID: LIB3281-036-P1-K1-H8
cccacgcgtccgaatcttcagaacttggagtgctgcctttttgttctcttcccatacttctccagaaggacttggcttgtcaggaattgtttctatactattcacagggatggttatgaagcactatacgtactctaatctgtcagataactcgcagcgctttgtttccgccttctttcacttgctatcatctttggctgaaacatttgtcttcatttatatgggctttgatattgccatggaagagcatagctggtcacacgttgggttcatcatcttctcgattatatttataattgttgcaagggcagcaaatgtcttttcttgtgcctacttggttaatatatcgcggccagaacatcggcgtatacctctaaatcatcaaaaagctttttgttttagtgggcttagaggag

SEQ ID NO: 6198 - DNA, 275 bp, Triticum aestivum
  Clone ID: LIB3281-037-P1-K1-A1
cggacgcgtgggcttgtttcggtttggagttggagacagtaacttgcaaccgaataggttgtaagtaatgcacttaggttttcagaaggtcaacatattcagtttcggcacagacgacacaagcaaagcttgaacagggtctgtattgcatcaaaggggggctgaatgatggttcttcaatacaagtccatgcatagcaagctatgcttgtgacatatcagaactgctttttctatgtttatcggtactcaacttatattaaaactacacttttg

SEQ ID NO: 6199 - DNA, 310 bp, Triticum aestivum
  Clone ID: LIB3281-037-P1-K1-A10
ctgctcgtcttccacctcggcaccgtattctggggcgatgtcgtcgagcggccgtcgtagggtgctcgtcgatctatggatttggcgggcttcggtggcctgggctaggtcgtggcggcggaggtgacgacctggctgtggcttttttgtcccctgtctccgacttcgcggcggtgaggtgggctccggcctcacagtggagtttctgggggtggttctggagttggagacgccggtgcgcgtccttgctttctctggcttgccgtggtggcagggggaggagcaggcctgcctgcgcgcttgacaaggt

SEQ ID NO: 6200 - DNA, 313 bp, Triticum aestivum
  unsure (1)...(313): unsure at all n locations
  Clone ID: LIB3281-037-P1-K1-A11
cggacgcgtgggcggacgcgtgggcggacgcgtgggcaaaaattcctctcttgagcaacgctccctccctccctctcgaatctgattcatcacaagactatcaacagacaacatcctacctccagaatgtttggggcccctaggtatttgactgaatagcacgggctcgcgtgtgtatgtcaccatgacaatactgcacttcaagatttcataagtttaatctttagttctaacattatctnttgtgcagataaggatggcagtagaagagcttgacgacaatgaatgacaaccatatggacatttttttagt

SEQ ID NO: 6201 - DNA, 334 bp, Triticum aestivum
  Clone ID: LIB3281-037-P1-K1-A12
cggacgcgtgggcggacgcgtggggctccgcgtcgagcaggggtcgctcaccggcgagaccaactccgtcaacaagaccgtccacgccgtgcccgccgaggacgccgacatccaggccaaggagtgcatggtgttcgcgggcaccaccgtcgtcaatggctccgccgtctgcctcgtcgtgcacaccgggatggccaccgagatcggcaagatccactcgcagatccacgaggcctcgcaggaggacgacgacacgccgctcaagaagaagctcaacgagttcggcgaggcgctcaccaagatcatcggcctcatatgcatccttgtctggctc

SEQ ID NO: 6202 - DNA, 356 bp, Triticum aestivum
  Clone ID: LIB3281-037-P1-K1-A2
gcttggaggctctgatgctgatatagtgctgaatacaattattttcaactcattcgtcttctgccaggtgttcaatgagataagttcgagggagatggagaagctcaatgtgctcaagggcatgctgaagaactatgtcttcatgtgtgtcctcagcagcaccgttgtcttccagttcatcatggtccaattcctcggcgagtttgccaacacgacgcctctcaccagtctccagtggctagccagcgtgctccttggcctcgtcgggatgccgatcgccgttgtcgtcaagctcattcctggtgggtccctcttgtgaaaagggcaacccaccatgtgaaggaggtgtggcgaaa

SEQ ID NO: 6203 - DNA, 205 bp, Triticum aestivum
  Clone ID: LIB3281-037-P1-K1-A3
cgtccgacctaggactacaggttagaaatggcatccacgattggtgacgatgtccttactgtgccaattgaggagttgattgaggacctaacctttgttgatgatgaggaggaagaggaggaagacggtgcaaatgctggtatggtggaatgagcgagcatgtctacctacaccataggtcatgattgttcatgcccactgcagg

SEQ ID NO: 6204 - DNA, 181 bp, Triticum aestivum
  Clone ID: LIB3281-037-P1-K1-A4
gcatggaaggcgagggcctaatctgccacgaccatgcccagctctaacacagcatccattatcgtgcgctgaaccaagaagcgaccacgggcgaacggattgcattacacgggcagctactctattaacaccaccgcatgttatgacatgaacggacgcacacggaacaagatctagaacg

SEQ ID NO: 6205 - DNA, 416 bp, Triticum aestivum
  Clone ID: LIB3281-037-P1-K1-A5
ccgaactccaaaccctagtagcgccgccgccgccaggtaagaggcgagatggtgtccggctccggcgtgtgcgccaagcgcgtggtggtggacgcccgccaccacatgctcggccgcctggcctcgatcgtcgccaaggagctgctcaacgggcagcgcgtggtggtggtccgatgcgaggagatctgcatgtccggcggcctcgtccgccagaagatgaagtacctccgcttcctccgcaagaggatgaacaccaagccctcccacggccccattcactttcgcgccccggccaagatcctctggcgcaccatccgcggtatgattccgcacaagaccgcgaggggcgaggccgcgctcgccaggctcaaggcgtacgagggcgtgccgtcgtcgtacgacaggaccaagcgcat

SEQ ID NO: 6206 - DNA, 320 bp, Triticum aestivum
  Clone ID: LIB3281-037-P1-K1-A6
cccacgcgtccgcccacgcgtccgcggacgcgtgggattcagctcaatcccagacgtgatacttaatggaaactcattcctgaatggacctgctcctacaccaccacctttgatgccaccaccccctagaaggccgcgcagtcgttctaaccgttctgggggaagtggaaatgctccaaaaggctctgagagctccactagtcaaggtggcaagaatggtctgcagacagcttctcttgtggggataattgttggctcaatacttgctgctttgtgtgtgcttcttcttttgggattatgcattcgcaaatctcgggaaa

SEQ ID NO: 6207 - DNA, 176 bp, Triticum aestivum
  Clone ID: LIB3281-037-P1-K1-A7
tataaatataattatatataaatgtgtatatgtaatatataaaagtattgatttgtgacgcacctaatacatgagatgccaggtgtacaatgagataagttcgagggagatggagaagctcaatgtgctcaagggcatgctgaagaactatgtcttcatgtgtgtcctcagcagaa

SEQ ID NO: 6208 - DNA, 308 bp, Triticum aestivum
  Clone ID: LIB3281-037-P1-K1-A8
gtttttccctccccctgacacaaaaaggcgaaatctttttttgttaattaggaaaaagaaagagcgcgtgtgaactggcgagggtgggaaaaggggggatatattggaggctgtaggcaggaaattatgggagctgggtaggagtagctggaaaattctgtgaattcgtccttctctccctcttgtgatcttctccgtttgtagcgctggagtgagctcgtgatgtctccattataggacggaggagtgtgcaagtgtgcttcttcctcttattattatcatttcttttctgtttgcaccccaaatat

SEQ ID NO: 6209 - DNA, 179 bp, Triticum aestivum
  Clone ID: LIB3281-037-P1-K1-A9
gcgatccatggacgccgaggccggcgccgccgccgcccagcagcttccgtggaggcagcactacaggaatctactactgctagcataccagagcttcggtgttgtttatggggacctaaacacattaactttggattgggattaaaagtccattttaaggagggttccggcggtcccaa

SEQ ID NO: 6210 - DNA, 315 bp, Triticum aestivum
  Clone ID: LIB3281-037-P1-K1-B1
gcgtggggccaggcctaaaaaggtctgtactagttggtgagacaggggtcagagaggttgctgcttacctccttgaccatggcaactttgcaaatgttcctccaaccatgctggtcaagatcacacacagtgtgttcaatgtgaatgccactgttggctgcaatcataagatgttccacaacaaatcacaggctgtgagcaagattgcatcattgcagcagttcatccctcatgattttgatgccagcgaccatgggacatcaagcttccctgtatcttgtgggcaccggattcggcattcttgacatcagaatc

SEQ ID NO: 6211 - DNA, 117 bp, Triticum aestivum
  Clone ID: LIB3281-037-P1-K1-B10
gagagagagcatgggatcctgtatgtaatgcctggtctggagtccgaactggtagtagtctgtagcgtcgattgatctcgaatcacttctgaattgaagctggaaacttgatcgttt

SEQ ID NO: 6212 - DNA, 306 bp, Triticum aestivum
  unsure (1)...(306): unsure at all n locations
  Clone ID: LIB3281-037-P1-K1-B12
accgtgtggtggactccccttgctgtctggtgactggcgaatatgggtggaccgccaacatggagaggatcatgaaggcccaggccttaagggactcgagcatggctggctacatgtcgagcaagaagaccatggagatcaaccctgagaacgccatcatggacgagctccgtaagcgtgccgatgccgacaagaacgacaagtctgtcaaggacctcgtgatgctgctcttcgagacctccctgctcacctncggctatagcctggaggaccccaacaccttcggcaccaggatccaccgcatgc

SEQ ID NO: 6213 - DNA, 85 bp, Triticum aestivum
  Clone ID: LIB3281-037-P1-K1-B2
cggacgcgtgggccctcacttgtcgctcgctcagtggtcgtcgttcctgcaccgcccggtagcgggcgcagcagctgccgctgcc

SEQ ID NO: 6214 - DNA, 197 bp, Triticum aestivum
  Clone ID: LIB3281-037-P1-K1-B3
cggacgcgtgggttttcttgcgttccggtccccagacttcgagttatttccctggtcaggcgcgcgcgcggcggaggcggcggcggaaggtacgagtcggcgctctcgcgagctagggtttcgggccgaggaggaggaggagcgagatggatgaggtgacggaggtggtcaagaacctggccgtcacggagccgcac

SEQ ID NO: 6215 - DNA, 66 bp, Triticum aestivum
  Clone ID: LIB3281-037-P1-K1-B4
attcccggggaagagagagcatgggatcctgtatgtaatgcctggtctggagtccgaactggtagt

SEQ ID NO: 6216 - DNA, 370 bp, Triticum aestivum
  Clone ID: LIB3281-037-P1-K1-B5
cccacgcgtccgcccacgcgtccgcccacgcgtccgctcgaagatctaagctgctgctgctgctgctgctgctgctgctgctgctgctgctgctgagagacggcccatcaggtttcgtcttgtcggtaggtatatcttttgttgttgagtcctttttcctgtaggggaggaactgcctgccgtttaatttttattactcgagtaatgagtctgtctgtggtgtatttattttctacaaggaggtccagccggtattctctccactagttccatgtgattgatcaaccctggagggaaaccaccactgttatttgtcggatttcgccatcctgaattttatatagcatgaagaaataaaatacgttttcac

SEQ ID NO: 6217 - DNA, 372 bp, Triticum aestivum
  unsure (1)...(372): unsure at all n locations
  Clone ID: LIB3281-037-P1-K1-B6
cggacgcgtgggcctcgagataaatttggacaccggcaagcccctctcagtaaagttacaccaagtctctcctttgtttgattttggttccagctttgatcgggagcaccaaccgcgagctgggagaaagcccaaagaactcgaggaagaagtgaagctcctcattttctgtgaagaagtaccttgagactgtccgtgaggaagacacgctgaatatcttgcttgattttgttccccgcccactgcacgccgctgtcgagaacacctctgctacctcctcccaatctccgccacaagattctccgtccagatcctgggcgaggaataaaaaaattagttcttgaagcttctncatcatgccggacggacaac

SEQ ID NO: 6218 - DNA, 328 bp, Triticum aestivum
  Clone ID: LIB3281-037-P1-K1-B7
cggacgcgtgggcggacgcgtgggcggacgcgtgggttttttttaaacagaaaaaagaatggtattgtacacaagcagcagagtcagaaattacagtgagggggcactgtgataacacaaacaggtgaataccactattttacaagggctgacagacaggcccccatcaaataaagtttactcctcctttggccactccattactttgcaacatgttgggaaaaagaaactagacacagggaaagaatacctagtacaataacactatcatcccctttttgcccctccaatctggcgacaaaacaacatacaacccaactatttggcg

SEQ ID NO: 6219 - DNA, 272 bp, Triticum aestivum
  Clone ID: LIB3281-037-P1-K1-B8
agaagcctcaccgttaccgccctggaactgttgctcttcgtgagatccgcaagtaccagaagagcacggagctgctcatcaggaagcttccattccagaggcttgttagggagattgcccaggacttcaagactgacctccgcttccagagccatgcggtgctggcccttcaggaggctgcagaggcctacctggtgggtctcttcgaggacaccaacctgtgcgccatccatgccaagcgggtgaccatcatgcccaaggacattcagctg

SEQ ID NO: 6220 - DNA, 341 bp, Triticum aestivum
  Clone ID: LIB3281-037-P1-K1-B9
cactgattggctggccctcgagcgtgcccaagtttatttccgagtccatttacgcagctacctgtatcattcggatcataagatgtactagggtcggttgcactatgtgaatcataagatgtggtaggatggtgctatgcgaagcgtgtcgagctgaagtacctagtggactacagtcatgaggacggtcatgtggacatcgtcgcttcttagttcattagcagatttcaaactatttcctgtattgcagcacattattagtattgctgtattagcaattttcatggcttggtgatgattgatcatacttggcgtcaagcacccccaaagcttgcctttct

SEQ ID NO: 6221 - DNA, 452 bp, Triticum aestivum
  Clone ID: LIB3281-037-P1-K1-C1
cggacgcgtgggggagcgaacatcgacccggcggcctgggaggacaagaagtgcaacggcgagtctcgcttccctgcacaggtaacttcactcgccatggcatccgtgtcaaaaacgttcttatactatgcgacagagggggtattaagttgatatcaatataattctacgaacataagttgctagagatatgaactggcgaggcagttgcaaggctagcttgatccggaaggagatgagatcaatgactagtaaaagcaatcgatcaattagttttatctttatattgaacagatggatgttgttgtcttgtttagttggaacctagtagatcgtcggcataaaactttgctagtgactgtccaacaacctcacctcgattaggtttggttggccggtcaatcctaggccaaccacctgttcttctagaactagcacacttgccaacacac

SEQ ID NO: 6222 - DNA, 153 bp, Triticum aestivum
  Clone ID: LIB3281-037-P1-K1-C10
cccacgcgtccgctctaatagaactctgctatccagagcgctctcaatactgggccggattctaattgacaaatcttatgtgtaaaccatttatctcgtatccacgcacgatgtgtgaatttccctgaacctgccaccatgccgtttaccacc

SEQ ID NO: 6223 - DNA, 352 bp, Triticum aestivum
  Clone ID: LIB3281-037-P1-K1-C11
cggacgcgtggggagttcttcacccgcaatgggcgctggaatattgcgaggaagaagctgattaggaccagctctgtcaagaggtggtccgtcgtcaatttctctgcacgctgtgatcttcgtggtcttgtccaagaccttaaaagggtcgcgactggaatgggactcgaatatgaggaccctcacactgtaattgaagagagcccgtcactgagacgagctccggtggcacgaagagtggaggagattttgcccagataaaggccaagctacctggagcacccttgttcctcttgtgcctcctccctgagaggaagaattgcgaagtttatggtccttggaagaaaaagtg

SEQ ID NO: 6224 - DNA, 373 bp, Triticum aestivum
  Clone ID: LIB3281-037-P1-K1-C12
cggacgcgtgggcggacgcgtggggaagcacccaagccccagtcagttctcagccctgtagctgctccacagagagaggcgagaggaagccaggtaggaggctctgctgcaaagggagatggccgggaaaggaggcaaggggctgcttgcggcgaagacgacggcggccaagggcgccgccgacaaggacaaggacaagaagaaggcgcccgtgttccgctccttccgcgccgggattcagttcccggtgggacgtatacacaggcagctcaagcagagggtctcggctaatggccgtgtgggtgccactgctgctgtgtactctgcagcaatccttgagtaccttactgccgaggtccttgagctggccggc

SEQ ID NO: 6225 - DNA, 361 bp, Triticum aestivum
  Clone ID: LIB3281-037-P1-K1-C2
cggacgcgtgggtacttacacatgatttatgaagaatactgataaagttacattgggaaaggtggaaagatctgtctaggctgttaagactgcggttcatatgttagaaagtggtgcggatatagaagaggccacagatgtatgctcaccatatgaccttttccaacttgcaaaatggaagaacaaactgaatatatatcttgccccgtttcttcatggcacgcgctatacatcttatgggcggcattttacaaaactggacaagctcgagaagattgtagataagttacaatggtatgttcaaagtggtgatacggtcgttgacttctgctgtggttcaaatgattttagcacattattg

SEQ ID NO: 6226 - DNA, 416 bp, Triticum aestivum
  unsure (1)...(416): unsure at all n locations
  Clone ID: LIB3281-037-P1-K1-C3
gacgccacgcgtcaggtgttcgtccactcgaaaccttagctctatttctcctataggacagcgtcgccgccgccatgtcagggaggaagaagacccgctagcccaaggaggagaacgttacgctcggccccgccgtccgcgagggggagcacgtnttcggcgtcgcgcacatcttcgcctccttcaacgacaccttcatccatgtcacggatctgtccgggagggagacgctcgtccgcatcaccggtggcatgaaggtcaaagctgatcgtgatgaatcatccccttatgcagctatgcttgcatctcaagatgttgctgtaagatgtaaggagccttggaattactgctctgcacattaagctccgtgctactggtggaaacaagacaaaaactccaggtcctggtgctcaagc

SEQ ID NO: 6227 - DNA, 361 bp, Triticum aestivum
  Clone ID: LIB3281-037-P1-K1-C4
cggacgcgtggggagggcctactctcacctacatggaaactccaggtttttccttgttgattgtgtggctgccgatggtttaggttccaggatgcttttggtgactcttgtggctgcgtgctcaacatgaccacgtttcgtctcagctacgatcgtgagggaaatctgcaaatcaaagacaggaaaactacctcctgttgcgtgtctaagcaactctcgtccttctccccagtggccttctggatgtagctacagccaaggaaattgctcgtgctgttttttatttatttagcttgatgtcatgcatactagctatgttcatcgtcctatctgtaaattactccctccatttttctatata

SEQ ID NO: 6228 - DNA, 281 bp, Triticum aestivum
  Clone ID: LIB3281-037-P1-K1-C5
cggacgcgtggggcagccgtcctttctcctggtcaccaaccccacggtcgtggtctcggggcgcgtcgccacaggaggtggaggcgccctggacgctccgatggccacgccggcgttccggctcttcatgagccggatctacgagtcggagcgccgctcgctgaactaccgcctcaattgggcgaagatgacctagtgttcggtcttttagcggccggactccctctccgacgccaccttccggctgcgccgtaaccttacctacttgcgcgtgaactaca

SEQ ID NO: 6229 - DNA, 315 bp, Triticum aestivum
  Clone ID: LIB3281-037-P1-K1-C6
cggacgcgtggggaaaaatttgctataacatcagggtagccactcaaatattacataggaagcatacattggatttgaagaggccccatttgtcttccatgctaaagttggcaggtggctgccgtgcttaggctgtatggggtctgagacgatccttgacaatacaacagaggggaactcaagtcgactgtctatgcaccctctggataatgtgttcccctgtcttgttttatttgtttgagcatcctcaacgatatacttgggtggtattgcaatcttctataactttccacctgtaatcatatgtaatatgta

SEQ ID NO: 6230 - DNA, 340 bp, Triticum aestivum
  Clone ID: LIB3281-037-P1-K1-C7
cttggactatggaacaggcaccggggtgttgggtattgcagctctgaagattggtgctgctctatccactggtatagacatagaccctcaagcagtgagctccgctcgtgagaacatgctgctgaatggtatggattctggcagaatgctggttcacttggtaccgacaggcgccgagccttcatgcttctcaagtagcatcgacaaatcagaagaggaaaagcccggcagtaaccttgagctgaagtcctcaaaggggacgtatgacattggtgctgcaaatatactgctgaaccccttgctggagctggtcgaggacatagtcggatttgcgaaaacc

SEQ ID NO: 6231 - DNA, 395 bp, Triticum aestivum
  Clone ID: LIB3281-037-P1-K1-C8
cccacgcgtccggcaaggttgaacacttatttgtggtgccaggttctgcgaggcaattcaaaattgttctagattttcttggattggtagagaaattttactacctttcgggaacatatgacctcgagctttcagttggtgatgcttcaatggaaaattcgttcctacgagcccttggccaattggagttggacttgccggaggccccagaaaaggccccacgtcctccggcacaagctgttgacccgttagcaaagtttaggccacagaaggagatagaacacatattccgtgtgccagagaagaggccaccgcaagaagtctcccttgcatttactggcctcacgctcctccctttcattgggttcttgattgggcttatgcgtctgggagtc

SEQ ID NO: 6232 - DNA, 404 bp, Triticum aestivum
  Clone ID: LIB3281-037-P1-K1-C9
cccacgcgtccgctctgctggatgtcgcctaagcagaggatgcggcagtctcggccacatttggttttcctaagctaatgtggggtttctttcccttgtattcttgcaagatgtggttctttgttggttcgttcgaccatgccgttaaccaacaaggttaggtctactcagattgccttgggttattacttcttgataatataggccgtgaactcctgcatttgtgcggctaggttgcctgtctatgtgtttcggggttcaccttattatgcttgtcgtgctttgtatgggttttccttcagatcttgttagaaaaaaatgtgttcttgaatacttatgcttggcctggtgggtttctttctgggtgattgtgtgcttatatgccattggtcgatattcatgtt

SEQ ID NO: 6233 - DNA, 359 bp, Triticum aestivum
  Clone ID: LIB3281-037-P1-K1-D1
cccacgcgtgcgctcggtcattcctctctctctctcccttgcttggggaagaagaagaagaagaagagagggcaagcgcccccgcctcccgacgccgtcgtccctcgccgccgatctgatctcaggagccagcgaagatgcattccaccaatctgctcctcgaggagcccatccggatggtctccatcctcgagccatccaagccgaacttcttcccggcgatgacgaagatcgtggggacgctgggtcccaagtcccggtccggtgaggccatctccgcctgtctaaaggccggcatgtctgtggcccgtttcgatttctcggggggggatgccgcgtaccaccaggagacactcgag

SEQ ID NO: 6234 - DNA, 365 bp, Triticum aestivum
  Clone ID: LIB3281-037-P1-K1-D10
cccacgcgtccggcacccgacccccccgatctggttgaatccgtccaatccaaggagcactcgcaatcgcaccggcggcggagatgggcggcgaccatggcggccacggcccgagcggcggcgacttccggcagaaggtgtggagcatgacgggcgggccctattgccggcccgtccactggcgccgcaacaccgccatcgccatggtcggcatcttcctcgtctgcatccccatcgccatgaaatccgccgagctcgagcaacgcccgcaccacccagtccggccaatcccatcccagctttggtgcaagaactttggcagaagagtactgaggatgtccgacttcacagaaagcatctttact

SEQ ID NO: 6235 - DNA, 389 bp, Triticum aestivum
  unsure (1)...(389): unsure at all n locations
  Clone ID: LIB3281-037-P1-K1-D11
gaaagacccagttacaaatgagtttgtccttgagggaggggcactggtactggcggacatgggtatctgtgcaatagatgagtttgacaagatggaagagtctgacaggacagcgattcatgaggtgatggagcagcaaacagttagcattgccaaggctggcatcaccacctctcttaatgcaagaactgcagttcttgctgctgcaaatccagcatggggaaggtatgatatgaggaggactccagctgagaacataaatcttcctccagcacttctctcacgtttcgacctcctttggttgatcctggatcgtgcggacatggaaaatgatcttgaaatggcaagacatgtngttcatgtacaccaaaatcttgaatcgccagcac

SEQ ID NO: 6236 - DNA, 185 bp, Triticum aestivum
  Clone ID: LIB3281-037-P1-K1-D12
cggacacgtgggcagacgcgtgtgataacaaccaccagcgactctgatgctgggggtgagatgtatcaagtcactgccttattcagccacgctgaaaaagtcgataaggaaataaaagagaaccgtgcaccatcagaagctgacgatcaggctgataaatttgttgtccaagtgaaaggatatgc

SEQ ID NO: 6237 - DNA, 133 bp, Triticum aestivum
  Clone ID: LIB3281-037-P1-K1-D2
acccgttggctagtgtaaaatatctttttgtctcagaaggctctcctgaagcatgctaccagggtgaacttgacagaggtgtagaacaaatatcatttataccagatggagaactattttttgaagggtgtac

SEQ ID NO: 6238 - DNA, 340 bp, Triticum aestivum
  unsure (1)...(340): unsure at all n locations
  Clone ID: LIB3281-037-P1-K1-D3
caaaaacattcgggagcaaactccactggattctgattgagcagagccacatggagatgagcctgctgagaagccgtaccttctctccgctcccatcgacgccccggccggtctcctcccagcgccgccgccgccgccgacttccctccacaacattcttcccgccgcagcctcctccgccaagcgtggttgctgccccccttcgcctatccttgccccccttctcccccgccgcgtaaactcttcgcttcttatctgcagcgaggggacagggcgtgcagcancgcaatgcggcagcggcaggagtgggtggaggacttggttcggagcaacgacacgc

SEQ ID NO: 6239 - DNA, 178 bp, Triticum aestivum
  Clone ID: LIB3281-037-P1-K1-D4
cgcttgtgttgggcagtcagtctttgggttccggggcggttcggttccattcggttcggaaggggttagtagcggtgaagaggaatgcatggcgcacgtcgagtatcgttggtttgtgggcggactatgatgacctatcgactaccagacactatagaacgccttctacaagtacggc

SEQ ID NO: 6240 - DNA, 361 bp, Triticum aestivum
  Clone ID: LIB3281-037-P1-K1-D5
acctcaactcctgatttgaagtcacttttctctgtggatggtgttaagctccctgcatgggtagatgggatgtgcatggctgagtatattcccactttagaagaagaccttaaattgcaggtcgtggatgcatcagcttcaatcggttgcaggagacgattcattgaagccctagctcctgctttcgggagaccattggaggctgatccgattttttgcaggaaagccacggttctttccatttcggggattttcacatttctggttcactttgtcatcccccttcaattccccaaacaacaacctatcctgactttgcagagttgtcagcactgtaattcccaaggtatacctatcacgt

SEQ ID NO: 6241 - DNA, 321 bp, Triticum aestivum
  Clone ID: LIB3281-037-P1-K1-D6
atttctttcagtccacctcttcttcttctcggcgacggcggcggcaggcgggcgggcgagcgaggaaccctaaccctaaccactacttccgatccgcaagggcttcgacgatggcggcgtctctccgcgcggcggcggcggcggccacgaggatcctgcgcccggcggtgcttccaggggagcggcttcgccggctcgtccacaccgagcagcatcccgcacccgcctgttccttgaaagaaggataccgtgggtcgcaaatccagcagaagaaagaggagctgtacgcggcttcccagctagacaggcgcccaataacta

SEQ ID NO: 6242 - DNA, 365 bp, Triticum aestivum
  Clone ID: LIB3281-037-P1-K1-D7
gaggggagggggagagacgagaaggggaacggaaaagaaagccaagccctctctcgcggaggccaacggcgaggcttcctcccttgcgccctcgatcagttcagcggttcggctcctcgggaccattgttggttcgctgaaatggagtcacacggagaggacctgccaccaccaccaccactcccgccaaatgcagagccgataaaagctgagtcggctgatgacttgccaccaccaccacccctgctgcctatcaaacctgaagaagcaaagaagatctcaaagcctaagagggccctgatcgctcgtcctggttttggcaagaggggaaatcctatacaagttgtgacaaatcattttaaagt

SEQ ID NO: 6243 - DNA, 415 bp, Triticum aestivum
  Clone ID: LIB3281-037-P1-K1-D8
gttggctagtggaaatcatctttctgtctcagaaggctctcctgaagcatgctaccaagctgaacttgacagaattgtagaagaaatatcatttataccagatgagaactatcttttgaagggtgtacagcttcagtctgttgttccagttacagaagtctctctggatgtcagtacagctgaaatgcagaaagtcacacaagaagtgttggcttcagatggagacctattatccccagacaagggtgagctaacattggagaggaatgatgtcctagctggtggtcagtgtcagcttgctgtctcagacggctctgctaaggaaagtgatgtagctgaagctgagaggatagttgaagaaaaggcaacaaaatcagatgagaattctgtacttaatggcaaagatatccagtct

SEQ ID NO: 6244 - DNA, 298 bp, Triticum aestivum
  Clone ID: LIB3281-037-P1-K1-D9
cccacgcgtccggctcatctacgaggagacccgcggcgtgctcaagatcttcctcgagaacgtcatccgcgacgccgtcacctacaccgaacacgcccgccgcaagaccgtcaccgccatggacgtcgtctacgcgctcaagcgccagggccgcaccctctacggattcggcggctaggttctctgtcgccgcctgcagattccaaaagcttgatggaaccccgacttgtctagttcgctatttcgtgtgtagttcgaactgaatcgtggaacaaagttgttcgcatgtgtttgttgg

SEQ ID NO: 6245 - DNA, 254 bp, Triticum aestivum
  Clone ID: LIB3281-037-P1-K1-E10
ctcacgggcagtgatgaccggtccttgtttacatgcgagtgtggacaattgagtcacactttaatgtggtgcagccatttcttgcggttcattaacatacttcttctggaggagatcccggtgaatcttattgctatttgttggaccaaggagggacatacttctcttgtacctggttcaacattagaaggttatatccagtgaaattgtcattttacatgcttacactttaactcttacctgaatgctattcc

SEQ ID NO: 6246 - DNA, 304 bp, Triticum aestivum
  Clone ID: LIB3281-037-P1-K1-E11
aggaggctgcaggcgccgagccaaaaagccactgccgagagagagagagatagagtagagggggcgagagacgtcccacgccacgccgctcccgtccaaaccccactcccgccccgcgccgcgcgatccgaagccccattatctaattcctcgccggatcgggccggcagatctcgccattgcccatttgccccgctccgccctcgtcctctgctcctcccgctgccagtgccggcggcggttgtgcggtactgttcggttcgtcgccggggaggctcgccaggggccggagggatgtggcggc

SEQ ID NO: 6247 - DNA, 151 bp, Triticum aestivum
  Clone ID: LIB3281-037-P1-K1-E12
caagccctagccaatggtatcacgactgcgcgcgcgccgagcccgatagctgggggggcacggtaagggggtggtacatgccttttctgcttggtgtcactcgttagtcacggaatgtattcgtgtcctgttacgcatgcaccggagcctc

SEQ ID NO: 6248 - DNA, 310 bp, Triticum aestivum
  Clone ID: LIB3281-037-P1-K1-E2
gccacgcgtgcggagaaaacctaaaccagatccagatgcgggtctgactccggcccccctcccggagcgagcacgcgccaccccctgccgtctatctatttggccgccgagcaagcccctcctcgccgtcggccttccagctcgcgcctcccgctcctgctccgtttgcgccttcccgacccctgacgcccaccttcggcggttgcgggtgacgccgacgacaacttctgcccaactctgcagtctttagcctgccgcaagaagatcgagataggagcctgaagtggtcaggacagaacagttggttact

SEQ ID NO: 6249 - DNA, 324 bp, Triticum aestivum
  Clone ID: LIB3281-037-P1-K1-E3
ggagttgctaatagcaaactagcactcatacgatgaaaaatattccaaaacacaaccagattgagtccagtacatgagacgatcatcaaaaggtttcacaaagtatgagctagcagtatttagacgacagataataggccaaaaatttcgactcagccagaccagatgctacaaactgctctaacgaataggcagataggttatgtagagcttccttctctaggccttcctggcaatatgggactcagtcttcttcttcaccggctcttccttcttcgacaagatcagctcaatgtggcatgggttggacatgtaggggttgat

SEQ ID NO: 6250 - DNA, 345 bp, Triticum aestivum
  Clone ID: LIB3281-037-P1-K1-E4
gattccaacgctgccgccgcgccgtagctcagcctcgccgccgaccaccccaacccctgcacctcccacgcgcgtcggccggccggccaccgccgtccctgttcttcctcaccgggtccccgccgtttccactccgtccggcaatcattggccattgagggtttgatgctattcctgtcttattggcaatttctcatttggggaggatcgtgtgagatagaagagagggcggactggattgtaatctgagctctggtggatctagactgaaagttgcatgagaaaaagttcagaaatttccatgaaagcttcgtcgtcgatggcaagcgacgcgtcaaggaacac

SEQ ID NO: 6251 - DNA, 403 bp, Triticum aestivum
  Clone ID: LIB3281-037-P1-K1-E5
cccacgcgtccgatggcgccccgcgcgcacctggccttctaccaggtgtgcttcgtgggcaagggctgcgaccgcgacgacatactcgcggcgatcgacgacgccctcgacgagggcatcgacgtgctctccatgtcgctcggcgctgatgacgccggagacttcgccgccgaccccattgcgctggggggattcagcggcgtcatgagaggcgtctttgtctgcacatcggctgggaaccaaggcccgtccccggccacagttgccaacgaggccccgtggctgctcaccgtggctgcggccacaactgaccggactttctctgcggacgtcaagtttggcaatgggcttgtgatcaacggcgaatcgcactaccagccgagcacctacgtgagcgtgcagc

SEQ ID NO: 6252 - DNA, 333 bp, Triticum aestivum
  Clone ID: LIB3281-037-P1-K1-E6
tgccggcgtacctccggatgcacccaatggcttcaaggtgttggattggcttacaccttcaatcgcaccactcaagggaaaaggaggaggcggcaagaatggtctcgcccagggccagggaagtgatgcttctcgggtcaaggaggcaatggagcttgctacccagatagcttcgatgaagctgagctgatttgttgagactggtcttcattacatgttaaagtggctgcttgattggtcgttgtcaccctactttcacaaattgtgatacgtgaagataaatttattcatgaaaatcgactagaagcagtgtccgtttccacatcacaggat

SEQ ID NO: 6253 - DNA, 371 bp, Triticum aestivum
  Clone ID: LIB3281-037-P1-K1-E7
cggacgcgtgggcggacgcgtgggtttttttttttcaaaatgaaacatgttgccctttgtgcaatggtaatcgcatatacgagttttaaacaagacttacacacctgagacattcatataaatcacacatgagatgatactgagagcaagttgctaaatgacaccgtgtctttgtttcaggaaaccctctctggttatgtttgacctgccaaggcgtcgatcaggagccggtagccctctggcacctctgcctggtgtcccacgcacgcagccagagtaggaacgtcggccttgacatccaagaaagcagcgatctggaaaagcaggtggaaatcaaagatccgcttgacgaacgggagatgctttgcacg

SEQ ID NO: 6254 - DNA, 308 bp, Triticum aestivum
  Clone ID: LIB3281-037-P1-K1-E8
tttggagaacagagacaggatcgttcaaagttgaggcgccatatattcattagaagtggaggcatgaggagggacactggtcgtacagaactaaggaacacatgacggttttattttatttagcgcgcgcgcgagcgcatgcggcggctagtggtactgatacgctgggtggtggtggtggtgatgatgattgcttgcttctcctcctaatcctcgtgctcgcctctgccggccggcctcctgtgcgccggctcagttgcagctgcagcaggagcagccgcacgcggtgccgcacttgcaggtggtgc

SEQ ID NO: 6255 - DNA, 463 bp, Triticum aestivum
  unsure (1)...(463): unsure at all n locations
  Clone ID: LIB3281-037-P1-K1-E9
ctcacggtcagtgatgaccggtccgagtttacatgcgagtgtggacaattcgagcacactggaatgttgtgcagccatgttttgcgggtcatgaacatacttcttctggaggagatcccggtgaagcttattgcgaattgctggaccagggagggacatactccccttggacctggttcaacatcagaaggataattcagtgaaattgtcattcacatgcagacactcaacacttacctgaaagctatgcaggtcgtgcggacgggcaacgcgagtgccgaagcatttgaacacacgatgagcgcaccattggcagcgaagagggatggtttaggtttttaagaccataatgagagactcgaactgggtagattggtttactatgttggtgctgataatggtaaccaagataacaatgatggaatgcccttcaaggcctagcgcctnctgataagcaacaaga

SEQ ID NO: 6256 - DNA, 232 bp, Triticum aestivum
  Clone ID: LIB3281-037-P1-K1-F1
gaaagcagtccgcgcggcgctcctctcagggttagggtgacacggacggagccctgaccggcgccgtcacagggagcatccaaggttgtatccactcaccgccgccggatgccaaagaccgtgcggaataccggccgggggtgccggcctgggctgtcatctggcatgggatatttgacctgccatgaccacaactgtgctgaaaactgttgtggcagcttgtgcatcagca

SEQ ID NO: 6257 - DNA, 356 bp, Triticum aestivum
  Clone ID: LIB3281-037-P1-K1-F10
cccacgcgtccgattcgtcgccattcaccgcccagatatctacaaatgagcgttgagcgtaggcgagcaattgctccatcggagtgaaatctcatgacgccagcatccctcgtccaactcagttaagctaatatgcggaatgtgtatatggatacttgctatccacaaaagcggcagggagatctgctctggtctttgtaattgtatttatagagggatgctcatctatctatgctcggtttgctatggtagcaaggaggtccacctgttgttgtcggtttgggtgtatatgtaacctatttcagccagggagaattgaatgttgcagaatcataaaaaaaaagtattgatagcac

SEQ ID NO: 6258 - DNA, 442 bp, Triticum aestivum
  unsure (1)...(442): unsure at all n locations
  Clone ID: LIB3281-037-P1-K1-F11
cggacgcgtgggcggacgcgtgggggactgccggaagcctgatgattcagagcaacaagctaatggcgaagaggctctgttttgcacattatgcaatgctgaggttcgcaaattcagtaaacactgcagaagctgtgacaagtgcgtggatggatttgatcatcattgtcggtggctgaataattgtgttgggcggaagaactacttcacgtttattgctctgatggcaatcagtctcctatggcttgcaattgaatttggagtgggcattgctgttcttgttctctgctttgtcgataagaattcaccaagaattctncaagaaaagcttgggaatggcttgactcgcgctccatntgctgtgattgtaggtatattcacacttctgtcattagtgggctgcgtaccttaggagaactttttttcttcacatgatattgat

SEQ ID NO: 6259 - DNA, 352 bp, Triticum aestivum
  unsure (1)...(352): unsure at all n locations
  Clone ID: LIB3281-037-P1-K1-F12
cggacgcgtgggggcaacactttacttgtgaagggagctgttgaaaccttgctggagaggagtagccatatccagctccaggatggttcagttgtgccattagatgagaaatcaagaaaagctattttggctagtctccatgaattgtcaacaaaagctctgcggtgcctcggatttgcatacaaggaggatcttggtgaattcgcaacatatgatggcgaataccaccctgctcacaagcttttgctggatccagccaattatgcggctattgaaactgacctgatatntgttggtcttgctggcctaagggatccctccagggaagaggtctttgatgctattgaggact

SEQ ID NO: 6260 - DNA, 232 bp, Triticum aestivum
  Clone ID: LIB3281-037-P1-K1-F2
cgcgtccgggagcgttgatggaatcattagtcatgtgaagatggaaatcaagcaactagaggatgaaaaatttgtgaaagagagggtgtctgacctgaaacgacatgcagatgaagcattcaaaaagcaggattattctaaatgcatcagtgctctacacacaggcactgaagatggataacttcgacgccaagttgttgtcaaacaagagtctttgctggcttcgcatggg

SEQ ID NO: 6261 - DNA, 256 bp, Triticum aestivum
  Clone ID: LIB3281-037-P1-K1-F3
gcggcgccggaacatgcaaagatttcaggtataccgcatatggaataagatctttggcagatgagcagagtcagctcatgacagaagccatgaacacctccgtggagaacccatggcgcctgccgccatcttctcaaacgactacattcccgctctcaagctactctcctcagcttggagcaacgagtgacctgggtcagaacaacagcagcaacaacaacagcggcgtcaaggccgagcgacagcagcagcagca

SEQ ID NO: 6262 - DNA, 237 bp, Triticum aestivum
  Clone ID: LIB3281-037-P1-K1-F4
cccacgcgtccgccgacgcgtgcgggcggaagcggatggggtatgggagcgacgacggtctaagagaaccaagcgtggacggccggagaagaagggagccattgcaaatgagacagagcaggttgctggcgaaaacaacaccatttttcttcagggccagcggaaaaattattaccttaatgagctcggatggcatgctgttcaaggtgtcggaggcggctgtactggtgtccgtgc

SEQ ID NO: 6263 - DNA, 345 bp, Triticum aestivum
  Clone ID: LIB3281-037-P1-K1-F6
gaagaaaaaaccccaccaccactaccctgcctgctgctccggctatgcggcggctacctctgtggatcctgcgctccgcggcggccggatctctccggagccccgccccctcacgcggcggctgtcctgtccctcgagcgccacatctgccggcggaggcagccgccgcgccggccgagcttgcccgctggctaccgcggagagggtactcccggttcgcgagcggattcacccccctggagccgaagaagctgggatccatcctcgacgtcgagcgcgccaagggcctctcccccgaacacctcgtcgcggcatgggatgactaccacctgggaagaggtcaca

SEQ ID NO: 6264 - DNA, 168 bp, Triticum aestivum
  Clone ID: LIB3281-037-P1-K1-F7
tggacgcgtgggttgacactagtttctgctcattgataagcgtagattttttgttttgggtattatgttgcaaatgatttatgttttattttcatttattcttcattactggattttttatttttatgtttttttagtttatatttgtatattttattatttattttt

SEQ ID NO: 6265 - DNA, 318 bp, Triticum aestivum
  Clone ID: LIB3281-037-P1-K1-F8
gtcagggatgattttgttggcatggtgcgattcgatctgaatgatgtgccagtacgtgtgccccctgacagtccactggctccagaatggtaccggcttgttcataaggatggggacaagtcaaggggtgagctgatgctggcggtttggattggcacccaagctgacgaggcatttcctgatgcatggcattcagatgctgctacacttgaggatccatctgctgtaacacacatgaagtcgaaagtttaccatgcacccagactgtggtacctgcgagttaatataattgaggcccaagatattctcatacatgat

SEQ ID NO: 6266 - DNA, 287 bp, Triticum aestivum
  unsure (1)...(287): unsure at all n locations
  Clone ID: LIB3281-037-P1-K1-G1
cggacgcgtgggctcatcttccaaacaccagagcgccagatccccatcccctccaccacgatggcccgcacgaagcagacggcccgcaagtccaccggcggcaaggcgcccaggaagcagctggccaccaaggcggcgcgcaagtccgccccggccaccggcggcgtcaagaagccgcacaggttccgccccggcaccgtcgcgctccgggagatccgcaagtaccagaagagcacggagctgctcatncgcaagctcccctttcagcgcctcgttcgggagatcgc

SEQ ID NO: 6267 - DNA, 339 bp, Triticum aestivum
  Clone ID: LIB3281-037-P1-K1-G10
gcggggcgggggacgcatgggtccttggtccggcggcgtcggcaggatgctgtgcgccggtcttgctttcttgctagataagtatttaggaaaaatctacaatactccttcaaggtttatacatcaattgcaaagggttttaggaatgcatcactacattgttttgggtttatacatgaatctcgaagagttttataaatgtatcattatattgttttaggtttatatatgaactgcaaaagaatttaggcatgtgaaaatcagagctcaggaggcatgtgatattcttttctgtggggcgtgtatgtattctgtgatttacttcctgtttgtttctct

SEQ ID NO: 6268 - DNA, 169 bp, Triticum aestivum
  Clone ID: LIB3281-037-P1-K1-G11
cggacgcgtgggatgcctggttactcactacggccggccatgtaggatacggtgcgccgctcttgctttcttgctagataagtctgcatgaaaaatctaccatgctccgtaaaggtttatacatcaattgcaacgtgttttaggaatgcattactacattgattatggt

SEQ ID NO: 6269 - DNA, 295 bp, Triticum aestivum
  unsure (1)...(295): unsure at all n locations
  Clone ID: LIB3281-037-P1-K1-G12
cggacgcgtgggcggacgcgtggggggttctgccggggtccgacccancctcgcaggcgcaggtagggctgcaggctccccctcggtgccgcggcgccatccgccgacgcagccgtcgtcgccagctgcagctctccgcgcgcgacgtctaccacgggccgtctccgccccggacgctcgccggtcggtccgcaccctgcgccaaactacttctcgacctgtcacgttctttagaagaaaagaggaaaaatcatacatggatatcacgcagacaagtgattcttcacaatatgga

SEQ ID NO: 6270 - DNA, 263 bp, Triticum aestivum
  Clone ID: LIB3281-037-P1-K1-G2
cggacgcgtgggcggacgcgtgggcggacgcgtgggtgggtgacctacctcacaaagtttgtaaagcggtaccagcgaagcaagttagagcgggcaagagagctgttcacggaagctgtcgaaaaggctccgccgcacgaaaagaaagccttgtatttgcaatatgctaaactggaggaagactactgcctcgcaaaacgtgccatgaatgtatatgatgaagctgtaagggctgttcccaacactgaaaagatgagtatgta

SEQ ID NO: 6271 - DNA, 196 bp, Triticum aestivum
  Clone ID: LIB3281-037-P1-K1-G3
cggacgcgtggggactctaggaaggcgcggtggccccactcatcttgccatcttggctcagccaggggacacaattaatggaccactccttctcactgttcatggtgaagtcatcgagccaagcattatggaggaacactagtgcttcacggcgctccagcgcttcacagctgctactatagagcatgtgatgtgt

SEQ ID NO: 6272 - DNA, 134 bp, Triticum aestivum
  Clone ID: LIB3281-037-P1-K1-G4
gcgcagacacgtgggtgcgcacactttactggtatatgatagggctatgccaaatatcacggtaggtgcgggaactgtggacgttcacctcactcctacagaaaacttcgccgacgtcccttcaactacggtgg

SEQ ID NO: 6273 - DNA, 307 bp, Triticum aestivum
  Clone ID: LIB3281-037-P1-K1-G5
cagatctctccctctccgcccccttcccctagctctgcacgccatggccgaggacgcccccaacgccggcgctgaggacatccaccccgcgcctaccgaagcctccgccgacgccgctacacctccggcgtcggcagagaagtcctcgtcggagacgctgctcccgtcgctcagcatctggccgccgtcgcagcgcacgcgcgacgccgtagtgcggcgcgtcgtgcagaccctgtccgcgcccagcgtcctctcccagcgctacggcgccatccctgagcccgaggccgagggcgccgcagccgcc

SEQ ID NO: 6274 - DNA, 367 bp, Triticum aestivum
  unsure (1)...(367): unsure at all n locations
  Clone ID: LIB3281-037-P1-K1-G6
cggacgcgtgggcggacgcgtgggtgccctcgctcccctcgcgcccgcaagtcgcgtcgccggcgatccacacctctgccacgccccgccgccggcgaccttcaccgccggacctccggccactccgccgcctcgcccctctgccttctcctccttcctctcgatctcctctcacatctctccctctttctcgctgaacagggacctccacgagggccatggcgccgccggccctcaatctcgccggatccggccgcctccacgccaaatccgccgaaaatggatccaccccggccagatccgcccggatccgaccgggcctnctgccgtacgacgcctcatngaggagtacaacagcttgcccatg

SEQ ID NO: 6275 - DNA, 347 bp, Triticum aestivum
  Clone ID: LIB3281-037-P1-K1-G7
cttctcctccccttccggttcgggttctggttcggttcgggtccgagagtagctagcctagtctagggtttccgtagttcggagaggagagaaagggagagatccatggcggagacggagtaccgctgcttcgtgggcggcctcgcctgggccaccgacgaccacaacctccagcaggccttcagccagtacggcgagatcctcgacgccaagatcatcaacgaccgcgagacgggcaggtcccgtggcttcggcttcgtcacgttcggcagcgaggagtcgatgcgccaggccatcgaggagatgaacgggaaagagctcgacgggcgcaacatcaccgaaaacga

SEQ ID NO: 6276 - DNA, 307 bp, Triticum aestivum
  Clone ID: LIB3281-037-P1-K1-G8
caatccaacccatcccctccctccgtcggcttaaaccctagaccgccgccaccctccggcgccgccggttgacatggagttctggggccttgaggttaagcctaaccagtccctcaaggtttcacctgatgatgaccacttcctccatctctcccagggtgcccttggtgaagtcaagaaggatgacaaggctaccatgttcgtcaagattggcgaccagaagctagccatcgggaccctctctactgacaagttccctcagatccaggtcgacctcgtctttgagaaagagtttgagctctcacac

SEQ ID NO: 6277 - DNA, 319 bp, Triticum aestivum
  Clone ID: LIB3281-037-P1-K1-G9
cgctgtccattcttctcggctcagtcaatgcggtctaccctcttgctgaagtcgctcctttctacaaatatggattgaagctgaatcgaagttcttgagtcctggcggagttggtctatttcttccatctggcggagcggatatggagcctagaaaatcgccaagatcaagaaaacaaatccagtctgaactttctagcgatgcatccagtgatgatgatgtttcttctagatccaaaagcactactaacagcaaaagaacttctccaaagaagattaagagggccaataggaaggatgtagttcatagatatcaaaga

SEQ ID NO: 6278 - DNA, 360 bp, Triticum aestivum
  unsure (1)...(360): unsure at all n locations
  Clone ID: LIB3281-037-P1-K1-H10
tgagatcgttcgcttggagttcagtcactatgatataaaatcatccaagacaatatctgctaaggactttgcattatccatggttgcttctgctgacatgaatcatataaacaagctacttgacagagttgatgattttgatgaatctcctgatgtcaaggatctgcgcattacctttgaggagttcaaggcttttgctgatctgcggcgaagattggaaccatttgcaatggctatcttcagctatggaaaagtaaacggtttgttgacaaagcaggatctaaaacgtgctgcaactcatgtntgtggngtggacttgactgataaggtgggggatgtcattttcatgtgtttgatgca

SEQ ID NO: 6279 - DNA, 265 bp, Triticum aestivum
  unsure (1)...(265): unsure at all n locations
  Clone ID: LIB3281-037-P1-K1-H11
ctatttcggcttcttcctctccaagctacagccccggccatggcggcgacgatccagtccgtgaaggcccgccagatcttcgacagccgcggcaaccccaccgtcgaggttgatgtgtgctgctcagatggaaccttcgccagggccgctgttcccagcggtgcatcaactggtgtttatgaagctttggaactgagagacggtggatctgactacttgggaaagggtgtttccaaggcttgntgacaatgtgaacttgattatc

SEQ ID NO: 6280 - DNA, 368 bp, Triticum aestivum
  Clone ID: LIB3281-037-P1-K1-H12
gatgcagtccagagcacctacctaggcgtacgtgggcgcgtgggtgctggagcacaccgatgtctccatcctgctcgacaacgaggccatctacgacatctgcaggcgctccctggacatcgagaggcccacctacaccaacctgaaccgcctcgtctctcaggtgatctcatcgctgaccacctccctgaggttcgacggtgccctgaacgtggacgtgaccgagttccagaccaacctggtcccgtaccctcggatccacttcatgctctcgtcctacgcgccggtcatctcggcggagaaggcgtaccacgagcagctgtcggtgtcggagatcaccaacagcgcgttcgagccgtcgttcatga

SEQ ID NO: 6281 - DNA, 335 bp, Triticum aestivum
  Clone ID: LIB3281-037-P1-K1-H2
cggacgcgtggggaaaccagtagcaccagtgggatgcgggacactgttgaaacaagccccctcttgcagtacagggcccagactgtagttccaggtcgcatattgaaaatggaagaggccatcaagaatcgtgattttgaatcctttgccaggttaacttgtgcagatagcaaccagtttcatgctgtatgtttggacacgagtcctcccatcttctacatgaatgatacgtcacacaggataattagccttgtgggaaagtggaaccactcggaaggaaccccacaggttgtctacacatttgatgctgggcctaacgctgtcctaataacacg

SEQ ID NO: 6282 - DNA, 232 bp, Triticum aestivum
  Clone ID: LIB3281-037-P1-K1-H3
cacgagaagccacatgaccctgctctgctcatgtatttcctcgactccggcggcggatcctacccggaggtcgtatcctgcgcacaggtcacgtggttccacagccagtctcggttcctcaatccagatggcaggatccctgagctggtattctggcacgtaccgagcacggcgtacgtcaaggtggctccgaaggccacgagcgaggtcaggaagccctgcgtcggcagtc

SEQ ID NO: 6283 - DNA, 339 bp, Triticum aestivum
  unsure (1)...(339): unsure at all n locations
  Clone ID: LIB3281-037-P1-K1-H4
cggacgcgtgggtttttttttagcaagccatcgccttattacttctaatgcgctgaacacatacagtacaataacaagtgttatgaaactacacaccctcaatgaagtgaatgaaagggaatcgaaccatcgcttatgtaacacaccattagttcaataaacttggattatgaagagccattttcttgttgaaaagagataattggccctcaggtgcattatagcttgctgcgacttgcaagttcttgcttcagctgatccctcaggacccttctcagcagcttgttcgaagcagttctcgggaactcggngacgacnttgacgtagctcaccctgaaa

SEQ ID NO: 6284 - DNA, 370 bp, Triticum aestivum
  Clone ID: LIB3281-037-P1-K1-H5
atttcatcgaacagggaaagaaagaatgttttgcttcttgcctcttcatttgctacgacttgattcgtgcggatgttgctcttgagcttgcatggacgaataacatgctggatttcgcatttccctatctattacagttcatccgtgagtacacaaacaaggtagatgatttggtgaaggacaggatagaatcgcagaaggaagaaaaagctaaagagaacgaagagaaagaactagttgcgcagcagaacatgtacgctcaattgcttcctctggccttgcctgctccgcccggcatgatgggcggtccacctccgatgggcggaatgggcatgccgccgatgggcgggatgggtatgcccttcgatgg

SEQ ID NO: 6285 - DNA, 423 bp, Triticum aestivum
  Clone ID: LIB3281-037-P1-K1-H6
ggcaatccacctagccgacgtgaggcctgggcacccagatcacgccgatgtctccaaccatgacatgctcggcactcttatccaaagcaaggaggaatctgtggcctccatggtctaccactacaagcatggtttctcgggcttcgccgccatgctcacccaagaccaagcaacaagacttgcagagtttccggaagtcatcagcgtgaagccgagcaggagggtcaggaccaccaccacgcggagctgggacttccttgggctcaactaccagtcctcccacacgccggccagtgagctgcttcaaatgagcaacttcggagaggacgtaatcatcggagttgttgacaccgggatctggccggagtcaagaagcttcagcgatgtagggtacggaccggtgcagcgaggtggaaggtgagt

SEQ ID NO: 6286 - DNA, 143 bp, Triticum aestivum
  Clone ID: LIB3281-037-P1-K1-H7
cccacgcgtgcgttgacacgtttgactgctacaaggaaaatacatattatctcgtgctgagcctgccgcagcaagagatttttgttccactatgattatagttcatttgtgtgtcagggttattaatttggtcatgttttttt

SEQ ID NO: 6287 - DNA, 93 bp, Triticum aestivum
  Clone ID: LIB3281-037-P1-K1-H8
cggacgcgtgcggagactctattttcagcttcatagaaactacatattatcgggtgcggatccagccgctgcaaatgatttaaattccattaa

SEQ ID NO: 6288 - DNA, 395 bp, Triticum aestivum
  unsure (1)...(395): unsure at all n locations
  Clone ID: LIB3281-037-P1-K1-H9
cctcagtaccgtccgattcccgtcgaccacgctccgtgccatttcagatcattttccatgcncgacgaccagatcaaccaaagaggtcggacgtagaaaggctgaggaagattatttctcactgagtcctctcatatatactttcttctctttactaattattttttctttattttcttcttttttcttcttacttattttttcttttttttttttattttttctttgttttttatcttttttttgtcctatctttttcatttttatattttttattttaattattttatttttttcttatccttcttttattttctgttaagtgtttatcattttattttatttttttactatctattcattttatctcttatatctttttcatttatttttta

SEQ ID NO: 6289 - DNA, 167 bp, Triticum aestivum
  Clone ID: LIB3281-038-P1-K1-A1
cgttccgatattccagtggcgacgccacgcgtccggtgagcttccgttatagaggatccaacctatcgttcccgaccatgccacatcattgggcggggatatttacaccgaagtgcaggacactgacctcctctttacatcgacgaggagtggaaagccctatactc

SEQ ID NO: 6290 - DNA, 288 bp, Triticum aestivum
  Clone ID: LIB3281-038-P1-K1-A10
gcaccatatttatggtgcatttgatcttgagcttgaaaatgacaaggttggccatacgcaagctacggtccttcttattttgaagaataagaggagatgctccatttttatgggaatagggtgagacatgcatatgcatgatgcaagcgaatcttacttatcctggataatccttttaagttgaaatattgtacgaccagtacagatggctgaagagttctcttaacgaatgtcatcaagccatggatatcctacacagatcgaaaggcttgctgccatagggataag

SEQ ID NO: 6291 - DNA, 413 bp, Triticum aestivum
  Clone ID: LIB3281-038-P1-K1-A11
atccccgccgccgcctccgctcggttccttctccttcctccgagcttcagccatgggcaaggagaagactcacatcaacatcgtggtcattggccatgtcgactctggcaagtcgaccaccactggccatctgatctacaagcttggaggtattgacaagcgtgtgatcgagaggtttgagaaggaagccgctgagatgaacaagaggtctttcaagtacgcctgggtgcttgacaagctgaacgccgagcgtgagaggggcatcaccattgatattgccctgtggaagttcgagaccaccaagtactactgcaccgtcattgacgcccctggtcaccgtgacttcatcaagaacatgattactggtacctcccatgctgattgtgctgtgctcatcattgactctacccact

SEQ ID NO: 6292 - DNA, 173 bp, Triticum aestivum
  Clone ID: LIB3281-038-P1-K1-A12
ttctcctccccttccggttcgggttctggttcggttcgggttcggttcagagagagaggccgagtagctagcctagtctagggtttcggtagagaggaagggagatccatggcggagacagagtaccgctgcttcgtgggcgggctcagctgtgccaccgactacaacaacct

SEQ ID NO: 6293 - DNA, 466 bp, Triticum aestivum
  Clone ID: LIB3281-038-P1-K1-A2
atttgatactcttaaagaacgtcatgccaagagaaacccagaagatcttatcattgactatgacgatcaatttccaagtgaggaagatgaagaagctcctggcagcgacgaggacagtttggtcccatatgcttctgatacacaagaactaagtctattccatgagagtggagaggaggaagaggaacccatccgtgctgatcttggaggaggctggggccggattatatacagccccattcgaagaggaagacaagtacagatggatgtttgccgtgccaccaaacgggatgcgtctgaaggcgcgttcgagcgtgtggtggtcacacaaagcaagaaccctgctttgcatcttcaggcccggaagtcgctttggggtgacctttggccattttaggctacagattctccaagctttggtgtagccacattttagggggctcccagtctgttcagcagtggactc

SEQ ID NO: 6294 - DNA, 399 bp, Triticum aestivum
  Clone ID: LIB3281-038-P1-K1-A3
taaaaaacttaaccttatttctgacgtttgcaaaaattggattaaaaaatattgcataatggcacgtggagcaggttatatttcattttttgcccggtgcaacgcacgggcatttgtactagttaagataaataggttagtggggatgaatctcttaggtatatatgattctaacgcaagttgtacaccggttgtttttagttgtagttctatagccttgaaatgataatcttgattaattttttcttatcgctgtttttgggtttaatttaaataattccaatccctacagtagatacggttggccaaaataattggtgtatccaccattaatttgcatggttttaatgctgaagatttcttttgcggtaggcttaaagtgttggcctcacaaatctt

SEQ ID NO: 6295 - DNA, 175 bp, Triticum aestivum
  Clone ID: LIB3281-038-P1-K1-A5
cccacgcgtccgcggacgcgtgggttctgatgtatgaaatggatgccatcaggaaggcttgtgcatctttgcaggaggattatcagccccctgtgacatttgtggttgtccagaaaaggcatcacacaaggctcttccctgaggtgcacggaaaagagaccgacaaaagtggaaa

SEQ ID NO: 6296 - DNA, 345 bp, Triticum aestivum
  Clone ID: LIB3281-038-P1-K1-A6
cggacgcgtgggcggacgcgtgggcgccaccacctgacgtgcccaaagaatccacagccgttgcattcccgtacggtgcccggccgcacacagatgcggcgaccgacaacaagccatggtgatcaacggagagctgtcgcagccggaggcggaggagtacggcctcgccgtcatgcgccgcctgcccaagaccaagatcgtctgcacgctcggcccggcctcccgctccgtcgacatgatcgagaagctgctgcgcgccggcatgagcgtagaccgcttcaacttctcccacggctcccacgactaccaccaggtgacgctggactacctgcacgccgccatgga

SEQ ID NO: 6297 - DNA, 78 bp, Triticum aestivum
  Clone ID: LIB3281-038-P1-K1-A7
ctcactcatctacgttcaaccacacaccattacttacatctgctttctattgctggggttttacattactagcaggga

SEQ ID NO: 6298 - DNA, 336 bp, Triticum aestivum
  Clone ID: LIB3281-038-P1-K1-A8
cggacgcgtggggtggatccgccccgcccgacgtcaagcacgaaccaggtaagcaggctctttcactctcccgcgcatctgtgctcgccgccgccgccgccaggccgtctgcaacctgtaggtctctgccgtcaagtctgttgcttcaagcaccgctctccgtcgccgcatgtaagtatatcgttgtcttacaactggctccacaaatcacatatagatagtttgggcaaggccgaagcccgatggtggatcaagctccactcatctcttcgatttgaccatgacttattcaccaacagagtccctgcagtgtcataggaagagtatggctccatt

SEQ ID NO: 6299 - DNA, 434 bp, Triticum aestivum
  Clone ID: LIB3281-038-P1-K1-A9
cggacgcgtgggtggacacttacatggtacaaacaattggatccttataggagttgtttgacccatgtgctagaaggatctgctgtagtttatttaattagtgctataccagtttacatctacttgggaagttttcatcagctgtacttttacagtctcacacgagctagtattattgtagcagacattacattctctaagatggatatgtggaattagctagcaatcaggtcttgtactatctggataaatatggagtgacatttgcgagcggtggcatggcctacactaacgttcacaaggctgatgtctcttttaaaaaaccatgcattcagttgttgttttctttgacctgatctgatagcaagtgttttttatgcatccttagagaacaagtatttgagtggctggctgttttgagcttgcggaagaac

SEQ ID NO: 6300 - DNA, 344 bp, Triticum aestivum
  Clone ID: LIB3281-038-P1-K1-B1
cccacgcgtccgggtctgcacacccacccagtggcccgcccctcctctcttcgtcttcctctcgcagcttgcagcaatggccggagcaccgctgcttcttcttctcgcggcggtgtgcctcgcgtgcttcgcccccggcgccaatgcggcggggaggaagatggtcggcgtctacgagctcagcaagggagatttctctgccaaggtcaccaactggggcgccaccgtcacctccgtcgtctttccggattccaaagggaatttgggtgatgttggccttggctatgacaccatcggtgaatatgttaacggatccagttactttggagcgcttgttggacgag

SEQ ID NO: 6301 - DNA, 405 bp, Triticum aestivum
  Clone ID: LIB3281-038-P1-K1-B10
gtcctgttgagagcggccacggggggaaaaatcacgcctttccgttccgttgcgtctccggcgccacactcctccggccggccgctataaagcgcgccgggtcacgggccccgcggacaatgggacccccgtccgccgccatcgacatcgacatcgacgacgatgctctgcctcacctcctcctcgccctcgctcctgccgcgcccttcccgtcccgctgctgaccggcccggtccggggatctcgggcggcgccaatgtgcggctgagcgcggtgcccgcgccgtctccgcttcgctggaaggccaagagcgatttctctgctcccgtgtctgcgccaagagactacaccatggcaacagctgaagatggcgtcggcgaccttccgatatacgatctggatccg

SEQ ID NO: 6302 - DNA, 416 bp, Triticum aestivum
  Clone ID: LIB3281-038-P1-K1-B11
aggaaagtcaccatggcaagcagcagcagcatcccagccaccaccgtccgtgagatccgtgttgcgcagcgtgcggacgggccgtcagcggtgctggccatcggcacggcgaacccgccccactgcgtgccccagggcgactaccccgactactacttgcgcgtcaccaacagcgaccacctcaccgacctcaagcccaccttcgccaagctatgcgggatgacaggcatcggcaggcgtttcttccaccacacagacgaactgctcgctgcgcacccgggcatgtccctcgacgcccggctggacgtcgtggctaccgccggcccggagctcgccgcgtcggctgcggcgagcgccatcgccgagtggggccgtccggcgggcgacatcacccatctcgtcgtcagcaccaacgc

SEQ ID NO: 6303 - DNA, 335 bp, Triticum aestivum
  Clone ID: LIB3281-038-P1-K1-B12
tgcggcaccggtcccggtctcggagattccgaggctacgacctcacgcgtccgcggacgcgtgggattgtgcgtacacaagggttcaacgtggacacagtagtgtatatgaacatcatcttcactgtttgggatgttggtggccaggacaaggtgaggtggtcgctcttttcttcttcttgggacactctttggctgcatttccttggtagccgcacatgaatcaaaagctaatccacctgtgtgctgctactaaagcgcttcattgacaaaagtctatttatgtaaagacaagctgatgatttatgtatgccatttccaaaacagatgatgact

SEQ ID NO: 6304 - DNA, 368 bp, Triticum aestivum
  Clone ID: LIB3281-038-P1-K1-B3
cccacgcgtccgcgatctgcgccgcgccgctcccctctcctccccatccgcgccgcgccggcctccgctcccctcctgccgtcgggaccagcaatggtgctcatgagcgctgcggcgacggccgccgtgatttacgcgtacggcaagtcggtcgcctcggtcgggcttgctgcagggaccagcgccagggcgttctgggtggtcggcggtttcaccaaggtgctgtgtccgctctgccacgagcatgtcaggcagatgaagtacgagaggcacaccagagagcatacgttcgagtgcccctcgtgctacgaccaggtcccgttctccgagctcgagaaccatgcacagagccatgggtatcgatgctc

SEQ ID NO: 6305 - DNA, 411 bp, Triticum aestivum
  Clone ID: LIB3281-038-P1-K1-B4
gtcctcgccgcccctccgccgtccccccgggtttccaggtcgccggccttcgccccgtcagccagccgtcgcgtccatggcggaggtagcgcccgtcgatcaggggaagaaggaggaggaggagttcagcacggggccgctgtccattctcatgctcagcgtcaagaacaacacccaggtgcttatcaactgcaggaacaacaagaagttgcttggtcgcgtgagggcatttgatcgtcattgcaacatggttcttgagaatgtcagggagatgtggactgaggttccaaagactggtaaaggcaagaagaaggctctcccggtgaacaaggacaggttcataagcaagatgttcctccgcggggattcggtcatcatcgtcctcatgaacccgaaatgagtttgacgact

SEQ ID NO: 6306 - DNA, 321 bp, Triticum aestivum
  unsure (1)...(321): unsure at all n locations
  Clone ID: LIB3281-038-P1-K1-B5
cggacgcgtgggcgcgaggagatagaggcgagctaccagtcccagatcagagtcagacaaggcgatagtcattgacttccacgcccagcccatcgtccacctccctcccaatgggatccacccacccacccgttctcacctcccttcatataatttttcttccgctgctaacaactgcctagtattacgacccccccttcctcggttgttgcaccagctgactacactccccgccgctcccctctgtntgcccgccggcggagggaggatcgcttgtttcccggcgagcttcctctggggcgtgtggggggactgtgactc

SEQ ID NO: 6307 - DNA, 126 bp, Triticum aestivum
  Clone ID: LIB3281-038-P1-K1-B6
cggtcgcatgtgactgtgcgcacagacagcttccaagccaccaccgtcagtgttaagctaattaattgctgtgatcgcgttgccccaggtgtgaacaccatcggctgatcgaacattcctgactgg

SEQ ID NO: 6308 - DNA, 366 bp, Triticum aestivum
  Clone ID: LIB3281-038-P1-K1-B7
ctccctcacctccggcgaaaaacacaccagagctcacctctcccctcgcttgctcgcgaaaatgtcgactgaagtggctgccgctgacatcccggtgcctcaggtggaggtagccgccgacgccgccgttgacacaccggcggcgaagccggccaaggcgcccaaggcggtcaaggccaagaagtccactggcccgaagaagccccgcgtcaccccggcccacccgtactacgccgagatggtgtccgaggcgatcgccgccctgaaggagaggagcgggtcgagcaccatcgcgatcggcaagctcatcgaagataaagcacaaggcgcacctcccggccaactttcgcaagatcctgctgaccc

SEQ ID NO: 6309 - DNA, 428 bp, Triticum aestivum
  Clone ID: LIB3281-038-P1-K1-B8
cggacgcgtggggcaactgcaactgccccagcgaaaaaaggagtgagtcacggaacaaaaattctccgtcggtgtccgagcgctcgatcccagtcggcgcggcgccggatcgaatgcgggaggcggaggccgccgccgctcgatctggtatttgaagtggacagggagctgatacgatctatagagggttgctgcgcttgtagttgtgggcaaaatggaggggagagttgctggcgacgtggagcttgattctgcagtgttccaagtgacattgaccaagaacaggtatgaggcaattgcttgtaatggagagagcgccgaatcagtagcatctggtcctttcgaccaactagtcctgcacttggaagatgccaaaaatttccaatcacgttcgtcaagcgggctcttttaagctgttattgattggg

SEQ ID NO: 6310 - DNA, 358 bp, Triticum aestivum
  Clone ID: LIB3281-038-P1-K1-B9
gtcaccttatagttaaaagagcgctgaatgaatattttgtcttcaaatgtaggtgggtgcttcagttagattctgctggctcaatcttctactccacagctcccaaatgggtgaggcaatcaagtatcaaggatctaccacaatgcgtcgatgacacgaaggattggtgtgatcactggaagcactgtgtttggtttacacaaggaaggggtgctcctgttatgaacgagcaaactctttctctaagggctagtcataacctaactagcatctcttatcagctgctaaacccaaatgatgaagcatgcaatggaagcttgaaagctgacaatctaacattgttgccagaaaggatagc

SEQ ID NO: 6311 - DNA, 338 bp, Triticum aestivum
  Clone ID: LIB3281-038-P1-K1-C1
cggcatctcctccaaggccatgtccatcatgaactccttcatcaacgacatcttcgagaagctcgccggcgagtccgccaagctcgcccgctacaacaagaagcccaccatcacgtcccgggagatccagacctccgtccgcctcgtcctccccggcgagctcgccaagcacgccgtcttcgagggcaccaaggccgtcaccaagttcacctccgcttagatagtctgttccggtttcttggtcgatcgatggtactctgtaatagtcatgtgttcggaccatgtcgtcttgtaagtgtttcattatcttgtgaaatagtaatggcgcttctttgatc

SEQ ID NO: 6312 - DNA, 423 bp, Triticum aestivum
  Clone ID: LIB3281-038-P1-K1-C10
gcctcatgggtgatggccagcctattggtcgctacgatgatatgtgggctggatggtgcgtcaaggtcatctgcgaccacttgagccttggagtgaagactggcctgccatacctgtggcacagcaaggctagcaacccatttgtcaacttgaagaaagagtacaagggcatcttctggcaggaggacatcatccccttcttccagaacgccaccctctccaaggagtgtgacacagtccagaagtgctacatctcactctcggagcaggtcaaggagaagcttggcaagattgacccttacttcgtgaagcttgctgatgccatggtcacctggatcgaggcctgggacgagctgaacccatctgatgctgtcgttgctgctgggaacggcaaggcagcagccaagtaggctggctggggag

SEQ ID NO: 6313 - DNA, 389 bp, Triticum aestivum
  Clone ID: LIB3281-038-P1-K1-C11
cggacgcgtgggccaatttcttaaagaaacctggtgatagagttgaagctgatgaggcgatagctcagattgaaactgataaggttacaatagatgtttccagtccagaagctggggtaattgaaaagttcattgccagtgaaggtgacactgttactccaggtaccaaaattgccgtgatatctaagtctgctgctccaagtgaggcccatgttgcaccatctgaagagacctcccagaaggagacccctacttcaccttctgcagagaaacctaaggttgaggcaaaatcaccaaatgtagaatctgtcaaaccacaggcgtcaaaactagccttcccctcagaacctcagctccctccaaaggaaagagagagacgggtgtcaatg

SEQ ID NO: 6314 - DNA, 396 bp, Triticum aestivum
  unsure (1)...(396): unsure at all n locations
  Clone ID: LIB3281-038-P1-K1-C12
gccgcatcccaccctctcctcctccctcttctgcttcctacctcctccccggatagggacaagtcttgttgattgggagacatggcaggacggctggcctctcgggctgggcactctgaaaccgggagccggagcggtcaggagcgtcgactcctcctcctccaccgcagccttcaccccgtcccactgcgtctcgtccgtcgcttcgtttgatctagacacagagtcggcatggtctttgccgcacgctggtggcggcggcggcatcacgctggcggccctgatcggcctggtggatgccatggagagccggtgcaacacgcgctggggcgagagggcgagcatgagcggcaagctgcgggcgctgctgctctcgctatgcctncggagccacct

SEQ ID NO: 6315 - DNA, 445 bp, Triticum aestivum
  Clone ID: LIB3281-038-P1-K1-C2
gaaatcttcaaaaccttgaaatactgaacatgtccagcaacaatcttcatggtttagtgccaaaggagatctttagaattccaacactaagggaaatttatttatctttgaacaacttcaatggacaacttcctaacgacattggtaatgccaaacaactcagaaatctagaactctcttcaaatagtctatctggagatattcctagcactctgggtgagtgtgcaagtttggaagatatcaagttggactggaatgttttcagtggaagcatccccacttcattaagcaaaataagtagcctaaaagttcttagtgtttcccacaataacattactggatcaattccagtgtctcttggcaacctacaatatcttgagcaactagatctgtcattcaaccatctcgagggggaggtcccaaaagaaggaatcttcaagaatgt

SEQ ID NO: 6316 - DNA, 336 bp, Triticum aestivum
  Clone ID: LIB3281-038-P1-K1-C3
cggacgcgtggggagggtttttggagaggatactcttgccattcctcgccggccgcatgtgggctcacctcggcggacgctccaatcaatgagagctgattaatcggcggcggatccgtcgatccatgagatccacgccaccaagagatggggtctcgtctggagtgcagatcatgacgagaagtcagagctatgtgacactgatatcgatgactatgctgagaaggcgtacacagaccttaagtctggcatgcttgtggagaagttcggcgcccacaggttcatatgcccgatctggcccgggaagaagaagcaggactaccgctacaatgagct

SEQ ID NO: 6317 - DNA, 123 bp, Triticum aestivum
  Clone ID: LIB3281-038-P1-K1-C4
ccccttgcgatcgaatcgattcagtcaggatccccactgatcgccgtggtcaaagaggagagcgcggcgccatgtgggccgtgtccatcctggcgtccaactgcgccgactgcgcgtgcgagg

SEQ ID NO: 6318 - DNA, 341 bp, Triticum aestivum
  unsure (1)...(341): unsure at all n locations
  Clone ID: LIB3281-038-P1-K1-C5
cccacgcgtccgcccacgcgtccggaacatcatctttatccaaatatcttcagctataactgacatcccagcagcgcgtgggagccggtgtcttccgccagagctgggtctncttgccggcgaccttgccatcaccagcctatctgcagtttgcagggatggacatatggattgaatggtaccctcctgaaatctacacagatgtcagatctgagaaagaagaaatagggcaaagaaattcagatcggagaaagaagagatggagaacaattttaactgaagagttgaagaagactaagcacgagtccccctgaagtgcttgaccaccggccggttgcagt

SEQ ID NO: 6319 - DNA, 227 bp, Triticum aestivum
  Clone ID: LIB3281-038-P1-K1-C6
cggacgcgtgggttcagggcgactgttagctgtgtgaattccctgccatgatcttgttagattttaatctctggacatggcatgtgtattgttagttttgggtggtgatttaggggaaaaatgcatggtccgccttactaactaatttttttctttgcatattttttctgccggtgatggaacactctcagattcaaaatgaagaggggccatgtcagatagggatg

SEQ ID NO: 6320 - DNA, 384 bp, Triticum aestivum
  Clone ID: LIB3281-038-P1-K1-C7
cctcctcctcccctagggttttgctgcccccctccacacccgtgccgccgccgccggcgccgcccgcgtccccccatggcgctgccgaaccagaacaccgtcgattaccccagcttcaagctcgtcatcgtcggcgatggcgggactggcaaaaccacttttgtgaagaggcatctcactggagagtttgagaagaaatacgagcccaccattggtgttgaagttcacccattggatttcaccactaactgcggaaagatccgtttctactgctgggacactgctgggcaagagaagtttggtggccttagagatggatactatatccatggtcagtgtgcgattatcatgtttgatgtcacttcaaggctgacctacaagaat

SEQ ID NO: 6321 - DNA, 339 bp, Triticum aestivum
  Clone ID: LIB3281-038-P1-K1-C8
cccacgcgtccgcggacgcgtgggtgctgttgtcacaattcaagagagtttgggaagcgcctgatgatataactggtgaaataaaggggacgtcgtcccaagtacaatctgcccaacagcttatccaggactccctggctgcgcacagagaacctgtgaggagcagttacgcaggattagatccgttatataggtccagctacccgtatggcagctcggcctacccgtcatcatcgctgccatcttattctagcatggacgggagtggatattcatcgtcagggctcggtggttacgggtccacttacccgttactaagctggtagctgtttgccatca

SEQ ID NO: 6322 - DNA, 431 bp, Triticum aestivum
  Clone ID: LIB3281-038-P1-K1-C9
cggacgcgtgggcggacgcgtgggtttgaggccagcattccttgcagtgcacctgctgctgataaaggttatccggtcaaggagtctattattccttcaaatggaaagaagaggctagaattgcctgtgcagaaaaacatattgacaaattacttctgcttagcatcgcttgaggcaaaacggaagttcagggcacctaaggttacacccaagcaaaaaatgttgaatgaatcttctttgccgagccgtcagactgaagactctggcacccctgattcaattgaagacactagcttgccaatgaataatattcaattctctcagtatagttctgagcattttagctctgaaccttctcgagatgattcaattgatgcttctcaacgtattactggtcgagccttcccctgggacgattcagatagtgtttc

SEQ ID NO: 6323 - DNA, 301 bp, Triticum aestivum
  unsure (1)...(301): unsure at all n locations
  Clone ID: LIB3281-038-P1-K1-D1
gtttcacatcatgagttcctatcgtcgcttgagtacattgagtttgcgggtgtcttcaacggcatggctgccaaggacgtctaagtttggtatatgaggatgttgtagagtttcgaaagcaggacaagtcttcaacatttcagtcaaccgcgagtttcaaggcgagatatgctgggaaggatgccttttcaattcaataatacaaactctgttagcttgagttgaaatgtgctactgctataaggttgtcttgaactagctctgggaggttgaattgagctatactatgatgttnnaaaaa

SEQ ID NO: 6324 - DNA, 337 bp, Triticum aestivum
  Clone ID: LIB3281-038-P1-K1-D10
cggacgcgtgggcggttcgccggagggggaatagcagggcacagggtctctttccactctctgcctctttccccgctttatatctagagctttataaacacttgtccacccttttgtgctctgcacaaatctaacaccttattaaacctccaagcgcgcgggctccccgcctcctccagattccggaggacgcgagcgggggatccacgggaccttctacttgtagcacctcctgccagggatgccgcgcatacaacaaccactgcattttttacctccagagcctaaagtagtcgtggcggagaacgagaacgacaagatggttgatgttcatgac

SEQ ID NO: 6325 - DNA, 343 bp, Triticum aestivum
  Clone ID: LIB3281-038-P1-K1-D11
cccacgcgtgcgcccctcacccaatgcatccaacaccgtggcggcggcgcgcgcaagctgctcgactgaaggcctgctaggcgaagatgttcgtcgagaagcgggacgggcggacggagacggtgcactttgacaagatcacggcgcgcctcatgaagctcagctacgggctcatccaggagcactgggacccggtgctcgtcgcacacaaggtatgcgcggcggtatacaagggcttcaccacctgccagctctacgagctcgcctgcaagacctacgtcgcgctcaccgactaccaccgagactatgcctcactcgcggcgaggattgctgtttccaacct

SEQ ID NO: 6326 - DNA, 255 bp, Triticum aestivum
  Clone ID: LIB3281-038-P1-K1-D12
tagactcagatccccatcacccaatccattcaacaccactaaaagcggcgcgcgcaggctgctcaactgtaggcctccgaagccaatatgttcttcgtgaagcgggacgggcggacggagacggtgcactttgacaagatcacggcgcgcctcaagaagctcagctacgggctcagtcaggagcactgcgacgccatgctcgtcgcacacaaagtctgcgcggtggtatacattggcgtcacctccagcctgctc

SEQ ID NO: 6327 - DNA, 453 bp, Triticum aestivum
  Clone ID: LIB3281-038-P1-K1-D2
ggaagcttcaactgttgtgctcttgctctctagctagtagtggttgctatcggtgctactaccgccgccgtccaaaccctatccctgatgccgcagcaggaggtgcccgaccagatcgccgcaaggtggctcgcggtggaggcgccggagcgaacggagagcctccagaggagcggctccaacagccgcctcaacgcgcatgcgccggaattcgtgccgcgggtcgcggcggtggttccaccgccacagccaccgccggcatgtgattcgtgtgtttgcggtgccctcgcctccacctggcgcgggtttctttgcggctcccccgcctcccccgtcgttcgagttcttcgcgccggtgagggttggcggtgcatttgtggccgaggagccagagcctgatatggatcgcgcgacgccacctgttgcttgaccggcggtggacgggcttactga

SEQ ID NO: 6328 - DNA, 395 bp, Triticum aestivum
  Clone ID: LIB3281-038-P1-K1-D4
ctattccggcttctttctgtacaagctacagacccagccatggcggcgacgatccagtccgtgaaggcccgccagatcttcgacagccgcggcaaccccaccgttgagggtgatgtgtgctgctcagatggaacctccgccagggccgctgcttccagcggtgcatcaactggtgtttatgaagctttggatctgagagacggcggatctgtctacttgggaaagggtgtttccaaggctgttgacaatgcgaacttgattatcgcaccagctttgattggtcaggaccctacagctcaaactgagctcgacaactttatggttcatcagcttgatggaaccaataacgaatggggttggtgcacgcagaatcttggtgctaatgcaatcctggc

SEQ ID NO: 6329 - DNA, 92 bp, Triticum aestivum
  Clone ID: LIB3281-038-P1-K1-D5
ttcccttccccaaaccagaccaagcaagagcaaccttggctccgattggcgtgggcagcaccctccccgacggccagctcggtggttcgacg

SEQ ID NO: 6330 - DNA, 351 bp, Triticum aestivum
  Clone ID: LIB3281-038-P1-K1-D6
gcaagcaaagcaaagcaattgcaattgatattggatcggcatccgcagagaattgcgctcctctccgatccacccaattgcaatcgcaaaattgcgtcctccgtcctggatcgccggccggccattgctcacctggatccgccccaccacatcagagcagagcagtttcagcaggcagggagacgacatcagtcaggccggtgaagcagtatgatgatggggaccgatgtgtgttcttcgcggatgctgtcgctgccccgttacgagagcggcgacgaggagctcaccgtgctgcccaggcacaccaaggtcgtcgtcaccggtaacaaccggacaaagtccgtgctcgtc

SEQ ID NO: 6331 - DNA, 374 bp, Triticum aestivum
  Clone ID: LIB3281-038-P1-K1-D7
gcggcggcgcgcgcataggaggcgaagcagcagcggagccaagccaccgacgccaccatgggtatctcgcgtgactccatgcacaagcgccgggccaccggtgggaagcagaaggcgtggaggaagaagcgaaagtatgagctcggccgccagccagccaacactaagctttcgagcaacaagacagtgaggagggtccgtgttcgcggaggtaacgtgaagtggagggctctccgtctggacactggtaacttctcatggggtagtgaggctgtgacccgcaagacccgtctgctggatgtggtttacaattcgtcaaacaatgagcttgtgaggactcagacccttgtcaagatgccattgtgcaagtgatg

SEQ ID NO: 6332 - DNA, 259 bp, Triticum aestivum
  Clone ID: LIB3281-038-P1-K1-D8
cggacgcgtgggccatacgcatcttgcttcttaactagaaccctcgcctttggccgtggcgagcccttggcggcagcaaaacttaacccccttgccatcacgggaaaaccttaacccggtcgacggcgtgtttgggtgtcaacccgctggacatacccgccttcaaggtgacaacttttcccggttggccggcccgtttgaaaccaaacccttcaaaggatggcggcccaacctacattatcaaaaagaaccccggccg

SEQ ID NO: 6333 - DNA, 439 bp, Triticum aestivum
  Clone ID: LIB3281-038-P1-K1-D9
cggacgcgtgggccaggttgttcatgggggatctgcagttacagagaatggcgcattaagttcacttgagttgaagagatcggcgtcttttcaacaatgtgaagctgcagagccattggcaaagcatctgcgtgtggaccagttgctacctgaaaatgcgcttaggcaaagaagaattatgagcgatgctgcaggtcattctgctcaaatgtcgaaaagtcctgtgcgagctccccttgggatacccttttgttcaacaagtgtaggtggatcaaggaaattactaccgccagcagtttatgcaggggaagatcacttcagcagctgttatgagcaaggtcagctgttgaacacggaggttctgcgtaagcgcatggagaaaacagcagaaacactgggtctggcaggtgtcacaatggattgtgctgaacttctgaat

SEQ ID NO: 6334 - DNA, 362 bp, Triticum aestivum
  Clone ID: LIB3281-038-P1-K1-E1
cccacgcgtccgcggacgcgtgggcggcgacgtctaccccgaggccctcaccgaggaggacagcctcgtcggcggcggcgactccaactccgtggattgcttgcatggatcatacagcagctctttaagcctccacggtgtcagagttgacgacgagcactcggctcttgagaacagcagcaggcctcctagtcatattaatatcctaacaccacaagatgttgtgcccatcgaagtggcacggtctaggttcctggacatcatcattgaccattttattggccagaatgttattgaggtggaagaaccctctctctatgactctatcctggccagcaatagaatcaacaaaagaaagcaac

SEQ ID NO: 6335 - DNA, 433 bp, Triticum aestivum
  Clone ID: LIB3281-038-P1-K1-E10
cggacgcgtgggaaccaagccaatctcgccggagaaagaagcgtcgacgatgtccggccgcggcaagggagggaaggggctgggcaagggcggcgccaagcgccaccggaaggtgctccgcgacaacatccagggcatcaccaagccggcgatccgccgtctggctcgccggggcggcgtgaagcgcatctcggggctcatctacgaggagacccgcggcgtgctcaagatcttcctggagaacgtcatccgcgacgcggtcacctacaccgagcacgcccgccgcaagacggtcaccgccatggacgtcgtctacgccctcaagcgccagggccgcaccctctacggattcggcggctaggccacgcgaatcgatccccccaccaccatatttgtgctcgtagctagctatggctgtgtattgttcatgggc

SEQ ID NO: 6336 - DNA, 436 bp, Triticum aestivum
  Clone ID: LIB3281-038-P1-K1-E11
cccacgcgtccgcccacgcgtccgcggacgcgtgggctggatccaaatgagttaagtgttgcaagagaagggaagaagaaagattttcctgatggcattgctgaatgtggcactgatgcactccgtttcgcactgatttcttacacttctcagtctgacaagataaatcttgatatcaagagggttgttggatatcgccaatggtgcaataaattgtggaatgccattcgttttgcaatgggcaagcttggtgatcattatgctccaccagcaaccattgttgtgtcttcaatgcccccggtctgcaaatggatactctcggtactcaacaaggctattggcaagactgtgacctcattagaagcatacaagttcgctgatgcaacatctgctatttactcatggtggcaataccagctatgtgatgtatttatag

SEQ ID NO: 6337 - DNA, 352 bp, Triticum aestivum
  Clone ID: LIB3281-038-P1-K1-E12
cggacgcgtgggcaccaccgtccgaccagccgtgtgtgtcaaccaaaagcagcacaggtccccacggtcggtctacatatactccccaccgactgcttctcctactaaaccactcgcgtacgtacgtaccaactgtgccgatcgaacaatgcaccggcagatggccgtcgcggcgtgggcactgctgctgctgctgtccgaggcggcgtcacagtgcgcggtgcaagcgctggtgccgggcgtgatgatcttcatcgactcggtggaggacgccggctacaacaacctgctggccacgctggtgcgcgccgacttcccgccctactgacgagacttaccggccacccacgcg

SEQ ID NO: 6338 - DNA, 392 bp, Triticum aestivum
  Clone ID: LIB3281-038-P1-K1-E2
gccacacatcatgagtcgctatcgccgcttgattacattgagtttgctgatgtatgaaacgagactgctgccaaggacgtactaactctgcatataatgatgttgtagacatacaacagcatgacaagtcttcaacatttcagactaccgcaagttgtcactgcgatatatgcaacagaaggatgcccttctaattctattaatcaaaccacaccaaccttgaggtggaaccatctaactggtatcaggctaggctcgcactacattatgagaggccgaattgtgctccactatgttgttgaagtggaagaaccctctctatatgactctatcctggccagcaatataatcaacataagaatagcaacaagaggtgcaattcttaggcgacc

SEQ ID NO: 6339 - DNA, 395 bp, Triticum aestivum
  Clone ID: LIB3281-038-P1-K1-E3
tgccattccaaaacctctcaaaaccctcgttctccccactccctgcctcctcctccggcgccgccggtgcctagcaagatgagtcggcaccctgaagtaaggtgggctcaaaggattgacaaggtgtatatcacagtacaattgcctgacgcaaaggatgccaaggtcaacctggaacctgatggtgtattctctttctttgccactgctggaactgatgggaactcctatgaatcgaaactggatttgaatgacaaagagaatgtcgaggcaagcaaagtaagtgttggtgtcaggtccatattctgtattttggaaaaagccgacgccaaatggtggaataagcttgttcgagatgatcagaaggcaccacacttcgtgaaagttgattggga

SEQ ID NO: 6340 - DNA, 443 bp, Triticum aestivum
  Clone ID: LIB3281-038-P1-K1-E4
ggtccatctggccgacattgggttctggatccaattgatgggactaaaggtttcttgagaggaggccaatatgcaatcgcactggcactgcttgatgagggcaaagttgttttgggcgtgttgggatgtccaaatcttcctttgacatcaataagcaacctcaatggtagctcatcaggagatcaaacaggggccctcttttcagctacaattggttgtggtgctgaagtagagtcattagagggctctccaccacaaaagattagtgtttgtaccattgacaatccagtgaatgcctcgttctttgaatcctatgaaggagcacacacaatgcatgatttaactggctctatagcggagaaacttggtgtccaagctcctccagtcagaatagatagccaagcaaaatatggtgctctggcccgtggcgatggtgccattta

SEQ ID NO: 6341 - DNA, 429 bp, Triticum aestivum
  Clone ID: LIB3281-038-P1-K1-E6
cggacgcgtgggattctgacggtagcttcatcccaaaacctgattactggggtggctacagattgacaccaaatctttgtgagttctggcaaggccaacagtctcgtctgcatgaccggctacagtattcacagcgagaaataggtgggggtacagaatggcacatgcaaaggttgtccccttgatcagtaagctccttaaagctctcgcctcttggtaataaaagggggtgtcgttttggcacctgcgcacactttttcctggtacctaatggactgcaatttcttgattggagatgtgcgctagatgtatttttgtgatatatatgtgaatgcagagaagcaggatacgtgaggtgtatgagccgatttaatgcagcgggcccaaactcgcgaggcaagctgtgaagattgctgctatgttgcttgt

SEQ ID NO: 6342 - DNA, 312 bp, Triticum aestivum
  Clone ID: LIB3281-038-P1-K1-E7
cggacgcgtgggcgccggcctcccccctctccccgtagctcgccggcctcctcgttgctcgccggcctccccgtctccccgtagctcaccggcctctccctcttccaccgccacttctccaccaccccgcctccactcacaccccggaggtaaacaaattccaatcttttgcgccggcgacgagcttctactccacgaaggtgtggatgtgcatgtgctagcgctggatctgggcgacagaggcatggatgtggagcggcacccgagcggctgatctggagcggtgccggagcggcggagcggccgatcttg

SEQ ID NO: 6343 - DNA, 436 bp, Triticum aestivum
  Clone ID: LIB3281-038-P1-K1-E8
atcgggacgaggcaatggcgtctccgagattcaagcccgtggaggagtgcagctccgaggggaggtcggggcagacggtggccgcagacttcgacggcacgctgctccgctcctccaacgccttcccctactacctcctggtggcgctggaggccggcagcgtcctccgcgccgtggcgctgctcctgtcggtgcccttcgtgtacgtgacctacatcttcttctccgagtcgctggccatcagcaccctggtgtacatctccgtggccgggctcaaggtgcggagcatcgagatggcggcgcggtcggtgctgcccaagttctacgcgcaggacgtgcacccagagagctggcgggtgttccggtccttcggcaagcggtacatcatcacggccagccccagggtcatggtggagcccttcgcagggagttcctc

SEQ ID NO: 6344 - DNA, 445 bp, Triticum aestivum
  Clone ID: LIB3281-038-P1-K1-F1
cccacgcgtccgcccacgcgtccgcataccctcgccgtctcctctcccacgaagcgcagcccgtctagatggcctccgaggcggctatagtggcggtgcccgagaaggtgatcctaaagaggaggagggaagaggtctgggccgccgagaagaagcagaaggttgccgccgagaagataaaggccgccgagaacaccaaggtcatctacgcccgcgcggagcagtacgccggggagtatgaggcccaggacaaggagctggtgcaacttaagcgtgaggcccggatgaagggtgggttctatgtcagtcctgaggcaaagctgctgtttgtcggcccgtatccgtggtatcaatgcaatgcacccaaagaccaagaagatcttgcagcttttgcgtttgaggcagatttttaatggtgtgttccttaaggtcaacaaggccacca

SEQ ID NO: 6345 - DNA, 285 bp, Triticum aestivum
  Clone ID: LIB3281-038-P1-K1-F10
ggcaccgccatgaaccgcgtcatgagcggcatcgtcaccatgaccttcatctcgcggtacggggccatcaccatggccggcgcattctacctttatgccgccgtcgcggctgcctcgttcgtgttcatctacacctgcctgccggagaccaggggccgaaacctcgaggacatggagcagcttttccgcacaaagtgatcgatcccccaacccgtggtcacttttttttttgaaaaatcaacccgtggtcacattgatattaacaaatctctggatttggatggt

SEQ ID NO: 6346 - DNA, 440 bp, Triticum aestivum
  Clone ID: LIB3281-038-P1-K1-F11
tgccgtgccggtactaatggggaggggacccacgcgtccgcggacgcgtgggtggatttcaaatgttcatttcttttgcaaagttgagtggttaagaatgcctgttacgtatccggggaacttctggagagcccgaaaaaactgtgcaaccaccgggaaaccaagaccaaatatcctaacgacctaaagataccgggggaaacatatcaagctactttgcaaaagagaaaagaaaaaagaggcaacaacacctgttcctttttacacttttctttcggttctacaaggctgaagagcaagcggaaaccactcctggggagtagggcagcttcgacgatgtgccgccgaatgtttcaggagttgcaccagctgccagcaaagaggatgaagaacagtcttgcggatgcacacctctgttgacgaaagcaactgactgcatg

SEQ ID NO: 6347 - DNA, 374 bp, Triticum aestivum
  Clone ID: LIB3281-038-P1-K1-F12
cggacgcgtgggcggacgcgtgggcgaccggcggtaaggcgccgaggaagcagctagcgaccaaggccgtccgcaagtcggccccggccaccggcggcgtgaagaagccccaccggttccgccccggcaccgtcgcgctccgtgagatccagacgtaccaaaagagcacggagctgttgatccgcaagctgccgttccagcggctggtgcgggagatcgcgcaagacttcaagatcgacctccgattgcagagcttcatcgtgtccgcactgcaggaggccggcgaggcgtacctcgtcgggctcttcgaggacaccaacctctgcgccatccacgccaagcgcgtgaacatcatgcccaaggacattcagctc

SEQ ID NO: 6348 - DNA, 433 bp, Triticum aestivum
  Clone ID: LIB3281-038-P1-K1-F2
gggattccttgtcttcaacgctgttggaggtggaactggctctggccttggttcgcttctcctggagcgtctctctgttgactatggaaagaagtccaagcttgggttcacagtttacccatctccccaggtctccacttctgttgttgagccatacaacagtgtcctgtccacccactcactccttgagcacaccgatgtctctatccttcttgacaatgaggccatctatgacatctgccgccgctcccttgacattgagcgcccaacatacaccaacctcaacaggcttgtttctcaggtcatttcatcattgactgcttccctgaggtttgatggtgctctgaatgttgatgtcaacgagttccagaccaacctggtgccctacccgaggatccacttcatgctttcctcctatgccccagtgatctca

SEQ ID NO: 6349 - DNA, 53 bp, Triticum aestivum
  Clone ID: LIB3281-038-P1-K1-F3
ttatcgatgagtcttctgcgagatccaccatgtttctacaccatccgcttgat

SEQ ID NO: 6350 - DNA, 408 bp, Triticum aestivum
  Clone ID: LIB3281-038-P1-K1-F4
gcctctattatttctattaagaaggaagcatgcagggcgccactcagatctctccggccctggctcgcctcgtgcccggcaccgcgcctctcgtcaacgccgccccgcccgaggagaggaggaaggacgagcgatggcatcgccggccgcgcgcgcggcctcggcgctcctcctcctgctcgccctcgccgtcgccagcgtcctctccgacggctccgaccaccgctacaagctcggcgaccccgtcccgctctacgccaacaaggtcggccccttccacaaccccagcgagacgtaccgctacttcgacctccctttctgctccccggagaaagtgaaggagaagagcgaggccctcggcgaggtcctcaatggggatcgggtgggggatgcgccctacaagcttga

SEQ ID NO: 6351 - DNA, 435 bp, Triticum aestivum
  Clone ID: LIB3281-038-P1-K1-F5
tgcacgcgtgggcggacgcgtggtctctttcttctctcgccgccgccgccgccgccatgtgagggaggaagaaaacccgcgagcccaaggaggagaacgtgacgctcggccccgccgtccgcgagggggagcacgttttcggcgtcgcgcacatcttcgcctccttcaacgacaccttcatccatgtcacggatctgtccgggagggagacgctcgtccgcatcaccggtggcatgaaggtcaaagctgatcgtgatgaatcatccccttatgcagctatgcttgcatctcaagatgttgctgtaagatgtaaggagcttggaattactgctctgcacattaagctccgtgctactggtggaaacaagacaaaaactccaggtcctggtgctcaagctgcgcttagagctcttgcacgttctggcatgaagattg

SEQ ID NO: 6352 - DNA, 372 bp, Triticum aestivum
  Clone ID: LIB3281-038-P1-K1-F6
cggacgcgtgggcccggacacagagcccgtgcgctcgaacgctcgtcgaaaaaagaaaaactcgcggcagcacccatctctattcccgaactcgccggcgacgagtgacctatggcggacggcggcgagatggacgaggaggcgatgatgcgcgccttcttcccgacctcatttggcaaggcgcccacccgccccagcgccggctgccactcctccaccctccgcaagccccaaaaccctagctccaacccctccacctatgccgccgccgaggaggacgatgtcggtggcgccgttgtcggaccccctaggccggccaaggaattggctcctatccaggaagatgacgaggagggtggcggtctgattggg

SEQ ID NO: 6353 - DNA, 396 bp, Triticum aestivum
  Clone ID: LIB3281-038-P1-K1-F7
cggacgcgtgggttcccagatcccccaagagctcgcactcccccaccccaccccaggctctcgtcccgatggcccgcacgaagcatacggcgaggaagtccaccggcggcaaggcgccgcggaagcagctggcgaccaaggcggcgcgcaagtccgcgccggccaccggcggcgtgaagaagccccaccgcttccgccccggcaccgtcgcgctccgcgagatccgcaagtaccagaagagcacggagctgctgatccgcaagctccccttccagcgcctggtgcgggagatcgcgcaggacttcaagaccgacctgcgcttgcagagctccgtcgtctccgcgctgcaggaggcggccgaggcctacctcgtcgggctctttgaggacaccaacc

SEQ ID NO: 6354 - DNA, 318 bp, Triticum aestivum
  Clone ID: LIB3281-038-P1-K1-F9
cggacgcgtgggttcccacatccatcaagagctcgcactcccccaccccacgcgggggtctcctcccgagggcccgtactaatcatacggctaggaattccaccggcggctaggcgccgcggaagcagctggctaccaaagcggtgcgcatgtccgctccggccaccgtcggcgtgaagaagccccaccgcttttcgcctgtcacctttgcgcatcttgagatccgtaagtaccataagagctctgatctgctgatacgtatgctccccttccagcgcctgttgctggagatcgcgctggacttcaatgaccgacctt

SEQ ID NO: 6355 - DNA, 236 bp, Triticum aestivum
  Clone ID: LIB3281-038-P1-K1-G1
gggcgacaaccagagctggaagatcctcccctggggcgaagaggcctacgccggaggcagcgccaacgccccccgcggcggctcctcagagcccaccgtgcgcatcttctgcaaggccgacgacggcttcagcgccaccgtccgcaacggcactgtggtcctcgcgcccaccaacccccgcgacgagtaccagcactggttcaaggacatgaggcacagcaaccgcatcaaggatg

SEQ ID NO: 6356 - DNA, 448 bp, Triticum aestivum
  Clone ID: LIB3281-038-P1-K1-G10
cgctcctcgaccttcatccgctctctcagctcgaaccaaggcgagttcgtcggcgaccatgtctgggcgcggcaagggaggcaagggtctcggcaagggcggcgccaagcgccaccggaaggtgctgcgcgacaacatccagggcatcaccaagccggccatccggcgcctggctcggagaggcggcgtgaagcgcatctcggggctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctaggcgtccaccttcgtccgcagctcgtcgccgcctcgtcgtcagtcaacaactccgccccgctgtggccccgggcgcgag

SEQ ID NO: 6357 - DNA, 449 bp, Triticum aestivum
  Clone ID: LIB3281-038-P1-K1-G11
cgcacacgccaagcgaccgaatcgccgccgcatccgcctagggcttcgccggcggggcagatccctacttgcggccgtctgctgcgggtcctccgtgttcgtggctgctgtgccggcgccgacagaaatttccctgccgtcagattttgtgagtgttcgagcttctgcaatgggtggaagcaactatgatgacgactgggtgttgcccagtgctgacatcactcttgttcttgttggaaaacttggctatggcaagagtgcaactggcaatagtatccttggacgggaagcatttgtatcagaatactctcatgccagtgtgacaaacacttgtcagatgggaagcaccatgctgacggatggccgcaccatcaatgttattgatacaccaggattatttgacatgaccgtaactcctgaggatgctggcaaagaaattgttaagtgca

SEQ ID NO: 6358 - DNA, 254 bp, Triticum aestivum
  Clone ID: LIB3281-038-P1-K1-G12
cccacgcgtccgaattaatcgaacccatcccaccggggaagaagaagaagaagaagcagcctctccttctcctttaagcttcgaatcatccttcccccctccctccctcccacctgatctcgccgcgacgaagcttccaaaacccccaaaaggatcccccaatcttcgcctctgcctgcggcccgatcaagctttctgcagcggttgccgcgcgactcggcccgggatccatggggaggtacgagctgctcaag

SEQ ID NO: 6359 - DNA, 404 bp, Triticum aestivum
  Clone ID: LIB3281-038-P1-K1-G2
gcgggctactaatttctgttggattccgtggttgggtttggatttggagacatgggggaagtggaggacatgctcaaggactatgagatcaagaaggaaggcgaggctgagatcctcatgctcgcgagtaacgccgtgttcttcaatcccgtccaggtgcacaacagagatatgtccattgctgtgttaaggacatttgttgccaagcgcaaggaagaatatgaggaactgataaacaaaaggaataataagtctcataaaaaagacaatcaggttgaaacacctgttgtaaatggagacactgctttaactagccagcatgatgaaatcggtgttgttcatgaaaaggagacaaatcaggctacaaatgaaataggagatctgtcaaaggagaaacaaagaca

SEQ ID NO: 6360 - DNA, 237 bp, Triticum aestivum
  Clone ID: LIB3281-038-P1-K1-G3
cccacgcgtccgcggacgcgtggggaacatacaagattagatacaggcaaggaaagagtttcattactaagagatcatgcatgttcaattctttttccttctgagggggtctgcttcaaatcctccaattacaagtagaaactgtggcctgctccaaaggctactgctttgtgctctgttttatttactgtgtgctctggaaaacaaacaaaacatagactcataggcccggaacac

SEQ ID NO: 6361 - DNA, 447 bp, Triticum aestivum
  Clone ID: LIB3281-038-P1-K1-G4
cccacgcgtccgcccacgcgtgcgaaacattctaagggtaggaccaacgagaagagcatggaggtcaccacacttgacgggagtggggaaggaacactattagccacgggctcctatgatggccaagcaagaatatggagtagggacggagagttaaagcagactttattcaaacacaagggacctatattttctttaaaatggaataggaaaggtgattttcttctaagtggcagcgtagacaaaactgctattgtctgggatacaaagacatgggagtgcaagcagcaatttgaatttcattcagctccaacactagatgttgattggcgaaacaacaactcttttgcaacatgctcaactgataacatgatctatgtttgcaagattggggatccacgcccagttaaaacattcagtggccatcaaagtgaaggtaatgctatc

SEQ ID NO: 6362 - DNA, 384 bp, Triticum aestivum
  Clone ID: LIB3281-038-P1-K1-G5
atttctctcctcctcctcctgccaccgatcccgaaccagggaggaacccggcgcgaggagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactac

SEQ ID NO: 6363 - DNA, 121 bp, Triticum aestivum
  Clone ID: LIB3281-038-P1-K1-G6
agtttatcgtcgcgtcgtttagcgtttagctgtgctccttccagatccaagtcggtgtctgtctgtgtaatgtttacctggtactgattcagtcatttggacatggtgtttatgttggttc

SEQ ID NO: 6364 - DNA, 435 bp, Triticum aestivum
  Clone ID: LIB3281-038-P1-K1-G7
cggacgcgtgggcccaaacccaaaccctaggccgcaccaggtgaaccggcgcccggtgagtcggtccgtccccgcggcgagccatgagtaagctatcgaccgacgcactcaaggaggccatcacccaggtggtggcggatgccaaggagaagaacaggaagttcaccgagaccgtcgagctccagatcggcctcaagaactacgacccgcaaaaggacaagcgtttcagcggctccgtcaagctgccccacgtccctcgccccaagatgagggtctgcatgctcggtgacgcccagcatgtgggagaggctgaaaagattggtcttgattccatggatgttgaagctcttaagaagatgaacaagaacaagaagcttgtcaagaggcttgccaagaagtaccatgctttcttggcctcggaggctatcatcaagc

SEQ ID NO: 6365 - DNA, 402 bp, Triticum aestivum
  Clone ID: LIB3281-038-P1-K1-G8
cggacgcgtggggcctatggaggtggcgcatatggtgcacctggcggctatggtgcaggtgcaggcgggtatggtggctatgggggaactgggagcatgggtggtggtgggagcgcgagcggtcgaggctcgggcagataccacccatacgggaaatgagtccacagctggttcctaggatctgataataaacacatacacccactcatttttgctatgagaagttgcaacaccccattgactttgtcggatcagaacattttgcattcttgcattgcactggcatcgtatcggacacaaatgtagattctagttgctgaaaactgaaccagcccgagctttatgtagaagcttcagctgaaaaactggtgtattcattagaaccctttaaaagtcgaaccc

SEQ ID NO: 6366 - DNA, 432 bp, Triticum aestivum
  Clone ID: LIB3281-038-P1-K1-G9
cgttacctttctgctgccaacccgacctaaggttgttcgtcgccagcatgggtctggcgaaggatggcgccgagatggaggaggggacattggagattggcatagagtatagaactgtctccggtgtggcagggccattggttattttggacaaagtaaagggcccaaagtatcaggagattgtgaacatccgattgggagatggcaccactcgtcgtggtcaagtcctcgaagttgatggtgaaaaagctgttgtgcaggtatttgaaggtacttcagggatagacaacaagtatactactgtacagttcacaggcgaggttttgaaaactcccgtctcacttgatatgcttggacgcatttttaatgggtctggaaaacctattgataatggcccccctatattgcctgaggcttacttggatatttctg

SEQ ID NO: 6367 - DNA, 252 bp, Triticum aestivum
  unsure (1)...(252): unsure at all n locations
  Clone ID: LIB3281-038-P1-K1-H11
cggcagaaccctcccaacaagcagcagaggacaccggcggggggcgcggcgcggcgggggggagcggcaacaagaccggccgcagcgcagacaaaccagccggcggccgagaacaaggncgagaaggcggcggagaagacccccgcggacaagaagcccaaggccgagaagcggctgccggcgggcaagacggacgccaaagaagccggcggcgaggccaagacccggggccggaagaagggcagcaaggcc

SEQ ID NO: 6368 - DNA, 310 bp, Triticum aestivum
  Clone ID: LIB3281-038-P1-K1-H2
ggtttgtacaacctcttgttcaaccttacaatctgttgcctctcgaatctccatcagcctcacgagcatcgccatcacgctcgtgatcatcgccatcaccctcatgatcagcgcctactacgctgtctgcaccgacttcgagtgagagcatggctcggaacggtgcactgctacgcgtcaacgccgaccgatcgagcacctcattctggcgatcttggagtgagagcgccgctctcaaagctgcactgctacgcgccaccaccgaccgaccgagcacctcaagtcatcctggcgatcttggagggagagc

SEQ ID NO: 6369 - DNA, 387 bp, Triticum aestivum
  Clone ID: LIB3281-038-P1-K1-H3
cggacgcgtggggcgagagtggaggttgctcggactcgggggcaccgaagcttgtctttgtcattggaacacatgttgaagagggggcctacgcacggtctgagtttatgatcttgcagggaggaaaagagtgtccgtactatatgcgcattgggagctgcaaatttgccaccaactgcagatttcaccatccggatcctagtaatatcgccattctcatgctcccttccatgggaaggaggagaaggactaccagggacgatcgtggatcactccacccaaggatgccaaggcgaccaccgagcgctgttatattcccaagaggtgtgtacatgagtgggttggacacactaagggggtctcaacgatcagattttcccccaagta

SEQ ID NO: 6370 - DNA, 456 bp, Triticum aestivum
  Clone ID: LIB3281-038-P1-K1-H4
cccacgcgtccgcctacggcggcccagcttcgccgtgtcgccttccctccagccggctgagcacgttccccggactgctccgcgccgcccgtgtgcggtgctcgtcgtccacctcgggcaggggcaggggcaggggcagcgtctcgcggttccagcgcagcaggatggccgcctcatgtactgagcatgcctacaacaatattttgaccagcctccctaagcctgagggtggtgaatacgggaaattgtacagccttcctgcacttaatgacccaaggattgataagctgccctactctatccgtattcttctggagtcagctatccgtaactgtgatggcttccaagctaccaagaatgatgtcgagaaaatcattgactgggagaacacatctccaaagctggctgagatacctttcaaaccatcacgagttctgctccaggactttactggag

SEQ ID NO: 6371 - DNA, 96 bp, Triticum aestivum
  Clone ID: LIB3281-038-P1-K1-H5
gccatccggctccggcaaggttgctaaaatggataagctcaagggctctgcgcgtcttatgattgtttcagatctcgatcacacaatggttgatca

SEQ ID NO: 6372 - DNA, 139 bp, Triticum aestivum
  Clone ID: LIB3281-038-P1-K1-H6
gctcgacgccacgcgtccacgcacgcgtccgcggcgggtcggcgctcccaccaagcatcagtgtacaccggcggtgtgcgcggcgcggcgggggggagcggcgggagaccggccgtgcggcggcaggccatcgggcttc

SEQ ID NO: 6373 - DNA, 287 bp, Triticum aestivum
  Clone ID: LIB3281-038-P1-K1-H7
gattgagtatccgtccatagggccatcgtagaaggttccttcagcaagtggtggcgcagttggtgttggaagagttggaagtgcatttggtgttggaaccttctacgatggccctattggggatccgtccatagatttcacaccagttgatgtaaccatgccacccactggaggtgggggtacggggctaaactttgcaaaacctgtttaaaatgaaatccagtgatgcaggattgggtacaccccgtgtggtacttgtttgatgttgtttggatgctcctgtggaa

SEQ ID NO: 6374 - DNA, 369 bp, Triticum aestivum
  Clone ID: LIB3281-038-P1-K1-H8
ggagaaggtctctgtccctctgcaccttcacctcccttcttggctggtgagcagcaggaggaggagatgttcccccctggcctgatccaccaccgcgcggacggcccggggcccggcgaggtgccgcgctccggcggcgcgcccagcctcgtgctcacggcggaccccaagcccaggctccggtggacggacgacctccacgagcgcttcgtcgacgccgtcgcccagctcggggggcccgagtaagcaacaccaaaaactatcttaaggacaatgggtgtaaagggactcacgctgttccacttgaagagtcatcttcagaaatacagaatggggaaacaaactggcaaagagacgccggagcaatct

SEQ ID NO: 6375 - DNA, 369 bp, Triticum aestivum
  Clone ID: LIB3281-038-P1-K1-H9
cggacgcgtgggcgccgactagcctcctccgttcccctcctctcttcttgcttgctgggacctcggcgagagagcgagagcgaaagctcccttctgctgctgcaatggcggttcctctggtgctcgtgctcttggtcgccatgttcaccggctcagatgcgatgtactgcgtgtgcaagtcggacgcgaacccggcggcgatgcagaaggccatcgactacgcgtgcggcaagggcgccgactgcacccagatcacctccagcgggccctgcttccagccctcctccgtcgtcgcccactgctcctacgcctgcaacagctactaccagaagaacgccggcatgggcgccacctgcgacttcatgggcg

SEQ ID NO: 6376 - DNA, 408 bp, Triticum aestivum
  Clone ID: LIB3281-039-P1-K1-A1
cggacgcgtgggcgcgccggccgccgagatggagaccccgccgccgccgccgcgctggccgccgggcttccgcttcagccccaccgacgaggagctcgtcctcttcttcctcaagcgccgggtcgccgccggccgcccctccccctacatcgccgacgtcgacgtctacaagtcccacccctcccacctccccgagcggtcggcgctgcggacgggggacaagcagtggttcttttgcagccggctggaccgtaagtaccccaacggtttgcgcgccagccgcaccaccgtcgacggctactggaaggccacgggcaaggaccgctacatctgcaacgcctgccgtgccgtcgggaacaagaagaccctttttaaccaccacgggcgcgccccccgtggggagcgcac

SEQ ID NO: 6377 - DNA, 317 bp, Triticum aestivum
  Clone ID: LIB3281-039-P1-K1-A12
cggttccttctccttcctcggagctccagccatgggtaaggagaagactcacatcaacatcgtggtcattggccatgtcgactctggcaagtcgacaaccactggccatctgatctacaagcttggaggtattgacaagcgtgtgatcgagaggtttgagaaggaagccgctgagatgaacaagaggtctttcaagtacgcctgggtgcttgacaagctgaaggccgagcgtgagaggggtatcaccattgatattgcccttgggaagttcgagaccaccaagtactactgcaccgttattgatgcccctggtcacc

SEQ ID NO: 6378 - DNA, 170 bp, Triticum aestivum
  Clone ID: LIB3281-039-P1-K1-A2
cggacgcgtgggagagagagagagagagagtagagcgagagctccggagatgtcggcggacgagttgcggctggacctggaggagctgcggcggctggagggcctctccaagcgcccccgcgttggcttccttctcttcaacgagatccggagcggccacccccaagttg

SEQ ID NO: 6379 - DNA, 337 bp, Triticum aestivum
  Clone ID: LIB3281-039-P1-K1-A3
agcaaggaagaggaagaggaagcggatcgagtcggcgagagcgagggcgaggacgatggcggcgctccggctagcgttgaggaggttttgcgaccgtgcgctcgggagatcagcgggcatttacgagctcaaggctgccaaggaattccccgacattgatcctgggcatctcaaggctgccaggaaattccccaaacttcgtgtcaaggatgccgatgctacggctctgaatgtctttaaagattcttccgggaccagtcaattcgagggcataaaagatgtaacccctttggaagggccgcatgactctgaggaccttggttgagattcaggaaga

SEQ ID NO: 6380 - DNA, 191 bp, Triticum aestivum
  Clone ID: LIB3281-039-P1-K1-A4
catatgctctgtgtgaaatttctctagcgtgtacatctcacaccacgatctccgccagttcataaccgccggccacgccccagctccttccaatcacctcagcgtacagattgcagcttcaccatcgtctccttgcaagctctgacttggttcgattattcttgccgcctggtgagtccaggttcatgaga

SEQ ID NO: 6381 - DNA, 234 bp, Triticum aestivum
  Clone ID: LIB3281-039-P1-K1-A5
gacgaacacccgccgcaaaaattccaaatcaccaaccaaatcccctcctctcccgcgttccgacgagcaccagccaccatacatggacgctttatccaccggagccggagcgaaggcaaaaaaaggcgcggtggggcgcaaggttggctgccccaagaagaagtctgttgacgcggtccgttaaggccgggctctattttcccgtttgccgcattgggcgcttccttaagaatg

SEQ ID NO: 6382 - DNA, 411 bp, Triticum aestivum
  unsure (1)...(411): unsure at all n locations
  Clone ID: LIB3281-039-P1-K1-A6
agttggtctgtgggctggtctgattattgggtttgtgaccgagtactacactagcaatgcctacagccctgtgcaagatgttgccgattcctgcagaactggtgctgccaccaacgtcatcttcggtcttgccctgggttacaagtcagtcatcatcccaattntcgctattgctgtcagcatctacgtcagcttctctattgctgcaatgtacggcattgcaatggctgctcttggcatgcttagcacaatggcaactggtcttgctatcgatgcttatggccccattagtgacaatgctgggggaattgttgagatggctggcatgagccacagaattcgtgagaggactgatgctcttgatgctgcttgcaacacaaccgcttgttatggaaaggggttttgccattg

SEQ ID NO: 6383 - DNA, 61 bp, Triticum aestivum
  Clone ID: LIB3281-039-P1-K1-A7
cggacgcgtgggctccgacctcatttggaaacctcccatcgaagcgaagccaaggcttttt

SEQ ID NO: 6384 - DNA, 411 bp, Triticum aestivum
  Clone ID: LIB3281-039-P1-K1-A8
atgggtttggatggggatgtctcagtatgcaattctttactcagcatgtatgcgcggtgtatggatttctcctctgcgatggatgtttttcatgagacaaaagatcgtgatgttgtcacctggaacagcattctcactgcatgtgtacagcaccagcatctggaagtagtctttgagttgttcaaccttttgcagaggtcggtgccgagtctggacgggatcagtttaaacaatgttctgagtgcttctgccgagttgggttaccttgaaatggtgaaacaggtccatgcatacaccttcaaagtaggtctggtgaacgatacaatgctcagcaatggtctaattgatacctatgctaaatgtggaagtttagatgatgccccaagcactttgaaatgaagggccccaact

SEQ ID NO: 6385 - DNA, 409 bp, Triticum aestivum
  Clone ID: LIB3281-039-P1-K1-A9
gcgcggacgcgtgggcggacgcgtgggcgccaccgacgaagaaagagagggcggtagaggccagggcgagctcgtcaaaaccgatcgtcgcgggggcttcccaggttcagcggcagagggtgagcggaggcgggtggactagccgccggatatcctactgctcctacggcgtgtacttactgctcatcatcctccagatcccgctcttcagggacccttgtagagcaggcacatgccctacacctatttaaataacatgattacacctggtctgaaatgagatatacccaccatctgttgtgaaggccatgctctaccctggagctatagtgcgcaacctcactaccagcatgagcatgacatttacaaggaggagtgacctgtttgacatatacaatctgacagaagc

SEQ ID NO: 6386 - DNA, 265 bp, Triticum aestivum
  Clone ID: LIB3281-039-P1-K1-B1
tcgtcgttgtgctctgcaattgcagctcgagccccttgaggaaagaagcacaccaagcgatcgaagaacctcgtgtgcatccgaccagtgagcgacgccatggacgccggcaagacgcctcatccgttgcctttgagcggggcccaaaagcagatccgggatgatgtccaattggtttgcgcatgggcgctcgtaaacgccttcgccatcgccggcggccaagcatccttttacatggttggttacacccacctcaagggcatcc

SEQ ID NO: 6387 - DNA, 235 bp, Triticum aestivum
  Clone ID: LIB3281-039-P1-K1-B10
cccacgcgtccgcccacgcgtccgggcattcctgctaacaacaaggggaaggagagcattggttgcctattttggctgctcgccaggatggttctgcagatgcgtggtaccattctcccaggacacaagtgggaaatcatggttgatctgttcttctacagggacccagaggaagctaaggagcttgaggaagatgaggctttgggtgctcctgagtacgctgcagttgcagagt

SEQ ID NO: 6388 - DNA, 326 bp, Triticum aestivum
  unsure (1)...(326): unsure at all n locations
  Clone ID: LIB3281-039-P1-K1-B11
cggacgcgtgggcggacgcgtgggcggacgcgtgggctgtaagccgtcctgagatggcaccacctagtgcatccccaggggcagggcattacatgtcacangtgccaatgttccctccgaggacccctctaacgcctcagcagatgcaggagcagcaactacagcagcaacaggctcagatgcttccgtttgctggtcaaatggttgcgagacctggggctgtcaatggcatgcctcaggcccctcaagttgaaccagcctatgcagcaggtggggccagttctgagccttctggcactgagagccacaggagcactggtgccgat

SEQ ID NO: 6389 - DNA, 274 bp, Triticum aestivum
  Clone ID: LIB3281-039-P1-K1-B12
aaccagtctccaaatcaaccactcttttgctaaccaaccaattccatccatcaagaggtagcagctacaccatatacttaataacaattcggtagcaaaatggctatagggctaaaacaataacaaatcggcaagcattcgggttgggggaactctcatgctgtcatgtcctttttccccacccacactctaaaatacttactatcgcccttaacattgccctcatcaccctcgagagcagggcagagcaaaagcagagctcaaacgttgcagt

SEQ ID NO: 6390 - DNA, 142 bp, Triticum aestivum
  Clone ID: LIB3281-039-P1-K1-B2
gtgaaagctcgtgccattcatacccggagtacctcgacgagtccgtgatgtggacggagagcggcgacgtcggcaagggctttcgctgcattcgcatggtgaacaacattcgccttaacttcgacgcccttaacggtgacaa

SEQ ID NO: 6391 - DNA, 425 bp, Triticum aestivum
  Clone ID: LIB3281-039-P1-K1-B3
cggacgcgtgggcttgcggagtgtgagaagtaagttactactggatccactttcttgtcactagccttgcttgacatgttcatttctcacgctacacttaccatcagaattatgtgattacatggagatatacatcagtgcttggcagttattaacattatggaagaaacttctaattatcttgattatcttgctgccactaactgtgttgtactgataacactgataggcttaactgatgtattcaggtatagctgtcaataacttttatctggacttctcagaaattgttccctagcaatcgaatgattatgtattgcatggtttgatttctcaaatcattctgtggtatggacggttcaaatttttcatttggacagcaaagctagcccatagtggtagtaaaaagtggagtactcttttta

SEQ ID NO: 6392 - DNA, 376 bp, Triticum aestivum
  Clone ID: LIB3281-039-P1-K1-B4
cggacgcgtggggctcgattcagaagctagggtttggggagagcagcggaagggggtaccagccggcggcgatggcgtcggaggaggatgtggcggtgaaggagccgctggatctcatacggctcagcctcgacgagcgcatctacgtcaagctccgctccgaccgcgagctccgcggcaagctccatgcttatgatcaacatctcaatatgatacttggagatgtagaagagatagtgacttccattgaaattgatgatgagacttacgaggagattgttcgtaccagcaagcgcaccatcccctacctttttgtccgaggagatggcgtgatactggtttcgccgcccttgcggaccgtctgatggcgtgatac

SEQ ID NO: 6393 - DNA, 341 bp, Triticum aestivum
  Clone ID: LIB3281-039-P1-K1-B6
aattccccaatctcctcccgcactcaacccaatccccacctacccgcaccccatggcgccgaaggcggagaagaagccggcggcgaagaagcccgtggaggaggagcccgcggcggagaaggccgagaaggcgcccgccgggaagaagcccaaggccgagaagcgtcttcccgcggcgggcaagacctccgccaaggacggcgacaagaaggccaagaagaagagcaagaagagcgtggagacgtacaagatctacatctttaaggtgctcaagcaggtgcaccccgacatcggcatctcctccaaggccatgtccatcatgaactccttcatcaacgaca

SEQ ID NO: 6394 - DNA, 369 bp, Triticum aestivum
  Clone ID: LIB3281-039-P1-K1-B9
gaaacatgtatggagcttgggagcagtatcttggactggagcacccggacacagcgccaagaaaagcacatagtgctaaccagaaccgccattcatttgagaggcctgtaaagatctacaactagacagttgtgagaagcgggagcaacgtcctgccatgcaataccaccaagcaagtggctgaaagtgaaattgctggcttgaataaatcgtgtaccatatgatggcaggactggttgctaagttaatgacggagcctgtaagcgcgtttcggtgcacttctgcctggatatataaagtttgtgcagagatgacccaacgaaccatcaccttttaatagataaggaggcgtgttttcttttcttgcac

SEQ ID NO: 6395 - DNA, 362 bp, Triticum aestivum
  Clone ID: LIB3281-039-P1-K1-C1
ggcctcaattaaatcagcacataaaaaccggtgattcagaggtggatggctcggaagttgagcgcaggggttttgcagggcacccgatgtgcaagttttgtagaagcccattttatggagagactgagctagatacacatttgacaagagaacattattcttgtcacatatgtcagaggcagcacggtgggcaggatgattatttcaggaactatgatgacttagagatgcatttccgaagagaccatttcttctgcgaggacagagagtgcttggagaagaagttcattgtctttcaaagtgaagcaaagcttaagaggcacaatgcttgggagcataagaagcgcatgcctcatgcacag

SEQ ID NO: 6396 - DNA, 326 bp, Triticum aestivum
  unsure (1)...(326): unsure at all n locations
  Clone ID: LIB3281-039-P1-K1-C10
ccgtccggcttctagtattacttnngtggcagtcattaatggccgnngccttgtgctttcttgagagatcgcnatcagaataaagccacacgctccgcaggtgaattggcaagcgtggctattaatagtggttggagtcatcagtgctgccctcggaacatactcctcggtggctagcataatcggatactactaattcttccaaagcaatctcttcgacagctctcagtaccgtcactcttggcaagagtttttgctgtgtatcatcgaattttaccgtgctctatgtacatccttcgacctagtatagtcgatttataaagact

SEQ ID NO: 6397 - DNA, 354 bp, Triticum aestivum
  Clone ID: LIB3281-039-P1-K1-C11
ccactggctgctcgtaatatggagctacaaggaaatgtagattttgcacttccacaacgaagaagcgtgcacacatcagtgaaagtatccaatcctgctggaggtccaagcaacatcacgttcagtgaggatcctgtagcgaagacagcaaagaaaatccacaaccagaagttccaagagctgacaggcaataacatctttaacgaggatgctccccctggctcagctgacaagtctctgagctcagcaaagcttaaggagatgagcggcaatgacatcttctctgatggaaaggcgtcttcgcgagactactctcgcggtgtccggaagcctccctgtggcgagagcagcatt

SEQ ID NO: 6398 - DNA, 245 bp, Triticum aestivum
  Clone ID: LIB3281-039-P1-K1-C12
gcttttctccttctccatggccatgccagtgccctccttgagctgacagagcaacaagcctctcgccgccccccttcccccggtctacgatggcggcaatgccggggccggcgaggctggcccttgccgtgctggcgctcgcgtcggtgctcccggcgtaccgctccgacgacctcaacaccgacgcgcatgcgctggaggcgctgcgcaaggcggtggggcggacagcgctgtcgttgtggaac

SEQ ID NO: 6399 - DNA, 255 bp, Triticum aestivum
  Clone ID: LIB3281-039-P1-K1-C2
ggcctcaattaaatgagcacataaaaaccggtgattcagaggtggatggctcgggggttgagcgcaggggatttgcagggcacccgatgtgcaagtttttgagaagcccattttatggagagactgatctagatacacatttgacaagagaacattattcttgtcacatatgtcaaaggcagcacggtgggcaggatgattatttcaggaactatgatgactaagagatgcatttcctaagagaccatttttttt

SEQ ID NO: 6400 - DNA, 299 bp, Triticum aestivum
  Clone ID: LIB3281-039-P1-K1-C3
cccacgcgtccgcggacgcgtgggtgaggacgaggatgcggggctggcgcagcagagcgtgatcgcgggcgggcgaatgcgcgcgtcggcggtgctgatgcagctcatctcctgcggctccatccccgcggcccccaagcgggacgccggcccgggcggcgcgaggtacacggcggagcgtaggctcccgcgcggccggtcggacctgagcagcagcacggcggcagacgggttctctggcagcattggcgtcggcgcaagcatggagcgggagtacttcagcggcagcctggtggaga

SEQ ID NO: 6401 - DNA, 304 bp, Triticum aestivum
  Clone ID: LIB3281-039-P1-K1-C5
ggttttatgtccactcctgatggtgaaaactgtggacttgtgaaaaatctagctgttactgctattgttagctctagagtggcacagccattgattgacagatttgtttcttgtggaatgaataaactggatgaaattcctgctaagcagattcccaaaatggacaagatcttcctgaatggtgattgggtaggatcctgtgctgatccagcttcatttgtcatgcgtttaaggtgcatgagacgtggtggtctgatcgatccacaggttgaaatcaaaagggacaagcaccaatctcctggag

SEQ ID NO: 6402 - DNA, 81 bp, Triticum aestivum
  Clone ID: LIB3281-039-P1-K1-C6
aaaaaaaaaaaaaaaaaaaaaaaaaaaaaataaaacaaaaaaaaaaaaaaaaatggagaaaaaaaaaaaatggggactccg

SEQ ID NO: 6403 - DNA, 260 bp, Triticum aestivum
  Clone ID: LIB3281-039-P1-K1-C7
cggacgcgtgggctttttgatagaatgaccaaaagattcaaaacttcgtgcaagatctggttgcgccgcattcagttttctctcactcaaggcaaggatgttgaatgcatcaaatctgtcgtaaaccgtgcgcttcttagtctaccacaaagcaagcgtataaagtttctaacgcagactgctatcctggagttcaagtgtggggtggctgaggaagggagatccagatttgagctgatcctaagggagtattccgaaag

SEQ ID NO: 6404 - DNA, 364 bp, Triticum aestivum
  Clone ID: LIB3281-039-P1-K1-C8
cacgccggaccggcccggaatgtgcatgggccgagccgacccacgcgtccagcgaagttccagaagtacatgttgatccccatatggctcctacttatgaatctgctgaagaatggaatgatgaaacaactgttgatttgaccataaatgggaatggaccagatcttctctttcctggaagagaagcggcagaatcaaacgctgtgcagtacctgtcacaaaaatgtcccgatgctagtcgtcactctagtttaaatcttcctacggagggcgtaacacatataccaggagcaggaagtatcactaatttgcaggcagcaaatggatcgaatattcctcggcctcgcattgaattaaaataata

SEQ ID NO: 6405 - DNA, 294 bp, Triticum aestivum
  Clone ID: LIB3281-039-P1-K1-C9
cggacgcgtggacaaggagggcatccccccggaccagcagcgcctcatcttggctggcaagcagctggaggacggcaggacccttgctgactacaacatccagaaggagtccaccctccaccttgtcctccgtcttcgtggaggcatgcagatctttgtcaagaccctcactggcaagaccattacgcttgaggtggagtcatccgacaccatcgacaatgtgaaggcaaagatccaggacaaggagggcattcccccggaccagcagcgtctcatcttcgctggcaagcaact

SEQ ID NO: 6406 - DNA, 354 bp, Triticum aestivum
  Clone ID: LIB3281-039-P1-K1-D1
gtcgcggctagcagatgttggcatagaggccttggtgccccggtttccctctcgaatccccgcacacagacaaatcctttccagaagcactgctgtatttcttcagttgttagacctttgaatatggagggcactgaagttccaaagtagaccattcgtctttccaacttccataactgctcccttgcaacgtatatgggatcgtagctagatttgtggtctgcaaatacctcattaacttgaaaataagtgccgttcagtgggaaactacccttcgtagctgttcgacacggaaccagaatggtggctctgacatatctagattggtttttccgctcaagcacacaatactgg

SEQ ID NO: 6407 - DNA, 382 bp, Triticum aestivum
  unsure (1)...(382): unsure at all n locations
  Clone ID: LIB3281-039-P1-K1-D10
cccacgcgtccgcagactttacaattgctgatttatttgcaagtgcactagctttcttagcaactggatggtgtatcttatgtctggccatcacatggaagcgtgtggtgaagactctggggctgtgggactccgtccgcgagatctcccggatgtacgacgctgggatgggcgccgttatctttgcgcccatcgtgttcttctcgtggttcccctttgtgtccacgttccagtcgcgcatcctgttcaaccaggccttcagccgtggtctggagatctccctcatcctggcggggaacaaggcgaaccangagtcatgagaagcctcatccatccgctgggtggttttgttgtacatttctggacttgattagggacatgc

SEQ ID NO: 6408 - DNA, 311 bp, Triticum aestivum
  Clone ID: LIB3281-039-P1-K1-D11
cggacgcgtgggcaaatttcccctcttccccctccccaccccgcgatctggtctcgattcatctaccttttctccccgaatcctcaattcgacaccagatccggtcctccctcgccgaggcctctctattggtaccgatttcgccccgtatcgttgattctgcgtgttcccgagattagggtttcgaggcgctgaaatcgggtaccgattggctcgattgaggcgggatttctccaggggaggctggtctgcggttgattggtggctctgagatcctattattgcggttcctttcatcgaatttgcgcgat

SEQ ID NO: 6409 - DNA, 86 bp, Triticum aestivum
  Clone ID: LIB3281-039-P1-K1-D12
gcgggacgcgtgcgctaacctgacagtgttatagagaagacccagacgggcggagagaggaagaaggcggttatccgatccaataa

SEQ ID NO: 6410 - DNA, 377 bp, Triticum aestivum
  Clone ID: LIB3281-039-P1-K1-D3
atccacacgagtcccttcttcccccaaatcgagcgacgatgtctgggcgcggcaagggcggcaaggggctgggaaagggcggcgccaagcgccaccggaaggtcctccgcgacaacatccagggcatcaccaagccggcgatccgcaggctggcgaggaggggcggcgtgaagcgcatctccggcctcatctacgaggagacccgcggcgtcctcaagatcttcctcgagaacgtcatccgcgacgccgttacctacaccgagcacgcccgccgcaagaccgtcactgccatggacgtcgtctacgcgctcaagcgacagggccgcaccctctacggtttcggaggctagaattaatgtatccggcagcagtggggc

SEQ ID NO: 6411 - DNA, 126 bp, Triticum aestivum
  Clone ID: LIB3281-039-P1-K1-D4
atcaagcgtaggtggtgtgcacgccgaacgtgtcgcaacctgtctgggacttcacgccggcgccgggccgatgcgtcgtgcttggccgagcagcactaggggacgcgtgctgctctcgtcagtcgg

SEQ ID NO: 6412 - DNA, 400 bp, Triticum aestivum
  Clone ID: LIB3281-039-P1-K1-D6
cggacgcgtgggtacgctcagcctctctctctcttatccttacccagccggctcgtgcccttgtactctcccgtatccgaccgcgccgccgacactaggccacgaccgccgacccctcccccagcctcgcttcgctgcggcggagatggaaaaccgcgatggttcctcattgccagactttcttgagctccagcgcacccgtgttctctgcaaggccgatgcccacactcatacagaggggtttcaatactcggaggctttcgctgctatgggagtagatactagtgtctcagttgagaagttctgcaagaactttaaaatcgagataaatcgacttacagatgaggatatggagtttgatatgattggcgttgatgcatcgatagctaatgctttccgg

SEQ ID NO: 6413 - DNA, 334 bp, Triticum aestivum
  Clone ID: LIB3281-039-P1-K1-D7
caccaatcgccgatccgggccatggacgccaactggcggcccacccaagggccggaccccgccgccgccgtaggcgattggcgcgcccagctccagcccgaggcgcgcagcagggtcgtcaataagatattggagactctgaggaagatcctgccagtatcggtgccagacgaactgatcgaacttcaagaaatcgccaggcaattcgaagacaagatctacactgaagcaaccaatcagtctgattatgtgcggaagatttctcttgaaatggtctctatggagacgagcagacaactggcttcttgaaatgctcaagtgatttcaaataaaa

SEQ ID NO: 6414 - DNA, 306 bp, Triticum aestivum
  Clone ID: LIB3281-039-P1-K1-D9
ccctcgacctctcctcccagtgcagcctcgccgtcgccagggagagcggggcagcctgctccaccactccggccactccggccggcgaccgcgcggcgtcctgcagcgaggtgtctgaattggtcattatggtgaagacaagtgcagagaaaagtcatggtgtcatggctgcatgcacatcaagttctgaacttccagaacttaaccaaaggcagaatttccgtttaggagatataacatgggttaagcatgatggctcctcatggtggccagcccacgtcattgatgaagcatgtgccagtagca

SEQ ID NO: 6415 - DNA, 292 bp, Triticum aestivum
  unsure (1)...(292): unsure at all n locations
  Clone ID: LIB3281-039-P1-K1-E1
aaccgcggcacgcgcggggcccggactctgaagcaacaacggcggacggcggcgcgcgcggccccgaccccgtccccgtccccgtccccgtctccggctcctcccggcggcgaatctcaccagcaaatagacagaactggagaattggcacagaacatgaaaagattggntttgatgtcgaaacatcgcgccctataacgtacgatcagatcagtgctatacccaatgggctgtctgagagatttgaatgggacaagataatggaagaaaaccatgttaatggtcccaagca

SEQ ID NO: 6416 - DNA, 399 bp, Triticum aestivum
  Clone ID: LIB3281-039-P1-K1-E10
cggacgcgtgggtcactctcgcttgactccttggaagcagagagaggaggaggaggaggaggaggaggagaccatgtcgtcgtccggtggcaagctcttcaccctggaggaggtcgccaagcacagctccaaggacgactgctggctcgtcatcggcggcaaggtgtacaatgtgaccaagtttcttgatgaccaccctggaggcgacgacgtcttgctgtcttcaactgccaaggacgcgaccgacgacttcgaggacgtgggacacagcacaaccgcccgggcgatgatggacgagtactacgtcggcgagatcgacgcgaccacgatacccaccaaggtcaagtacacgctcgccaagcagccgcactacaaccaggacaagacccccgagttcgt

SEQ ID NO: 6417 - DNA, 438 bp, Triticum aestivum
  Clone ID: LIB3281-039-P1-K1-E11
gacccacgcgtccgcggacgcgtggggccgactggtagcgctcgtcagactgcgactgccgcggtgagcgtctccggtggcgtcatgctcaacgcgagggctcggcggagatcacgttcgcagctgcgctgcgtcgctacggctggtgatatcccacctactgtggcagatacaaagatgaacttcctgaagtcatacaaacgtcctattccaagcatgtacagtacagacctacaagaactttctgtgcagcaacatctgatgagatacaaaagtacctatcagtatgatcctgtgtttgctcttggatttgtcaccgtctatgaccagcttatggaagggtaccccagcactgaggacagggatgccatcttcaagtcatacggaacggcgttaaatgaagatcctgagcaatacaaggctgatgcacaaaggatg

SEQ ID NO: 6418 - DNA, 415 bp, Triticum aestivum
  Clone ID: LIB3281-039-P1-K1-E5
cggacgcgtgggggcggcggctactacatcccagctaggagcagcagcactttgagacggggagcagcggcggccggcaagagcagctcgtggagacgccgtgagcaccagggggaggcgaggagacgcaagaggagcaagagggagaggtggtggcggggcagcaggggcctccggggagcagcagggcgacgacagcggtggcggctgtgtcaggagtgagcacgggctagggttcatcccgattgagggagcaaactgtgtgttttagtcaaacagttccccttcccggtccaaggagagcaacttcgagaaggaggcggcgagggcgagcagggagcggaagagatggagaacggcggcagcaaaggcgacgtcccggaagacgccaacgcccattgccctggaacgcagt

SEQ ID NO: 6419 - DNA, 422 bp, Triticum aestivum
  Clone ID: LIB3281-039-P1-K1-E6
ggcattccatactgtgctgagtgaaattcaccagattgtaagcaaaaaagcacttgcagcacaggagtctgctgctgccaacggccgttcgatgcacggaacgactattaacgttgctgaaccatccgccaacgcaaaaggttcttgctgttccagttgaagagctggttccagtggaagagattctttccggaaatgtctgcttccgcagaactggaccatgacaatatacataggttatagtttggtatcagatattcttgtttctcatcccgaatcccatgactggtaattcctatcgcaagaacacctttaccatactctataacctgcctccatcaaatcattctcattttgtattcttataactatcatcgatttcacttgtacaattgagaaatccaacatgttgtaacaatgat

SEQ ID NO: 6420 - DNA, 324 bp, Triticum aestivum
  Clone ID: LIB3281-039-P1-K1-E7
gtctccggcaggtggcgaggacagccgccgccgtcgtgtgagctacttctacgagcccacgatcggcgactactactacgggcagggccacccgatgaagccccaccgcatccgcatggcgcactcgctagttatccactatggtctgcaccgcctgctcgagctttcacgccccttccctgcctcggaagccgacatcagccgcttccactccgacgaatatgtctccttccttgcctccgcgaccggcaacccgaccattctcgacccccgcgccgtcaagcgcttcaacgtcgggggaggactgcccccgtctttgacgga

SEQ ID NO: 6421 - DNA, 246 bp, Triticum aestivum
  Clone ID: LIB3281-039-P1-K1-E8
cggacgcgtgggtgccgttccggtagcctccctccgtccctgctcgccgccacgactcacaggccacaaaccctagccaagctcgccggagctaccgcgtgcgcgcacgcagcgatggaaggcggcggacgcaagaggggcacggccgacggcgccgccgtcggaggcaagcgcacgcgagaatcggagtcatttcaaaccggcgtaggaagcaaatcgaagccatgcaccaaatttttcagtacc

SEQ ID NO: 6422 - DNA, 218 bp, Triticum aestivum
  unsure (1)...(218): unsure at all n locations
  Clone ID: LIB3281-039-P1-K1-F1
ctagaaaatctggtcctctaggcaatgcgccttcgagaaatccttcatttggcggtgctgcctccaactctggacctgtgtctaatgctggcggncggncaaactactccggttctctttcatcttcagttcctggcgctggnggatcagcaagagcaaaatctaattccggaccactcaataagcatggagaaccagtaaagcggtcatctggtccc

SEQ ID NO: 6423 - DNA, 370 bp, Triticum aestivum
  Clone ID: LIB3281-039-P1-K1-F10
cccacgcgtccgccgccgtctcctgcgccgccgccatggacgccgccaccgcaagccgccttcgcgccttcgagagctggatgcgggagcacggcgtcgtctgcagcgacgcgctccgcctcgacgccagcgaggccggcggcgtctacgtgcgcgcgctcgccgcgctccgggagggcgacgtcgttgccaccatcccgcgccgcgcgtgcctgacgccgcgcacgttcggggccgcggcggccatcaaggacgcgcagctcggcggcaccctcgctctcgccggcgccgtcatgtacgagcgcgcgcggggcgccgactcgccgtggcacgactacctccgcctgatcccggactgcgagcccgtgcc

SEQ ID NO: 6424 - DNA, 394 bp, Triticum aestivum
  Clone ID: LIB3281-039-P1-K1-F12
atattccttcacaaagatagtgctgatactctggtttcttctctcagtatgaagcagatggagcttctctgaggaaggaaggaaggaagaagaagaagctcttgatttctttgcatggagaaggaggccatgggggggcatgtaaatataatgctgccactggagaacctgagctcggatctccccaatggtggagtcgtacttggccatgacaaggaaatctcaactctgcatgaagagatttctgctctgagatcgaggcagaggcatctcaaccggaggagacgtgaggcgctggacaagctcatagacctgaaaggaagcatcagggtgttctgccgagtccggccgtcgatctcaaccagcaacatcaagatcaaatcaccagttactg

SEQ ID NO: 6425 - DNA, 294 bp, Triticum aestivum
  Clone ID: LIB3281-039-P1-K1-F2
cggacgcgtgggcggacgcgtggggaaggataacctctgttcatccttgctaactggagaggcttctctggtggacaaagagatctttttgaaggaatccttcaggctgggtcaacaattgttgagaaccttaggacatacaatcagcctgcctttgtatatatccccaaggctgcagagctacgtggaggggcttgggtcgtgattgatagcaagataaatccagatcgcattgagttctatgcttagaggactgcaaagggcaatgttctcgaaccctcaaggttgatcgag

SEQ ID NO: 6426 - DNA, 402 bp, Triticum aestivum
  Clone ID: LIB3281-039-P1-K1-F5
cccacgcgtccgcggacgcgtgggtctgcatccatgaagaagctcctaattggtgtgatcctttgtgttatattcatggcggttgaagtggttggaggcatcaaagcaaacagtcttgcaatcttgactgatgctgcccatctcctttcggatgttgcagcctttgccatatctttgttctccctatgggcagctggttgggaagcgacacctcagcagtcatatggatttttccgcatagagattcttggggcactggtttccattcagcttatatggctcctcgctggcatacttgtctacgaagctattatgaggctcattaatgaaagcggcgaggtacagggctccctcatgtttgctgtatcagcttttggtttgtttgttaacatcataatggca

SEQ ID NO: 6427 - DNA, 375 bp, Triticum aestivum
  unsure (1)...(375): unsure at all n locations
  Clone ID: LIB3281-039-P1-K1-F6
agcactcgtcgggtcacttgcacgcgaccctacttgcttaataaatacaacgtggcggtcgctgttcacagcaaaccccgaatactacctgactacttactcccctgcccgcgccgcctaccgagcccgacaaaccgtaggcgactcccatggactagcaggccgaccgccgcttcgagaacaagctcgtgcacaaccgactcaggcccgcgcccggcgccgactgtgcnggttactgtaccaaggtctgcatccattggcgcgctgggcgatgcaatcgctacccctgcccctgcctccacagcgagcttgctgaggcggccaccaccaagcgctcgaaccaacaggatggcccctgcgggcacgtttggcgca

SEQ ID NO: 6428 - DNA, 335 bp, Triticum aestivum
  Clone ID: LIB3281-039-P1-K1-F7
cggacgcgtgggccgaagatgaaatccgccatgctggtgatcttcggaaggtgacagctcgagtggatggtgttgctagcatcaatattactgactgtcatatcccccttacttgaccaaattcaattgttggccgggctgttttcgtccatggtgatgctgatgatcttggcaagggtggacattagcttagcaagagcactggaaacgcttgtgcacgtgttgtttgcggaaatattttgcttccaggcttataatttaatttttttcgacccacgttgcaacagattttggaaccctttttagaaaggcaaattttcaaatttttttttttt

SEQ ID NO: 6429 - DNA, 376 bp, Triticum aestivum
  Clone ID: LIB3281-039-P1-K1-G10
cggacgcgtgggcggacgcatggttctcatccctgaccacctccctgaggtgggacggtgccctgaacgtggatgttactgagttccagaccaacctggtcccatacccgaggatccacttcatgctctcgtcctatgcgccggtcatctatgacgagaaggcgtaccacgagcagctgtcggtgtctgagatcaccaacagcgcgttcgagccgtcttccatgatggtcaagaacgagccgggccacgacaagtacatggtgtgctgcctcatgtaccgcggcgacgtggtgcccaaggacgtgaacgcggcggtggccaccatcaagaccaagcgcgccatccagttctgtggactggtgccccacggtgttca

SEQ ID NO: 6430 - DNA, 407 bp, Triticum aestivum
  Clone ID: LIB3281-039-P1-K1-G11
gaactcgccgtcgacactgagctcgcgcgtccttcgacctcctcttgcgcaatccccttgaccccccgcccctccctctcgcgcctccagcaccgcccctccggccctggctgcgtcgcctccgctggccttcgcattcccctcgccgacggccatgattgactgcccgcggctgcttcttgctgccgcgagctccgctcccggcccctcgtccgccgcttgccggaggttcaccaccgggtgcccaaccttctgcttttcatgccgcagccgccttccttctttccctgtgcaatctgcatcctctggggcggagagccagtcaagcgtcctggatgagccggaggccgtcgaatgggccatgcacgacttctacgctttgcgcaaggatgttgagttggccgtag

SEQ ID NO: 6431 - DNA, 287 bp, Triticum aestivum
  Clone ID: LIB3281-039-P1-K1-G12
cccacgcgtccgcccacgcgtccgctccggcgtgtgcgccaagcgcgtggtggtggacgcccgccaccacatgctcggccgcctggcctcgatcgtcgccaaggagctgctcaacgggcagcgcgtggtggtggtccgatgcgaggagatctgcatgtccggcggcctcgtccgccagaagatgaagtacctccgcttcctccgcaagaggatgaacaccaagcccttccacggccccatgcacttccccgccccggccaagattctttggcgcaccatccgcggta

SEQ ID NO: 6432 - DNA, 222 bp, Triticum aestivum
  Clone ID: LIB3281-039-P1-K1-G2
cccacgcgtccgcggacgcgtgggccaaattccaatgtgcaacgagaaggaggtgtatcagcaatccattggagctgtctgcaacctggactggccgagatcgaatttcttggtgcaggtgctcgatgattctgacgatgctgcgacttcagctcttatcagagaggaggttgagaaatggcaacgggagggtgtccgggtattgtaccggcaccgggtgat

SEQ ID NO: 6433 - DNA, 414 bp, Triticum aestivum
  Clone ID: LIB3281-039-P1-K1-G3
gctcccctcctcctgcttgacccgccgccacctatcctcaccgggaagaaaaccctagctagagagcttcaaagtttcccgcagcacgagagatggcggcgaagggcgatgggccggccatcggcatcgacctcggcacgacctactcgtgcgtcggcgtgtggcagcacgacagggtcgagatcatcgccaatgaccagggcaaccgcaccacgccgtcgtacgtggccttcaccgactccgagcgcctcatcggcgacgccgccaagaaccaggtggccatgaaccccatcaacaccgtcttcgatgccaagcgtctcattggccgtagattcactgattctacttgccagagtgatattaagctgcggcccttcaaggttgttgctggacctggtgacaagcccatgatca

SEQ ID NO: 6434 - DNA, 425 bp, Triticum aestivum
  Clone ID: LIB3281-039-P1-K1-G5
gtcaacaaggtgacaggcgaggccatcaagcactcccaaggcgagggccaccctgtgaagctggtgccatacaacgccaactaccaggacgagtcagtgttgtggactgagagccgcgacgtgggcgccggcttccggtgcatccgcatggtgaataacatctacctcaactttgacgctctccacggcgacaaggagcacggcggcgtgcgcgacggcacctccctcgtgctgtggaagtggtgcgagggcgacaaccagcgctggaagatccttccctggtaaacgtgtcatgctgctgaagctgagttgatcgccaccgtgacccggagttggtagagatcggcctgtgatctgttgccgtgtcgttagaataaaagtcgtgtgcggttggtgatgtgtccgtgagtgtgtgtttagtttct

SEQ ID NO: 6435 - DNA, 428 bp, Triticum aestivum
  Clone ID: LIB3281-039-P1-K1-G6
cttccgctctccagggttcgtttcccctcggagccgaaaccctagccgccgccgccgacgaccgcgagcaggctcagatgggaggcaagtgcccgcaccgcaaggtcaaaaagcgccgtctcaactgcaagcaggtgcgccgcggcaagttcctcgtcaaagccgacgacgccgtctacgacgagctcgtcaagctggccgaccagggcaaggattccgagggcaaggcgcttcccgtcgacgaggacctccccggcatgggccagttctactgcctccactgcgatcggtacttcgcggatgagaccgtgaaggaggatcactaccgctcaaagcgccacaagaaaagggtcaagcagttgtctggaccagccccacacacgcaaatagatgccgatctcgctggtggaatgggaatgccggacaac

SEQ ID NO: 6436 - DNA, 320 bp, Triticum aestivum
  Clone ID: LIB3281-039-P1-K1-G7
cggacgcgtgggcggacgcgtgggtaagaactgagcgaggactgggggggttgctaagagaagcgttgagatggggttcaaaccactggagtggtactgtcagccagtgaaggatggggcatggtctcatgccgtcgaaagcgcgtttggtgcatacacaccctgcggcattgacaccctggtggtgtgcatctcgtacctcacactttttggcgtttgcttctatcggacatggaggacgacgaaagactacaaggtgcagaggtacaagttacgctcgccgtactacaactatctgcttgggctgcttgttgtgcact

SEQ ID NO: 6437 - DNA, 329 bp, Triticum aestivum
  Clone ID: LIB3281-039-P1-K1-G8
cggacgcgtggggagaatccccaaatccccaaccccgactgacgacgagtggatctgttccggcgcttcctgccgccgtcgaccatggcgtcttccaactccggcggcatccccatcaaggcggaacaggattcggatggctcggcccagagcacagctgatatgactgcttttgtgcaaaatcttctagttcagatgcaaaccaggttccaaactatgtcagagaacatcattacaaagatagatgaaatgggtgcaagaatcgatgaattggagctgagcatcaatgacctcaaggctgaaatgggcagcgatggtatgacccctac

SEQ ID NO: 6438 - DNA, 193 bp, Triticum aestivum
  unsure (1)...(193): unsure at all n locations
  Clone ID: LIB3281-039-P1-K1-G9
cggacgcgtgggcggacgcgtgggtctcatnctttgccaactttccttgaggtgggacgtggccctgaacgtggatgtgactgatttccaaaccaacctggtcccatacccgaggatccacttaatgttttgttctattggcccggtattttgggccaaaagggcttcaccacaagcagtttcggtgtctgag

SEQ ID NO: 6439 - DNA, 368 bp, Triticum aestivum
  Clone ID: LIB3281-039-P1-K1-H12
cggggcgggccagacccacgcgtacgcctacgcgtccgcccacgcgttcgcggacgcgtgggcaacaacggcggtgcgctgagctgggcgctaagggcggccagggaggccgagtccgtggcggcggcgggatgctccggccacggccgtgtgttcctggatggcatcgtcggcgaggacgggcggccagggtgcgagtgcaacacctgcttagaagggccagactgcttcgtacggacgcccgactgcacctgttacgccgacagaggggacccgatggtccgggagcctctctggattcgccacgcggaggccagcgccgtggtggtattcgggtggcaccgcatgagctacagagccaccgacgg

SEQ ID NO: 6440 - DNA, 237 bp, Triticum aestivum
  unsure (1)...(237): unsure at all n locations
  Clone ID: LIB3281-039-P1-K1-H2
ccagcaccnnccgggcggcangcggaagccgaaacaaagagcaacagcggggggggagggaaaaaaagggggagccgagcgaaaagcacagccagaacaacaaggcccgggggcaagagaaaaaaaagggggggggcaacacacgcacgacagagaacaagaaggcgaccaaccccacacagaagcacgaaaggggacacggaacggcggggaagccaccccagaaaaaaaaaacac

SEQ ID NO: 6441 - DNA, 286 bp, Triticum aestivum
  Clone ID: LIB3281-039-P1-K1-H3
cggacgcgtgggcggacgcgtgggcggacgcgtgggccgtgacccggagttggtagagatcggcctgtgatctgttgccgtgtcgttagaataaaagtcgtgtgcggttggtgatgtgtccgtgagtgtgtgtttagtttctgtcctgtcgttgtgtcctgctatggcgagctatccgatgtaataagcatttggcacttgtgcttgtttttcaaaccatggatcgtgatgagaacctctgtactgtggtgcaatcctttcatctatgcgaatggtctttattgtc

SEQ ID NO: 6442 - DNA, 421 bp, Triticum aestivum
  Clone ID: LIB3281-039-P1-K1-H4
cggacgcgtgggcaaatccccaagcgcgacaaccaactccgcctcgacctcccgccgcatctccgacgacatggcccgcaccaagcagacggcgaggaagtccaccggcggcaaggcgccgaggaagcagctggccaccaaggccgcccgcaagtccgccccggccaccggcggcgttaagaagccccaccgcttccgccccggtatcgtcgcgctccgcgagatccgcaagtaccagaagagcaccgagctgctaatccgcaagctccccttccagcgcctcgtccgggagatcgcccaggacttcaagaccgacctccgcttccagtcctccgccgtctccgccctgcaggaggccgccgaggcctacctcgtcgggctgttcgaggacaccaatctgtgcgccatccacgccaagcgc

SEQ ID NO: 6443 - DNA, 318 bp, Triticum aestivum
  Clone ID: LIB3281-039-P1-K1-H5
ggggccaccccaaaagcctcaacaacacgccgaaccaaagaaaggcaggcgaggaatacatggcgggtcccggcggctgtgccgccagctgggttttgtacctttcgctcgccgccaaatgcggcggcgatcaccccggccgcctcgccggcctcctcgcggtctgcgccgccgccttcgcactcacctgccttctgcactggtgcttccccggcgggccggcctggggcaggtggtggctcacccgccgcctcaagggctccctcgtctcggggcccaggggcttgccgctgatcggcagcatgtggctcatgaccg

SEQ ID NO: 6444 - DNA, 383 bp, Triticum aestivum
  unsure (1)...(383): unsure at all n locations
  Clone ID: LIB3281-039-P1-K1-H6
cggacgcgtgggcgcgaaccaaaccctaaccctacctcatcgctccaatggccggagacccgtcgccgtcgccgtcgccgcccggatcccccgccaagcaccgccgccgccgggagcgcgacgacgcggaccccgcccccgacgccttcccgaagcgccgtaggcaccaccaccgtcaccaccaccgttcccaccgncaccgccgtccggacgacgcccagcccccgccgccctctgcggccgacggagaagacgtcgaggagggggagatactagacgatgccggcgccggcgccggcggggctatggaagtcgatggcggcccccgcggngacgaccccgctctccgcgagccgacccggagctagtcgtgatcatgctgc

SEQ ID NO: 6445 - DNA, 314 bp, Triticum aestivum
  unsure (1)...(314): unsure at all n locations
  Clone ID: LIB3281-039-P1-K1-H8
cgatcgcgcaggcgccagggaaagagagagaaaaaaaacaaccagttcgtcggtagggtttcgggggctgcgatggcgatggaggctcggatgaaggggacggtcaagtggttcaacgacaccaaggggttcggcttcatcacccccgccgacggcagcgaggacctcttcgtgcaccagtcctccatcaaggccgacggcttccgctcgctggccgagggcgaggtggtcgagttcgccgtctcggagggcgacgacngccgtaccaaggccgtcgacgtcaccggccccgacggatccttcttgcagggcgg

SEQ ID NO: 6446 - DNA, 416 bp, Triticum aestivum
  Clone ID: LIB3281-040-P1-K1-A1
cggacgcgtgggatgcgccggctcacaagcgtgtttggaggtgctgcagagccacccaagggcggcaacccagactccaacacgctcatcagcgacacgacgacggtcatatgccttgatgactaccattccttggacagaaccgggaggaaggagaaaggtgtgaccgccctggaccccaaggcaaacgactttgatctcatgtatgagcaggtgaaggcaatcaaggaaggcaaggctattgagaagccaatctacaaccacgtcactggcctcctcgacccggcggagctcatccagccccccaagatcttcgtaatcgagggtttgcacccaatgtacgatgaacgtgtgagagagctccttgatttcagcatctacttagacatcagcaatgaggttaagttcgcatggaa

SEQ ID NO: 6447 - DNA, 436 bp, Triticum aestivum
  Clone ID: LIB3281-040-P1-K1-A10
cccacgcgttcgcccacgcgtccgggtgaatttggctgcagcagcaaaattaggttggttaatgatttgctggagagcattcattttgttgcttctactgaagcaatgtttattggtgttcgagctgggattcatccatcaattatctacgacataatatcaaatgctgcaggaagctcaaggatttttgtggaggtggttccgaaaattttgagtgaagatccattgcttattgattttctgaagtcactaaagaaacatgctagctacgtgatggatacagctaaagcagcaacattccctctgccacttctagctgttgcctatcaacaattaatacatggttcttcagcagtaattggagatgaatccgcttcaccgttgaaggtttgggaacaactatttggagtaaacatcatagatgctgccagtcaac

SEQ ID NO: 6448 - DNA, 367 bp, Triticum aestivum
  Clone ID: LIB3281-040-P1-K1-A11
cggacgcgtgggcccagggcggttgcgagagagagacggagaaaaacccggacataaaccaaggtatgcgcctggccgcctgagtcaatacgaacctaaactaaagcgacatggatttggattcggcatgtgccgggccgacgccagcctgtcctccaagggtgcggaagccgggagcagagctcgccaagctggaagcaggcttgcctggagcaggaactatgccgccaaagacatcatgtttggtgtcgaggcccgtgcctgcatgctgaggggtgtcgaggagtttgcagatgcggtgaaagtgaccatgggtcctaaggggcgcactgggatcattgagcagatctttggttgccccaaaaag

SEQ ID NO: 6449 - DNA, 299 bp, Triticum aestivum
  Clone ID: LIB3281-040-P1-K1-A2
caagagaacgccatggttctccgagctcgccaaaccccgccgccagggaccccctccggcgctccctcgacccgcgccgccccggatccggttctcccctccgccgcctcacggcctcttgcaccgccgctttctctcctgggcctcttccccgacgctcgaggtgcagcagggtgggcgctgccacgttctcgatccagtcggatctggcgcaagtcgccggcatccggcgccgcgcgccgtgattccagatcgggcgtaggtcgccaccaggagagcaagagcggcggctgcagcag

SEQ ID NO: 6450 - DNA, 332 bp, Triticum aestivum
  Clone ID: LIB3281-040-P1-K1-A3
gcagcggatgcaagaaaagggaaggacatccaaggaataccctgggagaggctagctatcacaagggaaaactacagacagaccagattagagcagtacaaaaactatgagaacattcctaattctggagaagcagcagccaaggaatgcaaaccgactgtgaaaggtggaatgtattatgaattcagacaaaatactagatcagtaaaatcaaccatcctacattttcagctgagaaatttagtatgggctacattccaagcatgacgtctacctaaggcacattactcagtgcgtcactggtcagcggtgagtggtgggacactgaactt

SEQ ID NO: 6451 - DNA, 397 bp, Triticum aestivum
  Clone ID: LIB3281-040-P1-K1-A4
cggacgcgtgggcccgtcctcctctcctcctgtcgcctccagagcaacagtcctccagctcgagcaagaaacaagtgtagtactagtttgatctgtgaacatgttggccatcttccagaagcaggtggcgcacgcgccgcaggagctcaacagcccgcgcggcagcaccgccaagcccaagaaccccgacgagatcctccgcgacttccacgccgcccaccccgcaacctcgccgccgccggctaccagaggatgttctgcgggctggacgacatctactgcgtcttcatgggcacgctggacaacctgagcgcgctgatgcggcagtacggtcttaccggtcgctcaccaacgaggcgctgctggtgatcgaggcctaccgcaccctgcgcgaccg

SEQ ID NO: 6452 - DNA, 371 bp, Triticum aestivum
  Clone ID: LIB3281-040-P1-K1-A6
cccacgcgtccggttagaagacaggattttcttctgttaacaaacaacgaaattggcaccgagttatcgcaacacactcaggtcattttcgattcagtgattcacacaataacaaacaaaatctaggccttggttcacggtcaatgaactatgtcatgatgagctatgtttctgatatacagaaatttagccacattttaggacagtaatactgagcagcttttcaaccatataacgccctgcgcgtttctggccattcattttcgtgacttgggcgcaaccttgaccgttagtctgttgtctactccggctttcaccgtacattctgattcctgagccaaatagtcctaaagggcttgcttttcagaaga

SEQ ID NO: 6453 - DNA, 407 bp, Triticum aestivum
  unsure (1)...(407): unsure at all n locations
  Clone ID: LIB3281-040-P1-K1-A7
cggacgcgtgggtcagaaggaagtgtccttgttatttcaggatggccgaagatggtttcggtctgttcctttagctgctgaatcttgggactcgtactgcatagttaatgagcaaggcaagactggctgatatctgggatggccaacgggttatgtgcgctgttaggaggagccgtaacgatgagttgatgcaacggtggcatgagtttgaaggtattgctcggatcattgtgtttactggtgatgaggaccggattgtttgtcaatatgtggctagtggctgctttctcttctagtagntgaccttataagattattatcacgtttagggggccatcccagtttatttacctgttgtttggaagataaggcccctccccagaacatatatttttggatgtcttctt

SEQ ID NO: 6454 - DNA, 321 bp, Triticum aestivum
  Clone ID: LIB3281-040-P1-K1-A8
cggacgcgtggggcaattcaatggcctggttgatgtctaccgcaagactctcaagtcagatggtattgctgggctttaccgtggattcaacatctcctgtgttggaatcattgtctaccgtggtctgtactttggactctatgattctctgaagccagttctcctcactggcactctccaggacaacttctttgccagctttgctcttggttggttgatcaccaatggtgcaggtcttgcatcttaccccattgacactgtccgcagaaggatgatgatgacctccggagaggccgtcaagtacaagagctccttggatgc

SEQ ID NO: 6455 - DNA, 407 bp, Triticum aestivum
  Clone ID: LIB3281-040-P1-K1-A9
cccacgcgtccgcagaaatgactgacatttttgaaggaagcatcatacggctagttaggaggctggatgaatttctgaatcagctaaaagctgctgctgaagctgttggggaggtcaaccttgagagtttgccagctaaaagctgctgaagcttcttgtttccctttcatttgttaacttgcacagggcatgattgctctattgtctattgtctagaaaaactgatcgcctacctgggtggcatctgcatcgtgctttccagattatttgtgtggtcaaatgaaacggtgagtggtattaaaatgctcatgtagacagtgtttaagcattagaatggtgtagatagagttggccggcaactacagggtctgtgattttcgaatccagccgtaatatgtgttcattag

SEQ ID NO: 6456 - DNA, 255 bp, Triticum aestivum
  Clone ID: LIB3281-040-P1-K1-B1
cccacgcgtccgggaggacaagagatggcaggatattatccgcgggaaaatgcaggttaccactcacttagagacaatgaagcaattggagcatcttatgaccgctacttacgcaatgggatgccttctgtggcagccaatgaaccaagtagggcagttgttggtgccatgggtggaggtgcaatggttggtggtggaatgagtggatatcctgtggatgatcgccgtatgattggtgtcgttggtatggacagc

SEQ ID NO: 6457 - DNA, 439 bp, Triticum aestivum
  unsure (1)...(439): unsure at all n locations
  Clone ID: LIB3281-040-P1-K1-B10
gttgacatgccctggtatacgcggtaggcttccaagtcttgggcttgggccgccccatggtggttgggccgactcttccttccattgctataccctgggggcttaacatcgtccatagcccttgagtcccaccctgcgccttagtaacgggaaaaaccgagaaaaaatatatgcctaaaccatcggaacggagggagtacaattcccgtatattaagcatgctttgtgagattaagtctagagtctagacctttataatatgggctcaccacataatctgacagatcatattttttagtttatatggaagaacagggtgtggctcatttgcctcttgttttaataacatatactccctccgtcccctaatgtanggacgtttttgacactaatgtagtggtcaagaaacatcttacattatgagacagagggagtattg

SEQ ID NO: 6458 - DNA, 244 bp, Triticum aestivum
  Clone ID: LIB3281-040-P1-K1-B11
ctgcactgctcttcttgtgctgcttcaccgcccggaatgctgccgctgccagtggtgatggaggcggaggtctgaggctgaacttctactccgagagctgcccgagggcggagcatatcgtgaaggagcaggtgaggaggctgtacaaggagcacggcaacacggacgtgtcgcggctccgatccctcttacacgactgcaccgttaagtcctgcgacgcgtcgctgctcctggagaccgacgc

SEQ ID NO: 6459 - DNA, 155 bp, Triticum aestivum
  Clone ID: LIB3281-040-P1-K1-B12
ggacgcgtgggcggacgcgtggggttcctatcacaagggccgcccactaaaagagggactttaaaaaattggaaaccctcaataaaaaagtatattaatgaaataaaaataacaggacaaaccaattaaattaaatatataaaaaaaaaataaaa

SEQ ID NO: 6460 - DNA, 375 bp, Triticum aestivum
  Clone ID: LIB3281-040-P1-K1-B2
gggagccgtcaccggcgggctgatcggcctggccacggagagcggcctcttccgcggcaccggcatcggcgccatcaccggcgcgctcgtgtccatagaggtcgtcgactcctccatccgcctctggcgctcccgccggtccgggatctggagcatcttgtacgtgcttaatgtgatctacagcctcctgacgggccggctcgtccgcgagaaggttgacccggcagtgcagcgggtggtccgcagccagatgaatgcagtggactcatcgcagttcagggaggcccctgacctcttcgagatcgagggaaccaactgcatgccgagggcgttcatcgagaaactgcccgaggcaccatcaccgaggagtataac

SEQ ID NO: 6461 - DNA, 268 bp, Triticum aestivum
  Clone ID: LIB3281-040-P1-K1-B3
agacacaaattaaaataatacaagctttatattacaagccaggggcctcgagggctcgaatacataagctcgaaaacacaagagtcggtggaagcaacaatatctgagtatagacataagttagacaagtctgccttaagaaggctagcacaaaagcaacaacgatcgaaaaggcaaggcctcctgcctgggatcctcctaactactccaagtcgtcagcagccgtcacgtaatagtaggaatcctcggggtagcagtagtcatcagt

SEQ ID NO: 6462 - DNA, 448 bp, Triticum aestivum
  unsure (1)...(448): unsure at all n locations
  Clone ID: LIB3281-040-P1-K1-B4
cccacgcgtccgcccacgcgtccggtcaagcccccctgagatgcagcgtccagttctggacaccaactcatcgacacaacttcccaacatgagtgctgtgccttcggtgccaaaggctatgacgccaggtttaagtgatatcagtattccaggattcccagatctgcatgatctcataacggaggatgcaattaatattcctgtagagaacttcacaatgcctggtcctgagtgtatattccccctacctgatgaaggcagtgatgactctgttcccatggaccccatcgacactgatgagaccgatgacacccagaagcttccgggaataattgattccttctgggagcagttcctttgtgccagccctctctccatcgacaatgacgaggtcgattcaggtctgctggacacancgggagcgcaagaggagaatggatggaccaga

SEQ ID NO: 6463 - DNA, 445 bp, Triticum aestivum
  Clone ID: LIB3281-040-P1-K1-B6
cccacgcgtccgcctctctcaacttgcacctcttcatgataacaagatggtttctggcaaacaattatcaggaacttcagctaggtatgaagcacaataaaggtggcaataagatgtgcgggcaattatctgtgttttcgtgaccatgctgatgtggagctgccattgaggcacattttgcctccgagatatcaaaccctccaacctccattttctttaggattgtcccgagcccatctcaccttggtcttctctcccccatggatttgattgtgtgcatggatgaggaaagagtcattacacgaggtgttggtggagacggaggttgagtggacgaccgacatacacagcttcatctataactgcctctatggcttcctcgacctcaatgttagcctccctgcttactactgcaaaagggtttgcagctttgtgtggtgatggc

SEQ ID NO: 6464 - DNA, 355 bp, Triticum aestivum
  Clone ID: LIB3281-040-P1-K1-B7
gcagcagctccggcgacgggccgccgatccagatcccgccgccgcggcccaagaggaagtcggtgcacccgtacccgtgcaaccagaggagcgcgcagccggggaagcacgcccatgccgcgctcctgcgggtcgacaagcctcagctgtccatgtgtgagcaggggaatggctcgccgacatccgccgtgaccacctcgcagataggcttgggctccgagagcttcgacagcgacacctcgaccatcgacgttgaagagcgatgccccacgccgagcacggtgaccgccgaggtcgctgtgcaagcgccaccaaccaatgatgctaagaaatccaagagcagtagtagcacttc

SEQ ID NO: 6465 - DNA, 381 bp, Triticum aestivum
  Clone ID: LIB3281-040-P1-K1-B8
cccacgcgtccgcccacgcgtccgcccacgcgtccggctttgtttacacctggggttttggtggatatggaaggttgggccacaatgaacagaaggatgagtggcaaccacgccttgttgaaatatttcaaaagagcaatatcctgggtcccaatgatatcatctcagccggttctgcaagttctgcctgcactgctggtggtcgcgggcagctgtatatgtggggaaaggtgaagaattcaggcgatgagtggatgtatccaaagccagttatggatttaagtggttggaacatccgctgcatggcttttggtaacatgcaccacactggtggcgcagatgattcttgcataagttggggcccttctgaatatggagagc

SEQ ID NO: 6466 - DNA, 310 bp, Triticum aestivum
  Clone ID: LIB3281-040-P1-K1-B9
cggacgcgtgggcggccatctcgccgatcgtgtacgagtgcctcatcaacccgctcatgcgcggcctgccgaccaaccaaacggtggtggacgagagcctggagaagctcaagaaggtgctggaggtctacgaggcgcgcctgtccaagcacgactacctcgccggggacttcgtcagcttcgcggacctcaaccacttcccctacaccttctacttcatggccacgccgcacgcggccctcttcgactcgtacccgcacgtcaaggcctggtgggagaggatcatggcgaggccgccgtgaagaactcg

SEQ ID NO: 6467 - DNA, 387 bp, Triticum aestivum
  Clone ID: LIB3281-040-P1-K1-C1
gttctggtgctcaaccttttggtgattccctaggcttcttcatgcagacaacctttgatgaggctccaaatcgtcttggttcattcaagaaccagtttcaggatcacagttatgctcgtcagttcgcagacccatacttatttatgcatcagcaaccttccttgactgttgaatcaagtagaaagatgcacacagagaacaatgatttacatttctggaatgggccgagcaccgtgtacggcaattcaatagaccaagcacaagatttcaggtttaaagaacacccatcaaattggttaagcccgcagttctcccgggcagaacagccacgagtgatcaggcctcacgcatcaatagctcctattgagctggagataacaacagaag

SEQ ID NO: 6468 - DNA, 384 bp, Triticum aestivum
  Clone ID: LIB3281-040-P1-K1-C10
gcaggggcagggcagcccggacctggttggtttccagttctacaagctcatggctgccggaatgtcctgggagaagctggtgctgcctgacaagttcgtgagggggctcaacggccgcgagctccggggcgtgaagctgcgggtggagggcggaggggcgcgcgcgtgggacgtggaggtcgtcgtcaacgagtgcggcgacatgcacctcggcaggggctggaaggagttcgtccgcgccaacggcgtagagctggggcagctcctcgtcttctgctacgacggcgccggcgccgccctgctcaccgtcaaggtgttcgacgactccgagtgcgggagacactgcagccagcgcgaggaggaaaacgacagcgccgaagagga

SEQ ID NO: 6469 - DNA, 439 bp, Triticum aestivum
  unsure (1)...(439): unsure at all n locations
  Clone ID: LIB3281-040-P1-K1-C11
ggggtatagtaagttccattttcaatgttccagggaccacttccagtaagtttgcactcgacatcagcagtaatgtccactacctgtatcagcatggttatcgcagtagataatcagggcaaatatcataagcaaattacaactttagaatctctgaattctaatagatttctaatatccttcaaaagatgatgtgtgagcgctctttagatattccagtaagttcctttctacaggtgttcttacatctcctgaatggatgattctctttgcatttcggccgctcggcccacttccaatgatccactacatcatcactgtttggtaactggttagatactcttcaatctccttatagaaaggtccacanatgcacaatcaatagatacatatagaactatgtaagtctgaacatacatgtgggtcaaaacatggtgcg

SEQ ID NO: 6470 - DNA, 215 bp, Triticum aestivum
  Clone ID: LIB3281-040-P1-K1-C12
cgccactgtccactgtcgggttagccctcctctaatctcctcatcggatcagaagagtgcccagcgaatccagggaaagaagactccctccgagtcccgttcgagacgcttagtgtcagcttctaccccgagcggatggcgtcttcgccagagggtgtggagcctgcgttgatccacgcttggtcagcgccttgctccctgagcgtccagactta

SEQ ID NO: 6471 - DNA, 349 bp, Triticum aestivum
  Clone ID: LIB3281-040-P1-K1-C2
ctgtgccaacatggacccttcagtctcgcatgcttatgaatggtacttccatgtcatctccttctgcctgtggtggggttgctctccttgttagtgccatgaaggctgaaggcattccagtaagcccttatactgtgaggaaggcaatcgagaatacagcttcatctataagtgatgcgcctgaggagaaactgacaacaggacatgggcttttgcaagttgatagggcttatgaatatgcgcggcaagctaagaagttgccacttgtttcttacagaatctcaatcagtcaagtagggaagtcaattccaaaactaagaggaatatatctacgtgggagtaattcatg

SEQ ID NO: 6472 - DNA, 157 bp, Triticum aestivum
  Clone ID: LIB3281-040-P1-K1-C3
ttttgtttttttttttttttttttttttttttttttttttttttttttttcaccccccaagattttttttttttgtgtgatcacatccccccattctttttaagggcccatttttttaccattttattttgccgggagcccaaagtttaaaaacaat

SEQ ID NO: 6473 - DNA, 451 bp, Triticum aestivum
  Clone ID: LIB3281-040-P1-K1-C4
cggacgcgtgggcaacgatgggccccaagaatgtctgttattggttttatctccacgaacaggggaatcagatgctccatcgttgctgatactatcagcagcacgtggtgagtcggcatttgttcccgatggttcattagtatgaacatcctttgccttcttttgatcatggtgatgataatgactccctatggaacttcggagataaggatggtgagaatggtgattcagatctattctttgggccaggaggtcttccccccataaggacagggggttctacatctgctagtgcttttggcaaggagcagaaaccgatgtttgattctgtcccaggcactccaatggagaagccattctttgattctgtcccaggcactccactacagaaatccgtctttgattattccgtcccaagtacgccgatgcagaattcatccttcgactactc

SEQ ID NO: 6474 - DNA, 418 bp, Triticum aestivum
  Clone ID: LIB3281-040-P1-K1-C6
cccacgcgtccgccgccgccgtcgcgcatggccggccggccgttgggggcggctgcgtactctgacaggcggctgcgcctcaatccgaacacggagcacaagccgcaggactacaccgacgtgcgcggcgagtacgcgccagccgtgtacagcgccctggagcggcacctcccgcctagcctcctcgaggccgaccgtgatgtcaagctacacttcatgcgggacatactcgcgcgctattggccccatggcgagcgaaacaaggttcataggcacaaagaatacaggcagaagatagtccacctctataagccacttcatcaagaattgtacagcatgcatccttcggctttcttcttaccaacattccttgaagcagtaagaaccaatacagaagaaagcattgcaagtataatga

SEQ ID NO: 6475 - DNA, 414 bp, Triticum aestivum
  Clone ID: LIB3281-040-P1-K1-C8
gcgttctacaagagatccctcgcctcctcccaccccactccagcacaagattccagcctcctcctcctcctcccaccagtgagagtgagacttagaccagccggtggcctcgcccgtgctccatggtgatcctgcgctctcacaggtaggcggccggtgcggcgaccggaagggagcaccaccggctcgatctgcttgctttgacgtgttgactttcggccgtcttcttggctgtttcaccggtctgattttccgagcacagggacacggagccggcggagatggcgcatggcagcccggacctggctggtttccagttctacaagctcatggctgccggaatgtcctgggagaagcttgtgctgcctgacaagttcgtgagcgagctcagcggccctgagctccggggcgtga

SEQ ID NO: 6476 - DNA, 285 bp, Triticum aestivum
  Clone ID: LIB3281-040-P1-K1-D1
atcgtattaataccaaggctgatggatgatcagaaaacgttggaaaccatgatttgtttctccctgaccattgcttcgtagtagcacaaataggattcttatagcaaccatggatgatgagtctcatgactagtcgcgagactagtctagtagtctcaatttgattgtcaactagcttcttcgtgtagactagcttgttgaattgagcggtggagtgactagtcttcgactagtctacgtttttgagtcgatcgactcaatttgggtggatcaagtttttagggg

SEQ ID NO: 6477 - DNA, 359 bp, Triticum aestivum
  Clone ID: LIB3281-040-P1-K1-D12
caatactcctacagaagtggtctgactatatttgctaagggtagttccagctgacagggtggttgttgactttggtgaacagatgctgagtgtccaattgaacttcccggtgaggaactataccattttagcctttttgttttcaaagatcgccctataagtgcagtatactgtgttttctcaaaggttgattgcgccttgaaaagctgttccagtaacttggacatgatttttttatacagttgttcgaaccgctcctcataagattaatgtacaagttgattcagcttataggccatcttatccataattaaaaatccaaaaaggtcttgtgatatgccttgaaagctaaattttaa

SEQ ID NO: 6478 - DNA, 277 bp, Triticum aestivum
  Clone ID: LIB3281-040-P1-K1-D2
agctcacgcatctctctcggctccggcaagcaagcaccagcgctctcctctcccctcgcttcctcgctgcaatgtcgaccgacgtggccgccgatgtcccggcccctgaggtggaggtggccgccgaccccgtcgtggagaccacggccgaggccgccgccggcgacgcgaagccggccaaggagaccaaggccaaggcggccaaggccaagaagcccttcgccccgaggaagccccgagccaaccctgcccacccgacctacgccgagatggtgtc

SEQ ID NO: 6479 - DNA, 386 bp, Triticum aestivum
  Clone ID: LIB3281-040-P1-K1-D3
cggacgcgtgggttttacttcaagattggagcttgtcgtcatggcgatcgctgctctcgcatccataacaggccaaccatatcacctactattgtgctcatgaacatgtatcagcgccctgatatgattacccctggggttgatgctcaaggccagccgatagatccccgcaagatgcaggagcattttgaagatttttatgaggatatctttgaggaactgagcaagtttggtgagattgagaccctcaacgtctgtgacaacctttctgatcacatgataggcaatgtgtatgtccagttcagagaggaagatcaggcagcagcagctcataccgcccttcatggacgcttttactctggtcgcctaataattgttgacttctc

SEQ ID NO: 6480 - DNA, 421 bp, Triticum aestivum
  unsure (1)...(421): unsure at all n locations
  Clone ID: LIB3281-040-P1-K1-D4
acggcatcctctgcgcgcagctggtcctcaccaccgtcgtctgcgccatcaccgtcttccaccccaccctcaacgccacgctctccaactcgcccgtcctcgcgctcgtgctcgctgtcctccccttcatcctgatgatcccgttgtacatctatcagcaccgacaccctcacaatctcgctatcttgggtttattcactctgtgcttgagcttcagcattggtgtggcttgtgcaaacactgaaggaactattgtgcttcaagcattggtactgacctcagctgtggttgtctctctgactgcatacacattctgggccgcaaagaagggcaaggaatttagttaccttggaccatttctgttttctgctctcaccatcctggtcgtgataagctntacccagatctttctcccattcgg

SEQ ID NO: 6481 - DNA, 439 bp, Triticum aestivum
  unsure (1)...(439): unsure at all n locations
  Clone ID: LIB3281-040-P1-K1-D5
cggacgcgtgggcggacgcgtgggcggacgcgtggtcgtcagacgaggagtgagagccagccacagtcagagagagtgaggagagggataggatagtgagagggtgtgaaggtcgtcaatggcgaggaggtaagaacagtgtggtgtaggatagaagagtgagcgacaagaacccatccaccccaccacacaaatagtgatctgcatcgcattgcatccatcctagatttttcttgtaggatctccgcttctttttcccccttcttcttcggttgatttttttacctctcttggagaagaaaacatattcatggaggtgttggggctcgccgccggcgaggaggctctgcagagagtgcccggcagcttttgattcatcttcttactttcttncttcgtagatgttattagacattttttctttcttcgttcattcttt

SEQ ID NO: 6482 - DNA, 386 bp, Triticum aestivum
  Clone ID: LIB3281-040-P1-K1-D6
cggacgcgtgggcaagcattaacgaagaagttcctactgcaataattgcatctctggtgaaggatgttgttgatggcatcgagttcgcaaggggaggggtcaacactacatggggttcagttcgtgcggcaatgggacatcaacaaccttttaagcttgattatgtttcaatagggaatcaagaatgctggatgctctactacagagggaattaccaaaagttctattctgcgattaaagctgcataccctgacatcaacattatatcaagctgtgataagtcaactatttcggcatccaaccctgccgatctgtatgatgttcatgtctatgcatcttctgctaatatgttttccagaaccagtatgtttgacaacacaccacgc

SEQ ID NO: 6483 - DNA, 380 bp, Triticum aestivum
  Clone ID: LIB3281-040-P1-K1-D7
ggagggtgaccgccaagaagcggccgaggccggatgcgtcctccaacagcgcgcggaagctgcagcgccgggagattgccgcattccccgagcgcaccttcgccgccagcaccacgcgggagcggttccgcaacatccagctccaggaagaatttgatacatatgatcctaaggagaacagttcgctactaccttacttgaggaagcggtctgaaattattgagatagttggagcccgtgatattatctttgctttatcacagctgggagtatgtgctgcattcagtagagtgacaaaccagcggatttgctttctgaatggaagtccagatgaagtcatccgtagtttggtttataacaagaacaatgactcgcttata

SEQ ID NO: 6484 - DNA, 326 bp, Triticum aestivum
  Clone ID: LIB3281-040-P1-K1-D8
ctatgatttctggggtggttttggctctgttcattacagcctcttgtccaagggtacgactcgagcccagtagctccagattaagaatggtggagaccatagcacatacgggtttcagctgttctacgatgtcccttatttttgtagacatttctacccgatcaaactttaactttggtatttgcggggcatgattcctctgcggtgccttgggggccagccaagcgccacaaagaaatcgctgcccatgttcacacgtgttggtggattccaacattgccctttttggatatggacctgaggatacttatttttgcacttgggct

SEQ ID NO: 6485 - DNA, 395 bp, Triticum aestivum
  Clone ID: LIB3281-040-P1-K1-D9
caaggctacaactaccccatgcacgacagctcgagttgaattcacggcatgcactacatccgggagtacaacgggctaaaccttgagaggcagatcacttagcatctattggcctagctgcgcaagtccattgcttacaaggtgatctcgatgaggggaaacaagggtgaactatgaagtttcatgatccaggatgtgatcttctgaagatgatggatgtgctgcagtctggcgtttggcattttggcttggtctatgaagactacagatttctgtggaagatcaaaatacctcctaaaatcagaatgttcctttggttggtgctgagggaaaagcatttaattagaagactctgctggataggggtggaaaaatgtgaatcgggttggcttttc

SEQ ID NO: 6486 - DNA, 370 bp, Triticum aestivum
  Clone ID: LIB3281-040-P1-K1-E1
gcagcagccgccgccagcagctgcgcaaaggctccacaaaccctaaccctagctccaagcttagcttccatcttctcgatctagctagagccatggcgccgaccaagggcgaggggccggccatcggcatcgacctcggcaccacctactcgtgcgtcggcgtgtggcagcacgaccgggtcgagatcatcgccaacgaccagggcaaccgcaccacgccctcgtacgtcgccttcaccgactcggagcgcctcatcggcgatgccgccaaaaaccaggtcgccatgaaccccatcaacaccgtcttcgatgcgaagcgtcttatcggcagaaggtttgctgatgctccttgccagagtgatattaagat

SEQ ID NO: 6487 - DNA, 464 bp, Triticum aestivum
  Clone ID: LIB3281-040-P1-K1-E10
atccatttctctcctcctcctcctgccaccgatcccgaaccagggaggaacccggcgcgaggagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacatgatcaagcccctgtggaggcactacttccagaacacccagggtctcatttttgtcgtggacagcaatgacagatagcgtgttgttgaaggcagagatgagc

SEQ ID NO: 6488 - DNA, 437 bp, Triticum aestivum
  Clone ID: LIB3281-040-P1-K1-E11
acaaagcactcaaaactatttcatttccagtgagctgctttacaaacattgttcagttgaaaggagctctactgatgagccgctggtacatatttgagcaaactctacatgacacaaaaataagtcacatgtcgaggaactaggcaaagaataaaaaaatctgctaaatccactaccaattacccctcgaaacacaaattatggctcgacaaaaggagaaagatcaccttccactccttcattgatcaatatatcatacatcaagctcaaatttgcccttccatgtgctcagcagctatggcctccatttggtcagtagctatggcaatacgctcactttccaggaatgaaagatctaagaacttggcaacaaatgcccacatcttgtacacatcttcaaagttagtgaggaagccaagcgaaacaagcacaacttc

SEQ ID NO: 6489 - DNA, 354 bp, Triticum aestivum
  Clone ID: LIB3281-040-P1-K1-E12
cgcgtcacagctcctccttcccgaccagatcgacggccgcctcaccctcatcgtgcgggccctcgggcaccggcagatccacgcgggcggcgaccctcttcgtcggcggctcaccctacgcgacgctcttctctagccatgtctacaatgaagggacagacaaggtgggagaggcctaggactcgcccccatggcctcacgcaacagaagaggcaggaaataaaggaagcatttgatcttttcgacaccgattactctggaaccatcgatgccaaagagttgaatgttgcgatgagtgccttgggatttgtgatgacagaggagcaaatcaatcagatgattgctgatgttgac

SEQ ID NO: 6490 - DNA, 379 bp, Triticum aestivum
  Clone ID: LIB3281-040-P1-K1-E2
cggacgcgtgggcggacgcgtgggttgctcgctcgctcgctctttctcaaacctcgccggtcccgaacccgaagccccattcctcacttcaacgccgcgcaccggagcgcgcgcccggcttgccactctgaccggcgtggctggcgctccgttgctcccccggctctcgctataaatatagtgcacgcgtgtccagctaaccagccagccaggcattggaggaggttccatttcctctctgttttgctctaaacttcgatccaccccgaccgaccgaccgaccccagcgtcgttgcctctcttcctcttttttttactcttctttctcttctttttcttcctcttctctagctagttctgtcttccctggcccgggctg

SEQ ID NO: 6491 - DNA, 375 bp, Triticum aestivum
  unsure (1)...(375): unsure at all n locations
  Clone ID: LIB3281-040-P1-K1-E4
cccacgcgtccgcggacgcgtggggaatggtgcattggagtttctgaatgagcaaaaccgtggcccacgtgctgcaaaaccaaagaaacaagacagagacaattctttagtagatgacaaaagcgagaaaaccactcaacttattgacagtgaactgtacaattgtcctgattttgccacggagtacaaggatgcgattttttttgtaattaaatcatacacggaggaccatgtacataggagcattaagtacaatgtttgggccagcacagctagtggcaatagaaagctggattcagcttatcgtgcggccaaacagaaagaagaccattgccgtgttttcttgttcttctcggtaagaccaggncccttctt

SEQ ID NO: 6492 - DNA, 423 bp, Triticum aestivum
  Clone ID: LIB3281-040-P1-K1-E5
ggaggatggcgaatgggaggcacccaagatggacaaccccaagtgcgaagtggcacctggatgtggtgaatggaagaagccgatgaaggataaccctgcctacaagggcaagtggcatgcccccctgattgacaaccccaactacaagggaatctggaagccccaagaaatctccaaccctgagtactttgagcttgacaagcctgactttgacccaattgccgctattggaattgagatctggacaatgcaggatggcatcctgtttgacaacattcttattgccgacaatgagaaggtagccacctctatcctggagaagacatggaagcccaagtttgatgttgagaaggaaaagcagaaggctgaggaggctgcaacaggtgcatcagaaggcctttctgaattccaagaagaagatct

SEQ ID NO: 6493 - DNA, 300 bp, Triticum aestivum
  Clone ID: LIB3281-040-P1-K1-E7
cgaacaggctgtttgggctctggggaatgttgctggtgactctccaaagtgccgtgaccttgtgcttggaagtggtggtctgttccctttgttgcagcagctcaatgagcatgccaagctctcgatgctcaggaatgccacatggacactctccaacttctgccgtgggaaaccacagccaaactttgaacaggtcaaaccggctctcacagcactgcagcgccttatccactctcaggatgaggaggtgctcactgatgcctgctgggctctctcgtacctgtctgatggaacttatga

SEQ ID NO: 6494 - DNA, 145 bp, Triticum aestivum
  Clone ID: LIB3281-040-P1-K1-E8
cggacgcgtgggcatgttacctatatactcattgattaccttgttatttttccattgtacaaccctgctgccaattgttggctcgttttgaaaccattgttgatgaatctggacatgatttgtttcataaagtgacgacttgtat

SEQ ID NO: 6495 - DNA, 402 bp, Triticum aestivum
  Clone ID: LIB3281-040-P1-K1-F10
aacctctcggcgctccagtcctttccgcctcactcccctcgcgcttcctcctccggctggtcgacccggtcccactcgcggcatcctccgccgccgcgccggcgcagcgatggcagcccgcgccccttacttcgcccccgaggaaggcgcgcggggcatccgcccaggggagtcacctgccgcggcgctccgccggatcctggcgacgccaggcgctcaccaggcgccctgctgcttcgacgcgctcggcgcccgcctcgtcgagcgcgcggggttcccgatctgcttcatgggcggtttctgtgtttctgccgcacgacttggattgccagatgccggattaatcctccatggagaaatggctgatcaagggcgtctaatcactgaagcagtttcaggccc

SEQ ID NO: 6496 - DNA, 434 bp, Triticum aestivum
  unsure (1)...(434): unsure at all n locations
  Clone ID: LIB3281-040-P1-K1-F11
cttttgcagggaatggcttcagttccgctactgtcacgagcctgaggttctgatcctacacctcggctgctcggccagaagctaagtcataccaacttttgttagttcttgagatttttttgtggctttggatttacagtctgcaaaatgtgtttatgcttttatcattccttctagctctaacatacatatgtttttttctatgatgtactactaaactatgcgtgttaaacagagcatggtgattactaattcctcatgagcttcttaatatttgtctctgcaccaaggaggcaataaacatgaaccagataactgtatttttttcctgttttcactgtacgcagtacatctccattgtgctttattttatttgccagctctgntgataggaacttgaattgttgtttctggtctgcggtaattcaagtgac

SEQ ID NO: 6497 - DNA, 383 bp, Triticum aestivum
  Clone ID: LIB3281-040-P1-K1-F2
cccacgcgtccgactagttctagatctgcttaccctatcattaattttggaccttataattctccagctgaagttacgatgtcattgtcccatgcaataggtatttctcatctcataatcaatctcttcccctactaaatgtttatcagatgtacctttcatgtccagtgttttgaactttaatcatcatactgtatagaaactctgaaggtgtatatctctgctctagtatgaaagtaggtgtgtcttctatgaaattataattccattttgacaaagaaaaagtagacaagttatgggtctgtgtagcaaaatattcagttctaagtctaactgttttcgcattattagttggcacttggcactgtaaaatttttttgaag

SEQ ID NO: 6498 - DNA, 385 bp, Triticum aestivum
  Clone ID: LIB3281-040-P1-K1-F3
cggacgcgtgggcggacgcgtgggccaaggcggccgatctgccctcaccgccaccgctaccgccgacgccgcagctccggcagccgttcgtctcgagattgacctttggtgactgttagaagcaacagacactgaagatggcgcagcctgctgagctttcccgcgaggagaatgtgtacatggccaagcttgcagagcaggctgagaggtacgaagagatggttgagttcatggagaaggtggccaagacagtcgactccgaggagctcaccgtcgaggagcgcaaccttctatcggttgcttacaagaatgttattggtgcccgccgtgcctcgtggcgcatcatttcctccatcgagcaaaaagaaaagagccgtgggcaatg

SEQ ID NO: 6499 - DNA, 336 bp, Triticum aestivum
  Clone ID: LIB3281-040-P1-K1-F4
gaacaaaaaacatgggtagattccaatttagattaaacagatatactacaaaaacaagcgtgcgaccaacaaggccagttcatcagcgacactgcggaatgttacagttgcatccaagaccaatagcgaccgacacattgcggagcaccagggaccagttttcctgaacaactccagtcaattattcatcatccccaaacagaaacgagaaaatgcctcaccctggcacggtcggcaatcggaagggtgggcactcagccggccatggggtggttggcgacatactcgatggcgagcggaagcgagttgatcttgtcagcctccaagtcggggatc

SEQ ID NO: 6500 - DNA, 441 bp, Triticum aestivum
  unsure (1)...(441): unsure at all n locations
  Clone ID: LIB3281-040-P1-K1-F5
caaaggagctggtactcatgacactaagccggagcctgaagatcctaatttagttaatggattggaagtgccctcaaatatcccaagctcttgcagagttgacctagtcgcaacacctcatttacgtgaaaggaagataatagattttcgggagaagctgtaccttgctcccttgaccactgttggaaatcttcctttccggaggctgtgcaaaacattgggagctgatgttacttgtggagaaatggccatgtgcacaaatcttatgcaggggcaagcttcagagtgggctttgctgcgaagacattcatcagaggatttgtttggggtgcaaatctgtggagcttttccagatacagtgtcacggacaattgaacttgtggataatgagtgttcgtttgacttttgtgacatanatatgggctgccaatcgatttagtg

SEQ ID NO: 6501 - DNA, 274 bp, Triticum aestivum
  Clone ID: LIB3281-040-P1-K1-F9
cggacgcgtgggtcccgaagcacgagtcgctggcgcgctcgttccacgactagctcaagcgccggaacaccggcctgatctactctacgtgcggcgtccgcgacgacgaggaggtcggcggctactccatgtacacctgcgccacctggctgtgggcctgcatcaccaaactcgccgtgaaggagagctgccggaggcagggcctcggcgaggcgctcctgcaggccgccctcgagaagtgcccgaggaggcggctccagcgggtgtcccttca

SEQ ID NO: 6502 - DNA, 329 bp, Triticum aestivum
  Clone ID: LIB3281-040-P1-K1-G1
agaaagttttcggcgccattgcatatttatgagtagcatgtttccacagcacgatgaatacagtgaatactcgttaaaagtacgcgctctgcgggtcaaacaaacagcatgaacaaatgctcggttacgaaacaaaaagttaaacgagagcattgccttctcattgaggttgtggaagaaacaaagatcatctccacatgacagtgacgcccagtattgctggccaccaaaactccacataaacagccgctgcccaccagaactccacatacttgctggatatatcggtcaaaatgacagaagctaacttctggtaaagcatttttttc

SEQ ID NO: 6503 - DNA, 251 bp, Triticum aestivum
  Clone ID: LIB3281-040-P1-K1-G10
ccacgcgttcgctgaaactcgatgacatccaatggctagcatatctccgtcagtggtgcgaataatacactgaagctggctccaatgatattgcccagggatgtaacatgtgtatcatcggccccagttgtgaagagtgcacaattccattcatctatgatcgagtgtgaagtgacgaatactctggccaactaaagactaaatttatggatgaactgaagcccatctatttgcctcaatgccttgatgca

SEQ ID NO: 6504 - DNA, 410 bp, Triticum aestivum
  Clone ID: LIB3281-040-P1-K1-G11
cccacgcgtccgctgaaactcgctgccatccaatggctagcatatccttgtagtgtagttaataatacacttaaacttgcttaaatgatatttcctagggatttaacatgtgtcttcttggccccagttatgaaaggagtgcttttcatttatttattttagtgtgtcaaggaatgaatacgctggccgactaaatactaaattcagttattaactgttgacctcatattttttcaattcattcatgcatgcatactttgttatgttgctatattgctctacaaattgtgaacactaaactaattattctctggttccttttttacccgtgaataatataagaagacatgtttgtccctgtgttctgtagcaatcccactctcagatgaccataaacctaacttaaagga

SEQ ID NO: 6505 - DNA, 204 bp, Triticum aestivum
  Clone ID: LIB3281-040-P1-K1-G2
ctcacgcgtgctcgtacgcgaggtcccatcttttcattgtcggcaagctgttgtcggagtggttagactacaatgtggagcaaggcttccacatgctagtttaatacatataccacatagtataactaggcgctcatgactggaaacgcataacacgttcaaccccttttttgcgatacaaagctctaatatatgaacattcct

SEQ ID NO: 6506 - DNA, 314 bp, Triticum aestivum
  Clone ID: LIB3281-040-P1-K1-G3
cgcaccgcggtgcaggtcgcggcgccagcgtacgtccgtccaaatacgtaggtccaatcaatccacacgctccgggtccgggagaggcaatccaaacagtggcgctactagctgttggcacccgctagctgctttcccaggccaaacgtgaccgcctggtggagacgagaggagcggataagaagccgccatgaagcatcctctgcctttcccacctccttgattaatccatcctgctcaacgaaccccacgcagctcctttccttcctctcctttccttttccctttcttcttcacccatccagatcatactt

SEQ ID NO: 6507 - DNA, 406 bp, Triticum aestivum
  Clone ID: LIB3281-040-P1-K1-G4
agtttgaggacctttgatgcacttcactcttaatcaaatgtataacagcttccactccatatgcatggtgggaacgggaaggttgcctacattggcactgagggaacgttccggcctgaacgcattgtgccaattgctgagagatttgggatggatgccaatgctgttcttgacaatatcatatacgctcgtgcatacacctatgagcaccagtacaacttactcctgggccttgttgccaagatggctgaagagcctttcaggcttctgatcgtggattctgtgattgcgctattccgtgttgatttcagtggcaggggtgaacttgcagagcgtcagcaaaaactggcacaaatgctttcccgccttacaaagattgctgaggagttcaatgttgcagtgtaca

SEQ ID NO: 6508 - DNA, 247 bp, Triticum aestivum
  Clone ID: LIB3281-040-P1-K1-G6
cggacgcgtgggcgccgctaccgttaagctgccctatgcacaccttgatagtattttgtttgagccatcaggttttgctaccttcgttctgagactacttgaagcttgtgctagaacctttatgtcgaggcatatctgttgaactatttgctatctgcctgtgttaccagaagaaagaatggtttagtaatcgtatgctgtgtgctatgctgtcataacattataaggtgaacgagcaaacatatga

SEQ ID NO: 6509 - DNA, 337 bp, Triticum aestivum
  Clone ID: LIB3281-040-P1-K1-G7
cggacgcgtgggccgcctcccgccgcgccctcagccggatcggtggcgccctccggcggtccttctcgtcgtcgtcggtgccggacgcctcggggtaccacgtgtccggtgggccgagcttcatgcgcgcggccgtgttctgggagcccggccgcccgctcaccatggaggagttccgcatgccgcgccccaaggccggcgaggtcctcgtcaagaccaaagcttgtggagtctgccactctgatctccatgtcatgaaaggcgaactccctttcggcagcccttgtgttgttggccatgagatcaccggggaggttgtccaccatggcatgcacac

SEQ ID NO: 6510 - DNA, 309 bp, Triticum aestivum
  Clone ID: LIB3281-040-P1-K1-G9
cccacgcgtccgcagagaaaacaccacctcccccctcacccaccactcctacctcctccgacttagcgttcgctgagcgggcctcgtggttggacgcgccgggtagcagccggagcagcggcggcggcggcggggagtccacaatgctgggcgctaggagcaaatctggcctggccgacgccaagggcgacggcaagccggagggtaaggtcggcagcaagccgagcggcaagccggaggccaagagcaacggcaagggcacgccaccgacacccaggggcgagacgccgccgacacccaagggcgaca

SEQ ID NO: 6511 - DNA, 317 bp, Triticum aestivum
  unsure (1)...(317): unsure at all n locations
  Clone ID: LIB3281-040-P1-K1-H1
ccaagagaacctcctcagaggaatttatgcttatggttttgagaagccttctgccatccagcaaaggggaatcgttcctttctgcaaggggcttgatgttatccagcaagcacaatctggaacaggaaagactgctactttctgttctggaatccttcaacagcttgactatggtttggttgagtgccaggccttggtccttgctcccacacgtgagcttgcacagcaaattgagaaggtcatgcgtgcacttggtgactacttgggtgtgaaggntcatgcatgtgttggaggaacctcatttcgtgaggaccaaa

SEQ ID NO: 6512 - DNA, 391 bp, Triticum aestivum
  Clone ID: LIB3281-040-P1-K1-H10
gcctcctccactgggctctctcgtcgcctccccacccattccagcggttgacggcgggagtcggccagtgaaaatggaagggaacactagaggaggcgggcattctgaagcgttaaagaactacaatgtgggcagaacattaggtatcggcacatttggaaaagtgaggattgcagagcataagcatacagggcacaaagttgctataaagattctgaaccgtcgtcaaatgagaactatggaaatggaagagaaagcaaagagagagatcaagatattgaggttgttcattcaccctcatatcatccggctttatgaggtcatttacacacctacagatatattttgtgtgatggaatattgcaagtatggtgagctattcgactgcatt

SEQ ID NO: 6513 - DNA, 228 bp, Triticum aestivum
  Clone ID: LIB3281-040-P1-K1-H11
cggacgcgtgggcggactcgtggtcggctccgtgttcagagagccaattatatgcaggagtgttccaaagcttgttccaggatggactaatcccatctgcattggaaggcatgctttcggtgatcagtacagagcaactgatgccgttctcaagggacctggcaaacatatactagtttttgagggaaatgtcgagacagttgatctttgaggttttttaacttctct

SEQ ID NO: 6514 - DNA, 413 bp, Triticum aestivum
  Clone ID: LIB3281-040-P1-K1-H2
cccacgcgtccgccgacgcgaggccgaagctggacaaggacggcaagctgtcgccgtactactacgacgacacctctgatcaaggcagcagtgtctaggtaaggtaataaaccacagagcataacacgttggtcatgactcgacgagcataacacgttggcccccttccatgactcgccgagctctcggtaagaaagaacctaagtagaattacagtgctgattttgaccgctgaaccgcttgttgtcgacgcctccagcgccactgtgacctggagttgatgtgtgctccggtcggtcggcaatggaggacaagtgggagttagggcatagctagctagcggcggtgttcttggttggtctagctgtctgtgggccgtgccattgattccggtagggtagatggtctgtatg

SEQ ID NO: 6515 - DNA, 407 bp, Triticum aestivum
  Clone ID: LIB3281-040-P1-K1-H3
cccacgcgtccgcggacgcgtggggtagccgtcccaatcctcgatctgttctcagaccctcctccgtccgtcgcagctccagatttccttccccatggctccgatcaagatcggtatcaacggtttcggccggatcggcaggcttgtggccagggttgcgctccagagccccgatgtcgagctcgtcgccgtcaacgaccccttcatcaccaccgactacatgacctacatgttcaagtatgacactgtccacggacagtggaagcaccatgaagttaaggtgaaggactccaagacccttctcttcggtgagaaggaggttgctgtgtttggctgcaggaaccctgaggagatcccatgggctgctgctggtgctgagtacgttgttgagtccaccggtgttttca

SEQ ID NO: 6516 - DNA, 375 bp, Triticum aestivum
  Clone ID: LIB3281-040-P1-K1-H4
cggacgcgtgggctcctgtgggcggcgccgccgctgcgcacaaaacacatcctcgccagcgtagcttctccggcgtccggccaacgcgctcactagcctcccgccttcctccacatctcctcgcctccaccccatccagttcgtgccattcgctgctccaagacaagggcatggcgctcggcggctgcggcaacgaagctgatggtgcacgagccaaccatgaaggcagtagcacggggcagcgacagcagcatggagggcgtcctcttgtttgggaaggtaatggaactgcaaataggagtggcagcggcgaccaagatgcaaatggaagtggttcccaaagaccttggaaaggacttaaaagacaataacttt

SEQ ID NO: 6517 - DNA, 421 bp, Triticum aestivum
  Clone ID: LIB3281-040-P1-K1-H5
cccacgcgtccgcggacgcgtgggcggggctgctgttggagctacttttggagggtcagctgcatacttaataaatgcagctatacctggtagtgctgctgttgcacagccacaagcttatgctcttgttgggatggctgcgacattggcttcagtctgctcagtcccgttgacttccgtattgcttctctttgagctgacaaaggattacaggattttgctacctctgatgggagcggttggactggcaatatgggttccttctgtggtaaaccaaccaaatgatggtgaatcttcagggtttagagcacccacgcgtggttattctttagtttcactacaagataaaaatagtagtgtctggacgcgaagtgattccgtagatgatcttgagcttactatctcacaaagtggccttcgt

SEQ ID NO: 6518 - DNA, 126 bp, Triticum aestivum
  unsure (1)...(126): unsure at all n locations
  Clone ID: LIB3281-040-P1-K1-H6
cccactcgtncgctgacgctttttcttttctgctatagcatcaaaattttgatcgacagatgcttatttaaaataggcggctatactctctaacaactgctattgcacaatctctatcttatcctc

SEQ ID NO: 6519 - DNA, 285 bp, Triticum aestivum
  Clone ID: LIB3281-040-P1-K1-H7
ggcacagcgacgtcggcgtggtcgggatggtcgcagcccttcaaaattctcaacggcggcgtctcggcgctgatggcagagtcgacggcgagcatcggcgggtacagatggagtaggaggacgagcaacaacagcaaatcagcctgatgatgacggggtgcggaaggcaatggtgatcatgctgatggcatgaagaaggcgaatgaccacaacctggaccttttggcatttagagatggcaaacacaggcggcgcggagacaacaacctggaccacccacccccc

SEQ ID NO: 6520 - DNA, 376 bp, Triticum aestivum
  Clone ID: LIB3281-040-P1-K1-H8
ccacccgtcgccccctcctcgcgttcctcgtgcgtgcgcagaaccccgaggcctcggcagccatggccaccggcggcgaccacgcggcggaggagctcgtgtccgtcgagatgcccgcgcccgagggatggaccaagaagtttactccccagagcaggggaagatctgagattgtttttgtttcaccaactggagaggaaattaagaacaagaggcagctgaacagctatctgaaggcaaaccctggaggccccacttcatcggagtttgactggtcaactggtgataccccaaggcgttctgctcggattagcgagaaagtgaaggtatttgatagccctcagggtgaaaagataccaaagcgcaataggaactc

SEQ ID NO: 6521 - DNA, 321 bp, Triticum aestivum
  Clone ID: LIB3281-040-P1-K1-H9
cccacgcgtccgcggacgcgtgggtgtaaaggaggatcagcccgaagacgaggaagggcttcctacatatccgtatgatcgcttgaggacatcttcaagcaatcctgtcacagacattgatagtaccaggcgtgagacgtatctatcttcggcagagttcagggagaagtttggcatgacaaaggaggcttttgcaaagctaccaaagtggaagcagaataggctcaagatcgcactccagctcttttaaagtcttctgctgtcaaatatgcagcaattaatgtctgcttggtgaaagtaaggacggcgagattgtttttc

SEQ ID NO: 6522 - DNA, 121 bp, Triticum aestivum
  Clone ID: LIB3281-041-P1-K1-A1
ggccgccgaaccaactccgcccctcccccccacgccccacgccccgccgctgaaggatgggccacgcccaatcgaccttccgccacaatggccgcgccggcgccgccaacggcttcagccg

SEQ ID NO: 6523 - DNA, 54 bp, Triticum aestivum
  Clone ID: LIB3281-041-P1-K1-A10
cggacgcgtgggcaccttgtgaggagagagtctcttctccttctaggaaggggt

SEQ ID NO: 6524 - DNA, 92 bp, Triticum aestivum
  Clone ID: LIB3281-041-P1-K1-A12
cctcagcagcagcagcaggaaaaagaatggccgcgccgcatcatgtccgcgccgtgcccctggctcgcgcgctccgtcttctcacgcgcgcc

SEQ ID NO: 6525 - DNA, 379 bp, Triticum aestivum
  Clone ID: LIB3281-041-P1-K1-A2
cgtgagcatcaaccatgtattattttcatggatgagattgatgccattggtggccgaagattcagtgagggcactagtgcagatcgtgaaatacaacggacattgatggagctcctaaatcagttggatggattcgatgagctcggaaaggtgaagatgatcatggcgacgaaccggcctgatgtcttggaccctgcgctccttcgtcctggacgcctagaccggaagatagagattccgctgccgaatgagcaatccaggaccgaggtcctgaaaatccacgctgctggtatcgccaagcatggtgaaattgattatgaggctgtggttaagttggccgagggcttcaatggcgccgatcttcgcaatgtctgcactg

SEQ ID NO: 6526 - DNA, 336 bp, Triticum aestivum
  Clone ID: LIB3281-041-P1-K1-A3
tcgcggacgcgtgggcacctcgtaaggagagaggacacttctcctccaaggaaggtaggaagggaaggacctcaaaaggagccattgaaagctggtttgtttccagcagaggaagttaaagaggacatcagaaagattaaggaggatgagaagctcaagtttgcagcacaggaccctccgttcactggtaaaggggcaaaggtggtgttccaagatagggaaggaaaaaggttaattcaagaagacttccagatggcaaagaaggacgagaagccaaaggaaaaccttttagattggggtaaaggttgggtgcaaaaccggcacaccaaggctcaa

SEQ ID NO: 6527 - DNA, 320 bp, Triticum aestivum
  Clone ID: LIB3281-041-P1-K1-A6
cccacgcgtccgcccacgcgtccgaaacaaccctagccctcgcagccgcagcggcgcgcacccctctccctccttcctgaagacagcgccgccgtcggccagagcacaggatggcgaccgtccccgctcccgcagccgagaccgcggcctccaccgcgcgcacggtgaaggatgtcaacccccacgagttcgtcaaggcctactccgcgcacctcaagcgctccggcaagatggagcttccagagtgggttgacattgtcaagacttgcaaggttcaaggagctggcaccttctgatgctgactggtactacatcaaggc

SEQ ID NO: 6528 - DNA, 436 bp, Triticum aestivum
  Clone ID: LIB3281-041-P1-K1-A9
cggacgcgtgggcacctcgtaaggagagagacacttctcctccaaggaaggttagaaaggaaggagctcagaaagagacaatgagagctgggttgatgtcagcagaggaagttaaagaggacatcagaaagattaaggaggatgagaagctcaagtttgcagcacaggacccttcgttcactggtaaaggggcaaaggtagtgttccgagataaggaaggaaaaaggataaatcaagaagacatacagaaggcaaagaaagacgagaagccaaaggaaaaacatatagaatggggtaaaggtttggtgcagaaacgggcagccgaggctcgagtgaaggagcttgaagatgtgaaggatcagccatttgcgagaacaagggatgatcctgagcttgacggcatgctcaaaaacagactccgatggggtgatcctat

SEQ ID NO: 6529 - DNA, 441 bp, Triticum aestivum
  Clone ID: LIB3281-041-P1-K1-B1
cccacgcgtccggcctaccacaagtaccgtgtgaagaggaactcctggcctaaggtgcgtggtgtggccatgaaccctgttgagcatccccacggaggaggtaaccaccagcatattggtcacgcctccactgtccgccgtgatgcaccacctggccagaaggttggtctcatcgctgccaggaggactggtcgtctcagaggccaggctgccgcctctgctgccaaggctgacaaggccacttagagttatcattgctgtttatctatgtttgctagctctagattacccgtcagtgacatgtattgcagtaaggatgtcgtttttgatcagtactttggtaacctggtgatatttgttatcagttttcgctgtcgtggtctggattcttcagtccacataaaaaagattattatgcttggatatttgtctgtcgatttt

SEQ ID NO: 6530 - DNA, 391 bp, Triticum aestivum
  Clone ID: LIB3281-041-P1-K1-B10
aaacgccctactttaattttaattatcgccgctgctcccacgcgccttcacgtacgtaccgacgacctttcgctcgcttttcttccgcctagtctgcccgccagatctgcatccgcggagatgaagatcacggtgcggggatcgacggtcgtggtgccggcggaggagacgccgcggctccggctgtggaacgccaacccggacctggtcgtgccgcggttccacacgccgagcgtctacttcttccggcgcggcgcgggggagggggaggaggcgggccgctacttcgacgcggagcggatgcgccgggcgctggcggaggcgctggtgcccttctacccgatggcggggcggctggcccgcgacgaggacgggcgcgtggagatcgact

SEQ ID NO: 6531 - DNA, 434 bp, Triticum aestivum
  Clone ID: LIB3281-041-P1-K1-B11
ggtgaatcataagctatcaatggatagtgatgatgtctggatcaaatatgtggaggctaataagaaagagaaaggattagcttcctacaagaccaaagtagtgaagcattgggagtccatatctatcatatattcaaaagatcatgccaatggtgaaggtgcgatgactggtgctgagactactgcagatccagaagcagaaccaatagaaatctctccagaagtggcaccaaagaggcaacgaacaggtgagtccattatgtgcatgattggagaaatgagggctactttcaaggatgctttgaagacaactgatccacttccactgccaaaagctaccactcctgctgcaattcttgctgcactttatttgataccagacttggcagagccagacatgttgcgatcatatgggaagctgtttcttaatgagc

SEQ ID NO: 6532 - DNA, 299 bp, Triticum aestivum
  Clone ID: LIB3281-041-P1-K1-B12
ggtgaatcataagctatcaatggatagtgatgatgtctggatcaaatatgtggaggctaataagaaagagaaaggattagcttcctacaagaccaaagtagtgaagcattgggagtccatatctatcatatattcaaaagatcatgccaatggtgaaggtgcgatgactggtgctgagactactgcagatccagaagcagaaccaatagaaatctctccagaagtggcaccaaagaggcaccgaacaggtgagtccattatgtgcatgattggagaaatgaggtctactttcaaggatg

SEQ ID NO: 6533 - DNA, 430 bp, Triticum aestivum
  Clone ID: LIB3281-041-P1-K1-B2
cccacgcgtccgacaagagttccttcgcactgttgcaaagtagcttggctgtaagaaatttgcatagcatctttacttcaatccctgtggagtacttcgatatccgctgtttgcctgtttgcgagcgaatattgccgctatattaacagctcatcactgagaagcagagagtagaatagaccgtgaatagaacgcactgtaacaaatacttcgacagtagcttcaagcagagagtatagccttaccatgctgtaactgtaataaatactccctctgtaccaaaatcgtcttatattttggtacagacgttccgcatattttctctccaaaaatgagttgttttcccgctaattctcactttatctagtcaaaatagataacttgtgctttaatcaggggcgttactggcatgtcaaaaacccacattttc

SEQ ID NO: 6534 - DNA, 382 bp, Triticum aestivum
  Clone ID: LIB3281-041-P1-K1-B3
cggacgcgtgggcggacgcgtgggcgccggggacgccgccaacatgacgctcggcgacatcctccagcacgacgcggtgctgcgccagtccgcgcacatccgcgcatccatggatgccacggggcaccgcatcgacaccctcgagcgcgagctcgccagtctccgctgccgcctgcgccgctccgagcaggccgcggctgctgtcacggcctcggccgcgatcgaccgcgtgtccgccaagtcggccagcttccgcatcccgcgcagccggctctggaacggcgaggacctctcgttcagcaccggcaccaccggccggtccgtcggcagggacaaccttagcctcaagtcacgtctggggcacgggttcaagagcctgttc

SEQ ID NO: 6535 - DNA, 417 bp, Triticum aestivum
  Clone ID: LIB3281-041-P1-K1-B4
cacagagacgagagagaaagcgagagggagacagagggttccgtgctcatccacgcatcgaatcgggtcgacccccctcaggcgtctcgtcggcgccctgccctgcccgggctactttttcctttgcaatggcatctggaactgatgagaaagccaagatggagagtttgacatcacctgcagcctttgtagagggtggggtccaagatgcatgtgatgatgcatgtagcatttgtcttgaggctttctgtgagagtgatccttccgcattgacaggttgcaaacatgagttccatctacaatgcatccttgaatggtgtcaaagaagttctcagtgccctatgtgctggcagcctgtcagtatgaaggatcctaccagtcaagagcttcttgaggcagtacagtgggagaggaata

SEQ ID NO: 6536 - DNA, 435 bp, Triticum aestivum
  Clone ID: LIB3281-041-P1-K1-B5
cccacgcgtccgcccacgcgtccgcaacaacattttggcggcggagatggtcgatggggagatggccccgcctctgatgcagctggagacgctgctagcactcaacatggaccagcgcatggcggagaaccaagctatagaggacggaggcttcttcttgtgtccgtgcgaaagtgaagctgtaccgattggcagtggaaggagcggggaacgggtacatgaagcttggatgtaatctgatttaaactatttttaagggaatgcattacatcacgcagcaagttcagaccaagaaaactggcattctgattctctcaaatctaatggcaaaagttcattgtttactgaagaggcagatgcgctaacggtgacgatcagtacaaaggacaactcagccgtgaacattaaaagagcaaacaagattctcgttttgga

SEQ ID NO: 6537 - DNA, 410 bp, Triticum aestivum
  Clone ID: LIB3281-041-P1-K1-B6
cccaatccctcacgcgcgtccgcctcgccgccggcccgccgggaagatggccgcgtcggggtccgggtccgggtccggccagatccagccgctcaagatcccggacgccgtcgtcgcgctcgcgcaggccgccgccaaggccaacaacagctgctacaccggcggcggcgacgccaccgacaaatatcttcccgggtggccgctcttctcgccggccaagatgcagctgaccaagtgcgccaagtgcccccgggagttgtgctccttcgtcgccctccgccggcacacccgcgtgcaccgtcgcgccctgaagatcgacaaggatttccccaagaacagagaccaccttgctgcattctgggacaagctcacggtggaccaagcccaagcgatactgtccttggagggcg

SEQ ID NO: 6538 - DNA, 367 bp, Triticum aestivum
  Clone ID: LIB3281-041-P1-K1-B7
tcttcaaggagatcggggaggagaacccgtcagaaggtccgatgaagcagggcgagcccggtgactacgatgactacgagagggagctccctgcccgcaagggaggtgcgtgcatccctccccccgccagcctgcacgtgaaccctgagaccgggatgcgcgctgatggctcgttcgatagcaagccggggtctagcggacggttgggccttggagcctctgctgatccgagtgaggtgagccaccagtatggcaatgtgtattcgtcatatcgcaagcagaggagcagcaactaccattcttccatcagttcccgcgcagtagcgccgaggtgaaaacggcggacgagcgtttccatatcaatttc

SEQ ID NO: 6539 - DNA, 421 bp, Triticum aestivum
  Clone ID: LIB3281-041-P1-K1-B8
gttctttgatgcctgtccaagtgcatttggtggtctcactaccctcgacctagagaatttgagatttggcgaatcagacatatccaatgtcctcatcacttgcaagcggttaaagcatctgcgtctgttcaactgtgactctggtgatgccagcacgttgcaagttgaacacgcccatctcagtgagcttagtatcgtccaatgtatgcttgccagagttgagctcaactggctccctcaactcacaaggttgttctttgaaggttggctgcaataccaagatccgcttgtaattggtcatgtcccattgctagaggttgtaagcctcacaaatattgcccttagttacagcaagatggtgaagttaagtgaagttcttagcggtacctctgtacgtgttctgaagttgggatttaattct

SEQ ID NO: 6540 - DNA, 429 bp, Triticum aestivum
  Clone ID: LIB3281-041-P1-K1-B9
cccacgcgtccgcggacgcgtgggtctagacttctgactgccggtgatatgctagctgcgaccctatgttatatttgtgctggaaatattgacaaagctgttgaaatatggtctcgcaacctgagttctgaagatggtggaaagacttatgttgatcttctccaggatttgatggagaagaccattactctcgcccttgccacgggccataaaaggtttagcgcatctctatctaagcttgttgagaactatgcagagctgttggccagtcaaggccttcttaaaactgcaatggagtacttgaagcttatgggagcagatgaaaattcagatgagctgactatactgagagatcggattgcattttctacagaagataatgatgccattaggaagtctgtttctgagggcaatgccaacacattctac

SEQ ID NO: 6541 - DNA, 386 bp, Triticum aestivum
  Clone ID: LIB3281-041-P1-K1-C1
ggccaagtaccgctacaaccgcgtcttcttcgccaacgacacgtacctgccgcaccagatgccggcggcgctgaagccgtaccgcgacgacgagctccggaacctgaggggcgacgaccagcaggggccctacgaggaccacgaccgcgtctaccgctacgacgtctacaacgacctcggcgacacccgcgacgtcctcggcggctccaaggacctcccctacccgcgccgctgccgcaccggccggaagccctcggccaccaagcccgaccacgagagccggctgctgccgctggtggggaacgtgtacgtgccgcgcgacgagctcttcggccacctcaagcagtccgacttcctgggctacacgctcaaggcgctggtggacg

SEQ ID NO: 6542 - DNA, 117 bp, Triticum aestivum
  Clone ID: LIB3281-041-P1-K1-C10
cccacgcgtgcgaaaacgcttagcgtatgcgcattctgacaaagatcctagcgtacgggctcgattgcgcagcctaattactctgcttatcaatccaccggctgtttttcgcggggc

SEQ ID NO: 6543 - DNA, 422 bp, Triticum aestivum
  Clone ID: LIB3281-041-P1-K1-C11
atccccaggtcataaacccaagtcggactcgccttcctcctcgccaactactcctctcctctcctccgcgcatcgcaccggggtcacctgagatcacacacacaatggtgaaggctgtggctgtgcttaccggcagtgagggtgtcaagggcaccatcttcttcacccaggagggagagggcccgaccaccgtgacgggaagtgtcaccggactcaaggaagggctccacggcttccatgtgcacgctcttggcgacaccaccaatggctgcatgtcaactggaccacacttcaaccccgctggtcatgtgcatggggcacccgaagatgaaatccgccatgctggggatcttggaaatgtgacaactggagtggatggtggtgctagcatcaatattactgactgccatattccccttact

SEQ ID NO: 6544 - DNA, 252 bp, Triticum aestivum
  Clone ID: LIB3281-041-P1-K1-C12
atccccaggtcataaacccaagtcggactcgccttcctcctggccaactactgctgtggtctcctccgcgcatcgcacctggggtcactctgagatcacacacacaatggtgaatgctgtggctgcgctcaccggcagtgagggtgtcaagggcaccatcttcttcacccaggagggagagggccctgtcaccgtgtcgggaagtgtcaccggactcaaggaagggctccacggcttcatgttcacgctgtt

SEQ ID NO: 6545 - DNA, 258 bp, Triticum aestivum
  Clone ID: LIB3281-041-P1-K1-C2
cggacgcgtggggtacaggggaatttgatccttcaactgcgagcatcaaaattacttaagtctgaggaggtgaagctccaacaacttgcaaaggatgtaccaaagggccacataccacgttctttaaccgctcatttgacaggagagctgacaagaatagcagcacctggagacgttgttgagatccctggtgttttcctgccacatgccttaatttgggttccccgccatgctagcaagattggttgctgataccta

SEQ ID NO: 6546 - DNA, 365 bp, Triticum aestivum
  Clone ID: LIB3281-041-P1-K1-C3
cccacgcgtccgcggacgcgtggggaccgtccccgctcccgcagccgagaccgcggcctccaccgcgcgcacggtgaaggatgtcaacccccacgagttcgtcaaggcctactccgcgcacctcaagcgctccggcaagatggagcttccagagtgggttgacattgtcaagactgcaaggttcaaggagctgccaccttctgatgctgactggtactacatcaaggctgcctcgatggcaaggaagatctacctgaggcagggaatcgggatcggcggcttccagaagatctacggtggccgtcagaggaacggttcacgcccaccgcacttttgcaagagcagtggtgcttgttcccgcaaca

SEQ ID NO: 6547 - DNA, 232 bp, Triticum aestivum
  Clone ID: LIB3281-041-P1-K1-C6
cctacgtttctgccttggcgtccgcacatgcatccgcctatcctcgtggcttacacacgaaagctcgaggagatgatgggggcggacaacacaccatcctccggcgagatcgtgggcgcgcagcagccgcccttcccgccgcccatggtgggcagagaccatcatgccgccctgcttgatacagatgcatcagcgcctcccatctccatcacatatccagattccacgtcga

SEQ ID NO: 6548 - DNA, 345 bp, Triticum aestivum
  Clone ID: LIB3281-041-P1-K1-C7
cccacgcgtccgaccaatgttgttaaagaattgctgttatgtggctacaagccggatgttgaaccatatctttctatgattctacaaacctttagagcatccaagttgctagaactgaaaacgaagtcaaggatattcatcccagaaggacgagcaatgatgggatgcttggatgaaacccgcacactgaagtacggagaggtattcattcaagcttctaatagtgcaaatgacagtgacaagttcgtcgtaactggaaaagttgtcgttgccaaaaacccttgcctccaccctggtgatatccgtattctcgaggctgtttatacccctgttctggaccatatg

SEQ ID NO: 6549 - DNA, 398 bp, Triticum aestivum
  Clone ID: LIB3281-041-P1-K1-C8
gatggaggctactacccgcccactccgtccaccggcactgccccaaccacgcctgggactggagactgcccgccctcaccgtccgccggcacctctcctagcacccctggcggtggtgactacccgccctcgccagccagcggcactgcgcctaccacgcctggtggcgggaactgccctccctcgtcgtccgcgggcacctcaccgaccgcacctggcggtggctactacccgccctcgccagccagcggcactgcgcctaccacgcctggtggaggaaattgcccaccatcgccgttcggcggcaccttttcaacctcacctggtggcagctactacccaccctcaccataaaccggcactgacccgaacacgcctggtggcggttgctacccacc

SEQ ID NO: 6550 - DNA, 155 bp, Triticum aestivum
  unsure (1)...(155): unsure at all n locations
  Clone ID: LIB3281-041-P1-K1-C9
cccacgcgttcgggacgcgtgggcggacgcgtgggactgaatgtaanaaaggagaaggtgattctagtagagatgtgatcctaaacatttaagatagaaacaagacattacggggacaaggaaaagttatgataggggagttccctggatcttca

SEQ ID NO: 6551 - DNA, 359 bp, Triticum aestivum
  Clone ID: LIB3281-041-P1-K1-D1
aaggccagcagggcggagaatgtgtatgtagccctggatgacaaggttggatgggttagcaggaaacggcgggatgtcatgccagacgaaagaccaacaagtgcagacagggtcaccgcgctggaaaaagctctaactgggtttgcagatagggattcagattctgttgtgactccgtccgttgggctatcatttgactcgataaatgaagcctatgaattctacaacctgtatttttgggagagtggatttggtgttcgctatgcaaagagcaagacaaatgtttaagggacaaatacatgtagtagttcgtcttctgctgctcgggcaaaccaaaagaagcaaattcgaagtctaca

SEQ ID NO: 6552 - DNA, 323 bp, Triticum aestivum
  Clone ID: LIB3281-041-P1-K1-D10
cggacgcgtggggccaagcctcaggaatggactttgctttggagcctgttcttccggttatatacgtgcgccctgatcaagtggagagaggtctgaaagctaggttccatgatgcgatgaccgcgcttggaccgcatcgcaaggagatcgagttgcttattggaattctccctgataacaatggctcactttatggtgacctgaatcgtgtctgcgagatcgaccttgggctgatttcccagtgctgtttgacaaaacatgtgttcaagatgtacaagccaatcctggcaaacctttcttctaagaaaaatgtcaagggtggg

SEQ ID NO: 6553 - DNA, 335 bp, Triticum aestivum
  Clone ID: LIB3281-041-P1-K1-D11
cggacgcgtgggattggacccaaagtttagactggactactgtaagctgtggaaagcattgatatcgctggatgtgcaaaaaattctggagttaggtgaacagtttggtgtcgggaaatatgcgaagtactttcctttaatattcactggaaggactatagacagcaaatcagctcttggaacacaaatatctggtgaagagaagacacgtataaagcaggacttgaactctcttggaatggatgatatatcttcatttatggaatccttgccgcctgattttctggtcatacttcgaacagaaatgctatttgtgatctcaattcagtggacta

SEQ ID NO: 6554 - DNA, 372 bp, Triticum aestivum
  Clone ID: LIB3281-041-P1-K1-D12
acccttcgggtgacgtccggcagttagtgaagctgctcgtcaggaaatggaaggagatagtggacggctgggtgcggctccacaactctggtgttgacggtggaaattcgatcctaactgatggtgactctcctgagaagactcaaggcaaaagctaccaaaatgcccgggtttcagacttcaagtatacgcccagcccaccacagaggcacagtggtttgagttcagagcggtctaggaataacaatgggttcgagtcgacactggagaggcatagagcaagcccagctcctacgtatcatacgaagcataacaatggcaataactattcaactacttcgtcatctggtccagctagggcgattagggagc

SEQ ID NO: 6555 - DNA, 271 bp, Triticum aestivum
  Clone ID: LIB3281-041-P1-K1-D3
ttttgtcttttcctttttttgagggacgtccaaaaacttccgggtccagggagtgaagaaatgtatgtacaacaaaggaagcaaaggccacaaatttactcataagcaagatacatataatttagtgaaggcagggggggatgagcctcaaaacaacatggtgatgatccaaacacgaaatgtttagcgcgtcgaaaattcaaaatgtgcaaggaaacaacactgggtcaggcatttatttcacaacaacaaaagcagtcccaccggggtt

SEQ ID NO: 6556 - DNA, 307 bp, Triticum aestivum
  Clone ID: LIB3281-041-P1-K1-D4
ccaaacccaccccgcgttcctcgtgcgcgcgcgcgcagaaccccgagacctcggcagccatggccaccggcggcgaccgcgcggcggaggagctggtgtccgtcgagatgcccgcgcccgatggatggaccaagaagtttactccccagagcaggggaagatctgagattgtttttgtttcaccaactggagaggaaattaagaacaagaggcagctgaacagctatctgaaggcaaaccctggaggccccacttcatccgagtttgactggtcaactggtgataccccaagggcgttcagctcgga

SEQ ID NO: 6557 - DNA, 310 bp, Triticum aestivum
  Clone ID: LIB3281-041-P1-K1-D5
cggacgcgtgggctccagcccagccaaacttttctcaccttcgaagaagaagcagcagcatccatggcccccaaggctgctgagaagaagccagtggagaagacccccgcgggcaagaagcccaaggcggagaagaaggtgccggcgtccaaggagggcggcgacaagaaggggaagaagaaggccaagaaaagcgtggagacgtacaagatctacatcttcaaggtgctcaagcaggtgcaccccgacatcggcatctcctccaaggccatgttcatcatgaactccttcatcaacgacattttttgag

SEQ ID NO: 6558 - DNA, 402 bp, Triticum aestivum
  Clone ID: LIB3281-041-P1-K1-D6
cggacgcgtgggattggatccaaaagaactttgtaaactcctggaggcgtgtcagagcatgcaaaatcgatcaaatgctgggacctctgaagcagctaatgctttggtgaatacagctgcagcagaggctgcaggaccatctaactctaaggctccttttgcgaatggtggtgactgcgggcagacgtcatctgctgttctaccagtacaatcaaatgctaccatggtggcaactaccgagactccagcatgcaagtttaggaattttgatttgaatgacacttgcaatgatatggaagggcttgaggatggttcaaattgcccatcatggatacgacaagattctactcaaagcccaccacagactagtggtaattcggattcaacatcaactcagtcatt

SEQ ID NO: 6559 - DNA, 306 bp, Triticum aestivum
  Clone ID: LIB3281-041-P1-K1-E1
gtcatatctactacttgtggtatcaatatctgctattgtcatatctctgttcacatgtagtcaaacatccttgtactaatgctgttgttgtatggcaaacaccagaggcatatcatatttgtgatgcagtttatgtaacttggcatttctacatggcttgtttatattgtcaaatatacactgatgatgatgtttacctgcactgcttaattttgtttatcttgatcttgatggaaaaatcatcacatgtttcttttctgtcttaagacacaacatacatgtttttttcataggtagtgcttaatt

SEQ ID NO: 6560 - DNA, 408 bp, Triticum aestivum
  Clone ID: LIB3281-041-P1-K1-E10
cggacgcgtgggaccgccccctcttcttccaagatgtcgaagcgagggcgcggaggttccgctggaaacaagttccggatgtcgctgggtctgccggtggcagccactgtcaactgtgctgacaacactggtgccaagaacctgtacatcatctccgtgaagggaatcaaggggcgcctcaacaggcttccttctgcctgtgttggtgacatggttatggccactgtcaagaagggaaagcctgacctcaagaagaaggtcatgccggctgtcatcgtcaggcagcgcaagccgtggcgccgaaaggacggtgtcttcatgtacttcgaagacaatgctggagtcattgtgaacccaaagggagagatgaaaggttctgccatcactggaccgatcgggaaggagtgc

SEQ ID NO: 6561 - DNA, 230 bp, Triticum aestivum
  Clone ID: LIB3281-041-P1-K1-E11
ctgggactgggaagaagacacggccttctgcttaagcttgcatgactatgcctcccatcatgatggtgcgctgtttgctagcgtcggtattaaagtgtcgacccctgctacggctgggtcaaccattccggcggagcagagagttcacgatcccttttgctgatcattgcataaaggtggtctcgtgatcagtctggtttccgtgtgccagggccagggataggtcctgg

SEQ ID NO: 6562 - DNA, 428 bp, Triticum aestivum
  Clone ID: LIB3281-041-P1-K1-E12
cgattcctcgccaacgaactcctcctcctcggttccacacttctcggatcctcgtcgccccggccgagcagaaaccggagccctgccgcagatccgcagggaggaggagccgaggagggggaagaatggacgccccgtcggtggcgctctacaaccagctcaaggctgcccaaccattcttcttgttagctgggcccaatgtgatcgaatcagaggaacatgtcatgaagatggccaaacacatcaaagccatcacaaccaagcttggggtgcctcttgtgttcaaatcaagctttgataaagcaaaccgtacatcgtcgaaatccttccgcggtcctggtctggaacaaggcctaaagatccttgaaaaggtgaaggctgcatatgaccttccagtggtcaccgacgtgcatgaaagctgccagtgc

SEQ ID NO: 6563 - DNA, 229 bp, Triticum aestivum
  Clone ID: LIB3281-041-P1-K1-E2
cggacgcgtgggctcctctcgcttcccctttcctccatctcccaccccaccctcgccccctcgcctcgcgcagcggctagggttcctcccgccacgccgccggccagcagcagcagcagatgccgcccgccgccatggcgccgccgcaggccccctccgaggggatccgctctacgacgagctctggcacgcctgcccggccgtcgtaccgtccggcgtgggacctgct

SEQ ID NO: 6564 - DNA, 232 bp, Triticum aestivum
  Clone ID: LIB3281-041-P1-K1-E3
caacctcgcaccctcgccggcgcgcccggcgtctctacccgaggccccgagcacgcccccccatccccacccccacctccctcgcctccacccatcctcgccggcgccccgttacccgagctcgccccttcggccgctcaacctagcggcctcgccgtcctccgtccgccgtgctctccactcataggtcgcccgcccgcccgcctgtatctgatccaccaagggcacctcg

SEQ ID NO: 6565 - DNA, 353 bp, Triticum aestivum
  Clone ID: LIB3281-041-P1-K1-E4
ctgacgcgtgggcggacgcgtgggtgccagttgggcttctggagaagattaatgtcgataagaaggtgctggtggacagggtcaggcaagcgctttattcgtccaaggtttgcagctacgcacaggggatgaatctgctaagagccaagagtgtggagcagggctggaatcttaaccttgccgagctttcaaggatttggaagggtggatgcattattcgggcaaggtttcttgataggattaagaaggcttatgacaggaaccctgagctggccaatttgattgtcgacagggagttcgccagggagatggtgcagaggcaaggcgcatggcggtgggttgtggcccgggca

SEQ ID NO: 6566 - DNA, 68 bp, Triticum aestivum
  Clone ID: LIB3281-041-P1-K1-E5
tccacgcgtccgcccacgcgttcggggaccccttggccccatggttccaaaaaaaggggggggggggt

SEQ ID NO: 6567 - DNA, 442 bp, Triticum aestivum
  unsure (1)...(442): unsure at all n locations
  Clone ID: LIB3281-041-P1-K1-E6
cgcctactcttcttcgccgccggggccggcctactcctactcctactcatactcttcttcccccacagtcttgtcccacccacaccccgaccactcctccttctcctctccaccatcctccgctgctccggcgcaaccgccgccgccacctctgcctctccctctccctctcctgcaccaacaacatcaacatcagcatcagcatcaagccgccgccgctgttgctactgcatccaacgacgacgacgacgacgccatgtaccaccacctcggagacatggggcagccatccctgatatcagagtatgacctgggagcagaaggcgacctgttcaaggctccggagcccataatcgaggagccgctgctggccctcgacccggtcgccgccgccatctcgatgatgtccggcggngacaacgccatggacgacagcatcaag

SEQ ID NO: 6568 - DNA, 403 bp, Triticum aestivum
  Clone ID: LIB3281-041-P1-K1-E7
ctcccgctcggcctcctcttcctcctctccggcctcgtcgtcaacactgtccaggccgtattgttcttgacgataaggccattctcgaagcgattgtaccggcagatcaacgtattcctggccgagttgttgtggcttcagctgatctggcttgtggactggtgggcaggtattaaagtacaggtgtatgcggatccagcaacttggaaactaatgggtaaggagttaatgccaatattaccacttggaactgatatcatttcattattcacttagaccatatttagaaaaggatgcgttttgaatacgaccttatctggagaattctttaggcaaaaagcacgcccttctaatatccaatcatcgaaatgacattgattggctggttggatggattttaaca

SEQ ID NO: 6569 - DNA, 336 bp, Triticum aestivum
  Clone ID: LIB3281-041-P1-K1-E8
gagcaaagaggaaggactgagggtgtgactgggcagtatgatcccagaaggactgaaggtgtgactgggcatgtatgagccaaaatgaaggactgagggtgtgactggtcagtatgatcaaagaggaaggactgagggggcaactccgagcgaaaggtatggattaagcgctgggcttgctgtgggtgcaagtgctgggggcgttggggcgcttgcgattgatgaaggtgtgaagtataaggaggaaaaggcggcagacagggtgggagaaaaagtggcttctgccgcaagggacgattacagcgagtatcgtcgagaagttttgattgggagttc

SEQ ID NO: 6570 - DNA, 436 bp, Triticum aestivum
  Clone ID: LIB3281-041-P1-K1-E9
cggacgcgtgggagctactagtagccgggagtgtagtgagagtagagtgagcgagaatgggtggcaaagccgctctcctggtggccctcctggccgtgagcctggtcctcgaggcccaggcgggcagcggctacggcggcggccacgcccccaccccgacgccggtcgccccaccccccaagcacgagaagccacccaagggccacaagccccctcaccaccaccaccacgccaagccaccgggcgtcttccacgggccgtcaacgcacgctccggcgccacccacctacagtcccccgacgcctaaacctaccccttcggcccccaaacctacaccacccacgtacgccccgatcccgaagcccgcgaagccatcttccttggctgcggggtaccaccccacgcccaaacctgcggcttccacgtattaaccacc

SEQ ID NO: 6571 - DNA, 255 bp, Triticum aestivum
  Clone ID: LIB3281-041-P1-K1-F1
acaagaatgggtggcaatgacgctctcctagatgccctcctcgtgcacaggagcgcacggacacgtggccaaggccgtgcgcaggtactgaggaacatcagcgcgcacaccgacgtgggcttcacggttcggactaccgtgttcctcccgagaagtcgacatgctcatccacgacgacaaggactccatcatcttcaacgtcggcacctacatgatgcccctccaggacatcgttcacccagtctgccaatattc

SEQ ID NO: 6572 - DNA, 406 bp, Triticum aestivum
  Clone ID: LIB3281-041-P1-K1-F10
cccatctgaatcgcaacacactccaactccgtggcctcaaagggtccgacttggcaagatacacgaccgccgcgcctcattatcgggaaggaaaagtgctttggagaaggccatgagaaattatacagatcgggtaaagcctacaatctctcgtgcggtgtctgtggacagtttttgttcataacccttggagtgtgtcccagatcggagatcgccagaggaggaagacggcggcgagtgtacctccacgttgcttcttcgtcctcaagccaagatggagagaaatctgctagcgacgcagaatctgaagttctggaggccatgccagacttctggccttccaactccgtggctgggaagggtggcttgggttacaagatcaagctgcaactgaactgcatgacca

SEQ ID NO: 6573 - DNA, 432 bp, Triticum aestivum
  Clone ID: LIB3281-041-P1-K1-F11
aagcaaaacaatctgaaggctatgtgaggccaaattttctgcctagaattacccttgcaaacatatgggagccagcaagcagagaagcttgtgacaacaatatttgggagataataaaagcttcttttggcattttatttgccaagtctactctccagcattcgaagaactgatcatactttattccgatgattctgctcaaagtaatgagaaggagagttctgagatgcagatgctgccgccgcagttgaaaatttacgagaaaatacccatcccagatctgccagtggttttccctcacaaaaagttgtcattccgcatccttgatacagtaaggcttgatatagccaccgttataggattgttggcatatgttgtcaactacaaatttgagagtttagcctcatctccggcagctttccttcttgatct

SEQ ID NO: 6574 - DNA, 274 bp, Triticum aestivum
  Clone ID: LIB3281-041-P1-K1-F12
aagcaaaacaatctgaaggctatgtgaggccaaattttctgcctagaattaggcttggaaacatatgggagccagcaagcaatgaagcttgtgacaacaatatttgggagataataaaagcttcttttggcatttaatgtgccaagtctactctccagcaatcgaagaactgatcatactttattccgatgattctgctcaaagtattgaaaaagagagttctgagatgcagatgctgccgccgcagttgaaaatttatgagaaaatactcatc

SEQ ID NO: 6575 - DNA, 318 bp, Triticum aestivum
  Clone ID: LIB3281-041-P1-K1-F2
cggacgcgtgggcgtccgtccgcgtccacaccggagctaggaggagaggagggggaagaagaaggcgtcgaggaggcgatggcgacggagtcgccgttccgggcggacgtgctgaagggcaaggcggcgctggtcaccggcggcggctccggcatctgcttcgagatcgccgcccagctcgcccgccacggcgcccacgtcgtcatcatgggccgccgccgcgaggtcctcgacaaggccgtcgccgccctccgctccgagggccttcgggctgttggatttcagggagatgtacgtaaccaggagggatgcacgaga

SEQ ID NO: 6576 - DNA, 230 bp, Triticum aestivum
  Clone ID: LIB3281-041-P1-K1-F3
ggtttattgttctcaaccaactgtcgagatggatgcttatctgctgcctagtatgttgaagaaattgtgaatctgtgacttcgtagcgatcatgaccgttgttgtagtgctcctgttatcctttggtgagaattatgttgcagtactgtctgtagacattagatgacctcctgttttcgatggatgaaagttgagatgtggaataatattggggagggagggttattgcc

SEQ ID NO: 6577 - DNA, 425 bp, Triticum aestivum
  unsure (1)...(425): unsure at all n locations
  Clone ID: LIB3281-041-P1-K1-F6
cccacgcgtccgcgcagatccacgcacaaccacctgaataatttacagatcccggagcggatttcgcacgggaacccgccgcagcccacccgccgcctcatcctcctcctcctcctcgtcgtcgtcctaggggccatggggaacagtatttacaagttcctgtgcggggtgtgctcggacctgtccgacgccgccttccagccgcatggcgcggacgcctncgtcgccgcgctcggccgcgacatcctcgagttccagcgcaccaagcaggtccccgagggcctcggccgccacgtcgtcttctccgccgccgcgcatgccaactggtacaagaagctgcaagtggcatggaagaaggcgaggccggccccgacgacgccggaggaagccggcccgcttggggtgctgacgctcaagaaccacca

(The sequence listing continues in the following parts.)

We claim:

1. A substantially purified nucleic acid molecule comprising a nucleic acid sequence, wherein said nucleic acid sequence:
   (a) hybridizes under high stringency conditions to the nucleic acid sequence of SEQ ID NO: 7979 or the complement thereof, or
   (b) exhibits a 90% or greater identity to the nucleic acid sequence of SEQ ID NO: 7979 or the complement thereof.

2. The substantially purified nucleic acid molecule of claim 1, wherein said nucleic acid molecule encodes a wheat protein or fragment thereof.

3. A substantially purified nucleic acid molecule comprising a nucleic acid sequence that shares between 100% and 90% sequence identity with the nucleic acid sequence of SEQ ID NO: 7979 or the complement thereof.

4. The substantially purified nucleic acid molecule of claim 3, wherein said nucleic acid sequence shares between 100% and 95% sequence identity with the nucleic acid sequence of SEQ ID NO: 7979 or the complement thereof.

5. The substantially purified nucleic acid molecule of claim 4, wherein said nucleic acid sequence shares between 100% and 98% sequence identity with the nucleic acid sequence of SEQ ID NO: 7979 or the complement thereof.

6. The substantially purified nucleic acid molecule of claim 5, wherein said nucleic acid sequence shares between 100% and 99% sequence identity with the nucleic acid sequence of SEQ ID NO: 7979 or the complement thereof.

7. The substantially purified nucleic acid molecule of claim 6, wherein said nucleic acid sequence shares 100% sequence identity with the nucleic acid sequence of SEQ ID NO: 7979 or the complement thereof.

8. A transformed plant having a nucleic acid molecule which comprises:
   (a) an exogenous promoter region which functions in a plant cell to cause the production of an mRNA molecule; which is linked to
   (b) a structural nucleic acid molecule, wherein said structural nucleic acid molecule comprises a nucleic acid sequence, wherein said nucleic acid sequence
      (i) hybridizes under high stringency conditions to the nucleic acid sequence of SEQ ID NO: 7979 or the complement thereof; or
      (ii) exhibits a 90% or greater identity to the nucleic acid sequence of SEQ ID NO: 7979 or the complement thereof, which is linked to
   (c) a 3' non-translated sequence that functions in said plant cell to cause the termination of transcription and the addition of polyadenylated ribonucleotides to said 3' end of said mRNA molecule.

9. The transformed plant according to claim 8, wherein said nucleic acid sequence is the complement of the nucleic acid sequence of SEQ ID NO: 7979.

10. The transformed plant according to claim 8, wherein said plant is selected from the group consisting of soybean, maize, cotton and wheat.

11. A transformed seed comprising a transformed plant cell comprising a nucleic acid molecule which comprises:
   (a) an exogenous promoter region which functions in said plant cell to cause the production of an mRNA molecule; which is linked to
   (b) a structural nucleic acid molecule, wherein said structural nucleic acid molecule comprises a nucleic acid sequence, wherein said nucleic acid sequence
      (i) hybridizes under high stringency conditions to the nucleic acid sequence of SEQ ID NO: 7979 or the complement thereof; or
      (ii) exhibits a 90% or greater identity to the nucleic acid sequence of SEQ ID NO: 7979 or the complement thereof, which is linked to
   (c) a 3' non-translated sequence that functions in said plant cell to cause the termination of transcription and the addition of polyadenylated ribonucleotides to said 3' end of said mRNA molecule.

12. The transformed seed according to claim 11, wherein said nucleic acid sequence is the complement of the nucleic acid sequence of SEQ ID NO: 7979.

13. The transformed seed according to claim 11, wherein said seed is selected from the group consisting of soybean, maize, cotton and wheat seed.

14. The transformed seed according to claim 11, wherein said exogenous promoter region functions in a seed cell.

15. The transformed seed according to claim 11, wherein said exogenous promoter region functions in a leaf cell.

16. A method of producing a genetically transformed plant, comprising the steps of:
   (a) inserting into the genome of a plant cell a recombinant, double-stranded DNA molecule comprising
      (i) a promoter which functions in plant cells to cause the production of an RNA sequence,
      (ii) a structural nucleic acid molecule, wherein said structural nucleic acid molecule comprises a nucleic acid sequence, wherein said nucleic acid sequence
         (A) hybridizes under high stringency conditions to the nucleic acid sequence of SEQ ID NO: 7979 or the complement thereof; or
         (B) exhibits a 90% or greater identity to the nucleic acid sequence of SEQ ID NO: 7979 or the complement thereof,
      which is linked to
      (iii) a 3' non-translated sequence which functions in plant cells to cause the addition of polyadenylated nucleotides to the 3' end of RNA sequence, (b) obtaining a transformed plant cell with said structural nucleic acid molecule that encodes one or more proteins, wherein said structural nucleic acid molecule is transcribed and results in expression of said protein(s); and (c) regenerating from said transformed plant cell a genetically transformed plant.

17. A method for reducing expression of a protein in a plant cell comprising growing a transformed plant cell containing a nucleic acid molecule wherein the non-transcribed strand of said nucleic acid molecule encodes a protein or fragment thereof, and wherein the transcribed strand of said nucleic acid molecule is complementary to a nucleic acid molecule comprising the nucleic acid sequence of SEQ ID NO: 7979 or the complement thereof, and whereby said transcribed strand reduces or depresses expression of said protein.

18. A method for increasing expression of a protein in a plant cell comprising growing a transformed plant cell containing a nucleic acid molecule that encodes a protein or fragment thereof, wherein said nucleic acid molecule comprises the nucleic acid sequence of SEQ ID NO: 7979 or the complement thereof, and whereby said nucleic acid molecule increases expression of said protein.

19. A method of producing a plant containing reduced levels of a protein comprising:
(a) transforming a plant cell with a nucleic acid molecule comprising the nucleic acid sequence of SEQ ID NO: 7979 or the complement thereof, wherein said nucleic acid molecule is transcribed and results in co-suppression of endogenous protein synthesis activity, and
(b) regenerating said plant comprising said plant cell and producing subsequent progeny from said plant.

20. A method of growing a transgenic plant comprising
(a) planting a transformed seed comprising the a nucleic acid sequence of SEQ ID NO: 7979 or the complement thereof, and
(b) growing a plant from said seed.

* * * * *